United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 14

SEQ ID NO: 55063 - DNA, 2112 bp, Glycine max
  Peptide Sequence Number=SeqID_171841
atgggtaagattctgagagaaaccgcgaggccgttctcgaattgttcgtcgtcgtcggcgtctccgttgtcggcgccgccggcaacgacgtcgtcgacgtcgttgacggacacggtgagggggtcgcaccggttcaagatcacggggtattcgctgtcgaaggggattgggattgggaagtacatagcttctgatatattctcggtgggagggtacgattgggcgatctatttttaccccgacgggaagagcgtggaggacaatgctacgtacgtttcgctcttcatcgcgcttgctagcgaagggaccgacgttagggcgctttttgagttgacgcttttggatcagagtgggaaggagagacacaaggtgcatagccattttgagaggaccctcgagagtggaccctacacgttaaaataccgtggtagcatgtggggttacaagcggttttttaagagaacagcactagagacatcagattaccttaaagatgattgccttagtgttaattgtagtgttggtgttgtgaagtcacacacagagggccctaaaatatataaaatcccaattccgtcttctaacatgggtcagcaatttgggaagctactagaaagtgggaaagacagtgatgtcagttttgaagtgaatggagaaattttcgctgctcataaattggttctagcagctcgctcacctgttttcagggctcaacttttcggtccgatgaaaaatcagaatacccattgtataaaagttgaagacatggaggctccagtctttaaggcattgcttcatgttatatattgggactcactacctgacatgcaagagcttactgggttgagctcaaaatgggctactaccttgatggctcagcatctgctagcagcagctgatcggtatggcttagagagacttaggctcatgtgtgaaacaagtctctgtgaagatgttgcaataaacaccgttgctacgactctagccttggcagaacagcaccattgtttccaactgaaagcagtctgtctgaaatttgttgcaaggcctgaaaatctcagagctgtgatgcaaactgatggttttgagtacttgaaggaaagttgcccatctgttttgactgagcttttggagtatgtggctagatttactgagcattcggacttcttgtgcaagcataggaatgaattgatacttgatggcagcgacgtaaatggaaggcgggcaacagatagcaatagcataccttcgttcatcttcacttcacgctctcttggagttttaaggagatgtgtcaaagaggaaaaggaagaggagcagcttctagaagggatgccaaaggagtactatgacgatgaatggcaagcccaacaacgtgagaagaccaaggagttgcatcggctacggatacaggaggaagaggaagaggaaagaaagattggagagtatcgtgaaattggcatgcggttgaaggaatacccagaagatgacgtcataaaagcaaggaaattggtttcgagctttctcagagctgctgaagaagtagaagagagaattgaggaagctgccgagaaaggagaactgactgaacttgttttaatggtcatatggaatcgccttgatcttgctcggcgtgatgaagaaaaggatgccattagaagtctggatctgttatacagaagggttgagactgagattttgaaacgagaggctacccctgcgatgagattgctcaatgatcttttgattatgtacgacggctataattttgaagagtggctaaagaaatgtaaaaaggtcatgattgatacgtttcctcgggaggatccattcagtatccttgttccaccaggatttgagtcattcgacatagataagcatcacgggccattgcgaccatcacttgaagtcgataatactcttttgagggtggactttgtaagagaggtggatgaattgctgcaagaggttcattctgaagagagtgaagtacagaatgaaccagggtttgatcctgaatctgttgcaaatagattgaaacaacaggagaagcaacaaacaatacgccaagtagaagctctgctggatttagccattggtttgaaatggtaa

SEQ ID NO: 55064 - DNA, 561 bp, Glycine max
  Peptide Sequence Number=SeqID_171842
atgggttgggataggcccatgcaagcctccataatctcaaaatttaggctaaagtgttcgagctccttcgtcatgggtcttctagccttcatgttctttgcagtccgacccgatcggacccgtggtgagctgggttggctcattaggtttgagctcagtttgacaggtctagttggtggccttgttttggtaactatggttgactcttcattcagtcgcaaaaacatgctcttcttttcatgcctcattgtgtccatatcttccttccttgccaccttctcagccaacgtttggatttactcagtgctcaaattcctcaatagatttggtcgtggtaatgttggaactgctgcacttgtgttggttgctgaacttttcactaaagggtggcgaggcaagcttagtgttgcggtgccaagatggttgtgcgtctgtgaagatagtaatgaatgtttgttgaccattagagaaccaagaaaaggagatgagaagagcatgaaggaattgggtccagttgagttgatatcctatgcacttgtctattttggggctaagagatga

SEQ ID NO: 55065 - DNA, 1608 bp, Glycine max
  Peptide Sequence Number=SeqID_171843
atggacaggatgagtatcaacgaagtagaagtcagaagtctttcctccacattggatattcattctacattgactgttcctttaaagagtcctgagaaagtgaaagtcaagccatcacaaaagaagaacaagaaagtagccagagagagggatctcttcaagaagaactacttacatgcatgtgagagccttctgtccctaatggttgacaagaggcgacaccggaaaacagcaattctctccctgaagaaatctggtcccgagcttcctgagctcctcacacaattttctgccagcattgccggtactggccttgctgtcctgctatctgtgatctgtaagctagcttgtggaaggggggttcccttttgtgcttataagctcctcaacactgggtttggatttgggctggtttggctttcttgggcagttaataagctaagggatacaattgtctgcatgaacaagaatgcaggaaagcttggactgaaagatgaggaaatgattcaaaaggtcgacaagagcctaagagaagtttacttcagagccgccgcattgctagcagtggcacacaagattgtggatgattggcttgatcagcacttgggtggtgtacttacggtatggttagtacctcatttcaataatcaaagcaaagaacatactcgtttgcttggtactagggcgatgattccttggggtggcctcagttgctgtttgagtgctgctgctctttaccttctcggcagaagcagtggcagggatgcggaaattcttaaatccgttacaagggtcaatcagctgaaggaactagctcaactgttagatgcagaaatattacccttgattgttacaatttctggaagagttagctctgaaaccccaattaactgcgagttcagtggtttaagaggtgtaatagttgaagaaacagcagagcaacattttcttaaacacaatgatgctggttcctggatacaagattccgctttgatgctatcaatgagtaaagaggttccttggtatctggatgatgggactgatcgtgtgcatgtggttggagctcgaggtgcttctggttttgcattacctgttggaattgaggcatttgaagagtcgggtcggtcacttgtacgtggaactttggattatctgcaaggtctcaagatgcttggagtcaagagaattgaacgggtacttccagttggaacttccttgactgttgttggtgaggctgctaaagatgatgttggcgctattcgaattcagcgaccccacaaagggccattttatgtctctcccaaaacaattgatcaactaattgcaaatctggggaaatgggcaaggtggtataagtatgcttctgtgggcttgacggtgtttggtgcttatctgatagccaagcatgctattcggtacatattggaaagacggcgccgcagcgaacttcaaagaagggttcttgctgcagctgctaagaagtcgggacaaaataatgatgttgaaaaggccgacagcttatcagatggtgctaaaaaggatcgcttaatgccagatttgtgtgtaatatgccttgagcaggaatataatgctgtttttgttccgtaa

SEQ ID NO: 55066 - DNA, 161 bp, Glycine max
  Peptide Sequence Number=SeqID_171844
atggatgagagagaaagaggcagcaatgactacttaaacaactacttcttaccggagcatcacccatcaagtcgaacgtattctcctgaacagtatgatgtggcccttgtccaagaatatgcaaggaatttaaaggatttgcacgcacttgggacaaggag

SEQ ID NO: 55067 - DNA, 1504 bp, Glycine max
  Peptide Sequence Number=SeqID_171845
atgaattgtggctttattttgaagcttttgtactccctcttggcatttttttggttcccttctttctgcaatcctgctgatgtggaagcatttactgaggagaaaaaacagtctattcttggaaaacatcatgggaagggtgctgaatttggtcgtgctgttaaggagataattgaagtttttgagaaattaaaaaaagagactcagcttgatgaaactggctctggtggtgatgttgctaatgcagatgtttcaaatcctgttaactcatctgccaagtatcagacgaatgctcctgagttggcacacacattaccaatgaattctttaaattctattatcaacaaacatgaggtggtatgtgcagctgaggatgactcagccactgtacttaaagatgaatctcataataaggaggcattgttagggaagcctgctgataagatggctgtggtaaaatctcccaagccagttacttactcttctcgaaaaagatctatgggtgacttgtgtctgcagggctgtgtaacacatagacatacctcagtacggaggtctagaaattcatcacgtgctcaaaactgtgtgttgccttgtaatgatagtggaaagagtgctggtaacccatcaaccactgcagctcagagtgtatgtgcacaaaggaatagaaatgtcaggaaatcacctgatctttctggctgtgataattttgagtcatccacttttgtctcgaatggtagcattgatgacaacagttctgaaattatcacaactgattctgatacatttagcttgaatgagggtagtacaatggattcaaattttaaacttgaactatctgaagctattgaatgtccagaagttgagttgaacaaagggcttaatcttgaaataaaacctgtagttaataagaaaaaaagaaaacccaatagaaagagggcagctaatgatgcttctaagccaatcagtaggccagaggaagagactggtgtgcagaatgccagtcaaagctcacaaaatatgtgtggaaattcaaaagaaagatgctttgaacaagatggagatgaacacttgccccttgtgaaacgagcaagagtcaggatgggtaaatcatccgttgaggcagaacttcatagcactctccaatgtctagaaaaaaattgtaaggaaaatactaactccgtgcagcagatgatcacaccctcaaattgtgagaataatagccctgctgatggagactcatctgtgctgaatggagctttagatgatgtttctccaaaaatttcagttccatgttccaacactcagatttgtaatactaagaaagatcaaaccttcagctctgtggatgttgaagctgctttacctccatctaaacgcctccatcgtgctttagaagccatgtcagctaatgctgctgaaggtcaagcccatttggaagcatcatcctccatgatctcatcaagtggcatgtgctgtatatctgatgtcaagagatgtccga

SEQ ID NO: 55068 - DNA, 2403 bp, Glycine max
  Peptide Sequence Number=SeqID_171846
atgatttttacagagaataaatcacctatccaagtgggtaagcaattgaccatgatacaacatgaaagtgacaaggatgttctcccaggtgctacagatcaagttggtgaagagcttagtgatcatacgatttgtcagacagctaaagtagatttaaaaattcagtcaaatggacaaatttcttctaatcttggttcaaaatgttgttatgttggaagcattcaagattcaccagatccatcattaccagcaaatagtgaagacaacattagaactgtgaatgattccaatacagcatctgatgcatcagaacataatggaataagccttgaccctgtaatttgtgtggacaaaaatgatgccttttcacctcataatgtcgatgtgcttcagaatgagggtgctgtatgtgaggatgcagagtgcttgaagccagctgttgttgagattggcacctcaaatgatatgcgtgatattgtgaaagaggtaaaatgtaaaggtccagagcaggatatgaattctgtctcaacatctgatgactgtttgggtgaaaagggaattttggacattcggtcaagtccatccttgtcagacgggggagattgcgttccacaaagttcgcctcctactacgtctgtttgcaatgtttcgacatcagacagtagtaatatccttcacaatggaagttgtagccctgatgtacatttacaccagaaacaaattgtatgtggtcctgtcgatggtagtaaagatggggatgtggcaattcaacaatcaatatgtatgggtaagtcaactgaagcaggacgtgctgctttgttgtactttgaagcgatgcttgggacattgacaaggacaaaggaaagtattggtcgagcaacacgcatagctattgactgtgcaaagtttggtattgcagataaggcgatgtatgtggagtatattcatttgctatccaagctgtccttccacgactattatctgctgctgctcctcctggaaatactggccaagaaaaccgtaggcagtgtctcaaggcaagttttaaggctgtggttggagagaagaatcctaccagaatccattattcggcgacatatccgggaactggatttatatagcagttcaggtggtatctacttgcggcgatctatgagaacagagagggctttggatgaccctgttagagaaatggagggcatgcttgttgatgaatatggaagcaactcaacttttcagctgcctggattctgcatgccccaaatgcttaaagatgaagatgatggtgaagggagtgattctgatggcgggaactttgaggctgtcacaccggagcatacttctgaaatatatgaaataacttctgcaattgaaaagcacagacatatcttggaagatgttgatggtgaacttgaaatggaagatgtggctccctccaatgaagttgaaatgaattcaatttgtaatgttgatagagaaaatgctaagcagtgtgagaagaatctgcctctgttctttgctcctctacatcaggatatgcggtcatcttccccacccccactatcattccttcctcctccacccccaccttctattccacaccacatgccatctacctctgatccatataacaccgtagttaattcaaaaggttgtactgtttcacagcaccaagtagcaaataactcatggtttactttgtccttcctttctactcgagctcatttgcagactctgaaagaaaaccaccacccacttcactctgtggctcagctcatggctgcaccaaggcatagccaacctatctgtgatgcagtgcaccatcaagtccctgaatacagagaaatgcagatgcacatgccagaatctacttgctctttcaacagttttcctgtaccacctccagagaattttcgacatactgatggtgttactacacataataaaggatactctatacgaccacctcaacatgtgccttgcaatcagttttcttttgttaatggggaacagcatgtgaaacatcgaagggaggttccaccaccccttccttactccagtagacaacactttgtgcagaacatagagagagagaacttctataataatcatgagagattaagaccacctccttatgattaccaagagagatggaatggtcctgcaccttatcccggtccttggtatcaggaaaaaggtgtgcctcccccttatggttgtcatccatgtgaatcaagtagaattccagatcatgggtggagatttcctcctcagtctatgaatcagaggaactcaatgccatttagaccaccatttgaagatgcaattccagtttcaaacagaggtgctttccctcttaccccacattttttcttctattgtgagaagtttttagttggatga

SEQ ID NO: 55069 - DNA, 210 bp, Glycine max
  Peptide Sequence Number=SeqID_171847
atgacaatgccaagaacaagaaaacctattcaagtttcgagtttgttccccacgcgaaaaatcagaaaagagtgttgcacgtgggccgggtcccgtgacagaaagctcatagccagagacacacgtgtgccggcaatgataagcgcaaggcatgtcaggtcgacaacaacaacgacttggttctgctttgagccaacacagtacacgtga

SEQ ID NO: 55070 - DNA, 960 bp, Glycine max
  Peptide Sequence Number=SeqID_171848
atgaggcaaattgagaaagagaaaatagtggttgtaatgggagccactggagcagggaagtcaaggctatccattgacctagccacatgttttccatcagaaatcataaactccgacaaaatccaagtctacgaaggcctcgacatagttacaaacaaaatctccaaggaagaccaacgcggtgttccgcaccacttactaggaataataaaccccaacatggatttcagcgccaacgatttctgtgacacgtcatcagaaattattgcctcgatcacgagaagcgaacgccttccaatcatcgttggaggctccaactcgtatctcgaggccctgatcgatgacgatgattacaagtgtcgctcgcggttcgattttctgtgtctctgggttgacgtggcaatgccagatctgcaatcctacgtggcggagcgtgtcgacgacatgttgtataacggaatggtggatgagctgagaccgttttatagtcccaacggggattactcgcgaggggtaagaagggcaattggggtgccagagttcgacgagtattttcggagggaagaagaggttgttgacgaggaaacgaggacgaggttgttggaagaagcggttaaggaaatgaaactgaacacgtgcaagctagccatgaaacagttggggaagattcgtaggctgaggaacgttaagagatgggagattcatcgattggatgccacgcccgtgtttcggaggcgtggtgaagaagcgaacgaggcgtggaagaagctggtggcagagcctagtgctatgatcgttgctcgctttctctataatagtaactccaaaaataatgctactaacgttgtttctggttctgggcttcgagtgaaaccagctacttcatcagagactgttctggctgcggcaacgtggctagctagttttttaggtgtcgttttggtggggaaggacttgtaa

SEQ ID NO: 55071 - DNA, 384 bp, Glycine max
  Peptide Sequence Number=SeqID_171849
atgggagaggtgttccaaacaagttcggcagcagaggacaaggctttacataatttggagatgcactgtgttactcttgtgctggcacgagtaaagaaattgtctattattatgtgcaactgtttggaagtcaatgaattggcaatagttccttaccaacccatgactagggatcgcgtaccacttacgattcactatataggccaaaatgcgaatgctcaaagacttcaaagttctctaatgagtcttcaagtgggatgcaaaaattactgtctgttagaaaatttacccttaagtgagaaggcagaagggtttgagttattcctaggttgtttgagggcagttcaccttgtgttgcttggtttctggtctcaggcgacttga

SEQ ID NO: 55072 - DNA, 312 bp, Glycine max
  Peptide Sequence Number=SeqID_171850
atgatagatggaatgatcaatagtgtgaatgggaacgaagaagggataagatggaacggaggagttgacttggactttttagcaacgtcttatccagataacaaacacaaatcggttagacttgcacaagtgggtgctaaaggtcgatgggttaacaaagctatatggcaagatgttaaagctgaggagagggttgtgacagctgaggcaacttatcttcaagtatgttcagtctatcaagaagtgcatgacatttctagagcatcgatcattcatgcttttgtacatatgcatcatgacactaattattaa

SEQ ID NO: 55073 - DNA, 237 bp, Glycine max
  Peptide Sequence Number=SeqID_171851
atggctgtacaggcgaacgacgtgaagggatcctggttttgtgagctgctaagcactagcagtaagatctattcagaaaacttgggtgatgtgaatgaacgttgtggaataattgatgacccaattgtacctacaaaacgtcgtgataaaccaaataagatcttgatcatgggtctgaaacaacccgagattctgatggatccaaaccaccaattcaaaaagaaatattcggattga

SEQ ID NO: 55074 - DNA, 1602 bp, Glycine max
  Peptide Sequence Number=SeqID_171852
atgtactatgttgatcccaggctactgagggctgtagctattgaacacccaaaggatgctgatctagcagctggaatagttcttgcggaagtcatcccgttcatgtccaaaaaactacctgctgcaattcctccacagcacaatgaccatggagccccactagatgttgaagttgaaagtgaggaagaaggcaataggttgaggcactgtcagcgtgttgatgacgtaaatgtggggccttcctctactttgtcaaatggctgtaattcaaaagatgatactgaaaaatttcttggaatggatgatattaaggagctagatatttttcagaatgctgaagataacttcattggggaaaccttgaacgagattgctcaggagatgtcaaatggctttattcaggaggaagataatgaaaattttgagagacaacctgtggattttgattgtgaaaatttgatatcttcagctgatgattatgatgtcaccccaagtcacagattggaagaatgcgaaacttacttgattgagttagaaagttctgaagctcaagaagtttgtcatgttcaaggcgatacattaaattctaaagatagtcttcaatcagaattggatgctggttcttctactgctggtggcaatactagtgatgttgaaaatgataatggtgcaaagagtgcaggtagccaatatagtcaagtatccaggattgatctgcttgaggaaatcattgatgaggcaaaaaccaacaagaaaacgttgttttcatcaatggaatctcttatcaacttaatgagagaagtggaagttcaggagaaagctgcagagcaggctaatatggaagctgctactggagggtctaatattctggccaggatagaagaatacaaaacaatgctggtgcaagctaaagaagcaaatgacatgcatgcaggagaagtttatggggaaaaagcaattcttgcaactgaactgaaggaacttcaatcacgcttgctcggcttgtctgatgaaagggacaagtctcttgcaattcttgatgagatgcgccacattcttgaagaacgactagctgcagcagaagaatcaaggaaagcagctgagcaacaaaagctggaaaaggaggaatctgcacgaaaggctcttgttgaacaggagagactggtggagatggtagtacatgaatcacaaagactacagcaggaggcagaagagaattcaaagttacaggaattcctaattgatcgtgggcgggttgttgatatgttgcaaggggaaatctctgttatttgtcaggatattaagcttctaaaagagaaatttgatgctaatcttccgttgagtaaatccttcacctcaagccagactagttgcaagttagcttcatcaggttcttcccacaaaacattggcatctgatgcgggttctgaccatagtgagtcatctggaatacgtaagacaagctggacaacctcaattgaaagcctttcttccaagattgggcatgacgaggaaaaatccaaagctgatcacaatgctcttcttgatgatgggtgggatatttttgagaaagatgcagaactgaattccggagtttgctga

SEQ ID NO: 55075 - DNA, 537 bp, Glycine max
  Peptide Sequence Number=SeqID_171853
atggttcttcacagagaactcgatcatctcttttcatcccctttcgttgaccctcccaaagatgatgcgaaatccagtggcatgtcaattgaaaagaagattgagttcctcgagagtttgactggaaaggtcacaaatcggaggtctcggaggtggttaaatgatcgtctcttgatggaactagtaccacgtttaaatgcagaggaaattagaggcttgtttgctccaccaccttggggtgatgaagttccaccttcaacattttccatgacgaacatggaggagtgggacagattcaggaatattgacatggataaagagggcttaagagcctggtactgcaaccatgatatcataccattggttaatataatccattccctggaaaactctatagaaaagaggaaaggtcacattgatgctgacaagatggcagtgttgaatggttggcatagaatcgattgtagaacaagagatgcgcttcgccgtagttgtctttctgagctcattgagggttatgaggtatacatctgttga

SEQ ID NO: 55076 - DNA, 426 bp, Glycine max
  Peptide Sequence Number=SeqID_171854
atgaagagagtcaagattttcattttaataactctagctctgacatttgtggcatttgtgccaaagatagagagccagatcatgccaccacttattccttttccaccaccatctcttcatccactttgtttatcccaactagcactagtaagctatgcttgtgcaatgttgcctccaaccacaacactaccaccttcaccactcacaccaccaccctctccttcatcccctggtgatgatgagggacacgggaatgaccaaagccagggtcaccaccaaacttctcaagaagaaaactgttgccgtactcaatcagcattggagaatcgtgtaatgtcacttactcgtgcggttgaagttatggttatcgtttctgattcgttgtgccatcgggtgttagaaacaaagtgtgccgtagcactctaa

SEQ ID NO: 55077 - DNA, 382 bp, Glycine max
  Peptide Sequence Number=SeqID_171855
atggagcaatccaaaattacttttccacggaatttcgaattcaaaccaaattgctccaaatgtaaaaagatagtgaagaccgtgttctcaacaatgatgggaagtgttacctccgtcaaggttgaaggtgaaggagatgttggggtaaaactgactgtgacgagtacaatgagtcctgatgtgtttgctgccataattgcaaatattacgaaagaaaattcgcataaaatcacgagtactactagtcctgatatgcagcttgatgcaatacttggaaaaaccgcgaaggaaaattcacataaagacaaggcacaagcatcaaatgcaaaccaggaagagaacaataatattgaggtgtcatatggtcagaacaaattcaaag

SEQ ID NO: 55078 - DNA, 107 bp, Glycine max
  Peptide Sequence Number=SeqID_171856
atggagagtgcatccattgttatgtattgtaatggtgacatgattccatcatacaaagggacacactctaccactaagctaatagtgagaacatgtcgtttgatgcc

SEQ ID NO: 55079 - DNA, 1755 bp, Glycine max
  Peptide Sequence Number=SeqID_171857
atggccagggatcagttgcaagtgcttaatgcactcgatgttgccaagacacaatggtaccatttcacagcaattgtgattgctggaatgggtttcttcactgatgcatatgatcttttttgcatctcccttgtcaccaaattgcttggccgcatatactactttgaaggccacgacaagccaggctctctgccatcaaatgtttctgctgccatcaatggtgttgcattctgtggaacccttgcaggccagcttttctttggctggcttggtgataaaatgggaaggaaacgtgtctacggaatgacccttatgctcatggtgatatgctcaattgcttctggtctttcttttggcaaagaccctaaagctgttatggccaccctttgcttcttccgtttctggcttggatttggcattggtggtgactaccctctttcggccactatcatgtctgagtatgccaacaagaagactcgtggagcattcatagctgctgtttttgcaatgcaaggttttggaattttggctggtggcacggttgcaattgttgtttcatctgctttcaaggccttgtaccctgctccagcattccaggttaacccagttttgtccacagtgccacaagctgattatgtttggaggataatcttgatgtttggtgcactcccagctctgctcacatactattggcgtatgaaaatgcctgagactgcaagatacactgccttggttgccaagaatgccaagcaggcagctgcagatatgtcaaaggtgctgcaagttgagatagaagctgaacaggagaaagttgagcaattggacacaagaaaagggaatgaatttggattgttcacaaaacagttccttcgccgccatggacttcaccttcttggaacagccgttacttggttcctgttggacattgcctattatagtcagaatcttttccagaaagacatcttcagtacaattggttggattcctgaagcaaaaaccatgaatgccattgaagaggttttcaaaattgctagagcacagaccctcatagccctttgcagtactgtacctggttactggttcacagtggcactcattgataagatgggaaggtttacaattcaattgatgggatttttcttcatgacagtgttcatgtttgccttggctattccataccaccactggaccatgaagggcaaccaaattgggtttgttgtgctgtactcattgaccttcttctttgccaattttggtccaaatgccacaacattcgtggtgccggcagagattttcccagcaaggctaaggtctacatgccatggtatatcggctgcagcagggaaagctggggcaatggtaggggcttttggctacctgtatactcaaaatgccattggactgagaaatacacttatagttttgggagtggttaacttcttggggctgctgtttacattcttggtgcctgaatctaaaggaaaatccctggaggagatgtctggtgaggctgaagaagagactactgctgctacaagagaatcagcaatggaggctggtcttgaagttagtgtatttttgctggtgcttactttctcgtttgctttgtataattgctttagaataaagcagagtggccccatcgttgatttttattcgtttaaggttgctatcaaagagctcgaagacaaagcacagttaacgacattgcggttgaagccaaaactgtcatactcccatttctgttccttataa

SEQ ID NO: 55080 - DNA, 1257 bp, Glycine max
  Peptide Sequence Number=SeqID_171858
atgccgaaaaaggagaatccatcttctatgagggacttaaggcctatatcgttgtgcaatgtcttgtacaaaatcctctcaaaagtctttgcaaacagattgataccattgttgcacaagtgtatttctcaggaacaatcggcctttgtggagaatagctccattcttgacaacgccttggtgggtatggagactatccaccatatgaagtgtaaatcgaaaggtaagaggggggaggtggtgcttaaagtggatatgagcaaggcgtttgatagggtggaatggggctatttgaaaggtatcatgttgaagttggggttatgccagcaatgggtgaattgggtgactatgtttatcttccccaatcagtggacagaggcaaaaggggatatccatgggatccaagtgtgtaaaagggttcctattataactcacttgctcttcgctaacgactacatcttgttcttcagggctgaggaaaaagagggtaagtgcttgaaggagattttggaggtttatgagaaaacatccgatcaggttgttaacttggctaagtcagagttgtatttcagtaagaatacctcttctgttattagagataggctggttgttgttcttggtgtctcgaagtatttgggaacggggaggtatcttggtcttccctcaatgattgggaggaaaaagaaggcaatgtttaattacttaaaggactgcatttggaagaaggttcagagttggtcaggagatgcagagaatgatcaactcgttctggtgggtacgaatagaatcaatgggagaggaattaactgggacaaactagcagttcgcaactattggacaatagctgggttgtgggatgatattcaggaattgatggataatgcggatggatttgttgatttttttttgcttgcttatctaacatcctggttgtgtggttatggtctctctagcggaggagaaacaatatggtttgggaaggaaaagatatccttgcacagttgctggttgacaaagccaacaatgtcctctccgagtggaattctactatcagaaaaaatttgcagctgcaaaatagaattgtggagacaagttgcgttggtagaaaccataaaaggggagttcaagtacaatatcgatgcaactgtgaattcggatcagcagaggtatggcatgggtaattgtgttaggaatgataaaggtgagtttgtttttggcaaaaaccttctgggctctgggttgcattcagtcgattga

SEQ ID NO: 55081 - DNA, 896 bp, Glycine max
  Peptide Sequence Number=SeqID_171859
acaacacgtgcggcgtaatccccgacaacaccgtcaccggcaccgccaccagcggcgagctcgcggaagacgttgtttcactccaatccaccaacggcttcaaccctaagcaaaacgccaccgtttcacgatttctattcgcctgcgccccaaccttcttactccaaggcctcgcaaccgatgtcagcggcatggccggtctcggcagaactaaaatcgctctcccctcgcagttcgcttccgctttcagcttccgtagaaaattcgccgtctgcctctcgtcttcaaacggcgtcgctttcttcggtgacggaccttacgttcttctccccaacgtcgatgcttctcagctactcaccttcacgccgttgttactaaaccccgttagcaccgcttccgctttcgccctgggagaaccctccgccgagtatttcatcggcgtgaaatcgattaaaatcgatgaaaaatctgtgcgcgttaacactactctgttgtccataaacagcagcggcgttggcggaaccaagatcagttccgttaacccttacactgttttggaggcttcgatcttcaaagcggtgactgaggcttttgtaaaagcttctgctgctaggaacataacgagggtggcttctgtggcgccatttgaggtgtgcttcagcagtgagaacgtggtcgccacgcgtttgggggcggcggtgcctaccattgagcttgtgctgcagaatcagaagacggtttggaggatatatatttggagcaaactcgatgcgcttcggtcaatgttgaccacaccgatggaagatacgtcacttatgacttcatcggagtcaattcaaccttacccaaccccaacttggcatgacttcatcgccatagctccaacacctcactag

SEQ ID NO: 55082 - DNA, 339 bp, Glycine max
  Peptide Sequence Number=SeqID_171860
atggactgccccctatggatgctctggagcatagagtgcaacatttgtggagtcaaaataaaatctgctggacttgcagagagaggatctggaagtggaatctgtgaaggtgctagaggaatcactgggatctttgtggaggaagagggaggaagtgtagaagaagaaggacctcctgtctctggtgctgaagtggaaaaggcctcagatctctttcttctagccttcctgggtcctctgaaagttactattggatcatcaagattccaacagttcttcttaatgtatgccaaattaatggcaagacttaagctctccaaggatctcgagtcagactga

SEQ ID NO: 55083 - DNA, 246 bp, Glycine max
  Peptide Sequence Number=SeqID_171861
atggaggagtttgatgctcagatgacctggccaggagaccagctttcttcttctggagggggtagggcctccatagcccaagagcctatgactgaggagccaccagcaccagcaccagcagaggagcaggctactctagatcagaccccacaaccatctccatcctctgcacatgctcctaaggagactcattcatcagcattggatcttaatgaagaccagccacaggaggagcatgacatttaa

SEQ ID NO: 55084 - DNA, 216 bp, Glycine max
  Peptide Sequence Number=SeqID_171862
atgtttgttatcacattcaatacttcatcatatgcgtacaacctgccaccattgagctattattatcgttcatcattacctactcaaatgtatgacatgggttatgaggatgaggaggaagatgatgataacaacaataataaggatgatgatgatgatgataatgataatggtcatgatggtgatattcatgatcatcaacaacaacaacaataa

SEQ ID NO: 55085 - DNA, 303 bp, Glycine max
  Peptide Sequence Number=SeqID_171863
atgaggttcatgagaaccctagggctttcttcaacagctctagtgcaatcctcttggagcctcttgttcatggctctggtgactggttccatcctagggaggattacatcactatttatcggagctcttctattgtacctctatgcaagtttgatagcattgtgtcccgacgtccttcagcacaaggttcctttaagcacttcacctagccatctgctcccccgaacacaaggttcaagatcatcacaggatccaaacacaaacagcaaaccgggagtgagttatcacattcctaactactag

SEQ ID NO: 55086 - DNA, 394 bp, Glycine max
  Peptide Sequence Number=SeqID_171864
acaaagaccataagaagatgggtattccttcagaaattgcagcagttggggttgttttgttgtggctgtggagtgttgccgtggacagtgttcccaacaccaacatcactgtcattctgtgcaacgttggggcgtacagctcaggtgatccttttgctgtgagtttatcctatgttgttggagaattggagacagagactccaaccaggaaaaactacgattactacaacatttctccttatcctaatgcatttgcctatggacatgctgcttgcaacattaatctgactgccactgactgcaaaacctgtctcggtgttgctaaaacatccgtgttcaacgggtgtccgaagcgtgtaggagctcgttcggtgctgcatgattgcacaatcag

SEQ ID NO: 55087 - DNA, 228 bp, Glycine max
  Peptide Sequence Number=SeqID_171865
atgaaggttgataagaagtggttagtgccaaaaagacagaggaaaaacactaagtttaaacctaaaaatgccaactataacatgagccaaggtgataatcaagagagacaacagaaaacgtcgaggaaaatcgaatttaacgattcccgtgagagtattcgattgaaaatgcgagaaactagccgcgaaatgaagaaccttgacatggtgcgtacctttcgaaagtga

SEQ ID NO: 55088 - DNA, 874 bp, Glycine max
  Peptide Sequence Number=SeqID_171866
tgaagtgatgagccaagacctcaagcgagactacgtcgtttcggaggagatcggccggggaagattcggcaccgttttccgctgctcctccgcagactccggtcactcctacgccgtcaaatccatcgacaaggtggcaataaccgccgccggagactccctcgacgcgcaatgcctattgacggagcccaagatcgttcagcttctctcccctcaccctcacatcgtaaacctccacgatctctacgaagacgaaaccaaccttcacatggttctcgacctctgttacgaatcgcagtttcaccaccgcgtcatgtccgaaccagaagccgcttcggtgatgtggcaactcatgcaagccgtggcgcactgccaccgcctcggcgtcgcgcaccgagacgtgaaacccgataacattctcttcgatgaggagaatcggctcaaattagccgatttcggctcggctgacacttttaaggagggcgagccgatgagcggggtggttgggacgccgcattacgtggcgccggaggtcctcgccggaagggattacaacgagaaggtcgacgtgtggagcgccggcgtcgttttgtatcaaatgttggcagggtttctgccgtttcgaggcgattctcccgtggagattttcgaggccgtgcttcgcgccaatttgaggtttccgactcgtgttttttgctccgtctcacccgcggccaaggatcttcttcgtaggatgctgtgtaaagagggcacccatggtttagcgttgctgaacagagtgagtaatcttatgtgcgtggaggttgaagaaaaccccctttttcccctttggcttgaggattcggcagagtatagagtacagaggagtgtgtaa

SEQ ID NO: 55089 - DNA, 765 bp, Glycine max
  Peptide Sequence Number=SeqID_171867
atggaatcaacgcatgtaatatccattttgaatggagaagagaatgttgttccaaggaagaatgataacacattccaattttcacttccacccgttttttcccgtcttagagaaaacaaagtaatccatcagttctctctttgccccatcacttcctatctgaggcaaaagaaagacactaaaaaaattatccacagcatcaaagttggaatctcccttgtattgatttcacttctgtacttcgtggatcctctctatgagcaagttggagataatgctatatgggctatcatgactgttgtggtcacctttgaatttttcgcaggagctacgctaggaaaaggtttaaatcgtggaattggaactgtattaggaggtggactgggttgcatagccgcagttttggcgcaaaacgttggtaatggtggagttgccaacttgattatcattggtacttttgtatttatctttggaacatttgcgacatattgccgcctattccctagtgtgaagaagaggtacaattacggagtgatgatctttatcctcacttttaatttggttgtggtgtctggtgtgcgcattcaagatcagaaagtttgggaaatagcacgtgaacgtcttttaacaattgtcatggatttcgttgtgtgcatttgtgttagcttgttggttttcccctactgggccagcgatgaacttcatgattctactgtctatagatttcaacaccttgccaatgcattacaagtaattgtgacatga

SEQ ID NO: 55090 - DNA, 474 bp, Glycine max
  Peptide Sequence Number=SeqID_171868
atggcacccaagaagtatgaaacgacaaggattctaggcatcaagaatgaaggtgatgccaataaggagataacccagaacattgtgaacaagttgctatatgatggtttccaacctattgcgtctaataagcaggttgtaaacaagtttctaagagactatgtgagcaacaaagacaaattttacatctacaatgtgattgtggaaaagaaggtcaacttgcgtgaagtgatcttctactattggttgcaagcattcaaggaccgcttcaaccaaaagaagaataggaaacttgtcccttactacatgttattttctcaaatcatgagggatgttagggtagatgtatttggatttgcacggtctgaagattcaactcagttgattaggtcaagctttgcaaagatggtgggaactttagaccagccaatggatcttaagtctgcagctacgtctcaacaggcgcaagagtag

SEQ ID NO: 55091 - DNA, 372 bp, Glycine max
  Peptide Sequence Number=SeqID_171869
atgggaagggaaaacagtgaaggtgactcacaattcacaggatatgctattagactcaatggatacttcagctacaacaatttagtggacactttcagagctcctaaagaatccacgggtgatgaagaaagtccaaatggagttggaaactattgtgggtatgtagaggaaggtgaaggaatcagacttggacaagttggagtatttggatatggttataaaggaaaacatgaggctccatctagtggcaccgttactaatgccacaccaatcgagggaagattgcatggttggagattttttcataccaagaaaatcaagggtgatagtaaatgcatgggcaattatgagagactcaagtgcatggagtga

SEQ ID NO: 55092 - DNA, 351 bp, Glycine max
  Peptide Sequence Number=SeqID_171870
atgtctcttgccaccttgtttggcaaattgcaggaacatgaaatggaacttcaatgtctcaacaaaaatgaagagactgacaaaaggaaaagaagcatagcactcaaagcttcctcctcaatgcaagaagaaaaagaagaagaagaatctgatgatgaaaaggacttctcactctttgtgaagaagtttcataaatttgtcaaaaagaaaaagtcagacttctaccttcaaagatctagacacttgaatcatgaaaaagaattcattcagcacttagttttcctaaaaagctctctggtaatcgattactacaatactgtaatcgattacagcaagtcaggaagagtgtaa

SEQ ID NO: 55093 - DNA, 807 bp, Glycine max
  Peptide Sequence Number=SeqID_171871
atgcccatcctttcttcgggtgataaaaatcttaatcaacctctttacgctttagggattacaggcgtttttaccagagatctggataccgcattattaaatgatgaaatagatattgctgtacactctctgaaagatgtccctacaaaacttccccaacatacagaacttatcgcatatctggaaagagattatccgcaggatgttttaataagaaaagaatcagcaaaaaataaagagtttcatgaacttaagttagcaacaagcagcttgagaagaagagcgttttggctgaaatattatccggaagcaactttctccgatattcgtggaaatatacagacacgccttcaaaaattggaagaacaggattttgatgccactatattatctttagcaggcatcaaaagaatgaaaatggacattgattacgagatgcttcctttaatgatcccagcgccttctcagggagttatcgcagttgccggacattcggataaaaaagaaatcaatgaaatagtacgtcagattaatcataaacccacacaaatctgcgttgagattgaaagaaatttccttagtacccttgaaggaggatgtactgcacccatcggagcctttgctgaaatatttgatgaccagatccgctttaaagcagcactttgctcactggacggaaaaaactgcatcgcgacggacgaaaatttcacatataatgacagtgaaaatttcggagaaaaatatgcaaaaatagtactcgaaaatggtggcaaggaattaatggccgaaataaagagccagatataa

SEQ ID NO: 55094 - DNA, 454 bp, Glycine max
  Peptide Sequence Number=SeqID_171872
ggacttcaagggcatcaatctcgtcaatcaagacgaccctatggttgtctccatcatcatagcaaacttcatggtgtctagggtcttaatcgaccagggagcttcgctgatatcctgtattgggaaaccttccaaagactcgaggtctcacccgacactgtccaccctcacgctgggtaagctctccaatagcttcaccatcagatatctaatggttgacgcaaacaaatcatactttgccttaatcggtagtaagacccttaatgagcttggagccatcgtcttcaccctctatctgacaatgaaattccctacaataataggggagattgtaaccatcaacgctgaccaaaagcaagcacgacaatgctatgcagagagcttgaaggtagcaccatatcctcccatccaggagctcaccatacttcaccccatagcggctgaaggcacttaa

SEQ ID NO: 55095 - DNA, 673 bp, Glycine max
  Peptide Sequence Number=SeqID_171873
atggcggaagaagaatttggactacctacagtcaatttgtatgcatctcattgtgatccacctaaacagaagaaaagtcaaggaaatgagaaaaagacagaagacgacaatattactcaagggccatcaaaacgaagaaagcaatttagggttggagatgatggtaaaatattatttgatgaagaagagctcaaaatgatcctagattttaagagaggtgaggactatattgaggttctttgtggcgcttcaaacaaaaaatatggagattatgttgggaggctaaaaattaataacgaaggtcaatatttcatcacttgtgagtgttgccctaagtgtcccttggtgagtgtcactctagaagcatttgagaaacatgctttaagggaagggagcggaaggtggaagagaaacatttgggttcattgtgtagatgaagacaaagttccactctggaaaacacctctgataaagtattacacacaccaggcaaatgtggctaaccggaaagactctgcaatgaggaaacaaaactttcacagggatgagttcctgcgttgcacgagatgcgggaaggagcgcaggttccatctcaagagcagaccagacattaagaactaccatgatgctttaaacaacaaatgctggactgttctctttggccgtatcaaaa

SEQ ID NO: 55096 - DNA, 261 bp, Glycine max
  Peptide Sequence Number=SeqID_171874
atgactaagacaatgatgaagattaacaaaaaaatagaggaaatgttcaacacagttcatattatggatcaggatgtgtcgagtaccatgtactcatttatgaaagctccaggattaacccatctgaatttggaagggattacggagtacaagattgtttataatcaatggaggaagactgcaaaaattggaaatggatggacgacttttgcacaatcacaaaatttgcaagctggaactcaaattatatttgagttctga

SEQ ID NO: 55097 - DNA, 390 bp, Glycine max
  Peptide Sequence Number=SeqID_171875
atggttaaaaccagaagtctgggtcggactttaggcaaggttatagaaagaagtctggggagacaagtaaatcgtgattcagatgaagctcccctgcggtgtgtagaagcaaagcttcatgaagatgataaaggtgatgacaaaaagttcaaaggtcaatcaaagaatgagttcaagatattcaagatagaatcaagaacacttcaagattcaagaggaaagttgatttcaagaatcaagaatcaatattcaagagatcaagatttcaagaatcaagattcaagagatcaagatttcaagaatcaagagatcaagattcaagactattcaagaatcaagagaaagcttgatcaagataagtatgaaaaggttttttcaaaaattgagtag

SEQ ID NO: 55098 - DNA, 423 bp, Glycine max
  Peptide Sequence Number=SeqID_171876
atgaataaggatgggcgaggtggtggattttcttttatttggaaggggtctataaaaggtgaaatagttcttttctctgagaacatcaccaatttacaaattgaagaagatatatttggttcttcatccggattggctcctctaagacttcagagaggctatgagagattgcggttttatggacacccctctcgaggcaaagtggagaatcatgactggcttttggagacagtgggagaatatttcaagcatttgtttttgagccaaaatatcaacatcaaccctattaatggcatagtaagcttgcacctggcggaggaggataacaatttccttactagtaatttctttgtggatgaattcaaggaggttgtgttccacatgcacccgaacaagttgatctctaggtctagatggccttaa

SEQ ID NO: 55099 - DNA, 309 bp, Glycine max
  Peptide Sequence Number=SeqID_171877
atgaaagctctcgagaaatcaaatggtcataacttttatctcggatgtccgattcagatgtctgattcaggcacatcacatattgagacgctcaaaattgaacaacgaaagctctcgagaaatttaaatggccataacttttcacacgaatgtccaattcaagcacatcacatattgagacgctcaatattgaaaaacggatgttctcgagaaattcaaatggtcataacttttcacatggaggtcagattcaggcgcataatcgaatgtccgattcaagcgcataacataacgagacgctcggagtag

SEQ ID NO: 55100 - DNA, 209 bp, Glycine max
  Peptide Sequence Number=SeqID_171878
cccatgggcccgaaattaccctaaggctcataagaaccctagggtcttctcttgcatctctggcccaatctacttggagtttttgtatccaatgctcttgcagggtaggattgtatcagtaagtgtctcctccaagaggacaattgttagcactgccacacctcttgggcttgaggttattcctcaagtaaaggtgtttttggatgagg

SEQ ID NO: 55101 - DNA, 249 bp, Glycine max
  Peptide Sequence Number=SeqID_171879
gatgtggaagacaacaaagatgatgatttggttctttcaaatttggttttgaggtgtgtggtgtctaggaatctagaggtagtggtgagacacgactcagaagtgctgaatgatttcaagaggtttgaggaaatggccttggttggactatggtgtgttcatccgaatccagctcttaggccttcaatgaagcatgtgatgcaaatgctagatggaaccgtggaagttgggattcctcatttggtatga

SEQ ID NO: 55102 - DNA, 297 bp, Glycine max
  Peptide Sequence Number=SeqID_171880
atgcccctgttgctccttctctctgtctatctcgtcagtgaacagtgtcaccctgagtttaaaaatggcacaatgctatcatttacgcattctcttgttcttttctatctccggtgcgcagtgctttcccgttttgttcgtttcggtgaaggtgaagatggaggtagtggcagtgttcggtgttgcagtggtcgttggcgacagcatacgagatcaagtatgaacttacggatcaagttgatccgcatacttcttaggaatcaacttgatccgcaaaggacatacatatcaacttga

SEQ ID NO: 55103 - DNA, 420 bp, Glycine max
  Peptide Sequence Number=SeqID_171881
atggtggattgtgcatgggccaagagaatgcactttgatgacaagttagcagcaaccatggatgagatcaactttaagcaagaggactccaaggagaaggaaggttctttcccaaaagctgcagatggtgtcctagctgagaaggaccaaacacctaggaaagttgagtctcttactgttatgaatcttgtggcaacaaaggagggtgagaaggaggtactaacacctcctcaggcctcgctcagcgcgtgcactcgctcagcacgcagatctggcttagcgcgagaaggcccacgaagaaaagcccagttcgcgcttagcacgcataggcgagctcagcgtggagaagctgaaggaaaggacacaccgagtctcaaagccctccagtgcataaatccataccatgagcctctcccttag

SEQ ID NO: 55104 - DNA, 195 bp, Glycine max
  Peptide Sequence Number=SeqID_171882
atgccttgcaaatatgaaatgactccaaagaaactcccagccaagaggtccaagaaggattccactagagagggttccagtgcggccccgcaggcagatatggaattcgataggcacaggttctggagtgcggaacaccagcaacggtttgaggccatcaaggactggtcattccttagagagagacgagtctag

SEQ ID NO: 55105 - DNA, 390 bp, Glycine max
  Peptide Sequence Number=SeqID_171883
atgcaacagggacaggcagttatcctcatagctaggttccctgaccctaactatggtgttaaaacgggtttcgttctctaccgaaaccgcaagccaagttggaagattccgcttcggttaaagggttcctctcggtgtggggtttcaacggagaaaaacgacagtttgtggtggctaatggtggctgtgggtgatgtagaaagtgcttgggacgttagaaatggttttggaagaaagaaggagaagaaaatgatgtttttcctaagctacttggactacaaggctcaaaacgcacaagtgagcaatgctctcgggaacggaaacttagcacacactccaggcatcttttcaacgatcccaacggtcagatcgtggacaagtgacttgtga

SEQ ID NO: 55106 - DNA, 116 bp, Glycine max
  Peptide Sequence Number=SeqID_171884
gttttgaggtagcagatacaggatgctgtggaacagggagatttgaaatgggtttcttgtgcgatcctaaatttacatgcgaagatgcaacaaatggcaataggcaaaacagctaa

SEQ ID NO: 55107 - DNA, 219 bp, Glycine max
  Peptide Sequence Number=SeqID_171885
atgtcattgtgggatgagattatctgccctcaatatgctccacaagttgaacaacctccggctaattttgaaagtactccaactcctaatgttgaaggtactccaactccaactaccactcaaggtactccaactcctagtgttgaaacaaacttcatacctccacctttgttaactatgtttagaccacctccaattaggccttcaacatcaatttga

SEQ ID NO: 55108 - DNA, 1314 bp, Glycine max
  Peptide Sequence Number=SeqID_171886
atgcgcccgcctcaaccagaggagtcacccatgaaatcgcagacaatcgcgccaaaacgctggtggtatatcatgcccatcgtgtttatcacctacagtctggcgtatctggaccgggcgaactttagcttcgcctctgccgcaggaataaatgaggatctcggtatcaccaaaggcatgtcatcgctgctcggtgccctgttcttccttggctacttcttctttcagatccctggcgcagtctatgccgagcgccgcagcgtaaaaaaactgattttctggtgtctgattctgtggggcggctgcgcctcgctgaccggtatcgtcagcaatattccgatgctggccgccatccgctttgtcctcggcgtggtggaagcggcggtgatgccggcgatgctgatctacatcagcaactggtttaccaaatccgagcgctcacgcgctaataccttcctgatcctcggcaaccctgtgacggtgctgtggatgtcggtggtgtccggctacctgattaactcctttggctggcgcgagatgttcatcatcgagggcttcccggcggtgatctgggcaattgcctggtggtttatggtgcaggataaaccggcccaggccaaatggatgagcgacgaagagaaagcggcgctgcaggcgcagctgcagaaggagcaggagaacattaaagcggtgcgcaactacagcgaagccttccgcaaccgcaacgttatcctgctgtgcctgcaatattttgcctggagcatcggcgtgtacggtttcgtgctgtggctgccgtcgattctgcgtaacggcacgcaaatgggcatggtcgaagcgggctggctgtcggcggtaccgtatctggtggcgaccatcgccatgctggtggtgtcgtgggcgtcggacaagacgcaaaaccgtaagctgtttgtctggccgctgctgctgattggcgcactggcgttcctcggctcgtggatggtgggctccagcaacttctggctgtcgtatgcgctgctggtgattgccggtggtgcgatgtacgccccgtatggcccgttcttcgccatcattccggagatgctgccgcgcaatgtttccggcggtgccatggcgctgattaacagtatgggcgcactgggttccttcatcggttcatggatcgtaggctatcttaatggggcgaccggcagtcctgccgcctcctatgtctttatgggtgctgcgctactggcgtcggtgtggctgacgctgattgttaaaccggcggccaacaaaacgccgccgccgattcacggggcgaagcacgcctga

SEQ ID NO: 55109 - DNA, 210 bp, Glycine max
  Peptide Sequence Number=SeqID_171887
atggcgtttttcctaagctatttggactacaaggctcaaaacgcacaagtgagtaatgctctccggaacggaaatgtcgtgcacacgctagacatcttctcaaagatcccaacggtcagattgtggacaacttcattaagaggcttcctcgagaagcttcctcatggcttctttgagaagctttctcgagaggcttctatgagaagctaa

SEQ ID NO: 55110 - DNA, 411 bp, Glycine max
  Peptide Sequence Number=SeqID_171888
atgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacaggaaaatcatacaggtccggttcagtctctttttcaatccgaaaagatcaagatcaaatga

SEQ ID NO: 55111 - DNA, 291 bp, Glycine max
  Peptide Sequence Number=SeqID_171889
atgggcaatgtggcttgccccatcatttcaaaacacaacctaggcctaaggccatcccctacaacccctcaattcaaagaaacaaagcataaatttgccccaaattgtctcacggaattggtcaaattaggtaccattgaaagcataaaaggcatcaatggaaagctagaaaccaaagggatactaggctgcctcccaactgcgcttttcgcttgtccagagctaggcatgggacgacgatctatcgatcgtgatcctagcctctacttgcttccgtccctaagtacctga

SEQ ID NO: 55112 - DNA, 144 bp, Glycine max
  Peptide Sequence Number=SeqID_171890
atggcgttacctgaggaatcagaaggtggatctgaatttcatcgttcgactcgaccactggataaaaagacgactctacccatttactttgcctcacaaaagttacttgatctctatgttggaaatcagaatttcaacaattag

SEQ ID NO: 55113 - DNA, 197 bp, Glycine max
  Peptide Sequence Number=SeqID_171891
atgagtaaagcattttcatcaaagaaatattcctctttgcccccatcacctacaccattcacagctgcaccatcccgtgcgaaaaagaagccatgtcctagaagccctttgcaggatctcaaccgcatttccagcagcagcaacagtagttatgcttcttctagtgtttccactgaagccccaaagggttgtctcag

SEQ ID NO: 55114 - DNA, 207 bp, Glycine max
  Peptide Sequence Number=SeqID_171892
atgaaggatttccctgggacaccgggcactggtcttggtttggctctaaggatatcacagttcgtttttgctgctggatcaattgcttccatggctaccactcccagtttctttaactttacggctttttgtattgatcatattctcaaactcactagtcatatatgttatgcacctgattgttgtcgattcgttttcatattttga

SEQ ID NO: 55115 - DNA, 1701 bp, Glycine max
  Peptide Sequence Number=SeqID_171893
atggagaaccttccaaagggtaatgctgggttgagaactaagacacttgcatcggataagaagcggacgcataagaagaacccgctgtgcctctaccaatggcagtctgggaagaaatctggttctaggactggccaaaagtctaagccttgttctgctttgaatgaacatggcaagcttttacatagactaccatctgcatcagaggagttaaaggaaaaggaggatatcttgggagggagaaatgataatgctggtgagcatgcccatgtcaatttgggtcatggtgctgtaaactcgactcctttgagtaaaaaggttactgggtcgtatttggaggatgttagagtttttagggatgtggaggagaatccaaactcaatggatagtagaacacctccaattcatgactctctttccccggagatacaatgtgggtcttctttggttccaaaaacagcaacacctgcttgttatggtgctggctatgttgtttctggtgtcgttgacaagaggaaatgtaggcctagagggattctcactgtagagaagaactattcatgcagtgataaaatagctgctaatagttttgataatgatgagaagaagaaagtaattgatactaatgaccatgctagtccttccttgttacctttgccaactgaagctgtagtgcattggctttcttctccatttaacaagggaaagaaaattccgagtaaggagtttggaaatggactaaatcaaagtcagggactagcagaatccacaactcttgcttccagtacttcaccatcatccagttctaaaactttttggaatgtaagtgataacggtgatttgtctggtggtgctaatggtatcatgagaaaaatcagttcttcaatttctccaaatggacttgctgaatttcaagtaccttctaattacatattatcgccttcttattcatccttattgttttctcccaatcccacacctatttgtagggcaggcagctcaggaaaaggaaaaactgatagatataatctcattgatgagaattctccattttccctgaattcatttggtagtggaaatgttattcaaactccacagtcagattctagttcagatttacatgttggattgtcattggtgcatgcagacaaacgaaaggaagatatttctaaccctggccttaactcatccagcaaaatacttctatcagaaagcttacttctcaatatttctatgcccctggaggattctgttaattcaagtttccaatttgattttttaactatgccttgtgaatctattgatctcagtaaacgtccaaattttttggagggtcaagatccttggttatctagttctacaacagagaatgcttcacaatcccaaatgaggatatcatggagggaagggttaatgagccaattgtatgagctggatgagtttgactgctgtagatgcttgtcagatgaaagagaaattgccaatgaatctggtaccaatagattttcaggtcctcaagtcaatattgaaataaatgatggtaaaaaattgaacagtgatgttggaatcactgaaactgaggatactgaacaggaaattgatggccttagcaaagaaaaaattccagctttaatatcatgttcaggtgctgagtccataagcactgatggtggtagtctagttgctccaggggatgactga

SEQ ID NO: 55116 - DNA, 414 bp, Glycine max
  Peptide Sequence Number=SeqID_171894
atgaacccagctcagctgggtatggaactaggcttggagatgagaatgagattgggaagggtgatggccaaaaagggatgtcttcattacttgatagcttcaatgggtttactagtcatttggagttttgtgcttgctttattggatgcatatgccttggtgaaaaaaaaggtcctccacaacgctgtactggttagcctctttgtagttggagattgggtaacagcaacactatctctagctgcagcgtcttcctcagctggcatcacggttttatactttaatgatctgggacactgccattttggagaggaatgccaaaagtaccagatttcagtagcattagccttcttgagctggttcccaatttcaatatcatccctaatcatgctttggctattagctgcagggtag

SEQ ID NO: 55117 - DNA, 327 bp, Glycine max
  Peptide Sequence Number=SeqID_171895
atggcccaggtggtggaaggtaaggtcgaagctcaacacccaaaattcagacagacccaggtggttggaggctcctccatgatggacaagaggtcaagtgtcacccgagatgacctgggtcgcaacatcagtcgtgatggtgatggtgacaacattgagagttgtcaggtgtgtggaacattgcggtggagatggacggaagtaccttatattcatcagttgtatgatgtcagacaaatgggtttgtggggccgtgcaaatcttggcaacaaaacagtggatgtgtgtaggtttctcagcttttacttgacattagttatgtattga

SEQ ID NO: 55118 - DNA, 225 bp, Glycine max
  Peptide Sequence Number=SeqID_171896
atggctgagaaaacaaagaaaaaacttgaggaagctgctcagtccggaagcactgagggcgccacaaaggaaatcgctgagaagattgcgtcacatggttcgtttgtcccccatggtcatcagaatgtcttgactactgacattgggcgaccagaacaccctggctatgtgcatgctgctggagccggtgtcaccatcaaccaatacttcggctttgctccatga

SEQ ID NO: 55119 - DNA, 690 bp, Glycine max
  Peptide Sequence Number=SeqID_171897
atggtaattattatagtgaggaacaactggcccgggagtagtgtggttagggtaatgcctcaggcccacaggcccagccaagatgctgggaatgggcaagagaaaatagacagaggggttctcggggaggtggaggacgccctcgacgaggcaacaattcttgctgaggacctcgagggtaaaatcactggcggtacggcggtagagccaagcgaaatgtttgttgcgacaatcttcagaggtcatagcaacagactaaagggtataatagtgagggtgcaagagagcttcattgtcttcttcttcattgacaccctcatgttcctctacaacacacctttactcccacaacaacaaccgccccgatgttccgctacaatgcatctccctttgtcgtcgtcttcttcagctcttatttttttctcttcaccacaccatcatattgacatagagaagaggaaaggaagttgtcacagaaagggaagctcacctagcaaggaagcttatgcaaataaggccacatggcaacttagaattaaaagaagaaggccatgtcatctgaagaactcgcccagcgactacagctcgcctagcgagcagatccctatgggtggaagaaattgcaattcatttttggactttgaagaacttgcccagcgagttgtgcttggccagcgagcagtgccataa

SEQ ID NO: 55120 - DNA, 408 bp, Glycine max
  Peptide Sequence Number=SeqID_171898
atgtttagttcactaagtgtgcgatacatgaatgcaatcaaatatttatacaggattaaacaaaacatacctaggtatggtggcgaaggagaagaagcacagagttgtcacgatgctcgagtgcgacgaacacgatgctcgagcttagacaaaacgatggtcagatggagaacagacagcttcaaggtagatggagaacaaagagagcaagaaagcttagatggagaagaagacaatgagaaggagaagacagtgcgaaggagacgaaacatacctaggtatggtggcaaaggagaagaagcagagacttgtgacgatgctcaagtgcgacgaacacgatgctcagatgcagacagggaccttcaaggtagacggagattagaagaagaagagagcgcgaaagcttag

SEQ ID NO: 55121 - DNA, 447 bp, Glycine max
  Peptide Sequence Number=SeqID_171899
atgactgtggatgaagttggtagtagctctgagtggagcacagaacaggataaagcatttgaaaatgccttggcaattcatcctgaggatgcttcagaccgatgggagaagattgtggctgatataccggggaaaaccttggaagagattaaacaccactatgagctcttggttgaagatgttaaccagattgaatctggttgtgtgcctttaccatcttataattcttctccagagggctcaacaagccatgctagtgatgaaggagctggcaagaagggaggccactcttggaatagtaacaatgaatctaatcatggaactaaggcttcaagatcagataaggaacggcgaaagggtattgcatggacagaggatgaacacagtgtatgtcattgtgaacagcacaaggcaggttcgattgtactgtggaagaggcaattctga

SEQ ID NO: 55122 - DNA, 816 bp, Glycine max
  Peptide Sequence Number=SeqID_171900
tccatgatgattggatgtggaattacctggatgttgtggaagcttgggaggattgaatggggacccggtgttgagaggaacgaggataagggctacgtgggagtacgtgagctcagttggaggtgggcaacaggggatgtggtacctggagatatgtcgcgggggtcaggagaccttggggacgtcaggcgaactcctggcagtcaacagataaaaggaacaaagaccacaaagcaaggaggcttgtgtggtgactggccgactggtgggcaattgattacaaggcttaaaaatgaagacatgaggctaagatggtctctggtaatcgattaccaaggggtgcttaaaaagggaactggaagattgtggaggcctctgatcgtgatggcggcgcagctaatccatgatcgagtggagatggagtgcctagagggagcttgggagaccctcgaaggcaacacaaggtgccaatttcggggcacgattcgatttacggctacttcattggtgcatccagatgaacccgcgcgcacgcttcagcgcactgtagagaggatactacccatgcctacaccataccgtctagtggagccagtccacgtgattgaggtgacgtcatccgaggaagaccctgaggaggatctcgaggagctacctcctgagcctgctgtggatgctcttgactttctagagggtgatgaggacccactccctgaggtggattcttctgaggacgtcatgtcggcatctgaggcaaactctacggaggatagtggtccgggagagatggcgatcagtggaggctcttcatcatag

SEQ ID NO: 55123 - DNA, 1563 bp, Glycine max
  Peptide Sequence Number=SeqID_171901
atggccaacccaaaccaccaagggtatcaccaaggagggaatccaggttatcatcagggggcaatttctcttagaactagggtcaaggttagaggttccatcttgggaacaacttcaataaggatcaaggagatcccggaagtgattggaaacctaaagattgtcccaaccaggatgacttttcaacaagtagaccactctattaaaaggccatatggtgtggttgaagacgtcctggttaaggttcaacagttcacctttcctgtggactttatgatcatggacatagaggaggatttagacgttcccctgattttgggccgtctatttatgtccactgctaaatgtgttatgaatagcggggggcaagatatgcgggttaggctaattaagggagagaaatccataactgggagcgttttgatacatatattgcttgctttcgaaaactggccccgacggacgcagagaaacgcgagaaactggaaccagagaaatggcacgcaaaccgaggcaggattttttagcgtttcaaagtgcccgtttctgccccaaatcgtgaaaggagagcatttttggagtcgtgaagtgcgtggctacgagtggaacttcgaaaatccagtcgatccaacggttaacgaattggatcgaaggaattgttactgtggtctttacgtgagaaaagctgtgattttggttgatcttgggaggattgatggggacccggtgttgagagaaacgaggatatgggctacgtgggagtacgtgagctcagttggaggtgggcaacaggggatggtgggtttggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtggtggctggccagctacagggggctaagatggtctctgggaactgggagttgatgggagcctctggtaatcgattaccagcctgtgtaatcgattacacagaggaatgggtcactgcctctggtaatcgattaccaaggctgtgtaatcgattaccagagatggaaagccttaaaataccccttttattgcatgtaatgtttatgagacgcatcgtgtgcagcacaagggagcttgggagaccctcgaaggcaacacgaggtgccgattttcggggcaccattcgattcacggctacttctttggtgcatccagatgaacctgcacggacgcttcagcgcactgtggagtggatactacccacgcctacaccatatcgtctagtggagcccgctcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagcggcccaagggagatggcgatcagcggaggctcttcatcctag

SEQ ID NO: 55124 - DNA, 339 bp, Glycine max
  Peptide Sequence Number=SeqID_171902
atggagatgaatggaaatgagatgctccaaatgaatgcgggatggcatgctgggcacgatgcaaagagtccaactggcttaagtgaccacaccctaagccgcatggtgcgtgcttattgcacttgcacggtggatatggtggatcttgtgttagaggatgagggagaggacctagaggaggacattttgtacgaggaagatccatctatggataaggaggaccccaccgtggagactgagatcatggaggaggattccttgcaggattcatctggggagtcctaccaggagaccttccttcatctgactttgactgattctttttgtggatatggataa

SEQ ID NO: 55125 - DNA, 555 bp, Glycine max
  Peptide Sequence Number=SeqID_171903
atggcttctcacaatactcaggccatgactattggttccatagctggctcatccaacaattggtatcttgacttgggttgccccccacttatatactctatatttaccttatctttggccaatgtgggatttgggtttttcctaatacaccccctcacgccagcactttttgggcttgggagattcagggtctactcacaaaagtgtgactatggaaagtttcaagcatttcacatgccttgtcaaaatgtcattgctgattgtgcacatgttcacgtagatcaatgtgtctccttatataggttgcaaaatgttttcaatgtgtacaaccattcattcgggatacttcccaatgaatcattgtggccagaaaatcctggagatgaatgttgtcatgatccaaaaaatcaaagaaatcttggtggccatccaaaaacaaggcacatacgtatcaaaatggacatgagagaaaggggtcagccaaaaagatgtagtatatgccaaaccattagtcattccaaaagcaagtgtccaaacaacccaagagaagcttaa

SEQ ID NO: 55126 - DNA, 222 bp, Glycine max
  Peptide Sequence Number=SeqID_171904
atggctggtacgttctttcttttgaaaaagcaaaatagtttagagattatgagcagtgagaaagaaatgactccgaacagagttggacgccacattatggagatggggaatggtaatctagaaatgagtgtggagtaccagaaggtgacctttaacttgtttgaagcaataaagcaccccaatgattacaaaacctgctttaagatggaggcggttaagtag

SEQ ID NO: 55127 - DNA, 819 bp, Glycine max
  Peptide Sequence Number=SeqID_171905
atgaattggtacacttgccaaggagttaagaagtttctggcgtcgttgccagggactttgtcccttgcactcgaggatgaccttgttccattaaatttggagattgaggcaacctataggagaatcaatgtttcaaggagacgaagagagcagcaagagagacaagaaaatctaagggaaagaggagcctcatcctctgcatcatcttcaacagttcctgtggtctttgagaaactgacggtgtccaatccgcatcacatctttgaggagcctttaatgttgattcaaggaaacctcttccatggtctgccaaatgaagatccatatgctcatttgactacttacatagagatatgtaatacagtgaagattgtaggggttccagaagatgtcattcgccttaatttgttctctttttccttggccagtgaagcaaaaatatggtttcatttgttcaaggaaaacaatttgagaacttgggaggagggagttgagaattccttgaagaagtatttctcggagtcctacaccactgaggggaagataaatatatttaatgatggcttacaaccccattctgagcaactcctcgatgcttctgctggtggaaagattaaattaaagacccctgatgaagctatggatcttatagagaatatgacagtcagtgatcatgttattctccgtgataaatcttacacacctgctaagaagattcttcttgagctcacgtctcaagatgcattgttggctcaaaataagctcttagacaagcaacttgagaccctcatggagacattgaacaaactatctcaatag

SEQ ID NO: 55128 - DNA, 1087 bp, Glycine max
  Peptide Sequence Number=SeqID_171906
tgcttgcttggaagatttagacaggttgaaggagattccctcaggggaatatgcttttgaagaattgaaaaaagactttgcaacaaagaggcctaaggttgagttgaaggtcttacctccttacctgaagtatgtcatcaaaaagtataaggcaacaataagatggcacatctttgatcttgaagggattagcccatcttattgtgtgcaaaaattcattatggaagttgattatagaccggtgagacaaccgcagaggagactcaacccatccatgaaggaggaagtgcaaaaggaagtcctcaagttgcttgaagcaggacttatctttccgatctttgacagtgcttgggtgagtccagtccaagtggtgcccaagaaaagtagtatgatggtgatccataatgaaaagaatgatctcacccttacacgggcattcactgagtggagaatgtgtatagactatcacaaacttaatgacaccacaaggaatgatcatttccctctatcgttcatggagcagattttggagcggctagctggacaagcttttattgtttcttggatggctactcaggggattgaagtggacaaggcaaaaattgatattattgagaagttgcctccacttatgaatgtgaaaggcatccaaagttttctcatacatgcccgacttctatcggaggtcatcattttcacagatcatgtggcgattaagtaccttctgacaaaggctgatttcaagcctaggttgattagattggtgttgctgctccaagaatttgacattgagatcaaagataagaaggggtgcgagaatctagtgcctgatgacctatctaggttgcggccttggttcacaaacattgtcaacttcaaggcagttggaatcatccttgatgatcttaattggcatcaatggaagaagttcctccctgatgaacactattatgttagggatgatcctcatttgttcaaacttggagcagataacttactaagaatgtgtgtcacaaaggaggaggccaggagtatattgtggcattgtcacaattctccctatggaggacattataatggggactag

SEQ ID NO: 55129 - DNA, 672 bp, Glycine max
  Peptide Sequence Number=SeqID_171907
atgattgggctaagtgcgctattcgcgctaagcccaagatggcctccaagaaacgtcgagcttccaccagtagacctcaagggttggaacctgcatgggactccaccagattcacatcgaaggtggcttggcaccgatactaggataatgcactggcacaggaagctcaccagagtgtcaaagagaaacattgacgtggcactggtgaaagaattttatgcaaatatctatgacccagaagatagcttacccaagcagcgcaaagttcgagggaaggtcattcagtttgacgctcagatgttgaacacctttctggagacaccttcaagaaggggagtggccattgtagtgaggttgtgtacgccaagaggccaatttattatgaatgcagaaggggccctttggaagattctgtggaaggacttaaccactctagctcagacatggagtgtcctttcttactttaacttggctcccacctcccacaccttggacttgaacatggaaaaagcacaacaaatatacaggattattatgaagatggatatggacttgggtagtatgatctcttctcagattgcccagtccaactcttcccggcttggttttcctgcgttgatcattgccttctacaatgccaagggagtttatttagacactgtcataccctaa

SEQ ID NO: 55130 - DNA, 237 bp, Glycine max
  Peptide Sequence Number=SeqID_171908
acgctcgatattgaacaacggaagctctcgagaaatgcaaatggtcataagttttcacacggaggtcagattcaggcgcataatatatcgagacactcgaaattgaacaacggaagctctcgagaaattcaaatggtcataacttttcacacggaggcgcataagatatcgagacgctcgaaattgaacaacggaagctctcgagaaattcaaatggtcataacttttcacccggag

SEQ ID NO: 55131 - DNA, 411 bp, Glycine max
  Peptide Sequence Number=SeqID_171909
atgatccttggttcaaagaagctcatttcacaagcattgttaggtttgtactcgatacccgactatatgtgtgttccattgactttgcctttttcaccttttcattcttcatcttcagcatcttctatggttggcgttgctatggtggtagaggaaatccttgctcatcctattgtgagggagtatgttttgtcatcccctagtagtgagattcctttatcttcctatccgtcgtacgatccaatcacacaaacaaggtttctcttgcctgaatgcctgactaattggccacccgttttggaggactacgttgatgatgacaatgatgaaaaaaaagattcttctaaggatgcaaatgacgtgaaggagtcatcaaggagcgaggaagacccatatgaggattcttcttag

SEQ ID NO: 55132 - DNA, 132 bp, Glycine max
  Peptide Sequence Number=SeqID_171910
atgacgccgcctctcctttgtcttccgctgcatctccgtggtggaaaatcaccattaaaggacctcattgaagctcaaagatccagcctccatagaagccccacaagttgtggtctaacccctaaatgttaa

SEQ ID NO: 55133 - DNA, 658 bp, Glycine max
  Peptide Sequence Number=SeqID_171911
atgtgcgctaagccactatacacgtcattaatgacaaacctgtggctaagcgagggttgtctcgctaagcctagccaattatgcaaagaaaaattttatatcaatgacaatattcttggccggaatatcctttcggagagaaatgtgaagctttatcatactgagttcgacgagttcaaggtggagtcggagaggcgtaatctacacaaacgcctcgccaacctccaggatggaagcatagacgtggctctagttaaggaattctatgctgatttatacaccacggaggaccaagctccaaagcaagccagagtaagaggacacctgatcaaaatagatgtagacaagctgaatgaatttcttcagactccagtggtgttagaggaggggactaaccaccaggagattgtagccaggctttgtattccctacaaggggtttgttttgaatgctgagggccagccatggaaacttctcagaaaagatctgacgacactggcccagacatggagtgtcttctcttactccaacctagctcccacatcccacacctcagatttgaatatggatagagctaggttggtctatggcttggcgactaacatggacatgaacatcagagcctttatctcagttcagatttcttctattgctcaga

SEQ ID NO: 55134 - DNA, 750 bp, Glycine max
  Peptide Sequence Number=SeqID_171912
atggaaggaccatcaagtgtgagaaaaggcgcatggagtaaatgcgaagacgaccttctaagagcttgcgtgcaactttatggggaaggaaaatggcaccttgttcctcaaagagctgggttgaacaggtgccgcaagagctgtagattgagatggctgaactatctaaaaccaaatatcaagaggggagatttcagtgaagatgaggttgacatgatgatcagaatgcataagcttttgggaaacaggcatttatttagagacttaaaagaagaccaaggaaagctgtcaaaaaaagaccaaggaaacaaatggtccctgattgcgggaagacttccgggaagaacttcaaacgatgtgaaaaattactggaacacctacatgcgccgtaaagtatactctcacaagaaagacaacaacgtagagaagcaagctgatgaggccaaatcaacagtgcaacggcaccaagtgataaagcctatacctcgagctttaacaaaaacagccccacggttgcaagggaaattgtttaatagttccaaagtcggtgttagtgaagcagcaggtgcagcttcatcagggtctggcaattggtgggaaacttttttagaaaacaaaaaagacaatcatgaagatggagagcttgacctttgggatgaggagcttaatccaattgcttgtgactttctttctgaaggtatacttatctggttatacataggtatggcaattggacaagatgggcactaa

SEQ ID NO: 55135 - DNA, 282 bp, Glycine max
  Peptide Sequence Number=SeqID_171913
atgaggatcaaaaggtcttttgaggttgtaatggggccaaggacaaggtatggaaaaatatggaataagtggctgaatcccaaaggaatagaggagcaatggggaataacctttgagaaacaacatcatattcagcatgtccaacatttaaccaatatgcaatgtacatcaagtatggctcaaaatatatcacgaagcatgaccaacaaaacatgttatccaatgaaacaaaaccccccacacttattcccaaaacaattccaaagctccaaaattccttaa

SEQ ID NO: 55136 - DNA, 351 bp, Glycine max
  Peptide Sequence Number=SeqID_171914
atggttcactcaacccttgttgagggcattcttccaagtaaccctcgtatcgctcttatgtctaatatattgactcactatcttcttgttggaagttggtctgttggtgatttggttcctcaactttttagtcctcgagggatcttcttcatcaatggattcctttgcttcttggaagatgaatggcagcggaatgaagaaaggaagagagagaggaaatgccacttcaaggagaagatgagtctagaagaagctcaccaccataggaggccatggataagagcttggaggaagaaggagatgaatgaagggagaggaagagaagagcacgaaattttgtgctctaaatga

SEQ ID NO: 55137 - DNA, 384 bp, Glycine max
  Peptide Sequence Number=SeqID_171915
atggtcaatgggggaagagaaagcacttcaaaaataatttctccaagcaagtatgaggtgggctacattgatattcttatggcaaaagttaatgccttgagtttgaagatagacaagatggaaaaggctaaggttaatgatgtgagtactccatcaccttgttgtgaacttcgtgggatgcaaggacattctactatggagtgtcaaactatgatgccggctgaccatgatgaacaagtagaaaatgttgcttcaacccacaatttctatgactatcccaggaagcgaaaatttgacccctacttaagggcaaggaaatcaaggttgcagtcaccaccaacagaactggtcgagcctggcaagtgcaccggatcacacaagtag

SEQ ID NO: 55138 - DNA, 228 bp, Glycine max
  Peptide Sequence Number=SeqID_171916
atgaagcctgttgtgttgtggacaatgaaatctcctggtgtccgccacatcaattgtgagggttccgttgtttggcatcttgtcttgtcttgtggcagtgtgttaatgttgcgcgatgaaatgcatgctggattcatttgttctagtcaccagaacaaggattcaagcaactcgcatgctgctgccacctgcatgcactccacaatcaacttagactttagactgtaa

SEQ ID NO: 55139 - DNA, 174 bp, Glycine max
  Peptide Sequence Number=SeqID_171917
atgtggctaaaaattggttggagagagatccttggtaaacagatcggcacaccgtgtagaggatggggcatgataataaggtcactgttggacattgggcctcacaaatacgaaggctctaacaagaaggataacataagtagcacaatggatagaggctttgcaagaacatga

SEQ ID NO: 55140 - DNA, 252 bp, Glycine max
  Peptide Sequence Number=SeqID_171918
atgacgattagtgactaccactcaccactagagatgtgcataatgaaaagagaaggaaagggagacgctaaggttagtaagagacaactgctcatcaccaaggaaaaagctaacagattgagccgtctagccaatatcaccatcagcagcatcaaagaaggagaggaagaagaacaatatagtgaggtgacaagaattggaatatttcagaaacagtttatgcttcaaccatcctccttcacgaccacataa

SEQ ID NO: 55141 - DNA, 672 bp, Glycine max
  Peptide Sequence Number=SeqID_171919
atgaacattgcaaatcaatatagggagtcctcatacacaaaacctgtgtcacaaaaagttactatcactcaattacaacaaagggtaaaaagcctgcttatcagtcatcatctccagattgatcaccatctaagaaacatcctgttcatatctgggaggttgacactagcacatgtcttaggcggtgggaggttggtgaatctgttagctgtgttgcttggaatcctctgcccaatattcatcttttggtggtttctgtgcaaccaaacacctactgtaagctggattaaagatgataaacacatgggtttaaggttaaggaactttaaggtatttccatatttgtttccatttccttttcaaggttctgttgctgatcatgcacctagaactattcctcagcaaggtattgtggatctttggaggcaatggctatgcctacagggagtggtggtattgcccatgccttgtttgtctccaaagatcgcaaaattcccaacattcgaatccaaacccgtcaacttcagaaccttttggacaagaggattattgtgtcacttgtttcttgggatcatcagtctcgatatccatgaggccattatgtgcgcactattagggagatacgtgataggcatactgaaatctaggtatggaatactggattttgtatga

SEQ ID NO: 55142 - DNA, 132 bp, Glycine max
  Peptide Sequence Number=SeqID_171920
atggtgaggccgcatcgtgctgctatgtcaccatcgtcatcgttgagaccctgtgacgacctcacgccgctaaaccgtgcgtccggtgacgtgagggtcgaggtcacacctccaccatggaggattttataa

SEQ ID NO: 55143 - DNA, 2193 bp, Glycine max
  Peptide Sequence Number=SeqID_171921
atggtgccagaatgggaagaagcatacatggattacaactgtctcaaagctactctgaaaaacatttcaaagtttagagagctaaacgagtcagcaccaatggcatccacaccaaaagggtctctgaagagaagattaacactctatagagcatttagtggtcttactgatagacaaagagggtctcctaggaaggacgaggatgaagttatacttgttcgtgctgcggagggtgaaggctcagaagggttgtatcagacattgttcctcaagccttcagaagaaggggcagaacaagatcttgtgtttttcaagaaacttgatcatgagtttaacaaggtgaatagcttctacaagaagatggtgaaggaaatgattgaggaggcagcggaattgagtaagcaaatgaatgctctgattgctcttagaatcaaggtggacaaggtggggttcataaatcttggtagctatggtcactcacgtgtgcacatggatgtgattcatgaaattgagatgagcaatggacggcatttggaaaatggaagtggaaattatgaggaagaaaccacttctaggacttccgttgagggctttagaccggcttcattggagatcctcgatcacgtgaagatcaacatgaccacaccagaaactgcaatgtcaaccataaaagggcttctcccaagttcaaaatccgacccttcatttagcaagaaagagctcaggaaagctgaggaacaaataagcatagccttaaaggaattctacaataagcttcggcttctaaaaagctatagcttcttaaacttgttggcattctcaaaaatcatgaagaagtatgacaaggtcagttcaaggaatacatcaaaggattacttaaagatggtggacagttcatatgttggcagctcagatgaggtcaataggctcatggaaagggtcgagcatgccttcattaagcactttgcaaatgggaatcatagaaaaggaatgaacacattgagaccagctgttaagaaggagcgacatagaattacattcttattgggactgtttactggctgctcaattgccctcgttgtggcactcattatactaatacatgcaagaaatattctatatagcgagggtcgtactagatatatggacaacatatttcctctttacagtctctttggatacatagtcttgcatatgataatgtactctgcaaatgtatacctatggaggcgttataaaatcaactacccctttatatttggcttcaaggaaggaacagaattgggatacagagaagtctttcttcttagctcgggccttgcagtactctcattggctgctgtcctctcaaacttggatatggagatggaccagagaacaaaaagtttctcagcattgacagaattagtccctttaggccttgtcattgttctgctgctcataacatttagtcccttcaacatcatatataaatccagccgcttcttccttattcagtgtgcgtttcatagtgcttgtgctcctctttacaaggtcaatttcccagaaaatttcttggcagaccagcttaccagccaggtgcaggcctttagaagtttggaattctatgtctgttactatttctggggaaatttcaagaccagatcaaacaagtgccttgaaagtgatgtctataaagcattttacttaattgttgctattattccattctggatccgttgtctccagtgctttcgacgtttgcttgaagaaagaaatacaatgcatgggctcaatgggctaaaatacatctcaacagtagtagcacttgtcttgaggactactaatgagttccgtagaggaatggtttggcaaattctagctgcaacttcttcaagcattgcaacgattgttaatacatattgggatatcgtcatagattggggtttgctgagaaggaattcaagaaatccatggttgagagaaaaactctctgtaccaaacaaaagtgtatattttgttgctatggtgttgaatgttatactgcgacttgcatggatgcaatctgttttaggcattagggaagctcctttcctgcatagaacagctttgacagctcttgtaacttgcttggagattcttcgccgtggcatatggaattttttcagacatggggatttacacatgaatcctgatataccttggatgccttag

SEQ ID NO: 55144 - DNA, 627 bp, Glycine max
  Peptide Sequence Number=SeqID_171922
atgatgacaacaatcatgacgatggtggtggtgacagaggtgaaaatcataatgatttttgcaatgttagtaactactgcaataatgaaggtcatgacagtagaggtggtgatagttgacgacgatgatggtgataacagcgacgattatggtggtgactacagcagtgctcatggtggaagacttccgggaagaacctcaaacgatgtaaaaaattattggaacacctacgcacgccgtaaattacactctcacaagaaagacaacaacatagaaaagcaagctagggccaaaacaaccgtgaaaccccacgaagttataaagcctgtacctcgagctttaacaaaaacatccccacggttgcaagggaaattcattaatagttcagaagttggtgttagtcatgaagaaggtgcaacttcaatatcagggtctgggaattggtgggaaacttttttagatgacaaggaagacattgaagaaggtaacaacaacaaatgcttctttggtggggaagatggagcacttgacctttggggtgaagagcttaattcaattgcttgtgactttcttacacaaggtgaaacttggagcgattttcttcttgacctagggctaggagattag

SEQ ID NO: 55145 - DNA, 248 bp, Glycine max
  Peptide Sequence Number=SeqID_171923
atggaaggatcatcaggtgtgaggaaaggcacatggagtcaaattgaagatgatcttctcaaagcttgcgtgcaactttatggggaaggaaattggcaccttgttcctaaaagagcagggttgaacagatgccgcaagagttgtagattgagatggttgaactatcttaaaccaaatatcaagcggggagatttcagtgaagatgaaattgatatgatgatcagattgcacaagcttttgggaaacag

SEQ ID NO: 55146 - DNA, 142 bp, Glycine max
  Peptide Sequence Number=SeqID_171924
gggttgctcgcccaggcgagctaacgagacgactgtacacgggaatgactcgcgtgaggggaccaaagcttttgatgctccgccagccactccgtaaggtactaatcgaaaccccccaggatagattaggcatcgaacaaag

SEQ ID NO: 55147 - DNA, 183 bp, Glycine max
  Peptide Sequence Number=SeqID_171925
atggcaaaaggtgcagaagacgatgttagtctctgcgcgtcaacgggctcgtttgcctcctggttgacgaaaggtgcggaaggtggaggagacgatattagtctctgcgtgtcaacgggctcgtttgccccctggttgacgaaaggtgcgggtaaccataaggtaaccccgcatgtcacctga

SEQ ID NO: 55148 - DNA, 438 bp, Glycine max
  Peptide Sequence Number=SeqID_171926
atggctcagttgaaagcatcccctgttactgctccttcccttcatacaacaggtgttgccctacgtggaaaattgagtaaggttgtgctggcttacagtggtggcttagacacatcagtcattgttccatggctcagagagaattatggttgtgaagtcgtttgcttcactgctgatgttggccaaggtatacaagaattggaaggtttagaagcgaaagctaaagccagtggggctagtcaattagtggtaaaagacttgaaggaggaatttgttagtgactatgtatttccttgcctacgtgctggtgcagtttatgagaggaagtatttgcttgggacctcaatggcccgccctgtaattgcaaaggtacttctgcttgaaaaatttcatatattcatcttccttggtaaagccatttcttctattagctcttag

SEQ ID NO: 55149 - DNA, 921 bp, Glycine max
  Peptide Sequence Number=SeqID_171927
atgaaagacattaagaaggctgcaggaaggcaattgcagatggcaatggagatcatgtatgatgctgaaaggcaaacatatataacttggatcgatgaattgttgagttcactcaagaattcaactctacaaggattgaaattttggtttcatgtgggtactgtgtgtgatgttgataagtggattcactttgccattcaaaagaaggttcaaaagcttgagctgtattttggacatacatttgaatatgttcttccattgaacctgtttaaactagaaagttttaattccttgcatgttttgcgtctgaaatccattactgtgaccaaggagatgctagagtatttactgtgttgtagttcattacttgaaacgttgagcttggttaactcgggagttccaaaaactatgatggtttcaggttcatcactcaagctgaaatatctggaattggtaaggtgttgggagctgataaaacttgaaatttttgctgagaatctggtgtctttcaaatactatggatcccatttggacacagaatttaagagtgtttcaagtcttgtggtagcaacatttggaggatcctttgtggagttcactagggaaagctttctccctcaaataaaaatgcttaaactagatcttacacaaaacgaacctgaagtgctttactggctaagtcaacttcccaagttaaaaaatctcaagcatttggagttggctgcctgtgttgatgatggtaccacacttgcttgtgcattgctattaaaggcatcaccttcactatggaggttcacagtcaagatgctaaatatcaaaccatcttttagaacagaacgcaaatttacaatgaatgcgggtacaatctcaaagagttggcattggttgggttttgtggagcagcatgtgaagttgaattag

SEQ ID NO: 55150 - DNA, 312 bp, Glycine max
  Peptide Sequence Number=SeqID_171928
atggcaaacaccactgcagatttactctggattcagtcccttctccgtgaactccaagtgccatttcttactcctaccttactgtgtgataacctcagtgcagtttccctatctcacaatcccatcttacactccaaaaccaagcacattgagcttgatattcattttgtacgagaaaaagtgctctccaaacaactcaatatactacatgtgtctgcccaagatcaactggctgatcctctaactaagcctctgtcaccttctcagcatactgcaattcgtaccaaactcaaggtgtttcctttggcatga

SEQ ID NO: 55151 - DNA, 198 bp, Glycine max
  Peptide Sequence Number=SeqID_171929
atggaggagaaaaggataaactttgggtccaagggaggagctttcctccactccaacaacaaagaaaatgaaaatgaaacaaagggaggaagaagaaagaacaacaaggagaggagaaaagagattccttttgcacaaggaggacaaaaactcaagcttccaatagaagggttctcttggataagtggaaaagagtag

SEQ ID NO: 55152 - DNA, 144 bp, Glycine max
  Peptide Sequence Number=SeqID_171930
atggtgcagttttattcaacattttccagcactttaactgcattctctacacctaatgttgctgcattaaacaagatttctgcaatctgcaatgaaaacgcgaagcaaaatggtaaaaggaatgcagctagagggttagtttag

SEQ ID NO: 55153 - DNA, 471 bp, Glycine max
  Peptide Sequence Number=SeqID_171931
atggtgtacagtggccgaaagaggcatggattctgggtcaagatgtttctgtcgggttcacttcaaccatattttttagcgggagaagttaagaagaagatagaggaaatgatcccaaagctcttcaaactattggagattctctgtaactttaatccaagcaagttgacgctgtccaatagatcaaagatttctataagatctccagaatcaagtgacaaggagattcatgcatgcgaaacaaatccaaaaagaaacacaaacaagatacatagagagttggccgaaagaggcatggattctgggtcaagatgtttttgtcgggttcactccaaccatgggataccaaagataccactagatcatcagagaaaaattcaattgaaaaagagattgaaacttaaactgctgaagcgcaaacgtatggcagattttttagcaaaaaatggggaagaagagaaagcacagtga

SEQ ID NO: 55154 - DNA, 357 bp, Glycine max
  Peptide Sequence Number=SeqID_171932
atggaaacagaggaaacaaatttgtggggaaatgacacaaatgaaggatgcaggtttgaagctggtagggaaatgatcagaaacactggagaaaaaaccacgtgcatcaccaacagaatggccaaagctaaacactcaacgtggcataaaacgtggcacaaaaccaagtcagacaaagaacaaggaaaactacgtatggaaaggactagcacgtggacatggagtgtgaaaaccaagtctagattagccagtcttcttgattatgagcaaccttcgttgattgctatggtctatgtctactacttatatcaagttgtgggactcatgagatgcatgcatgacatgaagagaatgtga

SEQ ID NO: 55155 - DNA, 351 bp, Glycine max
  Peptide Sequence Number=SeqID_171933
atggttaaagcacgagaaaagagggaggtggttgccgcccaactagcccaggcgagctcagctcacccaagagagctggattgcttctaccaaaaggcaccatcttctgttggaaccccctggaaggcccaagtgggtctggttgctatttgcacccccatcttgataagttcacccccgtctttcgtaatttatggaaaagttatagaagccttacagaagcatataggacttgactttcttctttttttcttttccttctcacccatattaggtgaaatatgcttatttaaggttttaggaattttacggaagcattacggaagccttacggaagcatataggacttga

SEQ ID NO: 55156 - DNA, 414 bp, Glycine max
  Peptide Sequence Number=SeqID_171934
atgtttgttaaatttctcattttcttctgcaaagcttcaatttgtagcctcaaatcagccactaccattgtttctcttgagacagaagacgaattagaaattcgaatagctgcacgtcttccatggtggcattgccgaatgaaactaccagaaaatgcacaacaactgccacttgcagacatggacaaatcaagagaacaagcagcagcgactgagcctcagagtagaagaagaagaagcaactcagcgtgggaagaagaagaagaagaagcaaccagcagcttcgtaaaccctaatttttttggggaagaagaagcaaccttgcgtgttctacacgtgagaactgttgtacaaggaccaggtagcatgttatggttagagacagatccaagaattcatcaagcaggggactga

SEQ ID NO: 55157 - DNA, 995 bp, Glycine max
  Peptide Sequence Number=SeqID_171935
atgcgcagattgccggaccaaaacatagtcattatcggagcgggactggttggctctgccatcgcctggggtctcgcccgatccggtctgcgtccaatgcttctcgatggggaagacctgtccctgcgcgcatcccgtgccaatttcgcgctcatttgggtacagggcaaaggcgtaggcgcaccacactatgcccgttggacaatgcaatcggcgcgcctgtggcccgctttcgcagatgaattgcgggatgtgaccggccttgatgtcgcgttgaaacagacaggcgctttcaccttttgcctcgacaagcgcgagcttcaaatgtttgccgaagacgtcgcgacagtggcgcgggcacttggcgatgacgcccccgaacatgtcgtgctcgaccatcaggaaacggccaaaatggtttcctccatcggtcgggatgtgatcggctcgatctattcgccgatggacggcgacgtgaattcgctacgcctgtttcgcgcattgcatacgggcatgatcaaactcggcgctgcctacgaaccgcattgcgaagtctcgtccatcaccccgcaaaacggcggctttctcctaagtggcgcatggggtgaagtcttcaccgagcgcgtcattctggcagcgggcaacggcaatacagagcttgccaagagtgtcggtcttgctacgccggttgtgcgcagcaaaggccaaattcttgtaacggagaaatgcgcgcccttcttcccctatacagcggccacgctgcggcaagcggatgaaggcggcgttatgatcggcgacagtcaggaaactcacacggatcggatcgccaccaatcaggatatcagcgcggttctggccaacagagcagtgcggacattcccacatctggccgaggtcaatgtcattcgcagttggaccgggtttcggatcaagacaccggacggcctgccgatttacgaacaatccgaaagccacccgggggcttacgccgtcat

SEQ ID NO: 55158 - DNA, 195 bp, Glycine max
  Peptide Sequence Number=SeqID_171936
atgcatgttgaggaagatatcgttggagaaacaaaaaaacctcttgaaaggtcaattcgccaaatgaggaaggacaccataccatttgatcctcatcaagtgacattggaaggacctcatctcggttttgcaccacaatatcctgaaaatgattctcaaagaaagctagaaaatgccactactaattcacaataa

SEQ ID NO: 55159 - DNA, 381 bp, Glycine max
  Peptide Sequence Number=SeqID_171937
atgcttcaacgtagtattaacatttcgtctcctttatctcttttgaaggtggctgatagcactagcacccgctttcagcaggaacctctttttaaaccaagcacttttaataggattatagcgtttataactctagttggaaagtcctcttcaagtactatgcagaattctattgaagacttcaattttcttaagaatttcaaggtaatggtgcatcctcgaaaagctccagttgtcactctcaaatcccatggaatccctccttatgcggttgaaccaaatgcaacacagatggtgttgcaaggggatctctgggtgttgcttcttgcgaagatattttccaagattcacagggaagtattatgggttatttctccatga

SEQ ID NO: 55160 - DNA, 1596 bp, Glycine max
  Peptide Sequence Number=SeqID_171938
atgatcgcagtcagatctgtcacctatgtctttaatatcaatggcaggttcactagaagattagaggctaggagaggaattagacaaggggatcctatctcccccttgctgttcatcctggttatggagtatctcaacagaattctaagccaactggataaaattcctaactttaattatcattctaaatgtgagaagatgaagataactaatttgtgttttgcggatgaccttctccttttttccaggggtgatatcggttcagtgcagattatgcttgacaagttcaacactttcctccgttctatgggccttcatgtaaatccttcaaagtgcaacatatactgcggatctgttgatattaatgtcaaagagcaattattgttgatttctggttttaaagaaggaaaaatgccctttaggtatcttggtattcctttatccagcaagaaactcaacataaagcattatcaagttcttatagataaaattgttggtcggattactcattggagtgctggtcttctctcttatgctggtagagtgcaacttattcaaagtgtcatctttgctacaatcaatttttggatgcaatgtctgcccctgccaaaatttgtgatcatgagaataaatgctatttgtaggagttttctgtggataggtaatagcaacatttctaggaagtctccaattgcttgggaaaaagtctgcagtccgaagattaatggtggcttgaacatcatcaacttagctatatggaataaaatcagtatcctgaaattactttggaatatctgtaataaatctgataatctttggattaaatggttgcacacgtactatattcgaggtcaatcaatttggagtatggttttgaagaagagtcactcttggattatgagcagcatgatgaagttgaggcccctgttgctgcaataccagtccagaatgcaggatgtttttaaaatgaaaaaaatttatttggctctgtttgaggaaagtgagaaaatgagttggaggactttaatgtgcaacaatctggccagaccgcgggctcttttttgtttgtggcaggcgtgtcacttcaggcttgctagcaaagatcgcctgataaaatttggtttgaatgttgatgctaactgtgctttttgttcctctatggaatcccatgaacatctcttttttggttgtattgagttgaagactatttggactgcggttcttaattggttgcagataactcatatgccaagtacttggtcagaagaattgaattggattactaggaagtgtaaaggaaagggatggcgtgctatgttactcaaatgtgcttttactgaaacaatatatcatatttgggcttatagaaaccatagggtaattggtggaaatgtaaataacaggaaagttgaggattcgattatcaatacgataatctatagagtgtgggatagaaagaggtataggaggatgctggaaaagtgcattgttaacagaaacaacattatagctggattacgagctgaccccaaacaaaggctctcagcagttgaagtcctcaatgttaacaggaagtatcttgctgctaaggaataa

SEQ ID NO: 55161 - DNA, 201 bp, Glycine max
  Peptide Sequence Number=SeqID_171939
atggtggaggaagaggagaatccttcctcctctatagaacatgttgttactaataatcaaaacaaggaaaagttaacagttgttctctctaaatcgcaaagaaagatgcttaagcgtttgcaaaactcctctattggaggctccctccaacctaacttgtgggctttgtatgacaattctcttgatccaatgatggtttaa

SEQ ID NO: 55162 - DNA, 231 bp, Glycine max
  Peptide Sequence Number=SeqID_171940
atggcgccgccgcaagcgaaatcggacagtacttatctgggcgcctccggcgatacctctactaggagaagcgtgacgacttgtttcatgacaacccaagcttccacacgtgcatcttcatgtctcccaaaagaggagaagaagctcaaacccatgttggggaacctccgccgccgtagaaggaggaacacggtgagagaacggagcaagagccaaacaagccgccgctag

SEQ ID NO: 55163 - DNA, 1386 bp, Glycine max
  Peptide Sequence Number=SeqID_171941
atgacttatcataataaagttattgtttgtcgccatgtgttatttgaggaaaatgaatttcccttctcaaagttgcatacttcctcttcctccacctatgattttcttgacaatggcttatcaccttatgtgataaaccatttacaaaatcagtccactcctcacattcaagtgcagaaccacccttctttagccccaacccagtcacctggtcagccccgctcccctaatcacgcaactccctcttctccacaaccgacccaaccaacttcctcacccccacagtcggcccattccacctctaccaacccaaagtcatcatcctccactttgggccagtcagatctcagcccacatttagaccatacacaacatctccctcttcctcccattttccagcttacttcgagttcagaaaacaaacccattacgaggagccaacatggtatttttagaccaaatacaaaatatcaacatggcttccttactaatgtcactaagtctcctctccctcgtaaccccgtgtctgcactcccaaacccgaattggaaaatggctataaatgatgaatatattgctctcattaagaataagacatgggatttagtgccctatccacctgatgttaatgttattcagtctatgacaatagatagtggagaaacttttagcccggttgttaaaccggcaactattcaaatagtgctcagtcttgctctctctaaagcttggcccattcatcagttggatgttaaaaatgcctttttacatggtgaactaaaagaaacagtgtacatgcatcaacccttgggtttcaaggatcctgatcatcctaatcatgtgtgtcttttgcgaaaatcgttgtatgggctcaaacaagctcctagagcctggtacaaacgatttgtcgactatgtttcttctattgggttctctcagagcaagtctgacaagtctctcttcatctacaagaaaggtttggagatggcttacattcttctttacgtggatgatatcattctcactgcttcttctgttgctcttcgcaagtctatcatgttacttctcaacttcgaatttgctatgaaagacttaggtccactgagttattttttgggaatcgcagtcactcaacatgctggcagtctatttttgtcccagaaaaagtatgtagaagaaatcattgaacgtgttggcgtgtcatcttgtaagccttgtccaactccggttgacactaaatcgaaacttagtgccaaaaccagcactccatatgaggatcccactcactaccgcagccttgccggagctctccaatatctcacattcacgagatctgacatctcttatatgttgtacaacagatctgtttatttatgcataatctaa

SEQ ID NO: 55164 - DNA, 864 bp, Glycine max
  Peptide Sequence Number=SeqID_171942
atgatgaaaaactcactaagatgccatgatataaccaacttcgctgattcaaaagtacttgaacatatcatcccacctactgatgcaaaggagaaagctgtatatgacaaggccaaagccaatgatttccctctttggaaatggcttgatgcggcagtcttgcagtggatttatgccacggtctcctccgacatcctcaccttcattctcattgacgatgacttggctgaacatgcttggcacagctttcaccaacgtcttgctgatttttcgacgaccaatgcatattgtaatcgtctcaaaagtcttgccgatcaactagccaatgtcgaggctcctgtcaatgatcaaaatatggttttgagaatgctacaaggattgacagaacaatattctcattttgtcactgatgcaaaacaagaatcttcccttgttgcatattcccataattcagatgatgatatgaatcaccaaaattcttctcaaggtactaatagaaaaaacaacaaaaattctggcagtcggaactccaaaaaagttggtcggaacaccggcaatggctcaaacggtctggtattagtggtagacgtggaaaacaccaacaacagtggcagcctgggtcttggatgcagtgggctccgtggacttgccctccttctccatatccttcctacaacaattgggccagacccactttcagtcctagaccaccacagcctggtcttcttggaccgaagcctcagtaggcagcttacaatgcaaatgcacccagcccaactgatattgaagcagctcttcatactctcagccttgctcaacctgatccgtcatggtacatggacaccggggcgacatctcacatga

SEQ ID NO: 55165 - DNA, 600 bp, Glycine max
  Peptide Sequence Number=SeqID_171943
atggccagacctcaacagcgttaccgaggtgtccgacaaaggcattggggttcttgggtctccgaaattcgccaccctatattgaagactaggatatggcttggtacatttgaaacagctgaggatgcagccagagcctatgatgaagcagccaggctaatgtgtggtgcaagggcaaggacaaacttccctttcaacccaaatgtgccacactcatcatcttctagttcaaagcttctctcagcaactttaactgcaaaacttcacagttgctacatggcttctttgcaaataacaagacaagctttggaatgtgagtctcagagaacaccctcagtgccaaatgcaacctccacaaccacactatttagcaacttcagtgtgaggagtgagcaaactcctgcagtgttgccacacaagagaccagaggaggagcaagagtcagaggccaacaggggtgggaaaagggttaaagctgtggaaaatgttcctctacaatttaagcctcttgaggaagatcacatagagcaaatgattgaggagcttcttgattatggatctattgagctctgctctgtcattccaccccaggccctctaa

SEQ ID NO: 55166 - DNA, 570 bp, Glycine max
  Peptide Sequence Number=SeqID_171944
atgtcattgaaatattcatatgtcaagggaatctgggcagatatatgcaaggaaggaaaaataattatataccttgatatgacaaacctttccacaacaagcaacgggaaagatcaagaatccccgatcaccattgatgaaaaggacattctagggagcattccccagggtatcgacatgaaactccagaaagggaggcaaacaaattctacaaagcaagaatataaagtgatttatgtcatagcaggagaatttacaagtggatgtccttcaaacaacactcgaaaaagacatgcgagggaagtactaattgtcgcacacaacagaagaaaccataagtcgacaaagagaagacccccaccattgatctccaacgacaaggatgtggatatgtcaattgtcctagaccatgacaatcccttgttagtaaaaactttgataaacaacaaagagagaggatatcaagaaagggacatgaacgcccaacacggatccgggaagaagttatcagaacctttagatcaggaaggagcaacaacaaatgacatctataggagcggatttggatga

SEQ ID NO: 55167 - DNA, 930 bp, Glycine max
  Peptide Sequence Number=SeqID_171945
atgccgatcctgagtgacctgcgggtgttcgtgctggtggcgcgccgcgccgggtttgccgccgctgctgaagagctgggcgtgtcgccggcctttatcagcaaacgtatcgcgttgctggagaaggcgctggacgtgtcgctgctgcaccgcaccacgcggcgggtggcgatcaccgaggacggcgagcgcatctacgaatgggcgcagcgcattctcaacgatgtcgatcagatgatggacgagctgtccgaggtgcgtcaggcgccgcagggcatgctgcgcgtggtcagcagcttcggcttcggtcgacgcttcgtggccccggcgctgtcggcgctggcgcgggagtatccgcagctggagctgcggctcgacgtgtccgatcggttggtggatctggtcagcgaagggttcgatctggatatccgcatcggcgacgatatcgcccccaatttgatcgcgcgcaagctggcggacaaccagcgcatcctgtgcgcttcgccggcgtatctgcagcgccacggcgtgccgaaaagcgtggcggagctggcgggccgcacctgcctggtgatcaaggagcgcgatcacccgttcgggctgtggcggctgcaggggccgggcgacgaagagacggtgaaagtgacgggggcgctggcgtcgaaccacggcgaaatcgtgcatcagtggtgcctggacgggcagggcgtcgcgctgcgttccgcctgggacgtgaaagagaacatcgacagcggccggttggtgcacatcctgccggagtattatcagccggcgaacatctgggcggtgtacgtttcccggctggcaacgtcggcgaaagtgcgggtgacggtcgaatttttgcgcgactatttccgcgagcactacggcgaaacggggccggcgagtgaaaatccgccgcggccttga

SEQ ID NO: 55168 - DNA, 141 bp, Glycine max
  Peptide Sequence Number=SeqID_171946
atggcgaaacaccctccacgtcagcagcatgtcgccaatgccagtggcgacttccctgtatcaccaatgccagtagcgggacttccttgtatcgccaatgtcagtggcaggatgcataccaccaaatcgaccattacctga

SEQ ID NO: 55169 - DNA, 1011 bp, Glycine max
  Peptide Sequence Number=SeqID_171947
atgtggctcgagattatcttcggtttggtcatttacaaattgttccgacgcttcttctacgacgacgacgttttggacattgaaggatccgattcttctgctcttttcttcgtcgcagataggcttaagaaactctacggagcaaatgtgtatgtgggtcttcggattcccgatgccgatactgcttctcgacagagcattgatatggttcttctcaccaaacaagagctatgggtgatatctgtgaaaaacttctctggaattttgacaattggtggcgatggtagttgggtctgtgaaaagccagacaaacataaagcagagcgtcaccctgatcctgctgcattagacgtggaagaacatgagttgattgcttacttagtggaagaagcaaggaagcaagcttcaatcgttgaatcatatcttgaacagagaggggttgctctgcctgaaggatacatttcttgcaaagttatacttccaaatcctaaattatgtaccattcctgctggcagttttccatctgaagttattacccatgatcaatggatgcaactgaagccagaaccaaagaggatgctgtctagttgggtgaagagtgcctttcgtagtgggaagaaggatatgcaagaatctgttaatcagaatcttgattttgtccttggctcagctccaatatgggatagggtggagcttaaaggcaacaagtatgtattgggggagttcctggaatttaagggcaaacaagaagatgttgaggctttaagacctattagaagatcaaaagttggtcgtatgataatccaaaagacaagcatgtttggactagctccttctaggcttcaagttctatacagcttgcgtgactatagaactgaaggggcatcaggaccagagtggaaagaagtaactgtcagatcaagtactgagatagcctttcagcctgaaaatgcttcaaaagttcgaaagtttaagctctcttcagtgagctctatgcttcttagcgcttga

SEQ ID NO: 55170 - DNA, 1032 bp, Glycine max
  Peptide Sequence Number=SeqID_171948
atgaatgaatgttgcatgcagtacgtgatgatgagaacaccaattgcaagcaatgatgaaagtggtttgaagaaggggccttggagcccagaagaggacaaaatattagtggatttcattgagaaacatggccatggaagttggagagcccttccaaggcttgcaggcttaaacaggtgtggaaagagttgcagactaaggtggactaattacctcaggcctgatatcaaacgcggaaaattctctgacgaagaagagcaactcatcatcaatttacattcagctctcgggaataagtgggcggctatagcatctcatctaccagggaggactgataatgaaataaagaatttgtggaacacccatttaaagaaaaagctaatgcaaatggggttagacccagtgactcaccgtccaagaactgataacctaaaccttcttagcaatctacaacagatattggcagctgctaaaattgtgagcagtttgacgaacccatctgctctaagctggctacagtcagatgccacactccaattattgcaaaacatgtatgctaggcctactgcctctaactcagacccactgatcaatccttttcgaacattaaactcactgccagattcttattctttgctaaatgatcttttgggtttcaatcttcactctaatctccaaaacctttatgatggtaattcgctttctcaaatccagcccaatttccaaaactttgaggcccctcagcagccaacgcagcacttgaatggtggcagaaatactagtttcagggaatcgcaaaagcaatttggttccacaaataatattgctgacccttcactatcgagttcgcttccaaatctggtttctgcctcacctgaacgttccccattcaaggaagctgaaaacattatggtaaactcaaaggactgttccacctcctttgagttaacgtggggtgatttcatggatgaagaaacaaccgaaacttattggaaaggtttcatagatcgaccatggtcgacagtcccatga

SEQ ID NO: 55171 - DNA, 1899 bp, Glycine max
  Peptide Sequence Number=SeqID_171949
atggcttccgggttgtgtgaggcttcgctttttgaagaagctatggatgtcttgaatcgaatgcggtctaattcctgcattcccaatgttgtcacttgtaggattttgctctcgggttgtttggggaggtgtaagagaattcttagcatgatgatgactgaaggctgttatccgaatcgggagatgtttaattctctttatctgttggaattggctgaaaaggcttatagtgagatgcttgattttggggtcgtgttaaataaggtcaatgtcagcaattttgcgcggtgtctttgtggagctggaaagtttgataaggcctttaagattatatgtgaaattatgagcaagggttttgttcccgatgatagtacgtattctaaagtgattggttttctttgcgatgcctccaaggtagagaaggcttttttgttgttcgaagaaatgaaaaagaatggcattgttcccagtgtctatacatatactacttcaattgatagcttttgcaaagctggtcttattcaacaggctcgcaattggtttgatgaaatgttaggagacggttgcaccccaaatgtagtgacttatacttctcttattcatgcatacctgaaagcaagaaaggtgtttgatgcaaataaactatttgagatgatgttgcttaaaggttgcaagcctaatgttgttacatatacagctttaattgatggttattgtaaggctgggcagatagataaagcttgccagatctatgctagaatgcaaggtgacatagaatcctctgacaaggacatgtattttaagctagatgacaacgattgtgaaacaccaaatattattacatatggggctttggtggatggtttatgcaaagcaaacagggttaaagaagcccgtgaattattggataccatgtcaattcagggttgtgagcctaaccaaatagtctatgatgctcttatagatgggttttgcaagaccggaaaacttgaaaatgcacaagaggtgtttgtaaagatgtcagagcgtggatacagtccaaatttgtatacctacagctctttaattaatagtctgtttaaagaaaaacgattggatcttgttttgaaagtgttgtccaagatgctagagaattcttgcactcccaatgttgttatttacacagacatgattgatggtctctgtaaagttggaaagacggatgaagcttacaagctcatgcttaaaatggaagaagtgggttgttatccaaatgttataacttatactgcaatgattgacggctttggaaaaataggcaaaattgaacagtgccttgagctatataggaatatgtgctcaaagggttgtgcaccaaactttataacctatagggtcttgataaatcactgttgttccactggtcttcttgatgaagcacacagacttctagatgaaatgaaacagacatattcgccaaggcatatatcaagttaccataaaattattgagggctttaaccgagagtttataacctcgattgggcttttagataagctgagtgagaatgaatcggtgccagttgagtctttgttcagaattttgattgataattttataaaggctggaagactggaagttgcattaaatctacttgaagagatttcatcatcttcaagccttgcagttgccaacaaatatctatatacttctttaattgagagtctgtcacatgcaagtaaggttgataaagcatttgagctttatgcaagcatgataaataataatgtggttccagagcttagcacatttgtccacctcatcaaaggccttgccagggttggtaagtggcaagaagcactacaattatcagacagcatatgccaaatggatatacgctggcttcatgaagagatgtga

SEQ ID NO: 55172 - DNA, 417 bp, Glycine max
  Peptide Sequence Number=SeqID_171950
atggtgcctagaaagttgtcgttcccccatcataactctgttagtcgaacctcaaagaagccaaaaattgagaagcaaccacatatgtgcctttggtgcatatgtttgacttgtcagggccatgtcatgctcagtgttctccaaattatgtttaaaacacaagatttgcctttgggatttgatggaatggatagttgggatattgtggaagccagacgaatccctaattgtgcatccaatgaaaaattagcattatgggtcatagagtggatgcaaatggaggagtcatttgggagtctcttgtatggagtgcttgatgaaaaggcactgagaatgaaggtgacaatgactctgctactagggacacaaccactacaagggagacttgatcagaaatgcagaacgcatctggcttaa

SEQ ID NO: 55173 - DNA, 354 bp, Glycine max
  Peptide Sequence Number=SeqID_171951
atgactacaaggaatggagacaatgaggctgaaaaatcagttgggagtaagggtgaagctgggaaagaacattctttagaggtaccattgccaaccagtatgagatcactcagggtggaaaaggataaagtggtggttggggatatctctggtagtgcaaccttggatgatgtggtggctgcaataaagcaagactacaatcagtcggccaaagatgttgtcgaggatgtggcaatgagtgggactcacaatactttcacctatgatgaaacattatgttatgaaaaccctaataaggcggtgtccaaggcgactgccaggtgtagcagaaaggaagcatatgggaaatgttga

SEQ ID NO: 55174 - DNA, 2298 bp, Glycine max
  Peptide Sequence Number=SeqID_171952
atgtcttcaataacttgccagggctcttgggtgctttccaattcttcaccaatagttgtagctaatgataaaaataatgatgccagacatgccaattttgctcaaatcccttcatgggtctctttgaaaagcagtcattcttcattgaggacccatcaaaatcaacaaggccaagttgaaaacttgcatttgatttctttagccaaacaagggaatcttagagaagtgcatgaattcattagaaacatggacaaagtgggtatttccattaatcctcgatcatacgaatacctctttaaaatgtgtggaacattgggagcattgtctgatggaaaattgtttcataatagactgcagagaatggccaatagcaataagttcattgacaattgcatccttaaaatgtattgcgactgtaagagtttcacaagtgcagagagattctttgataaaatagttgatcaggatttgtcctcttggtccaccattatatctgcttacactgaggaaggacgtatagatgaagctgttagattgttcttgcgtatgctggatttggggattacaccaaactcctctatctttagtactcttataatgtcttttacagatccttcaatgttagaccttggcaaacagatacattctcagctgataaggattggctttgctgccaatatttctattgagacgttaatctccaatatgtatgtaaagtgtgggtggttggatggtgctgaagttgccaccaataagatgactaggaaaaatgctgtggcttgcactgggttgatggtgggctatactaaagctgcaaggaacagggatgctctgttgttatttggcaagatgataagtgaaggtgtagagttggatgggttcgttttctcaataattctcaaggcttgtgctgctttgggagacttatacactggaaagcaaattcatagttactgtataaaacttggcttggaatccgaggtctcagttggtactccactagtggatttttatgttaagtgtgcaaggtttgaagctgcgcgtcaagcatttgagagcatacatgaaccaaatgatttctcgtggagtgctttaattgctggatattgccaaagtggtcaatttgacagggctcttgaggtttttaaggcaataagaagtaaaggagtgttattgaattcattcatctataccaacattttccaagcatgctctgctgtctcagatttgatttgtggtgctcaaatccatgcagatgcaataaaaaaggggctagttgcatacctctctggggagagtgctatgatcagtatgtactcaaaatgcggccaagtggactatgcacatcaagcatttttgactatagataaacctgatactgttgcatggactgcaataatatgtgctcatgcttaccatggcaaagcttttgaagcattaaggctttttaaagagatgcaggggtctggtgtaaggccaaatgcggtcactttcataggtttgttaaatgcttgtagtcattcaggtttagttaaagagggaaagaagattttggattcaatgagtgacgaatacggtgtgaacccaacaattgatcattacaattgcatgattgatgtatactctcgagctggactgctgcaggaggctcttgaggtgataaggagtctgccatttgaacctgatgttatgagttggaagagtttattaggaggatgttggagccataggaatcttgagattgggatgattgctgctgacaacatctttcgcctggacccactagactctgctacttatgtgatcatgttcaacttgtatgctttggctgggaagtgggatgaagcagcacaatttagaaagatgatggctgaaaggaacttgaggaaggaagtcagttgcagctggattattgtgaagggtaaagtccaccgctttgtggtaggtgatagacaccaccctcaaacagaacaaatatactcaaaattaaaagaactcaatttttctttcaaaaagagcaaggagcgccttctcaatgaagaaaatgctctatgcgactttactgaacgaaaagagcagcttcttgatcatagtgagagactagctatagcctatggtctcatatgcactgcagctgatacccccattatggtattcaaaaatacacgatcatgcaaagactgccatgattttgcgaaaagagtctcaatagtaactggtcgtgaattagtcgtgagagatggcaacaggtttcatcatattaattcaggggaatgttcttgccgtgattattggtga

SEQ ID NO: 55175 - DNA, 348 bp, Glycine max
  Peptide Sequence Number=SeqID_171953
atggtgcgtgattggtatagagtcggagccgcaaacagagatgacgagtacgctggtctccatagtcctctcgtggtgcgtggcctcgacgatgcagccgggtcaccaagggctcgccgtggaagccaaagtgtctgcatctcagacatgaagagaggaaaatgtcaaaatgtcaacatgggtgttccttgttgtcgtaggagttggcaacgcccacggccgacagccaaagctttggaagaccgagaagcgaaccttccctggcaggcatatcctgacaaaaatgtgagcgcggaaaaggccgaaagagtgaaggcattagattcatctccattgtttatcggctag

SEQ ID NO: 55176 - DNA, 537 bp, Glycine max
  Peptide Sequence Number=SeqID_171954
atggaacccaacctcacaatgaagtttcgcagaaatgaaaaccttccaaccaatggcaaacatttgccagagagccctcgagtaccaatggagtttctgtctagatcatggagtgcttcttctcttgaggtctctaaagcccttacacctccttcttcaatttcagacataccttccaagcctcctaatgcaccctcttctgtcagtgtcactaactccatttccgaacaagcttcagaggaattctcaaccatgtgtggcaaccagttctcttttgcttcctctgccacctcacagcttgtccttgaccgcattatgtcacagtccgctagagaggaagtgtctccattaacgtcaggtagactgtctcatagcagtgaacctttgaacggtggtgcttctttaaccggaacggatagtccaccaatctctccttctgccgagtttgacgatgttgtcaagttaatcttaaacatagatttaaagaaggtggagttgattttgataatatgcatgtggggccattgctataactag

SEQ ID NO: 55177 - DNA, 1665 bp, Glycine max
  Peptide Sequence Number=SeqID_171955
atggagcttatctctaaagttcgcaatccatttatcgtagagtataaagattcctgggtggaaaagggttgttttgtatgtatcgtcattggctattgtgaaggaggagatatggccgaggcaattaaaaaggccaatggcgtttattttcctgaagagaggctctgtaagtggctggttcaactgctgatggcacttgattacttgcatgcaaatcatattcttcatcgtgatgtcaagtgttcaaatatattcttgacaaaagatcaagatatacgtctaggtgactttggccttgctaaaatgttgacatgcgatgatcttgcatcctcagttgtggggactccaagttatatgtgccctgagcttcttgctgatataccctatggctctaagtcagatatctggtctttgggatgctgtgtgtatgaaatggctgctcacaagccagcttttaaagctcttactttttatcggttaattggtaacattggaaagtgcattggtcgttatcaagtaataagtcgagggcttgttaagagtatgctgcggaagaatcctgagcttcggccaagtgctgcagagttactaaatcatccgcatcttcaaccttacattcttaaaattcacttgaaattaaataaccccagaagaagtacttatccattccaatggtctgactcaaactatgtaaggaggactcagtttctcgagccaggatctgtttctactctttctgacagagacaaacgattgtcattcagcaatgacagggccttgaatcctagtatttctggaactgagctaggttctgtgtgttctactcaaagagcactaggattctctacttgttcaaaagagaagcactatgaactatctgttggccttgtccgtgaagaatgcaattttaacaaatcaagagacacaaagtcctcaactgttgatagattgccaagattgagatcagctaaggaatatgccactccccgacggcagactataccatcaaagatatcctatactggttccaagcgtgagttacttccatccactccagcagggggtaaattcaccccaccaactagaagagcttcccttccactgcctaccagaaccatgtgcacaaccaccccttatagagctaatgttggtcttcttcgaggtgtggactctcctgatatttctgtcaatgcaccgcgaattgacaagatggctgaattccctttggcctcttgtgaggattctctcttccctgtccgtggaacttcatcaacttccgctcagtgctcttctggttcgccaaagagtgctgactgcttaatcacgaaggacaagtgtacaatccaagttgtggacaaggccagtgtcccttccagtggcagtgatgcttgtcctgctgctccagtttcacatggcaatgaatgctctgaacatgctgtttcaagccactcctctgctgagtctagcaggcacaggtttgacacctcgtcttaccagcaacgtgcagaggcattggagggtttgctcgagttctctgcacggctcctgcagcaacagaggtttgaagaacttggggtgttgttgaagccatttggtcccgagaaggtttccccaagagaaacagctatctggttggctaagagcttcaaggaaactgtggcctaa

SEQ ID NO: 55178 - DNA, 324 bp, Glycine max
  Peptide Sequence Number=SeqID_171956
atggagaccagcgtactcgtcatctctgtttgcggctccgactctataccaatcacgcaccataaccccaacccgattttcagatctgtgttttttctctcaagtctgggtttgttgattgaggatatattggagaaggtggctgtaaccaagctgaaattggacaaggatcgcaaggcaaagggtcgtgtcgccaccgacaaggagaagggtaccaagttcactctcgtagacatcatttgtgcctatcacgtgatcataaaagttaacggaattaactgcgtttatgaaagactgggtgccataacagaaatggatgcataa

SEQ ID NO: 55179 - DNA, 1059 bp, Glycine max
  Peptide Sequence Number=SeqID_171957
atggagatggaggaagcagagacgatcgatctatacgagcttcaatattcagacttatcttcaccttcaacttcatccatggtcgattccatcatggaagccctagaacccactgtcccaggcctcctcgccgtccccatcgcttccaacctccgctcacaccttctctctctctctcggaaactcgctcttctcgacctcgacacccgaaaactcgttctcaaggagcataacttaggtagtgacgttcctttaagaaaccctgacaggagtgtatccccctttgccatgcaactcaaatatgcaaaatcacaacatgttcaacaaacggtgagtgaatgctatggcatggaattcgagaatcttggaaggtctttcaaagagctagggttttgcatgatggagcttgggttttgtcttgctcgaatatgtgacaaggctattggtggcaatgagttagagcagagtctattggattcatgtgcggctaaagggagactcattcatcatcattcacatttagatgctctcctccttaaacaacatgagaggagcagggcaactagcaagagacgtggtaataatgtcaaaccattggaagggtcagagtcgaattcaattgccagcaatgtgaattcgggtggaaatcatttgaatttgtggcagcagtggcattatgattatggtatattcactgttcttacaactccattatatatgatcccaataagtaaagaaagggccatcatggtaaaggcccctccagaaagttttatcattcaagttggggaagctttgctcgaccctcctgcatggactaaaacattctctatctcggattatcaccatgcaaactctaccttcaatggtcaacttttagtggctactgatgaggagcaagagcagtctgagcgggatagtaataatctaagtcaagaaattaagaaaatagttccccctctttcgtcacggttgaaggaaggtatgacttttgccgagttctcacgtgaaacaacaaagcagttttatggtggtagcggtttgcagtcaaatagatga

SEQ ID NO: 55180 - DNA, 351 bp, Glycine max
  Peptide Sequence Number=SeqID_171958
atgagtctgtgttgtatacctgattcaatctcagccgttaaagtcttgaaagccacgtgtttggtttttttcagcactttcgcgcctaaacttcttccaaagccaccaccttctcttttctccgcactcaccactttctgcagaaatcaacttccactcatatcgtcgctcgccgcatcgaaacgtgatggcgatgttgtcgttttgggcatcgaaaccagctgcgacgataccgccgatgctgtcgtgagaagtgacggtgaaattctcagccaagtagtgtcttctcaggtacggtgtcgtattgtatgtgctgaatttgctttcgtggtttttcccagtcaagtgtga

SEQ ID NO: 55181 - DNA, 1326 bp, Glycine max
  Peptide Sequence Number=SeqID_171959
gatttgaaaggatctagacatctaaaagaatcaggtgcatttgacaggaaatttccatctaggattgatcgtcctgtggctagtttggttgtttccactcctaagggtgatcaaaagcttacacctcatgctgaaagcagtaaagcttcagcaatgaacaacaatcgagagttgaaggttaaccaggatggaaaatcatgtgcattaccaaggtcaatgagtaatataagccggaaaagtttggagcctcaagttagttcagagagaacatcaacccgtgttgatgaaactcaacaggatgtgctgtctcaatcacgggagacagcaaatcaggttgagagaagcagagatagttctagtgatcgtggaaggccagctgttcctacttcaaaaaacccattatgtcaaaaatgtaaggaatttggccatgctttggaatgttgtacagctggttctacacaggaatctggtgctgaaatatctgtcactgcctcgagtagttcaaaagaggagatgcataaagacaatatattgaaagttgcaatccaggctgctttactcagaaggcctgaaatttacaagaagaaagaagtatcttatcaaactgacgaggtttctacctcaggcacagagttgaattgtgaagtgacttcaaaagaccaagttttggtttccagcacactgaagaatagcatatctgctgatgaaacccaagaacaacaagaaatccttgagaattctacctcagattcttccaaatgttcatctgccaatgatttgaagcaacttaactcttgtccaactgactttcggtccaaaccaggaaagtcagattccattggtcttgcagctggaaagcctgtagtgagagacttgtctgataaagctgtgacaatgtccagtgttcctttgaagatgttggcctttcctgaatatgaatacacctggcagggtgtctttgaagtgcatagaaatggaaagcctcctgatttatatactggatttcaggcacatctatcctcttgtgcttctcctaaggttcttggggtagtgaacaagtttctacccaaagtttccctcagtgaagtttctcgcttgagcatgtggccttcacaatttcttcatggtggtgttagtgatgataatattgctctttacttctttgccagggatgttgaaaggcaagcatatggatattattcttatattgacagtgtggaccatgaaatgcaaaagtttcatttttctttgttgcaagagttaaccttttacttatgctctgtcacagttatgagagacactacaagggtctattggatcacatga

SEQ ID NO: 55182 - DNA, 933 bp, Glycine max
  Peptide Sequence Number=SeqID_171960
atgagtggtgctactacaggcaatgccactccttcctccggacctaaaacagttggaagatggttgaaagacagaagagaaaagaagaaagaagaacacagagcccacaatgctcaactgcatgctgcaatttctgttgctgcggtggcagctgcagttgcagccgtcaccgcggcaacagcagcctcatctgcagctaacaaggatgagaagatggccatggctgtggcttctgcggccacgttagttgctgctcagtgtgttgaggctgctgaagcaatgggagctgagagagatcaccttgcttctgtggttagctctgctgtcaatgtccgttctcatgatgatatcacaacacttacagctgcagctgccacagctttacgaggggctgcaaccttgaaagcaagagcattgaaggaggtgtggaatattactgcagtgaccccaattgagagaggcatagggattggaatatgtggtaaaggcaataacagtaattctagcaccagtgatagtggagagattatcaatggtgaaaattttttgggtgcctgcagccaagagttcctagctaggggcactgcattactcaaacggacacgtaaaggtgatcttcactggaaaatagtttcagtctatatacatcgaacaggccaggtgatgctgaaaatgaagagcagacatgttgcaggaaccattaccaaaaagaaaaagaatgttgtgttagatgtgtgcacaaatttaccagcgtggccaggaaggcatctgtttgatgacagtgaagaaagaaggtattttggattgaagacagaagcaagggggattgtggagttcgaatgtagaaatcaaagagaatatgatacttggactcacggggtttctagacttctttccattgttgcacgcagacaaaacataaatggggtttga

SEQ ID NO: 55183 - DNA, 408 bp, Glycine max
  Peptide Sequence Number=SeqID_171961
atggctgcaagtgacattgctattatgagagataaagctcacattcctaccaaaaagagtttattggagttaacctcccaagatgcattgttggcacagaacaaattgttgtctaagcagctggaagccttgactgaaacactaagatgtaccatctgtggaggagctcatgaatctggatgttgtattcctgttgaagaacaccccgctcgtgaagtcaattacatgggaaatcagcccagaaacaattttaatgcaggagaattttctggattccaacatggccaacaatataatcaacagcagggacaatggaggaaccaccctgaaaatcaattcaatagagatcaaggtggaacatccataaggccacaacaactagggcctagtctctgtgggatcctctag

SEQ ID NO: 55184 - DNA, 390 bp, Glycine max
  Peptide Sequence Number=SeqID_171962
atgcgccatcttgttacccttttccatcaacacttaaacatccctcttgattctgaaccttatgttccaatcaagagatctttccttaaaggcgcttcagtcatagcatcttttggttatcaaaaggagcatgatggctcttgggtgaagaaaggtgctcgacatgtttgtgaagaaggacatgatggagaggattcatctctcctttcaaagataatgggcaggtttgatggtcttcaaacctttgttggtgaaaggtttgacactttggaattacaagtggatatgcgcttcaatgaaatggagtcaagaatcacaaaggttgaagaagatgtgtcttacattcgttcaagcttcgatcttccaccaccgccgccaccatcatcttag

SEQ ID NO: 55185 - DNA, 213 bp, Glycine max
  Peptide Sequence Number=SeqID_171963
atgtcagtgaaaaacctcgtcaggcgcctaggagtacatgacaagacaaaccacacactagcaagtcaagtcactctcactagttttatctcgccgcccttaaagggtcttagcattaactcaccgcccttaaagggtcttataattaactcaccgccctttaagggtcttataattaactcatcacccttaaagggtcttaaagttgtgtga

SEQ ID NO: 55186 - DNA, 282 bp, Glycine max
  Peptide Sequence Number=SeqID_171964
ctcatctacaaaggttggagcgttgcctacaacccatggccgaccagcaagagaccaagtccaaagccaaaggtaagcaaaagtactaggcccgtgaccgacaagtcatcacgcgtccagctcaagacgtcaaagaagtgctacaaggaggcagcctatgatgcaatcctccctaggaagggaccagtcactagagccattagcaagaggctccaagaggattggactagagctgctaaagaaggccctagggttctcatgaacctcaaggtagatttttga

SEQ ID NO: 55187 - DNA, 2664 bp, Glycine max
  Peptide Sequence Number=SeqID_171965
atgaggactttcttcaccgcagaatcgtgtaaagaagcacaccatagtgctttgaatccacagtcctggctccaagttgaaagagggaagcttcccagattgtcatcacagtcctcttctgcatcaatagaatccctaatcaaggtcccacagtcaccgatactcccattcttcaaacctgttgattatgtggaagtcttagctcaaatccatgaagaacttgaatcttgtcctccacaggaacaatcaaatctgtttttgttacaataccaggtctttaagggcctgggggatgtcaaactgatgcgtagaagcctccggtcagcttggcagagagcaaacactgttcatgagaaaattatatttggggcatggctgaagtatgagaagcaaggagaagaattagttgctcagttgctcacagcttgtggtaaatgtgaaaaggaatttggacccctagatgtagaatctcatattccttttgataaaaatgtaagttcccaagatagagctttgatgaatgggaacgatgcttcagaatatgttatctttaaaattggagatgagaagatagtctgtgatagacaaaagatttctgaactttcagcaccattccatgcaatgctaaagggttgtttcagggaatcactttctgagactatagatttgtctgaaaacaatctctctccttcaggtatgagggcagtaagttatttcagcttgacagacagtttacttgacgtccctccaaatcttttggtggaaatattagcttttgcaaataagtattgttgcgaaggactaaaacaggcttgtgatagaagacttgcatccttagtttcctccagagaagatgcactggaactcatggaatatgctgttgatcagaattcagctgtccttgcggcttcttgtttacaagttcttttacgtaatattcccaaatgcttgagtgacaatcgggttgtggagttatttattcatgctaataaacagcagttggcagtcatggttgggcctggtatattttcacttttctgtttcttaagtgaagtttctatgaaccttaattctagttcagacacaacagctcatttcctggaacggttagttgattttgctgaaaatgacaagcagagactgctggcatttcatcaattgggatgtgtaagactctcaaggaaagaatatgatgaagcctattgtctttttgagagggctttaaatgtaggtcatatttattctgttgcgggtttagctagactggactctataaagggtgagaaacttttatcttatgagaagatcagctcagtcatttcttctgttactccacttggatggatgtaccaggaaagatcactatactgtgatggtgatttgaggcggaaagaccttgagaaagcaactgaactggatcctactcttatatatccctacatgtataggactgcctctttaatgaagtcagggaatgttcaagttgcactggctgaaatcaaccggattcttggcttcaaactttcattagagtgcttggaactgcggttttttatctatctggtccttgaggactacaaagcagcgctccgagatgttcaagcaattctttccctgtgtccatcttataaaatgtttgaagggcgtgtagctgcatctcagctctgtactcttgtgcgtgagcatgtcgaacattggacaacagcagattgttgggcccgattatatgactgttggtctgctgttgatgatattgagtctctatctgttatctaccagatgcttgaatctgatgtagcaaaaggtgttctatacttcagacagtcattgcttctcctcaggctaaactgtcctgaggctgccatgcggagtttacagttagcttggcaacatgtatcaagtgagcatgaaagacttgtatatgagggctggatcttgtatgatacaggtcattgtgaggaagggcttcaaaaagctgaagagtctattagtattaaaaggtcttttgaggcctacttcctgaaggcctatgcattggccgactccagtttagattcatcatgttcttcaactgttatttctcttctggaagatgccttgaggtgtccttctgataatctgcgcaaaggtcaggctctaaacaatcttggaagtgtttatgttgattgtgggaaattggagttagcagaagattgctatatcaaggcccttaaaatccagcacacccgagcccatcagggtcttgctcgtgttcattttctaaaaaatgataaggctgccgcttacaaggaaatgaccaaccttattgagaaggcaagaaacaatgcatcagcatatgagaagaggtctgagtatggtgatcgtgaaatcacaaaggcagatctggagatggtgactagattagatccacttcgggtgtatccttacagatatcgagcagcagttctgatggacagccataaggaagaggaagccattgcggaactctctagagcaattgcattcaaagctgatttgcacctcttgcatctacgtgcagcattccatgaacacaagggggatgttttaggtgcactaagagactgtcgtgctgctctctcagtggatccattccatcaaaaaatgttagaacttcactgtcgtgtcaatagccacgagccatga

SEQ ID NO: 55188 - DNA, 1026 bp, Glycine max
  Peptide Sequence Number=SeqID_171966
atgaattatatgtatcaagtgaaagaagaatacttagaatcatcaccatcatcatcatatcaattaggtggtgaatttccagcaaagccaattgaaggacttcatgacacgggacccccgccattcctgaccaaaacttttgatgttgtggatgatcctgttaccaatcatgtagtttcttggagcagagatggcacaagctttgtggtttgggatccaaataccttctctacaagtcttcttcccagatacttcaagcacaacaatttctcaagctttgtcaggcaactaaacacttatggttttagaaaaattgatccagacaaatgggagtttgcaaatgaaggattcatcagagggcacaggcacttgttaagaaacataaggagaaggaaggcaccttcccaactaacacaaggtcaccactgtgttgaggttggacgttttgacttagacaaggagattgatcgtttgaggcatgacaagctggtgttgctgatggagcttgtgaatctaagaaagcagcaacagaaagccagaatgtacattcaggagatggagcaaaggttacaagggacagaaatcaagcagaaacagatgatggcattcttagctagagctataaaaaatccaaccttcatacaccaactcctacagaaagagaagagtaaggagcttgaagaagctttcaccaaaaagagaaggcaaattgagcaaggagctagagggtttggagaatcaagcagtgttaaagttgaggctttagaatttggagaatcagagttggaaatgttagctagggaaatgcaaggttttggaaagggagggatagaccgggaggtaggacctgaggcactagaatcacaagagaggctggatagagtacttgatgaagagttttgggaagaactattgtttagtgagaaatttgagggtcgattagatattccaactgctgaagataaagatgaagatgttatcaaagtgttggccaatcaacttgatcttttggattcaagtcattaa

SEQ ID NO: 55189 - DNA, 1368 bp, Glycine max
  Peptide Sequence Number=SeqID_171967
atgattcagaacattgatatgagacttgaatcgggaacttgcaatgtgtgctcagctccttgttcatcttgcatgcatcttaaccatgctctcatggggttaaaggctgaagagttttctgatgaaaactgtcgcataggagaggctaattctatggatgaggataatgaatattctcttaggagcagagcttgtgaaagctcacagcacactgtcagtgaagcaagtaatatgcagagtgtgaattcaagtcatgacgcactgtctgaaaatgctgacagtagacagatcatactgaataagtatcaggattccaagcatttagaaggtcttgatgacaacacttcttgtattagtagagccagtgatgctaatttagtgaacgatagccatcaaaggaatgaagagagaataataatgaatgtggaaagggattcattttctcatgtcccagaaaagttgtcagaatgctccattgagaattctagttcatcattgaccaaagagagggaacctgttgtttctggcgagaaatatattgctgttattgagagtacttctaagatttcactaaaagtatgtcctaagtcagaagcagatactgatgtctgtgatgctaacaatgaagatcctaaatatgcagttcaagacggacagtgtgagaaagctcaagagctggttaaatcccctggcaagcaggaacctcaatctgatgacgagagtgatgaatcagatgttgtggaacatgatgtaaaggtgtgtgacatctgtggagatgctggtcgtgaggatctacttgccatatgtagtaggtgcagtgatggtgcagagcacacctactgcatgcgagaaatgcttgagaaagtccctgaaggggattggttatgtgaagaatgcaaagatgcagaggagaatgaaaataaaagactggatgttgacgacaaaaaaatggttgaagttagttcaacctcacaagtttctggcaaaagactctctgataacattgaagtagctccagcagcaaaaagacaagctcttgaatcaagtataggatcaccaaagacgtcaagtcccaagagattagttccactgtcccgagaatcttcatttaagagcttagataaatcaaaagtgaagcctggtcttctgatgcctattcgaaaccactctggtggtattgatacagagattgctcgctctccttccattggtccccggggtcaaaatccaaaaggtatgctgttgaagtctaattcattcaacaacttaaattccaagccaagagtcaaacttgttgatgaagttgttccccccccaaaaaaagggggtaatgaacatacttcaaagaacatggagatgcctgctcgg

SEQ ID NO: 55190 - DNA, 363 bp, Glycine max
  Peptide Sequence Number=SeqID_171968
atggttgcttgcgcgatatggtatactcaagcaaaacgaagttacatatatatcctaagggattgttatagtgttagacaaatttggaaagctacattagtagaccttctcggcctcaattttttcaccatggacttgtttagatgggttgtgttgaatttgaaagccgactgtaactctattgatggatttgaatgggcaacttggtttgtcgagtctgtctatttaatttggcaagcaaggaaccaagaagtgttttctgatatccacttgtctactggagtcttgggcactccccatattatgatcaattgtgattcaaaggttgttttagagctagtcccccaagaggtgtttgcctaa

SEQ ID NO: 55191 - DNA, 951 bp, Glycine max
  Peptide Sequence Number=SeqID_171969
atgtcccatgagttccaagccttttacacttcaatccgtgtatggactattaccccctctcccatgcatgatttcccccacctttttgcaaacggggcacatcctacaaggacgacgaaggacagcttcataactcacagagcattctgtgatgcattggctgaagaaagtgcaagactctcagcaaaccaattagccaccaacaccaccacaaatccattagttcactccctcttccttctcccaacccaacaacgcaacaacaataacaacatcaacttcatcaatccctgggacccaaaccctaaccctagcaacctcaccactctccacaataacaacatcaaacctgaatctcacaacttccacatccccaacaccagcaccaacaacaacaacaacatttcctcttcattacttcatcatcatcagcaacccaacaagagaataataacctcaccctaccgtgacctccacgtgagaacacaaccccactccaacgctgccacgtcagcacacctctcagccactgcgctgctgcagaaggccgcgaccgtcggtgccgccgccatcacgggccccactctcatgactcagctcagcatggcggagttaggagccgtgacaactcagctcgactcggtgccgatgacggtgccgctgccgcccgatcaacgctacatgaacatgagaggcctcaagaataataacaatgacggtctcacgagggactttctcggtctcaccaacggcagcgcggtggacgttagcatcgacgtcaaggatatgctaacgttcaccgcggggagcatagagtacaaccatcgccaccagcaacaacaatcctacgagcaccatcacagtcataataacttgcttttcaagccccaacaaggttttggattccttgggacaaccactggccccgaatcctggggaaattgtgagtaa

SEQ ID NO: 55192 - DNA, 618 bp, Glycine max
  Peptide Sequence Number=SeqID_171970
atgaataagagtgggggaggagagatgagtaagtggccgttcacaatgtctcagtggcaggaactggaacatcaagctttgatttacaaatacatggtggctggtcttcctgtccctcctgatctagtccttcccattcagaacagcttccactccatttcccaaaccttcttgcaccatccctctaccaccatgagttattgttccttctatgggaagaaggtggacccggagccaggacgatgcaggaggactgatgggaaaaagtggaggtgctccaaggaagcctacccagactccaagtactgtgagcgacacatgcaccgtggccgcaaccgttcaagaaagcctgtggaatcacaaactatgactcagtcatcatctaatgtgtcatcattgactgtaactgctggcagcagcagcagtgcaactggaaatttccataaccttaccaccacaaatgcatatggtaatccccaagggactggttctggatcagaccaaacccactatcacatggattccattccctatgggatcccaagtaaagaatacagaaagaaaaattacttcaatggaaactatgtcactagaatcatcttgcctggcatattttga

SEQ ID NO: 55193 - DNA, 312 bp, Glycine max
  Peptide Sequence Number=SeqID_171971
atgaatgtcctttacgtcagatggatcaatactcgtgggtcaatctctcaacttgatggttttttcctacgcctgcggctcggaaagtgggaagaagggccagggggaactggataccatgtggcatacataaatgagacccagtcccagagacagtgttcagagcagaatacaagaaaatctctctcagtgaaagtggggagtatcaagtgtatggtcgaaagtcagtatatatccaatcatgattttcttgagctgaatgcgattgttagggaaacaaaccattttaagtacaatgaagatcaaagatag

SEQ ID NO: 55194 - DNA, 2049 bp, Glycine max
  Peptide Sequence Number=SeqID_171972
atggaccaaaatccttctccagggagacattctgatggaagcgtaaatattggtcttgaaaaaaaggctgtagtaactgatgatgatttacatactgcagttgagcctataattgaatacagaggctctggtgctcatgagactaatttagcatcctccagcaagaatcctttagaaaaactggaatatagtgcagagaatgatttgcaaactttcaactgtgaagctgcttgtgctggaacaagcagagttaatgttagtgagactgaaaacaaatttcaggacactgaaatgatgctaccatgtgataagattcttccagttttgcattctccatgtcatagcagaattcatatggcaataaacaaaggcaaggaaaaatccttatccgatggggatgcaaatgtaatgttatcaagggaggagaatgacagccattcaagtgttgagagctgtaacagtactggctttttttcaacaggtaagaagagacgtaactttcaacaacagttgataattgggagtaaaagagtcaaaaagcaaattgaagaatcttctggtcccaaatcctatgttaaacaggataactcgttcatgaactggatttcaaacatggtgaaaggactctcaccatcaattcaaaatgattcaaacactttggctcttacccttgcaaatccagatcatcataatctacagcctgacgagaaacttatcgcatgcaatatgaatcaagatcctgagccaaaaaatacaggattcaaatccatttttcagtccatatgttgtccaagcttgaagaatgtaggaacgagaatgtctcatcaagaaggaaagagtagtcaggatttagtgccaggtaacatggaacatggaatagatgctactccaataacctgttgggcagaaaacaatagcctttccaaactgtgtttgcaatcaaataagtttgaagtatctactgggggaaatgatgccggtctgtcctcgcagcctaagattaaacctctaaatttttttaactgtcatgaaagcagcaaaaacaacccagtggagactaaaaattattccatcttgggccatagtaaggacaaggaagaagtggcatcacattcatcttcaaccaaacaaaatacagataataatgataacatcgattctaatgtgctatgtgatagaaaggaagaagagaatatctgtcacagaagagataatctgggaagtctgtggataactcgtttttctccaaaattcactgctcccttgagagaacaacctgccaatgacacagaggtctctactgatcttaaggaagataagggaaataatgatcataaatcaatgtatttgttcaaacccctttcatcttccccaggattcagaaatttagagccaacggcttcaatgtttggaaggagatttggtgccatcaaacaaatcataccaacaaatgcaacagatactaccacacaggttaatatgttgtgttttttttgtggaacaagaggacatcaactctctgattgcttagctattgcagaaaacaagttagaagatctccagaagaatatagattcatatggaggattggaagaacatcattgtctatgcatcaaatgttttcagcccaaccattgggcaatttcatgtcccacttcaatctcaactaggaaacatgaactgaaagctaatgccttggtcaatgattgtggaaaacatttaatctcgagcaatgaagggagtgccaggctgctgactgatgaggatgaccgagttttatctggaggttctattaatgatgaaacagatcaacgagcaggtcaaaatattaatttgaagtggaaatcaaatgaaattataacccataaggtagggtgcaatgcatcattcaagaaataccgtggtttgagttcagaggaaaacaaattcagagaaaatcctacattatctccatccaaattggctgaaaggcagatttcacaggtgccaaaggaaatatttgaagcagtaaaaaagcttcaattgtcccgcaccgacatcttgaagtaa

SEQ ID NO: 55195 - DNA, 453 bp, Glycine max
  Peptide Sequence Number=SeqID_171973
atggggattaacaaaaggaggtggtgtcggttttatggtttatttaggtgtgggtgttatgccctgaatacagttcaaatcagtgataatcgtcttctgaactgtaaactgacaaatagaagtacaggcacagacgaagaacagcttcagtctccaatatgcatcagtttaatctttggaggtacctgtggggccaattcatccataaggtttcacttcatttggcatctacagacccagacaaagaaaagctccagtttcaaatatgcatcaattcactctttggagcaaaaatctcttaacgcaattatgtattttctatcatatatgaaagtgaaactaaagtctcaatgcacatgcagtgcaaccaatgctagagactcatgcacaggaacaatgatgaggatagagactattgaaaagagaaagatgccaccatcaaagtatatttag

SEQ ID NO: 55196 - DNA, 732 bp, Glycine max
  Peptide Sequence Number=SeqID_171974
atggaaagatggtggcgtgagaaagaaaataaagatcgtggtaacgcaaacgcaatgatgagagttcttgatcagtcggcttcgtttctttcagtagtcacgccaaatgctaagcgtattacggccacaaccaaaaatgcagcggcggcgttgctcctccttgtattcttcctcagtgcagcgacggaggcggcggcagggtgcacggaagagctgatatcgttttcagcgtgtctgccatacgtgtcgtacccgccgaacaacctcacagaaagtgcttcgaaaaagtgctgcgaggagttctcctccgccgtagaatcagaatcggtttgcctctgctatctgatccggcagccactgattctggggttccctctcaacaccaccaggctccattccctctcttccctttgctcaacctcaacctccttcccttttctttgctcctcatcatcatcagaatcttcggctctgccccctctcaacagcgcactaccaactcaaactgaaggatcttccgcttctttgtcaggggcaggaggaggtgggtcccgcggtaagggaggaggatcttatgggagtgggactacagtagtacccacattcaccggcgccggaggaggttctcagcatcgctcctcccatgtttcaaccctcactacctctcaattcctatccatccaccttgctacaatattcctcacaacatgtcacctttacaattcttgctaa

SEQ ID NO: 55197 - DNA, 735 bp, Glycine max
  Peptide Sequence Number=SeqID_171975
atggaatcgtcgtccattggaatccgaagatatgaagagcttccaacggttaaagacttcgagtctctgattgaacctgcaaacgttcccgctgcacgtgtgggctattgcacggtggaggctatggtatctcaatctgcacccgttttttatggtgatcttggaggccaccaaagggttcctcttccattttctaccttccttgatttttgtaagaagcggatgcagatgcaaagtaagcaccaacaaggccttgatcagtgtcctgcctcacaaactcatgatgacacagaacatgcttatttggccttggaagatgctcctgaacaaatttatttagcacaggtgtcaattatgaacagtgatcgtcaggaaaatgttcaattagaaaccctgagggaagacattcagacgcctccgattttggtgtcaaaagaattatcttctataaacttgtggatgaacaatgcccaagctagatcaagtacacactatgatccacaccacaatcttctgtgcatagtttctggctgcaaacaagttgttttgtggcctccttctgctagtccctcactctatccaatgcctatatatggggaggcttctaatcacagttctgttactttagaaaatcctgattactcaatttatccaagggcagaatgctcaatggagtttgcgcaaaaggctgttcttcaggcaggcgatgcacttttcattcctgaaggctggtaa

SEQ ID NO: 55198 - DNA, 216 bp, Glycine max
  Peptide Sequence Number=SeqID_171976
atggtacaaaatcaagaatgtgaccgtgagcgtacaaaatcttctagtctctcccagacgtcctatgctgcagcccttgtcttgaggtcgcttgttcttactaatctgccgacgccagcaatcttgcatgactccaataactgcggttacaaccctatccctactgagattcttctggacagtaacacaatcgggcctggcaccttgacattgtag

SEQ ID NO: 55199 - DNA, 369 bp, Glycine max
  Peptide Sequence Number=SeqID_171977
atgacgacggaacctagaacttggaaaagtgtatggtgcggaatgaaaacaacgcatcagtataatctagagcatattccatatgtgtatggggagttgttccacacattgtatggatcaactgagtgggttaagaactcaagcatttcacaacctctagtctcttcaatatggtatctagagccaccttgtttgttctttaaaggtttctgcatctggtcagcaaaacctaaagtcccatctttgtccctttgtccaaacaacaacctcaatatccaaaagttccttccactgacctacccactatccaaggccgccttggtcaccctcaccaaaaatcgccggcctctcctcttccttcctaggtga

SEQ ID NO: 55200 - DNA, 2085 bp, Glycine max
  Peptide Sequence Number=SeqID_171978
atggctgcattgcagtatttgctcactttgcccaagactagtgcacggctagtacgtgtgggcgctgtgattgtggagtatggtgggattttgggatccaatcgcaaggtgtggaacttgagtcccacattagaagtatgggattcaaatatggggtttataaggacttgggttctccaattaaaacaattagctttttttgtatggttctcctcaggttcttatcaaaatcacttatacaaacttaacattaccaacaagactagtgcacaactagtatgtgtgtgcgctggggttgtggagtgtagtgggatgttaggatctcattgcaaggtacgtgtcttgagtcccacattggaagtaagggattcaaatggatatatccaccgagttgaagctgatgagatctatttgaagtttgatcctggatttcacttttaccacagggatgaaaatcgctatgatgttcacttcacatataacaggatcaatatgagaaggttatatcaagcagctgaggctgcagaaaagttggtaactgattttctttttccatctacatccagaaagagacacattaaaaccacttctctgcttcccatatctggtacttttaacgaggagcaaattagttcaatcaaaatgattcttggttgcaaaggtgcaccaccctatatgattcatgggcccccaggtacgggaaagacaaggacaatggtagaagcaattctccagctctacaaatatcacaagaatgctcgtattcttgtctgtgcaccctcaaatagtgcagcagactacatactagagaaactacttgctcaacaggatgttgaatttcgagagaatgaaatattcaggctcaatgcatctgccaggccatacgaggatgtcaaacctgaatttgtccgcttctgcttctttgatgaaatggtatttaagtgtcccccagtcaatgccctcattcattataggatcataatatccacatatatgagtgcctctcttctttatgctgaagatgtttcccatggtcacttctctcacatttttttggatgaggctggccaagcttctgaacctgaaaccatgatccctgtatcccacctctgcacaagcgatactgttgttgttctggctggagaccaattgcagttgggtccagtaatatattccaagaaagcagatgagtatgggttgggggtttcatacatggaacggttgtgtgaatgcgaattatatgccagtggagatacaaattatgtaacacgactgattaggaactatcgatgtcacccagtgattttacatctcccttcaaagctgttctattgtggggaactgattgcctgtagagactccaaatctttcatggtgattggggatttgctacctaataaggatttccctattattttctatggcatccaaggatgtgatgaaagagaagggaataacccatcatggttcaatcgaattgaagcaagtaaggttatagaagttgtcaggagactgatagccggtgggaatataaaggaggaaaacattggcataataactccatataggcaacaagtgctgaaaataaaacagacacttgaaaatctagatatgcctgaaatcaaagtgggcagtgtcgaacaatttcaaggacaagagaaggaggttattatcatatctacagttcgatcaactatcaaacacaatgagtttgacagagtccactgtcttggctttttgagcaattatagaaggtttaatgtggctataacccgtgctatatcattgctggttataattgggaacccgcatattatctgcaaggacgaccattggagccaaatgttgtggcactgtgtggacaattcatcttatcagggttgttctcttcctgaaagggtggaactttatgaagatgaggacactggagagaacacttgctttactgaagataatgcatcgccctcaaacaatgtagaatggggtcaagattcatcaaataatggagaatggggtcaagattcatccttcactaaacctgttacagatgaagctgaatggtctgatggctggagaagtaattaa

SEQ ID NO: 55201 - DNA, 777 bp, Glycine max
  Peptide Sequence Number=SeqID_171979
atggcagttgagctttcaaaccaacttcaacacctctattttttctcccctccacttccattctattctctctttataaatttccttaccctgctgcactttcccatcatcaaacttccaattccaaactgcacttttgaacacaagcagccaaagcttcaaaacatggaacgttttgtgcgcctaactgtggtattagccatggctatggtgatggctgcaccagcctacgctcagatcagcagcacgccttgcagcacatcgatgataaacagtttgttcaacccttgtatgaatttcctcacaaatagcagtgccaatggcacttcacctactgctgagtgctgcaattccatcaagtcactcacaagtggtggcatggactgtttgtgtctcattatcactggcaatgttccctttagaataccaatcaaccgaaccttggccatctctcttcctcgtgcttgcaatttgcctcgtcttccacttcaatgcaaaacctcaggcggttcaccacttccagctccaggaccagcggcttttgggccatctctttctccatctgctccatctcttagtcctgaagcttcctctgtacttccctcaccttctttggcaccagtgtctgacacaacccctcctcttttgactccgtcatctgcaaccactggaagtggccgttctgatctgaccccatcatctgccatgtcatcttaccgttttctaccttcagttgtgttgattgtgttaggatttgctgttcttaaacactactag

SEQ ID NO: 55202 - DNA, 1629 bp, Glycine max
  Peptide Sequence Number=SeqID_171980
atggtgttgcttatggagttcactaagagtggttttttcccacaagaattgggcaccaatatgctcttgcttcaatccaatgagatgcaaaagcattgtggcgaaaaaattgagggaagagatgacgtagaatatagaagcaggaacagcagcttctctgagagagagatcaaaaagagcaaaacagagaagtttagcaggaacacagagcaggtcaggcgaggaagagtgagtctcgaccatcctcgaattattgatgtccataactacagcatttttgttgctacgtggaatgtggctggaagatccccaccgagtaatttgagtatagatgattggcttcatgcctcaccaccggcagatatttatgttcttggatttcaagagatagttcccttgaatgctggtaatatcttaggcgcagaagacaatggacctgccaagaaatggctagctctcattggaaagaccttaaacaaccttccgggtactagtggaggtggtgggtattatacaccatctccaatccctcagccagtggtagaaataaatgcagactttgagggatcagctaggcaaaagaattcatcattcttccatcgccgatctttccagactacctctagtggctggggaatggacaatgatacttcaactatgcagccacgactagatcgaagattcagtgtctgtgatcgtgtgatttttggtcacaggaaaagtgactttgatcccagctttagatggggttataggcctagtgactattccagggcaagtgactactccagacccagtgactattcaagatggggttcatctgatgatgacaatggccttggagattcaccaagcacagtctcaccattgtcttatggtggacctgcctctgctgaagatggatatggtatgccagggcgttccagaggattgatgggttatcttggaaataagggatccatctcaattagcatgtctctacatgaaacaagcttttgcttcatatgtagccacctaacctctggacaaaaagagggtgatgaactaagaagaaattctgatgtgatggagattcttaaaaagacaaggtttccacgtgtacatggtgctgacaacgagaagtctccagagacaatcctcgagcatgatcgaattatatggcttggagacttgaattatcggattgccctctcttaccgttctgctaaggcacttgttgagatgcaaaactggagagcattgttggagaatgaccagttgagaatagagcagaagagaggtcgtgcatttgtgggatggaatgaagggaagatttatttccctccaacatacaagtattcaactaattcagataggtatgcaggagatgatatgcacccaaaggagaaaaggcgaacacctgcttggtgtgacaggattttgtggtacggagaaggtctccatcaattatcttacgtccgtggagaatcaaggttttcagaccacaggccggtttatggcatattttgggctgaggttgagtcaagtcatggaagactgaagaagagtatgagctgttctcggaacagaattgaggtggaggaactcttgccatattcccatggatatactgaactaagttttttctaa

SEQ ID NO: 55203 - DNA, 363 bp, Glycine max
  Peptide Sequence Number=SeqID_171981
atgtcttgttctgtggcagttcccacttccccagtgttctctttctacaacaacaataacaacgttaactcttccaccgcagaacctctcatgctctctcttcccattccctctacgacgccgtcttgctcctcattatctccaccctcctctcccttgttgaagagaaagagacccgccaaaatcgacattcccgtcgcttctatcgcttttgctgtctcgccgacggcggcgccgtcgccggcgagggacgccttcgaggtcgacggacctgggttttctgtgttttgcaaacgaggaaggaggcatcatatggaggattgtttctccgctgccgttgatcttcacggtcaaccaaaacag

SEQ ID NO: 55204 - DNA, 3141 bp, Glycine max
  Peptide Sequence Number=SeqID_171982
atgtccacttcaatcctcgcacctcttcctctcaatcccatctccgtcaacaccctcaatcaaggaacacttaaacccgcttttcaatcctcaaccctcctttccgctcacccactcgcaaccccctctcgtctcgaacacgcgcattctctcctcctcgacctctgcgccgccgagaaagccctctcacaaggccaacagttgcatgcccgtttgctaaaatctcacctttcggtgtttctggccaccaagctcgtgcacaaccgtggtggtggaacattcggaggtgccgcctcagcgattgcaatggaactctcagaagaatggaagtcattcttcccaacaggagcatccacagtatccccacttcttctgtcccgttcccattctctccctctcggccccctcctcttcaaccctaaccctaattccctctccgttctcttctcttccccctctctcgtaccctgtctccatctccctccccatctctttccctcccgcttcctcctcacttcccaccctcactccattctcccctccaccgcttcctccgtcgcctccctcttctctttccccaatcaaaacgacgccgcttccctcttcctccgcaaccgcctccacctcctctattaccctaaccgtccaaacgccgtcgttttcttccccactggcgccaacgacgacaaactcggcttcttcattctcgccgtcaaggattcgcgcttggacattctgcttgactccaacggcgatgtttttcgtgcttccaccggctccgcgcaccgcatcttgaacatttcggtgaaccccgttgctgattctggtctcttcaatgaatctcatgttatcgggtatctgttggcttccgctctctattccgttcactggttcgctgtgaagcacaattccgttttggatagacctagtgtgttttatttgggtggtaaaacgtttaagacttgccctgtggggactaggttgaaagtaccatggaatgacttgggtttttcggtaaacaacacggtgtggttgagttgtgagtttagttggcaccccagggtttttgttgttgcgcgttctgacgctgttttcttagttgatttcaggctgaaggagtgtagtgtgagttgcttgatgaagattgagacgctgcgaatgtatgctccgggtggaaatgagcggtttcttgcattatcaagggttggtcctgacgatttttactttgctgtggcttctaccagtctgttgcttctctgtgacatgaggaagcctttggtgccagtgttgcagtggatgcatgggattgaaggaccttgcttcatgtctgtattgagcttgtctaatttgaggtcccactcgagggatgatgcttttaagttggcttctgaatctgggttctgtattgtgttgggatcattttggaattgtgagttcaatatcttctgctatggctctatattgccgtttcgtaaaggatctgttacttcgaagattaatccaaacatctgtgcttgggagcttccatttgaaatcaaattatctggtcatgagtgtcattgtgggagttgtctcttaaggaaagagttctcaaaagatgctcttcctgagtgggttgattggcagctaaagaaagagatagttttgggatttggggttttaagcaatgaccttgctgcattactgtgtgaaccggatgaaaatgggggttttacactcataaggctaatgtcatcaggaaggtttgaattgcagagatatcatgcctcttggacgcaggctagaaacatgaaagatttccatgatcaagtgttttgtttggacagacacttactgtatcccgagagtgatgagaaatacaaatttcggaaatattttcactacttaaaattagatttcctttatgaatatgcagggggtgatctttctcgatttctggttaaaaaactagaaaagaactgtatggatgctcaggacgaggagcccttttgtgatgaagtgcatgagttattgtgtgagaaattaaatgcttgtgggtttggccaatcaagatcatatccagcagttacttctgtttttaatgatgtcaagctaccagcaagcttacatgaggttgctttgagaagattgtgggttgacttacctatggaactattacagttggcgtttttgagttatgctgaatgtcataaagtagttggagacctggaccaaaataagatagctttggaatttttagctgttcctgaccttcctcaattgcctccattctttttaaggaaatcatcaccccacggcaatgaagacattgtgggcccagttattccttttcctgttctacttgtgcttaatgaatttcacaacgggtactcaaatttggaaggagacgcattttcagtagaagcagagcttggcctcaaatacaaagaagttatgcaggtggctggtgagatcgctgtttcagcttatggccctgcacaccttgatgatcatgcagtctcccttgctgaagatggagaggaaacctgggttggttcttcaaaaccaaaatcttttttgttataccatccaattgcattcaactcatctgccacagaccttgtacgggaaaagtctgtttatagcaatacaatttatgatacattcatttctcatgttccagagaagaagtccaatgagaagactgagtctgttggacaagagatatttgatgatctttgccctgttgagttgaggtttgctgctcctgtgaataagcttgaacctcaagttatgggttttggttctgggaagctccctatttatgaagttggagctacaattgatattgccttggactcctgcatggtatctttgaaaaaagttgaggctaatcaagcttcaatttgctcagctagtggtgtgactatgatattcccttttctggtgtctgatatcctgggagttaataattctgcccagaaggtttttggtgaagtcaccagtttttctcttttgcttacaacacttcacggactccaaagtgatagtggggacttggaccaatcttcattgaatgtttgcattaagttaaaacttttagacttgattgaaaagtttgctatgctggtccgttcaatcaggaaagcctcatgtcagtag

SEQ ID NO: 55205 - DNA, 11031 bp, Glycine max
  Peptide Sequence Number=SeqID_171983
atgaaatgggttacattgcttaaggacttcaaagagaaggttggcctcactcaatcgccaccctctgcttctgctcctccttcttctttttctcctccttcctcttcttcccgcgacaacaacaatgcctttccagcttcgcaatcctctgcttcgtcccctaccagggacaaacatgaactggaattggacttcaagaaattctgggaagagtttcggtcatccagctctgagaaggcaaaagaagcggccttgaatttgagtatagatgccttttgtagattagtgaagcagcatgctaatgtagctcagttagttaccataattataaccctggcctacatcacactgtcagttagaagttgcaacatgcttttgtctgtatttactttggttgtctatggtgcagtaatgctactcatgcttaactgttatgttctagtgatttggttagttgaaacccatatattctcttttgttgtcggaagagcatttgtaacagatatagaaaagttaaaaatcagcagcaaaacaagatctttggatgttgctcaagttttaaagtttttctcggaagtcacaaagagatttccttctatgcaggatggaatcagtccaggagcaaatttattaacttcagtggaaatccttgtctctgggcctattgacaagcaatctctacttgactctgggatattttgctgtctcattcaagttctcaatgcccttctcgatcctgatgtaaccattcaaaggccaaatagtactactgatcatgaagataacattgtattacaaaaagattatgatgaagttgggcaaaaccgccggcttgaggtggagggaagtgttgtgcatatcatgaaagctctagcaagccattcatcagcagcacagagtttgatagaggatgattcacttcagttgctttttcaaatggttgccaagggatctttgattgttttctctcgttataaggaaggacttgttccattgcacagcatacaacttcacagacatgctatgcagatacttggtcttcttttggtaaatgacaatggaagcacagccaaatacatccgcaagcatcatttggctttggttcaaggggtgggttggtgtggttttagcatttattgtgacaaaaggatcccctttcggtctcttctctttcaatctcatataaaagttcttctattgtctgtgaaagattttgatcctgattgtggagatgctgcctttaccgtaggcattgttgacttgttactcaagtgtgtagaattgtcatatagagctgaagcggctagtgtgagacttcgagaagatatacataatgcccatggatatcaattccttgttcaatttgcactaactctgtccaatatgtcaaaaaatcagggctttcaatctacacgttctgatacatttgatgaccaagatattgcttctgatggatccgaaaatagcagaggacaaaattccaatgagcaagaacattcctccattcagtatctttcacccacattatctaggttgctagatgttcttgttagtctagctcaaactggaccaaatgagtctccacgtacttatggaggtaagggttctaaatctactcagaacaagggtggtggtcatagcaaaagtcgtaccttatcttctgattggcttggtgatgaattatgggagaaggaaaatgataaaattaaagaccttgaagcagtccagatgttacaagatattctcatcaaagctaatagctggaagttgcaggctgaagtattaaatagactgtttaaaattttttcaggccacatagagaattataggctgtgtcagcaattacgaactgttccacttttaatcctaaatatggctggttttccttctcatttgcaagagataatcttgaaaattcttgagtatgctgtgactgttgtaaattgtgttcctgagcaagaactactttcactttgctgtttgttgcagcaaccaataacatcagcattgaagcagacgattctttctttctttgtaaaacttttgtcctttgaccaacagtacaagaaagttctacgagaagttggtgttttggaagttatgttagatgatctgaaacaacacaggattttgggtccggatcaactgactgttaactcggaccagttggagaggaaaaatagctcaaacaatttcaagaaacgcctggacaatagggatgttattattacttcacccaagcttatggaatctggttcagggaagttccctatttttgatgttgaagatacaattgctattgcctgggactgcatggtatctttattgaagaaagctgaggttaatcaagcttcattccgctcagctagtggtgtgactgtgatgttgccttttctggtgtctgatgtacatcgttcaggggtccttaggatactatcatgtcttataattgaagatacctcacaggctcatcctgaagaattaggtgtggtggttgaaattttgaaaagtggaatggttaccagtgcttcaggatcccaataccggcttacccttgatgcaaaatgtgacactatgggagcactgtggcggatcctgggagttaataattctgcgcagaaggtttttggtgaagccactggtttttctcttttacttacaacactccatggcttccaaagtgatggtgggaactcggatcaatctttattgaatgcttatattaaggtgtttacgtacttgttgcgtgttgtaactgctggagtatctgacaatgctgttaatagaatgaagttgcatgcaattatatcatcacaaactttctttgatcttcttagcgagtctggcttattgtgtgcggatcatgaaaaacaagtcatccagttgatgttggaacttgcccttgaaatagtgattccgcctttcttagcatctgagggtttgacaaaatcaaatgcaattgagaatgagtcatctcataatcttttattggctccatcaggtccaattaatcctgataaagagcgggtttacaatgctggtgctattagagtactgatccgttcattattgctttttactcctatggtgcagttaaaacttttagacttgattgaaaagttggcccgtgctggtccctttaatcaggaaagcctcacgtctgtaggttgtgtggaacttttgctggaaacaatccacccttttcttctgggttcatcttcgttactctcttatgcattgaaaattgtggaggtccttggttcttacaggctatctgcatctgaacttcgtatgctcattagatatgttctgcaaatgaggatgaaaaattcaggtcatataattgttgaaatgatggaaaaattaattctgatgggagatatggccttagaaaatatttctctggcaccatttgtggagatggatatgagtaagattgggcatgctggcattcaggtttccttgggtgaaagatcatggcctcccgcggctggttattcatttgtttgttggttccagctccgtaattttttaaaatcacaatcaaaagacactgacgcttcaaaatttgcctcttccaagaagcgctctggttcaagtggattgcatgagcgacatatcttaagaattttttctgttggtgctactaacaatgataatgcaacctatgcagaactttatctccaagaggatggtgttctaacccttgcaaccagcaactcttcctccttatcattttctggtgtagaacttgaagaaggaaggtggcatcaccttgcagtcattcacagcaaaccaaatgctcttgctgggctgttccaagctagttttgcatatgtttatctaaatggaaagctaagacacactgggaaattaggatattcaccatgcccacctggtaaacaattgcaggtcactattgggacatcagttggaaatgctagagttagtgatttgacgtggaaactacgctcttgctatctttttgaggaagtgctttcaccaggctgtatttgttttatgtacatacttggtagaggatacagggggctcttccaggacacagaccttctgcaatttgtacctaaccaggcctgtggtggtggtagtatggccatattagattctttagatgctgatctgactttgtctgctaatggtccgagactggatgctacaagcaagcagggagatctaaaagcagatgggagtggaattgtctgggatttggagagacttggaaacctttctttacagctttcaggaaagaaacttatttttgcatttgatggaacttctacagaatttattcaatcgtcaggtagcttttcaatgcttaatctggttgatcctatgtcggctgctgcctctcctattggaggtattccacgttttggacgtctctgtggagatatttatatctgtaagcaaggtgtgattggagagactatccgccctattggtgggttggaacttgtacttgctcttgttgaagcagcagaaactagggatatgctgcatatggcccttactctacttgcctgtgcgcttcatcaaaatcctcagaatcttaaggacatgcaaatttataggggctaccatctgcttgcgctttttctgcgtcgtagaatgtcattatttgatatgcaatctcttgagatcttctttcagattgctgcttgtgaagcttctttttctgaaccgaagaagttggagagtagccagactactttatctccttcttcatctctgctggaaaccagtcttgaggatcattttttgtcaaagtttcacgatgagaattcttcacttggatctcatggggacatggatgatttttctgtacaaaaagattcatttagtcacatttcagagctggaaaatactgatgttgctgctgaaacttcaaattgcattgtcttgtcaaatgcagacatggttgaacatgtcttattggattggacattgtgggtaactgccccagtttcaatccaaattgcattacttggattccttgaaaatttagtgtccatgcattggtacagaaatcataatcttacaattttgcgtcgaattaaccttgttcaacatttactagtgaccttgcaaaggggtgatgttgaagttcctgtcctagaaaagttggttgtactgcttggggtcattttggaagatgggtttctatcttcggagcttgagaatgtggttagatttgtgattatgacatttgatcccccggggttggttccacagcgtccaattatgagagaatcaatgggtaaacatgtaattgtcagaaatatgttgctagagatgtttattgatctacaagtcactattaaatcagaagagttgcttgagctgtggcacaaagttgtctcctctaagttaattacatattttcttgatgaagcagttcatcccacaagtatgagatgggtcatgactctacttggtgtgtgtcttacttcttctccaacgtttgcacttaaatttcgcaccggtggaggttatctaggtttagttcgggtgctacccagtttctatgattccccagacatctattatattttattttgtttgatatttggcaagccagtttacccaaggttacctgaggtccgcatgttggactttcatgcccttatgccaagtgatgggagttatacagaactgaagtttgtagagttgttggattctgtaattgccatggcaaaaactacttttgatagaataagcatgcaggcaatgcttgcccaccaaaccggtaatctttcccaggttggggcaagcctcgtggctgagcttgtagagggaaattcagatatggctggtgagcttcagggggaagctctgatgcacaagacatatgctgctcgccttatgggtggagaggcatcagcccctgctgctgcaacttcagttctaagatttatggttgatttggctaagatgtgtcccacttttactgctgtttgtagacgtgcagaatttcttgaaagctgcattgacctatatttttcttgtgtgagggctgcacatgctgttaaaatggctaaagatctctccgcagttacggaagagaaaaccttgaatgattgtgaagatacatgcagttcccaaaatacattttctagcttgcctctggatcaggaccagtctgtcaaaacctctatcagtgttggaagctttcctcaagggcaggtaagtacaagttctgatgatatggctgcaccaccgaactctatggctggtgagagacctcagaataatcttagtgtatctgagctggagtcaaataaatctgtccgcgaagatatacaaactgttcagagcttggatggtgataatgctgatcaaggttctgttgcttccagtgcacatgaattcagctttcacagtatcaaaggcaatttggacattctcccaccaacagattcccagagttcagcatcttttgctgcactggattctcctgtattttcagaaaagtccagttctatagttccccttacacattcttcgtcccctgttgttgcattagcatcttggctgggaagtgcaaaccataatgaagcaaaatctcccttaactgccactccttcttttgattcttccatgtctgctgcggagtttgatacatcttcaaatctaaagtctagttctcaagggccatcttctacaaatgcttacttcactgtaacctcaaagctgcttttggacgtagatgattctggatatggcggtggtccatgttctgctggagctactgccatgttagatttcattgcagaagtcctttctgattttgtgacggagcaggttaaagcatcacagctcgtagagaacatcttggaaagtgttcatctatatgttgatggtgagtctgtgttagttttccaaggtctatgcctcagtagatttataaacttccttgaaagacgactgctacgtgatgatgaagaagatgagaaaaaattggataagattcgctggtccacaaatttggatgctttgtgttggatgatagtggatcgggtatacatgggtgcttttcctcagccttcaggggtactgaaaactcttgagttcttgttatcaatgttgcaattggcaaacaaagatggtagaattgaagaagctgctcctggtggaaagaggctcttatcaatttcaagaggaaataagcagctagaggcttatatccattcgattcttaaaaacactaatcgaatgatattatattgcttcctcccatcattcttagtcagtataggggaagatgatcttcttttgcggttgggtttgcttaatgaacctataaagaaattgtcctctacttcctctcaagatgattcaggaattgacataagtacagtcttgcaattattggttgctcatagaagaattatattctgtcccagcaacatcgatacagatcttaattgctgtctatgtgtgaatttgatatctcttctctgtgataaaagacaaaatgtacaaaatattaccattgatgtgttcaagtatcttctggtacataggagagctgcattggaagacttgcttgtttctagacctaatcaagggcagcaacttgatgtgctccatggtggttttgataaattattgactagaagtttatctgagttttttgaatggtatcaaaatattgaacaggttgtgaataaggtattggagcagtgtgctggcattatgtgggtgcagtatattgcaggatcagcaaagtttccaggagtaagaatcaaaggcatggaaggtcgtcggaagaaagaaatgggacggaaatctcgagaagctgcaaaattggatttaagacactgggagcaggtaaatgagcgaagatatgcactggatttagttcgtgatgcaatgtccactgagttgagagttgttaggcaagataagtatggatggattctacatgctgagagtgagtggcaatgtcatctacagcaacttgtgcatgaacgagggatattcccactaagtaaatcctctttcacagaagagcctgaatggcaactttgtcccattgaaggtccgtatcgaatgcggaaaaaacttgaatgctgcaaacttaaaattgataccatacaaaatattcttgatggacattttgaattagagaaaccagagttgtctaaagtaaaatttgaaaatggtcctgattcatcagagtcaaaaccttattttcaacttttgactgatggtggcaagcagaatggttcggatggcgagccctttgatgaacctttctttgaaaagttggatagcgtcaaagatgctttttctgctaagaatgagtggaatgatgacaaggcaagtagcataaatgaagcaagtctccattctgcacttgaacttggtgccaagtctagtgcagtatctgtcccaatagaagaaagcacacacggaagatctgaaatgggatccccaaggcaatcttcttcattgaaaattgatgatgttaagattgctgatgataaatctgataaagaactgcatgacaatggtgaatacttgatcagaccttttctggaaccatttgagaaaatacgatttaaatacaactgtgaaagagttataagtcttgacaaacatgatggcatattcctgataggtgaattctctttgtatgtgattgaaaacttctatattgatgattctggttgcttttgtgagaaggaatgtgaagatgagctttcagttattgatcaggctttgggtgttaagaaagattttactggcagtgtggattttcaatccaaatcaactttgtcatggagcacaccagctaaatcattggttgggggaagggcgtgggcctatagtggtggtgcatggggtaaggagaaagtacatagcattggaaacttacctcatccttggcgcatgtggaagcttgatagtgttcatgagattttgaagcgtgattatcagcttcgtcctgttgctgttgaaatatttagcatggatggatgtaatgatctcttggttttccacaaaaaagagagagaagaagtttttaaaaatctagttgccataaatcttcctcggaatagcatgctggacacaactatttcaggatcatcaaaacaagaaagcaatgagggtagccgtcttttcaagataatggcaaaatccttttcaaaaagatggcagaatggagaaataagcaatttccagtacctcatgcatctaaacaccttggcaggacgtggatatagtgatctcacccaatatcctgtctttccatgggtccttgcagattatgagagtgaaaatcttgatttgtccaacccaaaaacatttcgtaggcttgataaaccaatgggttgccagactcctgaaggtgaagatgagtttagaaaaagatatgagagctgggatgatccggaggtcccaaagtttcactatggatctcattattctagtgctggaattgtcctattctatcttctccgcctacccccattcagtacagagaatcaaaaacttcagggtggccagtttgaccatgctgatcgccttttcaatagcataaaggatacttggcttagtgctgctgggaagggaaacacatctgatgtgaaggaattgattccagaatttttctacatgcccgagttcttggagaatcaattcaatcttgacttgggagagaaacagtctggcgagaaggttggggatgttgtcctacctctatgggccaaaggtagtgctcgagagttcatcagtaagcatagggaagctcttgaatcagattatgtctcagaaaatttgcatcactggatagacctcatttttggatataagcaaagagggaaggctgctgaggaatcagttaatgtgttctatcattatacatatgaagggagtgtagacatagactcggttacagatcctgcaatgaaagcatccattttagcacaaattaatcattttgggcagacacctaaacaactattcctcaagccccatgtgaaaagacgaactgacagaaaacttcctccccatccccttaagcattccagtcatcttgctgcacatgagattcgcaaaagttcttcacctatcactcaaattgtcactcttaatgataaaattctcatagctggaactaacaatttgctaaaaccaagaacatataccaaatatgtggcttggggttttcctgatcatagcttgagatttattagctacgaacaagataaacttctttcaacacatgaaaatttacatggaggcaatcaaattcagtgcgctagtgttagtcatgatggtcatattctggttacaggggctgatgatgggctagttaatgtatggagagttagcaagtttgggccccgtgccttacgtcgcttgaagttggagaagccactttgtggtcacacaggcaaaattacatgccttcaggttagccagccttacatgcttattgtgagtggatcagatgattgcacggtcattatatgggatctcagctccatggcatttgtacggcagctcccagaatttccagcaccagtttcagcaatttatgttaatgacttgaccggagagattgttacagcagctggtattcttctggctgtttggagtataaatggggattgcctggcaatgatcaaagcatcacaactgccatcagattccattctctctgtgacaagcagtacgttttctgattggttggacacaaagtggtatgcaacaggtcatcagagtggagctgtcaaggtgtggcagatgattcactgctccaacccagatagctcccttagcaaatcaggttttggtgggtcgggaggtttaaatcttggtggattagaaccagaatacaagttggtcctacgcaaagtgctaaagtttcataagcattcggttactgcccttcacctcacaactgacctgaaacagttattgagtggggattcaggcgggcatttgctttcctggacactgcctgaagagagtctgcgaggttcattaaatcaggggtga

SEQ ID NO: 55206 - DNA, 681 bp, Glycine max
  Peptide Sequence Number=SeqID_171984
gcctttttcgggatatttgatgggcatgggggaacaaaggcttcggaattcgctgcacataacttggaaaagaatgtgttggaggaggtggttaggagagatgaaaatgacattgaggaggcagtgaagcatggttacctcaacacagattctgaattcttgaaggaggatcttaatggtggctcttgctgtgtgacagcattgatcaggaatggtaaccttgttgtgtccaatgctggagattgtcgtgctgtgattagcatagggggtgtggcagaagccctaacatctgatcacaagccttctagagaagatgaaagggacagaattgagactcagggtggctatgttgatgtgtgccgtggtgtatggaggatacaagggtcattggctgtttctaggggaattggagatagaaacctgaaacaatgggtcatagcagaacctgagaccaaagttcttaaaattgaacctcagcatgacttgttgatcttagcttcagatggattatgggaaaaggttagcaatcaggaagcagtagatattgctcgtcctttttgtgttgggaacaataaacagcaacctttgctggcttgtaagaaactcgtggaattatctgtgtcacgaggctctgtggatgacataagtgttatgattatcaaattgcaaaactacatttga

SEQ ID NO: 55207 - DNA, 409 bp, Glycine max
  Peptide Sequence Number=SeqID_171985
tgcaccgtgtgtatcatatctgctccgcaaacgagctctttacgatgatatgtcaagatacacatgttgtgctggttacatgccctgcagtggtcggtgtggagaaagtaaatgtcctgaactctgccttggtgcggaggctttcatgtttgtccttcaacaacttgcctgcatattttctattattgctttaattgtgggaaatagtgaaattcgacaggcttctcaattgctatcttgtttggctgactttgtctactgcacggtgtgtgcttgcatgcagactcagcataagattgaaatggacaaacgcgatgggaaatttggaccccaatcagtaatgggtgttccccctgttcaacaaatgtcacgctttgatcaggcagtccccccttttgttgggtattga

SEQ ID NO: 55208 - DNA, 177 bp, Glycine max
  Peptide Sequence Number=SeqID_171986
atgggtaagaccccttctcttttcgccgttccacctctcactgtcgactcaaaaagactattgccccgccctcacttatgtctctactgcaacctccctacatgtcgtgctagtcagaatcatcttcccatgaaacgttgctcgtcttcacttagcttggttgtagatgtcggatga

SEQ ID NO: 55209 - DNA, 1209 bp, Glycine max
  Peptide Sequence Number=SeqID_171987
atggcacacgtcacactcaacgcccagaaatggaatcttagtataaataagaggcagttccacttcaaagttgaaattgaattcacacaagagatggcttctcctcttcttactccttacaagatgggcaaattcaatctgtcccatagagttgttttggcaccgctgaccagacagaggtcttacgacaacgtcccacaaccccatgccatcctctactactcccagagaacttccaacggaggccttctcattactgaagccactggcgtctctgacacggctcaaggctatccgcaaacccctggcatatggactaaagaccatgttcaagcttggaaacccattgtcgatgccgtccacgccaaaggcggtgttttcttctgtcagatttggcacgttggaagagtttcagattcagtttatcagccaaatggacaagcacccatatcttctacggacaagccactcacaccccaaattcgaagtaatggcattgatcaagtacaatttacccctccaaggagattaaggactgatgaaattccgcatattgtaaatgacttcagacttgctgcaaggaatgccatcgaagctggttttgatggggttgagatccatggggctcatggctacctgcttgagcaatttatgaaagataaagtgaatgaccgaacagacgaatatggtggatcccttgagaaccgctgccgatttgctttggaagttgttgaagctgttgttaatgagataggggcggacagagttggaattaggctatcgccattcgcagaatattcagagtctggagactctaatccaaaagaattggggctttacatgatgaatgccctcaataagtatggtattctttactgtcacatggtggaaccaagaatgaagactgttggagaaaaaactgaatgccctcatagcctggtgcctatgagaaaggccttcaatggcacttttatagccgcaggaggttatgaccgccaagatgggatcaacgctgtagctgaaaacagggctgatcttgttgcttatggccgttggttcttggctaatccagatttgccaaaaagatttgctctcaatgcccctctcaacaagtatcaccgggagacattctacacttctgatccggttcttggttatactgactacccctttcttgatgatgaagaatccaatgccgtagcatcctag

SEQ ID NO: 55210 - DNA, 372 bp, Glycine max
  Peptide Sequence Number=SeqID_171988
atggctagctgcaccttctcagttctcaggatctcaatcttcttcatactccttacaagaattggggctgtacatgatgggatcaatgcagtagctgaagacagggctgatcttgttgcttacggtcgtttgttcttggctaatccagatttgccaaagagatttgctctcaatgctcctctcaacaagtatcacagggagacattctacatttctgatccggttcttggttttacacttatactgactacccctttcttccccagcaaattcatatttgcaatttggttggtcaggactattgttgttgtaataatgtcactggatcaaaacaagtgttgggctaaagctatatatgcacctgatttgtaa

SEQ ID NO: 55211 - DNA, 288 bp, Glycine max
  Peptide Sequence Number=SeqID_171989
atggaacgattttgtttctttcacaggaaaacctgtcaccttgtccaagacattgttcgtaagtacttgccgggagcaaaaaagcatcaacagccagtgcgatacttctcttggcttccccatcaagaaggcataatggccgttgtagccttggctggtaagctgggtaacgggggtccatgtaagaacttgatccggcagattcagagcttcggttattcggttaaagagtttcagtgtaggcatgttatgtctccaataaatttcaaccaatcagaatgtgtttaa

SEQ ID NO: 55212 - DNA, 551 bp, Glycine max
  Peptide Sequence Number=SeqID_171990
atggctgcttctgttcccgttccccttattactccatacaaaaaaggttacgtaagtcccttagtcctatttccagttaaattgcaattcgttttgtttttcgtccctcaacaccatgccatcctctattactctcagagagcttccaacggaggccttctcattgcagaagctactggtgtttctgacactgctcaaggctatccccaaacgcctggcaccttggaagcaaggaatgctatccatggggctcatggctacctgctcgagcaatttatgaaagataaggtgaatgaccgaacggatgtatacggtggatcccttgagaaccgttgccgatttactttggaagttattgaagctgttgttaatgagatagggactaatccagatttgccaaagagatttctgctcaatgctcctctcaacaagtataaccgggagacattttacattgatgatccggatgcttatattcacatattctttacatacttctctgcaaacactttggaaccagttgggacatcttctaaatgtgagggcatgca

SEQ ID NO: 55213 - DNA, 1584 bp, Glycine max
  Peptide Sequence Number=SeqID_171991
gcccgaaggaaacatcgcagggttatcctgcatgttggtccaacaaatagtggtaaaacacatcatgctttgaagcaacttgagtcaagtgcttctggtgtatattgtggtcctttaagattgttggcatgggagatagcaaaacggttgaacaaggcacaagttccttgtgatctcattacaggtcaggaaagagaggaagttgacggtgccaatcataaggctgttacagttgaaatggctgatctatcagctgattatcaatgtgctgttattgatgaaattcaggcaattgtattactaattgagaattggagtaattgttttatgactgaaacatctgcatttgaggaggaattgatggcattgtgggctttgatgatagggtgtactacaaggggatattcatttacacgtgctttattaggaattgctgctgatgaacttcacctttgtggtgatccagctgctgtgccccttattcaggagatattgaaaattactggtgacgagattgaggttcaattttatgagagactgtcacctttagtcccactgaatgttcctcttggatctttctctaatgtaagaaatggtgattgcattgtaaccttttcacgtcaggagatatacaaattgaagaaaagaattgagaaagaaggaaagcatctttgttcagtggtttatggatcactgcccccagagactcgaacaagacaggcaagcatgttcaatgatgctagtagcgagtttgatgttcttgtggccagtgatgccattggaatgggtcttaatctaaacatctctaggatcatattttcaaccatgaagaagtttgacggttttgaggtgcgggatttgagtgtacctgagatcaaacagattgcagggagagctggtagatatggatcaaattttcctgtaggagaagtaacgtgcatggatgaagaggatctactcttgctccattcatctttgaattctccatcacccattttagagcgtgctggcttacttcctacctttgatctgatgtatatgtattcacgattacacccaagaaatggtttctatcaaatactggcgcattttcttgaccatgcgaaattgtctgaaaattatttcattgtcaattgtgaacaattactgaaagtggctgctgttattgatgagcttccccttggattacatgagaaataccttttctgtatcagcccagctgacatggatgatgaaatttcatctcaaggcctaacacagtttgcagagaattatgcaaagaaaggccttgtcaggcttcgagaaatatttacaccaggatcactcaaagtgcccaagacgccagctgctcttaaggagttggaatccatccacaaggtcttggatctgtacgtttggttgagctttcggttggaagaatctttcccagaccatgagctggccgtatcccaaaaggccatttgcagcatgttgattgaggaattcctagaaagactcgggtggcaaaagccaatggctagaaggttggcttctcataaaatgtcaagtcccctattatcccaacacatgaggaaatgcctttaa

SEQ ID NO: 55214 - DNA, 231 bp, Glycine max
  Peptide Sequence Number=SeqID_171992
atgggaaggacaataaaggaaaatctgactgaggagctaaaagactcgttcaaagtatttgacagggataatgatggatatatatcagcaactgagctgagacaagtaatggtgaaattgggagagaggctaacagacgaagaagttgaacaaatgattagagaagcagatttggatggagatggtcgagatagctatgaagaatttctgaggtttatgacgttaaattga

SEQ ID NO: 55215 - DNA, 1857 bp, Glycine max
  Peptide Sequence Number=SeqID_171993
atggcacttcctgagggtgttcaagttcatggggcggttgttaagatgggtttggagggagaaatctttgtcagcaactctttgatacatttctatgaggagtgcgggagagttgacttgggacgaaagatgtttgaaggaatgcttgagagaaatgttgcgtcttggactagtttgatcaatggttatgctgggaggctgtttctcttttctttcaaatggttgaggctgttgggtgtggaacttaacacactcatggttaatgcactggttgatatgtacatgaaatgtggggatatatgtgctgcaaggtggatttttgatgaatgtactgataagaatttggttatgtacaatactatcatgtcaaactatgtgcaagatgggtgggctggtgatgtgctagtaatattggatgaaatgctgcaaaaaggaccacgaccggataaggtgaccatgttatctactattgcagcttgtgcacagttagatgatctttctgttggggagtcatcccatacttatgtcttacagaatggacttgaaggttgggataacatttccaatgcgatcattgacttgtacatgaaatgtggcaaaagagaagcagcttgcaaagtttttgagcatatgccaaacaagacggtggtgacttggaattcgttaattgcaggtttggttagagatggtgacatggaattagcttggagagtctttgatgagatgcttgagagggatcttgtatcttggaacactatgatcggtgcattggttcaagtgagcatgtttgaggaagcaattaagctattcagagagatgcacaaccaggggattcaaggagatagagtgacaatggtgggcattgcttctgcctgtggatatttaggagctcttgatcttgccaagtgggtatgtacttacattgagaaaaatgacattcacttggacttgcagcttggcacagctttggttgatatgttttcaagatgtggtgatccctcaagtgctatgcatgttttcaaaagaatgaaaaaacgggacgtgtctgcctggactgctgccgtcggagctttggcaatggagggaaatacagaaggggctattgagctttttaatgagatgcttgaacaaaaggtgaaaccagatgatgttgtttttgtggcactattgacagcatgtagccatgggggctctgtggaccaagggagggaacttttttggtcaatggaaaaaagccacggagtacatcctcagattgtccactatgcatgtatggttgatttgatgagtcgagctgggctgctggaagaagctgttgatctcatacaaactatgccaatagaacctaatgatgttgtgtggggatctctgctagcagcttacaaaaatgttgaattggcacattatgcagctgcaaagttaacacaattggcccctgaaagagttgggattcatgtgctgttatctaacatatatgcatcagctggaaaatggactgatgtagcaagagtaaggttgcaaatgaagaagaaaggggtccagaaagttcctggatcaagctcaatagaggttcacggtttgattcacgagttcacctcaggtgatgaatcacacacagagaacacccagattggattaatgcttgaggaaataaactgcaggctaagcgaggcagggtatgtttctgatagaaccaatgtcttactcgatgttgatgagcaggagaaagagcatttgctcagaagacatagtgcgaaactagccatggcttatggattaatcactactgatcaaggtatacccatacgggattctgtgcttgtagagattattggtaatagatttattagtatttag

SEQ ID NO: 55216 - DNA, 1677 bp, Glycine max
  Peptide Sequence Number=SeqID_171994
atgccgtccaagttccgattcctaaaactcttcactcaccgtctctctcctagaaccgccgccgccaatggctcgcaccgcttcctatacggcaaccctctctgcaccatggcggagtccccggagctccctccgtggctcaagttctccgacaccccgacccctccagacgctgactcagacgacaacttcgttatcccttcactcgctcactgggtcgacacccacatgctcactaccaagcccaaagtcctcacgcaatcacccaagcaagacaacctcgacgaactcgaagcagtaaccaaagttctccaaaaacgctacccttctcccgagttagcctctttagcactcgatggacttagttttcagccatcaagcggtttggtttcgcaggttctcaacagattcagcaacgactgggtcccagctttgggttttttcaaatgggcaaaatctctaacaggttaccggcattcccccgaactctacaacttgatggttgacatcttgggaaagtgcagatcctttgattccatgtcggagttggtggaggaaatggcaagactcgaagggtatgtcacactggaaaccatgaccaaggtaatgaggaggcttgccagggcacgcaagcatgaagatgctattgaagcatttggcagaatggagaagtttggtgtcaagaaggacactgcagcgttgaatgttctcattgatgcattggtgaaaggagacagtgttgaacatgcccacaaggttgttttggagtttaagggttcgatacctttgagttctcgttctttcaatgttttgatgcatggctggtgcagagcgagggactttgacaatgcaaggaaagccatggaggacatgaaggaacacgggtttgagcctgatgttttctcgtacactaatttcattgaagcgtatggccacgagagagatttccgcaaggttgatcaagttttggaggagatgagggaaaatgggtgcccccctaatgctgtgacttatactagtgtgatgcttcatctggggaaagcagggcaactgcgtaaagctttggaggtttatgaaaaaatgaagagtgatggctgtgtggctgacactccattttatagcagcatgatatttattcttggcaaagctgggaggttaaaggatgcttgtgatgtgtttgaggatatgcctaagcagggggtcgtgagagatgtggtgacatacaacagtatgatttctactgcttgtgctcactcgcgggaagagactgctcttaggttgcttaaggaaatggaagatgggtcgtgcaagccgaatgttgggacttaccatcggttgcttaagatgtgctgcaaaaagaagagaatgaaggtgctcaagtttttgttggatcacatgttcaaaaacaatataagccctgatttggcaacttactcgcttttggtaaatgctctacgtaaaagtggaaaagttgaggatgcttactcgtttttggaggaaatggtcttgcggggattcactccgaaacccagcacgctcaagaaattggctggagagcttgagtccaagagcatgttagaagagaaagtgcgtgttgaggaatggatggaccgcttttcgcagaatctgattcggcctggcctgtcggatcggtccgaccgggatccggtgacctaa

SEQ ID NO: 55217 - DNA, 846 bp, Glycine max
  Peptide Sequence Number=SeqID_171995
atgtcaatccaacctgactcacccaacaacaacacgttgacccaaatgtttcagaacatattctcagacaacagtaacatcatgcttgcagccatcatttctctcctcctagtaatcctctttgtcctccttctccacctctatgccaagttgttcctcgctcaggcacagcctcaggcccacgcccgccgccgccggaggaggaggcggcgaaacacggtgacagtctccgacgtcctcggcccggcaaggttccaccacttccacagcttcaacatagaagacagttcacccctcacaacaaaaggcttagattcttcaaccattagaacaattccactcttcatctatgaacccaacaacaacaaggtccaagaagaagaagaagaacttgaatgtgtaatttgcttgagtgcctttgtgagtggtgaagtggggaggtgcttgccaaagtgtggccatggcttccatgtggagtgcattgacatgtggttgagttcacactccaattgtcctatttgtagagcctcaattgtagcaagtgttgaggagaatgtttctagggtggtggtttcatcaagtgatcatcatcgtgatgaattatattacggtggagatcatgatttggttgagattgtgattgaaagtggtggtgctccaagttctgagattattagagagggtgatggtaatggaggagcaagaacaagtgtttctgttgggtcagaaacttcttcttctgagttttttgggtgctctttggagagaatgcttggcaaggttttcccatcaagtaatgggttatttgagtggggtggtggctggtgctacctgcttacatcatag

SEQ ID NO: 55218 - DNA, 1986 bp, Glycine max
  Peptide Sequence Number=SeqID_171996
atgggaactggtgcatcgaaggacgcagaggaagggagcaaggaagagcgtgacaggctcgatcatgcaggtggccaactctacgtctctctcaagatggagaatcggaagctcacaggggaccttgttcctcacgtttatggctctgttcctcttgttggctcttgggatccttccaaagctcttttcatggagcgggaatcggtgtcaatgtgggaacttagctttgttgtcccacctaatcacggtaatgccttttactttttggaaagtgtggctcttagcaatggctttgttgcctttaccatgaggagggagtctggtattgaggggaagaggatgagagggagggcaggccactggaaagtggaaggagaacagaaagagttagggaggaatctagtattaaggtatcttggcgagttaggttatggaaattgtgttgtgcatgattgtctcaatagtgaaattggaggggtgtttagttttttgaagtatgcatggatttcagaaactttggatttcaaattcctgttgaagcctaaggacagcaatacaccttgttttgttgaggagggtcctagccgcctgcttgtggggggagcgttgcaagaggatgccaggcttgcgttgtttaggcttgatagtggcgaggttcttgagtatcaagtctttgttaaagcagacagggtttctccctttgaccttgcagcgagttggagggcttatcaggataattttcgtccttcatctgtgagatggattcctgatgttagcataaattcagcacctcagaccagtggtgagaatggttgttctgtaggtttggaacttgatcttgagcattatgttgtcccaactcccgcaacttcagcaaattcagcacatgtatatgccgctaacctgacagagaatccaaggtcactaattattgggtctggcagcagttcatatcccatcaaggagatggaggttattgtacctgatccatctaagatatttcaaagtcctggaatggttgaatccaagtcagttggaacattttcacctctgcaaaagcaagagagtcagaggggactttttgttgatagaggtgttggatctcctagacctgtaaaatcttctagttcaaatattttctctactgatctcaatttggatagcgataccaagaattcaatgccagctgctgctggagctgttgctgctgcagctgttgctgatcagatgctgggtcccaaggaagatagacatttggcaattatcctgtctgctgatttctttcgagctgacaatccggaaggcatggaggcacggaatgaggtagcagcactggcatttgaagatatgatctcttggatgcaagaaggtggccaggttgggatatttgatgccacaaacagtagcaaggaacgaagaaacatgctgatgaaattggctgaaggaagatgcaaggtttatgagacagttaatgaaggatcttacataaaaatgattgatatggtcagtgggcatggtggacaaatacaagcaggagaactttattcaaagaagcttgccaagtttgttggaaagcgtctcaaatcagaacgggctgcttctatacaatggcgtgcacttgatgagataaacgcaggggtgtgtgatggtatgacatatgcagaaatcaagaaaaacatgccagaggagtatgagtatgttgcaaacttatcgcgcaagaaggataagcttaggtatcgttatcctcggggtgagtcatacttggatgtcattcaaaggttagaacctgtaattatagagcttgagcgacaacgagcacctgttgttgtgatatctcaccaggcagttttgagggcactatatgcttattttgctgacaggcctttgaacgaaattccgcatatagaggttcctcttcatacgattattgagatacagatgggagtcacgggtgtccaagagaaaagatataaactaatggactga

SEQ ID NO: 55219 - DNA, 201 bp, Glycine max
  Peptide Sequence Number=SeqID_171997
atggcgtctgaaacggcgtcgtcggcggatgaagaaaccgttgttgttgtttcggctgctgcgggtgcaggaggaactgataagagaggcaagcaccggattcttgccgaactgaagcgtctcgaccaagaatccaagtttcttcagatgcctccgctgatgcaccccaaaccttggccttgcgggaccctaaatttgtaa

SEQ ID NO: 55220 - DNA, 1110 bp, Glycine max
  Peptide Sequence Number=SeqID_171998
atgagtcgcctaccatcaaacctgttgccagttgatggaagcccggagtggatgaacaggggtgacaacacgtggcagctgacgtcagctactctggtgggcctgcagagcgttccgggcttggtcatcctctacggcagcatagtgaagaagaaattaatgggctttgaactctgccttcatggccctccaaacacggccttggacagggaattcgtttttcgccaagcttttgcaggggaatttcccaacgccaccatggtgtactttcagttggcttttgctgccatcagggcagtgaaggatagagagaggttccctccaaacaacatacttctgatggcttaccatggattcaacggtggagatccatacgcagccagcatagatgcatctctggccgtccttaacacccacgtctgcacggcaatgagcttgttgacttggcttttccttgacatactcttctttggaaaaccttccgtcattggtgccactcaaggcatgatcactggcctggtttgcaacacccctgctgccggtgtggtgcaaggttgggcagcaatcataatgggaatgatgtctggaagcatcccatggtacacaatgatggtcctgcacaaagaaagtaagctactcaaacaagtagatgatacttcagcagttttccacacccatgccgtggctggtagcttaggtggcattttggctggtttctttgctgaccctaacctttgttatctcttctatggagtacaagattccttgcactatacgggtcttgtttatggcatattcaatgggaatctcaagacagggttcaggcaaatgggggttcagcttcttggcattgtttttgtaatacttctgaatgtcaccacaactagcattgtgtgtttgttggttaggatgatagttccacttaggatgagtgaagatgacttgcaagttggggatgaagcagttcatggcgaggttgcatatgcattgtggggtgatggagagaagcttgagactgctgctggtgaggctttaacttctgaaaagaatcatgaattgccaactgtggaacttataaaaagtttgagtgatgctccattaatcgattga

SEQ ID NO: 55221 - DNA, 156 bp, Glycine max
  Peptide Sequence Number=SeqID_171999
atgggtggtagcagtgtatgccacaaccgtgtcaactttaataaaaacttcgtaccccattacccagaggctcttcgctatgcgaaggtatgggggagggatattgtacgcagccttacccttgtatatgcaaagaggctattttcggatgcgaag

SEQ ID NO: 55222 - DNA, 637 bp, Glycine max
  Peptide Sequence Number=SeqID_172000
atggcagacaagatacggagggaagatactgttgccaactcaacagatcctgttctcatctcagacaaaatctctcagacagaaccagttagcggcatcgctgtgcaggatgacactgctgtaggggatcgtgttgcagtggtcgtggcgataatcttggacgggaagtgcgatgtcgatattggccgcgacgacaacaaaactgcttgtgtcgcaacctgtgtcatcgacagagggggcacctcctctccttttctggccatggggagcagatccaacagagtcggcatggtttttgtgcattgtcgcgccatcggtgtcgttggtgttgcagaaaccttaggtgaccttcgcgaatcatctgttggcggtgacttcatggtgtccacgggttgtagagatgtgttgtcaacgtggaacgcggtggcggtgaaatcaaagctaagacgggagaggttggtgtctatgttctgtggttccattattatggtctccacaggtgggggtgatttgggaggggatggagtgggtgtgaaagcagataggcgcctcttcaaagaggtccatcgtggtttggtggctggaaagacgcgaaccatggttgatgacaggggtagaggtagaagttccggcagag

SEQ ID NO: 55223 - DNA, 732 bp, Glycine max
  Peptide Sequence Number=SeqID_172001
atggacctctttgaagaggctgtatactactttacccagaacctatccaccatgaccaccaagacattggagatgaacgccaagcttgatgtcatccttaaccgcctatctgctttcacacccactccatcccctcccaaatcacccccacctgtggagaccataataatggaaccacagaacatagacaccaacctctcccgtcttagctttgatttcaccgccaccgcgttccacgttgacaacacatctctacaacccgtggacaccatgaagtcaccgccaacagatgattcgcgaaggtcacctaaggtttctgcaacaccaacgacaccgatggcgcgacaatgcacaaaaaccatgccgactctgttggatctgctccccatggccagaaaaggagaggaggtgccccctctgtcgatgacacaggttgcgacacaagcagttttgttgtcgtcgcggccaatatcgacatcgcacttcccgtccaagctgccccctctggtaacgaaacacgctgcggcgcaagtgattttgctgggggtgtttcgcactgtccaccaacattatcgccacgaccactgcaacacgatcccctacagcagtgtcatcctgcacagcgatgccgctaactggttctgtctccgtgccactaatatacattcactcattcctacacctattctaatttgggatccaggttcaatcttcctagagccaacaccttga

SEQ ID NO: 55224 - DNA, 369 bp, Glycine max
  Peptide Sequence Number=SeqID_172002
atgtgggccttccatacagggcgtcaactcgactgggcacacttagtcagatatcgcatgcataaggcattgcgattaaatgctccactaccatatccacagcttgttactctatttcttcgtcattttgaaattcttcttgattctgaatcttatattccaatcaagagatccattttaattggtgctgctgcaattgcttcttttggttaccgcaaaaagcgtgatggctcttggtttgatgccatggaattacaagttgacatgaggttcgatgctatggaatcaaggatcaccagagttgaagaagatgtctctttcatccaaacttgttttgatccaccacctccgcctccttcatcctcttag

SEQ ID NO: 55225 - DNA, 279 bp, Glycine max
  Peptide Sequence Number=SeqID_172003
atgggttgtcaaaatgtgcaaattgcccctacctctagcgccgacacgtggcttgctcctctgtgtttctttgttttgtttgcacccgatgttgtgttgtttttgtgtgttgtgttttttggtttccatttgcttgggttgaaaatgaaagaggttaagcattggggtattaagattgggttaaaactctctatggaatttacttcaggtcatggtttaccacaaggagctaagtataaactttctcttctgggacaatggatgcagaaaccttattga

SEQ ID NO: 55226 - DNA, 471 bp, Glycine max
  Peptide Sequence Number=SeqID_172004
atgtggctgtcaaatccttgtcggattgagtggctatcagtaaacttcttcctggccgtggcctgctggcccaatgatgggggtgtatcttcagaagaaggttttagtgctggagatggtgatcctcaagatggccaattacggagtgaagatcgagagctgaaggataggcttttacgcaagtttggaagtcacattggttatttgaaattggaattttcaaagaagaaaaagaggggtaagctgcccaaagacgcaaggcaaacactacttcaatggtggaatattcactacaaatggccataccctacggaaggtgataagattgcactggctaaatcaactgggttagaccagaagcaaattaacaactggtttattaatcagagaaagcgtcactggaaaccatctgagaacatgccgttctctatggtggatggtctcaccggtcggttccttactgatgaatga

SEQ ID NO: 55227 - DNA, 1299 bp, Glycine max
  Peptide Sequence Number=SeqID_172005
atggaaaagatcagtgaacagatgcacaacaccggttatggcacagcagttgtagggacaggaggaccagacactaactatggattggctcagtgctatgggctgtatagcttctatgacaagtacacagggccaggagacaaggctgtttgtggaaacacaacaaggaggagcacaaattttcaagctgcagcaaagaaggttgtttggagtgctgttcaagctgcaccaaacaatgaagggtatgctagggaggaggtttctgtggcaggaacagcaaatgattcagcctatgttctgctaattgttggaggagtttggacacaagaagggagagcattgaacactggatgcttcatgaggtactcagacagagattttcttaacaaggaacaggaaaaaggaagttcagaagataatgtattagtgatagtggttgcagtggtcagttcagtgattgttttggtggttggaatagctattgtggcttatatccgcaaacacagatatattcaaatgaaacgaagagttagccaagagcttcaccacaatagcttgaacttcaagtactctcttgaaaaggctactaattcttttgatgaagttaacaggcttggacaaggtggatttggaacgggagttcttgctgatggaagagagattgctatcaaaacattatacttcaacaacagacataaagcagcagatttctacaataaagtcaacataattagcagtgtggaacacaagaatctagtcagactcttaggatgcagttgctcaggacctgaaagccttcttatatatgaatatctaccaaaccgaagtcttgatcgcttcatatttggtaataactcaactcatgaaatagactgtctcatttcagattcgaaaatccctccatttcatgatataaaagccagcaacatcttattggatgcaaagcttcatgctaagatcgctgattttggtttggccaggggttatatggctccagagtacctagcacatggtcaattaacagaaaaagcagacacatggaagcattttcagtcagggactgcggaacaagtaattgatccatgtctagtgttggatgacaaccatagaagcaatgtcctgaatgagattttaagagtgttgcacataggacttctatgcacccaagaaatcccttccttaagaccatctatgtcaaaggcattaaagatgccaacaaagaaggaggagcacttggaattggaagctccttccaatccacccttcatacatgaaagtaccatggaactccatgactaa

SEQ ID NO: 55228 - DNA, 285 bp, Glycine max
  Peptide Sequence Number=SeqID_172006
atgaaatggaataacttatattggaggaagaattatttttcatgtgttagactttatgacttcctagcaaacaagaacaataacaatagccttatcccatcaagtgaggttgactataaggatcacacgacagccattgaacttggtaaaaaaccaaattctcaggaatattattcacttacaaagaaggccactggaagcaccagtgatgagagtagattgcatggcaaagaatgtacatataataagtataacaccaggtctggactgagacacaaggagtga

SEQ ID NO: 55229 - DNA, 975 bp, Glycine max
  Peptide Sequence Number=SeqID_172007
atgacgacggctatcgtacgcgaccagaacctggagaaacacattcacaaacagatggggtgcatggctggtttccttcagatcttcgatcgccaccagatactcaccggaaaacgcatctactcccacaaacgcctccctccggcctcgccggagccggaaaaacccgccgcctcaccgacgcgttcaacgccatcgccgcccagagaggtcgtgagttcagagcccaaggcgagtgtccccactctccccgttctcgaattcaaagaaggcacgcggtcctcgtggaagttcgcgagagaagctccgaggctgtcccttgacagcagagccatcgtggacgcgaaaggaacgctacaccttcacccgcgcggcgagatccctcccgaaaacgacgctgacaagcagcgtcgttccaccagtgtcattgccaagctcatgggccttgagcccttaccagattcggagcccgagcccgggcctgggcccgtggccaagctccagagatccgcgtccgagtccagagtccccagagatctgcctctgcccctaacgcagtgtcgtttcttcgaccccaacaattttaccgctcaggtcacaaccaatgtggttcacgagaataataataataataataataataacagttattatactaacaacaacgctgtcatcgattcacgattcgttagcagcagagtcgccgcagatccaccgaaacagaggttaaagaagagtttctacgactctgccgatttcttccccgagccaaaacacaccgtttcggtgtacggagagattgagaggaggctgcgggtgcgtgggataaacgagccttccaaggatctccacactctgaaacacatcttggaagccttgcagctcaaggggcttttgcataacagcaccaaaaccaaaccaatctcccattgtggttatgaaaccggttcgatctgtgaatcggaccgggagtga

SEQ ID NO: 55230 - DNA, 480 bp, Glycine max
  Peptide Sequence Number=SeqID_172008
atgagtgaggagaagaagaaagaaggagaaaatccaagtcgaggtgcttccgtaacgcttctgagatattttcgtgatcgattctgtggacgttcttcgttgttcttcaccgttcttcgttctccaaccgacgcacccgtgagcctcgcgtcgccctctcgccgaagggtaggtcgcgacaatggggaacaaacaaaacaaaagaagggcatggagcaagccaaagcagaggagaaaccaacacacaagaacaacaaaagaacaacacacagaaacaacggaagaaaaatacgtagaggagcagaaaggagaacaaagaagcgcaccgaccaagccaacatagaaaacaacaacacgacaggggaacaaagaaaagaaaagaagcacaccaagcaagccaacgcagaggagaagccacgtgtcggtgctggaggcagggacaatttggacattttgatagcacattcctttattaaatag

SEQ ID NO: 55231 - DNA, 936 bp, Glycine max
  Peptide Sequence Number=SeqID_172009
atgggtattaaacattttgaagtggtcaaacgaaggtcgcatgccgacaaacaatggttcccggacgacattagggactttgatagccttggaataatgaaagcaagtgtgcggataaccaaagggtgtctccgcatgctacctgacttctcacagctgggtatatctgcctgccgcctgactcaagggtcaggatcagcagatgttgtgcttgtacgaattaccgctgggtatatctgcctgccgcctgactcaaggggtcagaatcaacagatattgtgtttgtacggattaccgctgggtatatccgcctgccgcctgactcaagggtcaggatcagcagatgttgtgcttgtatggattaccgctgggtatatctgcctgccgcctaactcaaggatgttatgctgggtgcggataacccttaggtatatccgcctgccacctgactcatgggtcgggaaatgtgttagtacggataactacttaggtatttccgcctgcttcctgactcatgggtcagggtcagcaaatgttgtctttgtacggataatcgcagggtatatccgcttgctgcctgactcaagcagatgttgtgtttgtacggattacagctgggtatatctgtctgccgccctgactcaagggtcaggatcagcagatgttgtgcttgtacgaattaccgctgggtatatccgcctgccgcctgactcaaggggtcagaatcagcagatattgtgtttgtacggattaccactgggtatatccgcctgccgcctgactcaagggtcaggatcagcagatgttgtgcttgtatggattaccgctgggtatatctgcctgccgcctaactcaaggatgttatgctgggtgcggataacccttgggtatatccgcctgccacctgactcatgggtcggggtgacagaactatga

SEQ ID NO: 55232 - DNA, 273 bp, Glycine max
  Peptide Sequence Number=SeqID_172010
atgcctcaacttcttgctgctgcaacattcacatcgcctctattgcccgatcacatgatgtggatgtggattatgagctttctttgctctcccaaccccaagaggtctctgcccaaaaaatctcgttatcattcaggactagttgatgactcgtcaaaccattgcattgtaaaggcctttccaaaagccacaccaccttcaaggctgaatgatgctaaaatgtctctaacgtctcgtgcacacatgaaagtccaccaaggtcaggtgcattaa

SEQ ID NO: 55233 - DNA, 615 bp, Glycine max
  Peptide Sequence Number=SeqID_172011
atgggtgaagtagaggaggtgcaagagcagatgaaggccgacatggaggccatgaaagagcaaatgaccacaatgatggaggccatgatgagcataaagaagataatggaagccaatgcggttgcagttgtcgttaccagcattgttgctaaggtgaacctaacgcccccatctggcctcaaccaaatgaatcatccaacctcagatatggtaggcaaagatttgggaagtacgggtggccccattatgtgcaaattcaaaacaagcacgccttcccgccatatggcttgcctcccaactatactccacccaatgtggcgtacactcccaagccaacaacctcaatctgatcatgcacatgtctctcaacctatgggggagacacatgaaattccccaccacaatttagccgaattggagccttgcctcggatatgccactgaagggcaagccgttggtggtatacccctgcaaaacactttggaggggccctcaatttcgcccctaaccataacccttctatgggaaaataatgggttacacaccttcaagctttacggatttggtcttcgccggcgaaatgatcaaagtgggtctggaaagaggcaaatctga

SEQ ID NO: 55234 - DNA, 309 bp, Glycine max
  Peptide Sequence Number=SeqID_172012
atgttaggattcacaagcaattctcctcaaatttcagccaacccacatcaattagactttgcaccttatgcttcaaggtcatacagtgctcaatggaatgtcccgaaactcctccatgatatgcacatgttgtgttcgagtcgtatcctcggaaaaatggaggttgaggaaccctggcaggggttatggctatcattgcattatcaagtggtgtttgggcattgggcgtgtggtgagcaggcaggccgtgtggctgatttggggatggattttatggatgattgggtgaaagggactgttattggctga

SEQ ID NO: 55235 - DNA, 2355 bp, Glycine max
  Peptide Sequence Number=SeqID_172013
atggacacgccagagaggaaccagatcacctctactctctctaagtttgaggattcacctgttttcaactatatcaatagtttgtctcctataaagcccgttaagtctgttcccatcagtcagactttcaattcactgagcttttcgtcccctccatcggttttcacatcaccccatgtcagctgtctcaaggaatctagattcctccggagacataacccgttgggcacatcgaagcctaaggttccttctgaagatgtaattaaagttcactcaagtgaagagactcttgcagattctacacatgcacaccataactcaagtaaattagaggaggaaaacactggtaaagggatttcagtaagagatgcttcaatcgagctatctagggagcacataaaattttcagatgagctaccgcaagcgttaaaatataattgtggtagccctggctttgatcctccaccttgtggtgatgaggctaactctcttttggaattgcctggtgaggcagcaacagatgttggctatgttcaggaaggctgtaaaactgattctgtagaggttgaagtgcatcttcaggaagtatgtcagatggagccaaagagtgaaggtccagactgttattgggatagtttaattcctgatgccctggatatgctaatttttaattccccaggtgatgcagaagcttttaagggtctaatgcacaaacccttggcctcttctattcgactcaatgaatttatgtctatgctaccacattctaccatcaataatggtaggaaaatgcacattgttgattcagatgcttctggttctgcacctgaaattgaagatcattgttctgagctgatgacagccacaggcacgaaccaaacacaagataattttgccaatgttgctttagtgactagcaattcaaatgagaaagcaaacgaccagcttgtttctgccactcaccgtaccatacggaggcgctgtctagactttgagatggccaatgtgcaaaggaagaactctgatgagaattcaaacactggttctagtacatctgagtctgatgagaggaatgttgctaatgaaaagcaattgcttcctgcaaaacgcaatggggatttacagaggggaattttgcaaggaattggtctacacttgaatgcacttgctgccttaaaagaatacaagggcatacaaattgaaaaattgtcttctggaagacaactcagtctgcccagctctacttctttgcaaatctctacaagccaagaacatcagaatctatcattggtacctgtgtcatctgaaagagaattggatccatcagacaatggggttcagcctgctgaagattgttcccagccatcagcttacatggctggtgaagacttcaatcagaacagccccaaaaagaaaaggcaagtgaagcgtaagtcggagacaccaggagaaaccgagggctgtaaacgctgcaattgcaagaaatcaaagtgtttgaagctcaatggaatagtttactgtagttattgcgagtgctttgctgctggtgtctactgcatagaaccctgctcctgtcaggattgcttcaacaaacctattcatgaagacactgttcttcaaactcgcaagcagattgaatctcgtaaccctcttgcatttgctcctaaagtcatcagaaattctgattctgtacctgaaattggggatgacccaaataaaacaccagcttcagcacgacacaagagaggatgcaactgcaaaaaatcaagctgcctaaagaaatattgtgaatgttatcaggggggtgttggttgctccattagctgtagatgtgaagggtgcaagaatgctttcggtagaaaggatggttctgcttctgtaggcatagaaactgatccagaagaaacagaagccactgacaagggtgtgacagaaaaagctttacagaaaactgaaattcagaatactgaagatcatcccgattctgctactgtggcaacaccattacggctttccagaccattgcttccattgcctttttcatcaaagggaaagccaccaagatcttttgttacaaccatctctggctctgcattgtttgccagccaaaagcttgggaaaccaaaccctctttggtctcaagctaagcattttcaaactgttccagatgaagaaataccggatattctgcaaggtgatagctctcctatcacttgcatcaaaacctcttctccaaatggcaagaggatctcctcacctaactgtgacttgggatcatctcctagtcgcagaggtggcaggaggttgatattacaatccattccttcatttccttctctcacccctcacccttag

SEQ ID NO: 55236 - DNA, 1424 bp, Glycine max
  Peptide Sequence Number=SeqID_172014
tcttcgtcgcgaacttcctggccgcgatggacgcgctgacccctctcaccacctcgcacggccacggcgccgtctttaacggctcccaaaacgccaccgttttcgctttcggcgagtgcatgagggacctctcgcagaacgactgcaacctgtgcctggcgcagtgcaagacgcagctcctcgcctgcctccccttccagagaggcacacgtggcggtcgcttgttcttcgatggctgctacctcaggcttgttcttcgtggtcaagtcaatcttataactccctcagtctcctacttcaggtacgatgactacaacttcttcggcgaaactcgaagcgaccaagacaccaccgtgtgtggaaataatagtagtaacaacaattctaacagtgctgcaaatagtgctactaacagtagtagcggtgtttataaggcaaatgctatggccttggttcggaacctgagtgggttggcgccgaagaacgatggttttttcgttgggtcggtggagagaaagaacgtgagtgtctatggattggctcagtgctgggagtttgtgaatggcagtgcttgtgagagatgtttagcggatgctgtcacgaggattggttcgtgttcgacgcaagaagcgagggcgttgagtgctggttgttacttgaggtactcttctcagaagttttataacaattctagcgatgttgtaaccgctggaaaacatggaaaacgtactctagttaaaattctggctgcgtcttctgctgccctggctcttctgctagttgttgtgacagttgttttctttacaaggaagaatgtggtgacaaggagaagagaaagaagacagtttggcgctcttctagccacagtgaataagtccaagctaaatatgccttacgaggttcttgaaaaagcaacaaattacttcaatgaggccaacaagcttggacaagggggatcaggttctgtttataaaggagttatgccagatggaaatactgttgccataaaaaggcttagctataacacaacacaatgggcagagcatttcttcactgaggtcaatttgatcagtggcattcatcacaaaaatctagtgaaacttttagggtgcagcattacaggacctgaaagccttcttgtttatgaatatgtgcctaaccagagcctccatgatcacttttctgttagaaggacttctcaaccgctgacttgggaaatgaggcagaaaattatattaggaattgcagagggcatggcctaccttcatgaggaatctcatgtgagaatcattcatagagacataaaattaagcaacattctgcttgaggaggacttcacacccaagattgctgattttggacttgctagattatttccagaagacaagtctcacattagcacagccattgctggcacactgtaa

SEQ ID NO: 55237 - DNA, 1248 bp, Glycine max
  Peptide Sequence Number=SeqID_172015
atgcattttccgatgaaaattcagccaattgattcccaggttccgtccgaagggactcggcttgagctagccaagccggttgtgaagtcacgactgaagcggctcctcgagcgccaattctctggcgttctcagaaattcggcgccggaaaagattgccggaggcgatgaaccgcttaacggcgccaaggatttcgagccgagctcggcgtgtttggcgaaaatggtgcagagtttcatcgaggagagtcacgagaagcactccgcttcacaccaccgcaaccgatgtaactgcttcaacaggaactacgacgacagctcggacgaagactcgaactcgttcggcgactccaatttctcctccggcgaggcctgcgaaactctcaagggtttggtagcgtgcgcgagcgtgcgcgataggagtttgcttgcggacactgcgaagatagttgagaagaataagatctgcaagcgcaaagacagtttctgcagaaaaattgtcacagacggattgttagccctcggatacgatgcttccatttgcaaatctcgctgggaaaaatctccttcatatcccgctgggggatatgaatacatagatgtgatgatggggaaagagcgagttgttattgacattgacttcaggtcagaattcgagattgctcgatccaccaaagcgtacaagacgattctccagaaccttccctacatattcgttggcacgtgcgagcggttgcagagcatcgtggcgctcgtgtcggaggcagcgaagcagagtctgaagaagaagggaatgcacgtgcctccatggaggagaaccgaatacgtgaaagcgaagtggctctccccttacacgcgcactcacgatatcaaagaggagaagaagaaggaagaagaacaacaacagctttttaaggacaatttaaacaccgcggagtcagagagttccggcgaagataacacggcggttgtcgaatggaagccaccggagttgaaacctaagggttcgctttccggcgtgaaggttgtgactggtttggcagtggttggtggtggattcggttggtggcggtttggttgggtttgggtcgctgttggttggttgtggtgcgttgaggttggtgactgtggtaatggggttgtgacgtcggcggcggcgatcgagtggccctcccgatggtttgttgcggttcaggaagcggcgttggtgtttggtggaacggtggttatggaggtgaggtatatatag

SEQ ID NO: 55238 - DNA, 612 bp, Glycine max
  Peptide Sequence Number=SeqID_172016
atggtttcagtttttcacttcctcgtcaaatcaggatcatcagggtttggtgttgggcacatgcgtgacacaaagacaaaaggaatatgggtttggggaacacctatagatttggatattaatggagtaagaacttctgtcttttaccttgatacagaaggatttgaaagtgttgggaagtccaatgtatatgatgatcggatatttgctttggcaactgtcttgagttccgtgctcatatataatttgcccgagacgatacgtgaggctgacatctctcgactctcttttgcggttgagcttgctgaagaattttatgggagagtgaagggtcaggatgttgcatttgaacctgctaagctcttatggctcatccaacgtgattttttgcgagatatttacagcaataaaaaaatattcttacatcatgtcagcctatatcaatcgtggggtgaacctggtgttgaacccatgagaaataaaaacctagagaaacagtaccctcacaaagaggagtttgtacaattgatccctgaaattgacagaggaaaggctgatgaggtgaatggcactggcagcgagtttggtggtggtgtcccagggagaggctga

SEQ ID NO: 55239 - DNA, 222 bp, Glycine max
  Peptide Sequence Number=SeqID_172017
atgcagcaagccatgcagggttgcagctgcagcagggtggattcgccaatgagtatggcgggatgcgcttcaccgggaatcgtcaagttggctggcgatttgctttatttcaaacgtgtccattataaaagcaggaactcagctacacctgctacgctttcttcttcttcatattactgcactacattgctgttctttttgttttgtttctggtttagatag

SEQ ID NO: 55240 - DNA, 225 bp, Glycine max
  Peptide Sequence Number=SeqID_172018
atgcattgtaagcacaagaacaaaggcaatgatgagagggcagggtccatggaaggtgcattaattcaagcaaaagcaaaaaaacttaggaacaactataacaacaaagaagaatcctctctagcttgctctcgttgcaaaaagaaaaatcattctcgacagaagtgttattggaggcctgatgttaagtgcaaaaaatgttacaaccttgggcacatggagtag

SEQ ID NO: 55241 - DNA, 771 bp, Glycine max
  Peptide Sequence Number=SeqID_172019
atggtgaatgaagctctgagacgagtccccaatactgatgggaacaaaaatattgatatggtcaatcaaatccgagattcattggctgttatgggtgacaacagtactgcctttagcttaccgcaaccacatatccagcggacaaagctttgtgatatggaggatgtggagcttgatcaattatatgtcaagagaagggagcaattgaaagagcttgttgctagcataatcactccaaagattgtacagggaaagactctaaacgggaaggagtttgtctcctttctggagcagatacttgaagccttgaacaaaggagagattccatcaacaggctctcttgtggaggttttcaacaagaatattcttgagaaatgtctgaagttatacagtgaaaagatggcaaaattagttctacctcttcctgaggaatctctgcaaggggcccatgataggtctagagatgaagtcacaaaagtctttgatcagcagcattttggtcgtcaccatgctaagaaatcatttatgcagctggatgaagaaatacaacaggtgtataagaatgttgttttgcaaaacgagtatcaatcttcaaggctctgtgaggcgctgtacaccagatgtgaggacaaaatggatcagcttcaagttctcaaacttccttccttggcaaaatttaatgcaggtttcctgcaatgcaatcgtagttttgagcatgaatgtgttggaccttcaaaaacaaattacgagttacgcatgatgaaggtctga

SEQ ID NO: 55242 - DNA, 300 bp, Glycine max
  Peptide Sequence Number=SeqID_172020
atgacaaccaatgaagacaaggaatggacacttttaatgagttttggagcagtggcatgtgcctcatccacttctctttcacacaagccttgtacgtggttaggtttgtgcccttttgaggagacacaaaaccctaatccttggatttggttgggggttggccaatgggccaagaggcttaaagaaaaacaaaatgagagaaaagggttagacagaggcccacgtaggattaaaaaaaaggctggaaagtctgctactctgacgtatagattcgaagttgtacctcctatcgccctataa

SEQ ID NO: 55243 - DNA, 213 bp, Glycine max
  Peptide Sequence Number=SeqID_172021
atgtcgctatgcaaaggatggtcgcagactccgaggtcccatcgtgcttcaacttcaaccccgtgctacaatgcaaataagttttgccctttgtattcagtggacagaataaattttatagaagtgttcagacatggcccaacacagaacgggccttattgtacaaacgtgcaacaagaagaggggcccggtttgaggacatggtggacttga

SEQ ID NO: 55244 - DNA, 852 bp, Glycine max
  Peptide Sequence Number=SeqID_172022
atgggaatgggggctagtttattacagtctacaaaactgggctccaaccaatgggccgaaacccaaccgttctgtccgaaaccgattacaaattttccagttcccttatctatccgcgctgtggaaagaacgaagacacgggaaagaaaaatggtgctagaacaagcagtatcatcatcaagcaccttgaggaacgttttcaccaatcccaaaaccctaatttcaaaaccccaattccaagtcgccgcttccccttcatggaaaccacagcagccgcgctgggaagggtggctggggataaacttgaagtgctccatgacaacaacaacaacgccatcatcataccctaagccctcggagattccgtggcagaaggaactctgcaactccgtcaacctcatcggcaacgtcgccgcccccgtcgaaatcaaatacctcccctccggcaaggtcgtcgcctggacccgcctctacgtcaagaaaagcgccacacaatcatcgcccataaacctcactttctgggacgacctcgcgcatgtcgcttcccagcatctccagaaaggtcaccagattcatgtctctggtcgcctcattaccgacactgttgaaacggaggaaggaaaaagccaaacttactacaaggttgttgttcaacagctgaatttcattgagaggaatttctcttcggtgtcatcatcgcagggtcaagagtttgattttgcgatggctggtagtggtaggaaagtgagcaatgctgcaaacagtactggttctgtggtggaaacatggaatgcgttctttgctaacccaggggagtggtgggacaataggaacaacaaggtgaattcttga

SEQ ID NO: 55245 - DNA, 486 bp, Glycine max
  Peptide Sequence Number=SeqID_172023
atgagttttgctagggtttttgagcatagtgagtcctcgaagggaaaaccttccttagaggaggaggaaaacctcgtaagaagcacaaaaaaacataagaaggatgtggtaactattgaagatggctctgatggagaagttgatgaaggttggaagatggagaagagaatgtttgacaactttccaattgcaaacaacacttacaacacaaacgagttgggttggaaagtatccttgtcggataaggagtgggagaaatggtcgaagccatggaggaagaccttggttgtaaaagtgcttggaagatgtgtcaatttttgggttctagaagctaaactccaacgaagttggacgaaaggaggatctatcaatgacaagtctgatgatttctacttagtcaagtttgctatagaagaggactacaacttagcactctttgagggccctcgaatggtggcggatcactacttaatcgttcaaaggtag

SEQ ID NO: 55246 - DNA, 282 bp, Glycine max
  Peptide Sequence Number=SeqID_172024
atggtgggagggtgtttcggtaatttgggagaggtggaaggggtaggaactagtattattggaggaattagtagagaaggtggagtgagtgtgtggtggtgcatggtggaagaagggggtgttgttggtggaagtggtggtgttgggaaggaattggaggaggtgagagttgtccatggcaaaggcaaagtggtgcatgatgatagggtaggtgtgaggggggctaataataagaagggactgagtgagtgtggtacagtttttcagtttttgtggtcgtga

SEQ ID NO: 55247 - DNA, 582 bp, Glycine max
  Peptide Sequence Number=SeqID_172025
atgggaaagtacgaaaaagagcttaatctcgaggctacagagttgagattggggttgcctggaagcgatgagcctgggaaacgttctattgttagaagcaataagagatcttcaacagaagcaagcgaggaagagtgcataagcaagggcaacatgaattctaatggttctgatatcacaagtgatgaccaagacaaccttgtgccacctgcaaaaaaaaatatatatatgatagatgcatggaagaatactctacaacaaaagaaagaggaacagggtgaagggtctgggatgtacgtgaaagttagcatggcaggtgcaccttacttaaggaagatagatctaaatgtttacaagagctacccagaactactcaaggccttgggaaatatgttcaagtgcacatttggtgaatattcagaaagggaagggtacaatggatctgaatatgctccaacttatgaagacaaggatggggattggatgctggttggagatgttccatggaacatgtttgtgtcatcctgcaagagactgagaattatgaaagcatcagaagcaaaggggttgggttgtttttga

SEQ ID NO: 55248 - DNA, 270 bp, Glycine max
  Peptide Sequence Number=SeqID_172026
aggaatccaaaagctcctgatttcaaacacaaagatacaggggaagctctgtggatcgaaggcagatacaatccgccatgggtcaagtctcaactggaaatactagactcaagaatggggtcgtttgctagtcaaaatgctaggatgcctgtagtactgataatggttaagtttgcccttgagctatatttagttagtgatcaagtgattgtgttgcattcagcattctctattcctgttgtgcatttactggaatcgataaagcactaa

SEQ ID NO: 55249 - DNA, 1537 bp, Glycine max
  Peptide Sequence Number=SeqID_172027
atgatcaagctgattgatgaggaagcagattcatttgcaaggagggcagaaatgtactataagaagcgtccggagctcatgaaattagtggaggagttctaccgagcataccgtgctttagcagagagatacgatcatgcaatgggagagctacgccatgcccacaaaacaatggcagaagcatttcccaaccaagcacattacatgctgaccgatgattcgcagggtgttgaatcacacactccaggagtgccttgtccaaattattccgagtctgagcatgcagagaaagcagatagtgaagttcaaaccttgaggaaagccctggccaaaatacagtctgacaaggatgctatctttcttcagtatcagaagagtatggagaagttatccgaaatggaaagagatcttaataaggcacaaaaagatgctggaggccttgatgaaagagcaagtaaagcagaaattgaaactagagtgttgcaagaagcactggcacatctaaaatctgacaaggaagctagtcaagttcagtacaaccagtgcctagaaagtatagctaaactggagactctgttatctcttgcccagctggatgtcaaggaatttgatgagagagcttctaaggctgaaattgaagccaaaaatctaaagcaagaactaggccagttggaagctcagaaggatgctggtcttcttagatacaagcagtgtgttgaaaagatttcagttttggaggccaagataacccttgctgaggagaattccaggatgttaaatgagcaacttgaaagagcagaactggaagttaaagcgcttagaaaagatcttgctgaactgaatgaagagaaagaatctttagctgtcctttaccatcaatgcttggagaagatatctaaaatggagaatgaaattttgcttgcccaagaaaattctgaaaaactaaatagagaaattgagaaaggggctgaaaaactcaagacttctgaagaacattgtgatatgttggagaaatcgaatcaatctcttcgactagaggctgaaaatctgctgcagaagatagctatgaaggatcaagcacttttagagaagcatgctgagatagagaggctgcagactctagtgcatgaagagcattctcactttcttgagattgaatctactctacagactctgcagaagttgtactctaagtcacaacaggagcaaggaagtcttgttatggagcttaaatatgggcttcagttgttgaaggatttggagtttccgaaacagggttttaaggaagaaatgcaagagaatgtgaaagaaaacaggatcctgaatgaacttactttctcttccactaggtcgttattaagaaggcagcaaacagaaatctctaaattaaaggagatcaaagagaaactggaacgagagcttgttgtaaactctgaagaaaacaatgccctccagcaggaagctcatcaaataaagaatgatatccagctcttgaataataaatatcatgctatgctggaacaactacagactttag

SEQ ID NO: 55250 - DNA, 460 bp, Glycine max
  Peptide Sequence Number=SeqID_172028
agagggcggtgtcggcggtgctgatgagggaaatcctgccggtgttgaagttctcggagatggagatgccggtggaggcggcggagagctgcgcggtgtgcctgtacgagttcgagggagaggacgagatcagacggctgacgaactgtcgccacatattccacagagggtgtctggaccgttggatggggtacgatcaaagaacgtgccccctgtgtcggacacccttcataccccaccatatgcaagctgcattctattacaatcatcactagattggcctctttttcttttttctggatcttctgttaaggttgttgaaagaaacttgatttggattgtgaagacgtgtttgataggaagaaggtatagctgtgtgctgcgtagaggtaccgacactggtagcggtagcttcctttttcagttttatctccatggaagtaagacagagaaagcttaa

SEQ ID NO: 55251 - DNA, 1194 bp, Glycine max
  Peptide Sequence Number=SeqID_172029
atgagagatgacaactcgaagaaaagcaagctttcatggcccaaaacgttggtcaagaagtggttcaacattaaaagcaaaaacgaggactttcaggcagatgatgtcctctacgcaggtgtcaatcaagagtggaggaactgctcacagagggaggaagacactatcaagagaagcaaaacagagagagcaaagaggagacactcagatagaatgcggcgaggtagaattgaccgtgatgcagctccggttacagatgtgcataactatagaatctttgctgccacttggaatgtagctggaaaatctcctccaagttatttgagtctggaagattggcttcactcttctcctcctgctgatatctatgttcttgggtttcaagaaattgtacctctcaatgctggcaatgttttgggcacagaagataatggccctgccagaaagtggctatctcttattaggaagaccctaaacagtcttcctggaacaagcggtgaatgccacactacttcaccgctccctgaccctattgtagagttagatgctgattttgagggatcaatgaggcagaagacgacctctttcttccatcgccggtcattccaatccttgagtcatagtatgagaatggacaatgacatgtcactaccacaagcatgccttgatcgtcgtctcagcgtatgtgatagaatgatgtttggtcacaggccaagtgactatgacccctgttatagatgggcttcctcggatgatgaaaatggccctggtgactccccagttgtaacacattattcaccaatgacatatagaggttgcttctctatggaggatagatttagacagacaggacagtcaagatactgtttggttgctagtaagcaaatggttggaatatttctaacagtttgggtgaaaagtgatataagagatgatgttcacaatatgaaagtgtcttgtgttggcagaggattaatgggatatcttggaaacaagggttcaatatcaattagcatgtctttgcaccaaacaagcttttgcttcatctgtagtcatttgacttctggacaaaaggaaggtgatgaactaaggaggaattcagatgtaatggagattctcagaaagacaaggtttccccgagttcaagacatgggagatgagagttctcctcagacaattctggatcatgagtaa

SEQ ID NO: 55252 - DNA, 1116 bp, Glycine max
  Peptide Sequence Number=SeqID_172030
atggctgtgttacctttctcatactcaggatttcccactctatctctcccgttatctcaacaaaaacggcttaaaacgaaaccaaattccaacacaaacacatgctcactaatccaatgctgccacaaccaaacagaaccaatcgaactaaatggccaagccagatttccagagaagaatcctcacatcaaccctgccgctgcagttccaccaaggcctcgaaggataatccttgttagacacggagagagtgaaggaaacgtggatgagagcgtgtacacaaggatacctgatccaaagatatccctcactgagaaaggaaaggtccaagcagaggaatgtggtaaaaggattaagcaaatgattgagaatgaccatgaccaacattggcaggtttacttctacgtctctccatatagaaggacccttcaaaccttgcagcacctcgctcgtccttttcaacgctcaagaatcgctggcttcagagaagagcctcgcattcgagaacaagatttcgggaattttcaaaacagagaaaagatgagagtggaaaaggcattacgccagcgttatggtcgtttcttttaccgatttccagatggagaatccgcggctgatgtatatgatagaataacaggattcagagaaacgctgagaacagatattaacattggacggtatcagccacctggggagaaaaaaacagacatgaacttggtcattgtgtctcacggactaacacttcgagtttttctgatgaggtggtacaaatggacggttcaacagttcgagagtctcaacaacatgggaaatggaaatatgcttgtcatggaaaagggttttggtggaaggtatagcttactgatgcatcatggagaagaggaactgagacggtttggattgactgatgaaatgttgattgatcaggagtggcataaatttgcaaagcctgctgatctgaattacgattgtccaatggtcaattccttctttccccacctcagtgaagaagcatgcagttcccgtatgaactacttcatgatcacgtgtgggtatctaactcctcaattattcagttacagttgggtaggatcaatcggtttgttagcatcctaa

SEQ ID NO: 55253 - DNA, 861 bp, Glycine max
  Peptide Sequence Number=SeqID_172031
atggaagtaatgacaactgagatagacaatctacggaagcagctgtcagacttggaaaagagtcacaacaatttacaggaggatagttgcaagatattggaagagaagaagtccttgacgagaagttttctatatctgggtgaagagaaaagtaacttggaagaagaaatatgtgtcatgatccatgagacaatagctcaatctaatatttccctgatttacgagaatgttatctttgaaaagctcctggaacttaaagagctaggtgaagatcttgataaacattgttcagcaaataatgaccttgatgagagattaaaagtaatggtgtgcaaattagaaaatgcagaaatggaaaattcacatcttaaagagtcattcataaagtcaaatgttgaactacatttagttgaatctatcaatgatcaattgagctgtcagattagtgatgagagggagatgttgcatcaaaaggaaaatgagctgttggaagcagctgagatgtttcgtgttttacatactgagaaaacagaattgcaaagaatggtggaagatgtcaagattaaatatgatgaagccagggcgatgcttgaagaacaggctaatcaaattttgaaattgtccacagacaaggatcatcaaaatgaagagctcacatgcctgtgtgaagtgaaccagaagttggagtctgaaatggggtacctacgtcaagagcttggagaaactaaactgagggaaaagaagctaggtgatacagtacttaagggaacaaatgagattgaacaatgggaaactcaggcttcaacactctttgctgaacttcagatttccgctgtcaatgaaacattattagtgggaaag

SEQ ID NO: 55254 - DNA, 987 bp, Glycine max
  Peptide Sequence Number=SeqID_172032
atggggtacctacgtcaagagcttggagaaactaaactgagggaaaagaagctaggtgatacagtacttaagggaacaaatgagattgaacaatgggaaactcaggcttcaacactctttgctgaacttcagatttccgctgtcaatgaaacattattagtgggaaaggtctctgagctagctgagatgtttcgtgttttacatactgagaaaacagaattgcaaagaatgatggaaaatctgaagattaaatacgatgaagcctgggtgatgcttgaagaacaggctaatcaaattttgaaattgtcctcagacaaggatcatcaaaatgaagagctcatatgcctgtgtgaagtgaatcagaagttggagtctgaaatggggtacctacgtcaagagctcggagaaactaaactgagggaaaggaagctaggcgacgaagtacttaagggaacaaatgagattgaacaatgggaaactcaggcttcaacactctttgctgaacttcagatttcttctgtcaatgaaacattattagagggaaatgtctgtgagctagctgagatgtttcgtgttttacatactgagaaaacagaattgcaaagaatggtggaaaatctgaagattaaatatgatgaagccgaagtgatgcttgaagaacaggctaatcaaattttgaaattgtccacagacaaggatcatcaaaatgaagagctcatatgcctgtgtgaagtgaatcagaagttggagtctgaaatggggtacctacgtcaagagctcggagaaactaaactgagggaaaggaagctaggtgatgaagtacttaagggaacaaatgagattgaacaatgggaaactcaggcttcaatactctttgctgaacttcagatttctgctgtcaatgaaacattattagagggaaatgtctgtgaactagctgagatgtttcgtgctttacatactgagaaaacagaactgcaaagaatg

SEQ ID NO: 55255 - DNA, 507 bp, Glycine max
  Peptide Sequence Number=SeqID_172033
atgaggactttatcatttgttgaagacagatgtttgatcttggaaagcagcaagggaaaattgggttcctctaatagcgtctcttcattagtatcaatatgctggaaggtgctgatggatgttataattgggaatttgatgtttcttttaactttcttctttatggttaagatgtttttccatgtatcgatcaccatctccaggtgcattgaccttttgcttacactcatgatttcaagttacttcaagatttttcttattgccatgatggtctgggactttccatcttctgtgatcttcatcattgaattattttgtttatcatctaatgctgcggcattgaaagtgatgactgagtcaactatgcgtcgatgtgtttggacctgcttcagtgcatatgctataaaatttattgtcactcgaatactggagctcatattgttggggcaattaatgcaaggctggagtcaaatgccattcacattctctaaagccaccatgatttag

SEQ ID NO: 55256 - DNA, 507 bp, Glycine max
  Peptide Sequence Number=SeqID_172034
atgatatggctaaagcaggatcggacaaaagtctactttgcggaagggctgaaagaattcagaaaagatttatcaatttacgaatctgtgatcattaaattcttggcatgcaacgaaaaatccatgtttgatctttatttcgttccctcactggaatgccagacttgcggaaggccagaagttatgtcaagacaacatatttggacacttgaaatcgcacaatcaattcttggtgcaccaggaccactgagacttcccaattgtgccattacacatgtaaatgcctgcggtcaacacatgaccattctcaggagatttggaccaccattacagtggaatgttgtggtggttgatggtggagttaggcgcagatatgttgtccaaccatggtatcaattcattgcagataatgatttctcccacggtgatgaagtctccttctattacaggaccattgataaaatatgggaaattgtcatccgccaaagaaagaattgggagtattag

SEQ ID NO: 55257 - DNA, 321 bp, Glycine max
  Peptide Sequence Number=SeqID_172035
atggggagtccacgtgcaccatcatcagcaaggaatgttgtcaggaatttaccttcctatccaactcaccaaatggaggcaagcagctatgcatttatgattttgatgaccctatcagctttctatgcagccgcaatatttgaagctgggtgtagaaactaccctgctccaatgcaagctgcagtagagccaacggaggactcgatcactacccttgtctctatgggctttgacaggaattctgccagacaagccctagtgcaggccagaaatgatgtcaatgtggccaccaacatcctactggaggcacagtcgcactaa

SEQ ID NO: 55258 - DNA, 1659 bp, Glycine max
  Peptide Sequence Number=SeqID_172036
atggctatctctcgtgtacttgctatactcattcttcagtactcattagtagcactagtttcttcagctggaccacgaggtggctggaaaacattgcaaggatctccacctctggtcatagcacgtggcgggttttcagggatatttccagattcaagttcacttgcctatagtttgacactagatacttgtggcccaaatgtgactctatggtgtgatgtgcaattgacaaaggatggtgttgggatttgtttcccagagctcaagctggacaatgcctctgacatttccattgcttacccaggcaaggcaaaggattacttagttaatgaggtctcaacccggggatggttttctgtggactacaacttggcagaactagcaaatgtctctgttgttcagggggtatattctcggactaataagtttgatggtaacaagcttcccattcgcagtgttgaagacgtagctaaattaataaaatcaccatctacaggcctgtggctaaatattcagcatgattcattcttcaagcaacaaaatttgagtgtagaaaattttctgcaatccctccctgctaaaagtgtacctgtcaattacatctcatcacctgatgtggatttcttaagaagagtaaaatcaagctttagttctggaccaactggcttcatcttccggtttctcgagcagtctaaacttgaacctacaaccaatcagacttatggtgaactcttgaaaaatctcatgcttatcaagacatttgcttcaggaattcttgttcccaagggctatatatggcctgtagactcaggcctttatctacaaccacatacccctcttgtcactgatgctcatagagaagggctgcaagtttttgtatcagaccttactaatgatgttccatttagctacaatttcagctatgatcctctggctgagtgtctatctttcatcgatggtgatgatttttctgttgatggtgtgctgtctgacttcccagtaactccatctgcagccataaattgcttttctggcctaggaaaaaatgccaaaaaacaagtggacactttggttatcacaaaatatggagcaagtggagataatcctgcgtgtactgaccttgcatataatcaagctaaatcagatggggcagatgtacttgactgtcctgttcaaatgtccaaggatggaatacccttttgcttaagctctatagatctatcagagagcacaacagttgctgatacacaattgaaaaaccgtgcaacgactattcccgagattaaatatcgcagtggcatatatacattcagcttgacatgggatgagataaaaacattgactccctcaatattgaacccttatgagaaatacatattgtcccggaatccaaaatccaaaaatctaggaaaacttataaccttgtctgactttttgtccctgactgaaggctctcgcatcttgattagcatagagaatgcagcctatcttgctgagaagcagaatttacgtgtgactgatgcagtccttgatgctttacagaaagcaaaaccaagatcacataaaataaatccaaaatttgaaagggtttacaaggttgatgagaacattggcggtgcagctgactcggccattgaggacatcaaaacattttgctga

SEQ ID NO: 55259 - DNA, 906 bp, Glycine max
  Peptide Sequence Number=SeqID_172037
atgccacagaaaaaaggttgcagttttctgaatgagcctcgtcttgttgccaggaaattcttggcacgacctcagattgagggtgtcggggctgttgttagaagaagcataggacggtttgagctcaagtactttgatcccttcattgtgttggatgaattctcagaataccaactaagctactaccaacttgtacctaaagttgtgatttgtgaagttataatgcatgaagattttgaaggacataagggaacaatagaagctggtgacttgcaatggatgactgcagggagagggatagttcactcagaaatgcctggggctcaaggaattcactcaaaaatgccaggggctcaaggaacccaaaggggtctacagttgtggatcaacttggcttccaaatataaaatgattgaaccaaggtatcaagaagtgttgagtaaggacatagcagaagctgaggatgatggtatcaaggttagagttatagctggtgaagcactagggataaagtctccaatctacacaaggacaccaaccatgttcttggacttcactctcaaacctggaggtcacttgcaacaacctataccaaaatcttggaatgcttttgtgtatgtattggaaggagagggtatctttggaaacatgaaatctcagccttcaaattctcaccatattcttcttcttggtgctggggatggcctagaggcatggaaccaatcttctaagctccttaggttcattttggttggagcagaacctttgggggaacctctagtgcaatttggaccctttgtcatgaacacacaagaagagattgaccaaaccattgatgattttgagaactttgccaacggatttgagaaagcaagacattggagatctgaaagccaaattaattaa

SEQ ID NO: 55260 - DNA, 684 bp, Glycine max
  Peptide Sequence Number=SeqID_172038
atgaacaaaagaaccacgttgcttattcgaaccctcttgttcctcttcgtcctcaactccctctatctctccctctacttcacccacaaaccctcttattcttctccttcagaagaaaaagaaaaatcagaactcgaaccagacacatacctaacacccttttcacacgaacctcactcttcaaagccatggcctattctcccttcctacctcccctggaccacttctgcgcgatcccactcctgcgaggcctacttcgggaacggcttcacgcggcgccgcgacgccctccttccccgcggcggcgcggggtggttccggtgccaccacaacgacgcgctccgtagctcggtgtgcgagggcgggaggctgcgcatggagcctgagaaaatcacgatggcgaagggtggcgaggatttggcggcggttatggggcgcacggaggacgaggagatgcccgtgtttcaaaacggtgcgtttcaggttgacgggggtgaggtcgccgttgaccggaaggttctggttgaccaagagtttttggatgagtatgtgccaaggggagggattgatagacacaccatgcgggatttgatcgccaagattcggatcgtgagagggaaggattttcaatgtgatgaggaaattgtgactgatgtggactcaattgtggtcacggacacttaa

SEQ ID NO: 55261 - DNA, 198 bp, Glycine max
  Peptide Sequence Number=SeqID_172039
atggtgattctagactaccagattaaaagggtctgttggatcatggtggtgctgttggtgttgaggtcgttcgcgctaagccttggaggttcatatctggggccaaagatggtgcaattaggtggaggcgcgatgagggggttaagggaatgggaagtggtaggagaaggagaggggttatggggtgtagggatttag

SEQ ID NO: 55262 - DNA, 2520 bp, Glycine max
  Peptide Sequence Number=SeqID_172040
atgcgtggtggtggcggcggcggcggcgaagtcgaagtgaaaagggtgtttattggagcgggatgcaacagaatagtcaacaacgtttcatggggtgcttctggtttgctctcttttggagctcacaacgccgttgctattttctgccccaagagtgctcaaattttgactactctcccgggtcacaaggcagttgtgaattgcacccactggcttccatctagcaagtttctatttaaagcaaaactattggagcagcactatttgctatctggagatgcagatggtgctattattttgtgggaactgtcccttgctgatgggaagtggaggcaaatgttacagctgccacaatcacacaagaaaggtgttacatgcattagtggaattatggtttctcaaaccgaggcaatctttgcatctacttcttcagatggcactgcttgtgtatgggaacttgtatttccaacgactggtagcggtgactgtaaattatcgtgcctggattctttctctgttggttccaaatctatggtagccctatcgttagctgaactgcctggagatagtgggcaaattgttcttgcaatgggaggattggataacaagattcacctttattgcggtggaaggaccagaaagcttgtacatgcatgtgagctaaaagggcatacagattggatccggagtttggacttctcattacctataagcatcaatggggaagtaaacaatatttttctggttagttcatctcaggataaaggcattcgaatttggaagatggcattacgcagctctatgtccaatggacacggcatagacaagaaaggagaaataagcctatcatcctatatagaaggtcctgtgcttgtggctggttcatcttcttttcagatatccttagaatctcttttaattggacatgaggattgggtatattcagtaatgtggcaaccccctttggttgcatccatggaaggggatgcctattatcaaccacaaagtatcttatctgcatctatggacaagactatgatgatctggcaacctgaaaagacttctgatgtctggatgaatgtggtcactgttggggaactaagccactgtgctctggggttctatggtggccattggagcccgaatggagattcaattttagctcatggatatggtggatctttccatctttggaaaaatgttggtaatgataattggctgccacaaaaggttccctctggtcattttgcatcagtgactgatattgcatgggctagatctggtgattatattatgtccgtcagtcatgaccagacaactagaatttatgctccatggaaagttgaggctcctctccaagatggagaattttggcatgaaatatctcgccctcaagttcatggacatgatataaattgtatggcagttattcatagtaaggggaatcatcgttttgtctgtggagctgaagaaaaagttgccagagtatttgaagccccattatcatttttgaagacattaagtaatgccactttgcagaagtcctgttcttccgatgatatcatgggagatgttcagattttgggtgcaaatatgtcagctcttggactatcacagaaacctatttatgttcaagctgtgcacgaggcccctgaaagaagtggggtcaatggcctcgacacccttgaaactattcctgacgcagttccaactgtgttcactgaaccaccaattgaagatcaactagcttggcatacactttggcctgaatcacacaaactctatggtcatggaaatgaactattttctttatgttgcgatcataagggtgagcttgttgcttcttcatgtaaggcccaatctgcagcagttgctgaggtatggctttggcaggtgggttcatggaaagcagttggccacctgcaatcccacagcttaacagtgacacagatggagttctcacatgacgacaactttcttttgactgtctcaagggatcgccagttctctgtcttttctatcacaagaacaggcaccggtgaaattagttgtagtcttcttgcgagacaggaggggcacaagcggattatctggtcatgttcttggaatccgcatggtcaggaatttgcaacaggttcaagggataagacagtgaaaatctgggccatagagagggattccatcaggcagcttatgtctttaccgcaatttacgagtagtgtgacagctttatcttgggttggtctccatcataggaggaataatggacttctagctgttggaatggaaaatggccaaatagaattgtggaatctgtcttataacagagcagatgatgggagcatagcagcaccaggtttggctacttctcttgcagtacgtatagatccttttatatgccatgcatctaccataaaccgtctagcatggaagaaaaatgaggatgatcacatgagtatgcaacttgcttcatgtggagctgataattgtgtgagagtgtttgatgtaactgttgagtaa

SEQ ID NO: 55263 - DNA, 1415 bp, Glycine max
  Peptide Sequence Number=SeqID_172041
atgctccctttttttgctttgttcttttttcttctttgctgcaactctcttgcacccgtggtgtattctctgaatgccgaaggttctgtgcttttgacactgaagcagaccctcacagacccacaagggtccatgagtaactggaattccttcgatgaaaacccttgttcatggaatgggatcacttgcaaggaccaaactgttgtgtccattagcatccctaagaggaaactctatggctctcttccttcttctctgggatctctctcccagcttcgccatatcaacttcaggaacaacaagctctttggaaacttgcctccacggctctttcaggctcagggacttcaaagcatggtgctttatggcaattcgctttctgggtctgtcccaactgagattcagaacctcaggtaccttcaagctctagacttatcacaaaatttcttcaatgggtcattgcctgctggaattgtccaatgcaagagactcaaaacccttattctcagtcagaacaatttcactggccctttgccagatgggtttggtactggtttgtcttctctggaaagactagacctttcttacaatcacttcaatgggtcaattcccagtgacttgggaaatctgtcaagcctgcaaggaactgttgatttgtctaataattattttagtggttcaattccagctagccttggtaatcttcctgagaaggtttacattgatcttacgtacaacaatttaaatggtccaataccccaaaatggtgctttgatgaatagagggccaactgctttcattggcaatcctggtctctgtggtcctcctttgaagaattcatgtgcttctgatacttcatctgctaattcaccttcctcatttccatttattcctgataactactcacctcagggtactggtaatggttccatgggaagtgagaaaaacaaagggctaagtaagggagctgtggttggcattgttgtgggtgatataattggaatttgccttttaggtttgctgttctctttttgctactcaagggtttgtggttttaaccaggatctggatgagaatgatgttagcaagggaaagaaagggaggaaagagtgcttctgcttcagaaaagatgactctgaggtcctatctgataataatgttgagcaatatgatcttgtcccattagattcccatgtgaactttgatttggatgagcttctcaaggcttcagcttttgtgctgggtaagagtggaatagggattatgtacaaagtggtgcttgaagatggacttgctttggctgtgagaagattgggagagggaggttctcaaaggtttaaagagttccaaacagaggtagaagcaatagggaagttaagacatccaaatattgcaactctgagagcctattactg

SEQ ID NO: 55264 - DNA, 609 bp, Glycine max
  Peptide Sequence Number=SeqID_172042
atgcatgcaaagttccagcaacatctgtttgatgaatgtgaaatacagttcaataaagatcaacagttagaacttataaatggtcaaatatgctttaaaatttacccatttgaaaatgagataccagtcgaaaggaaaataataatgcctggttctttccatccattacatgatgggcatctcaagcttatggaagttgctactcgaatacatctaagcagtatttgtggtgatgggtatccttgctttgaaatatctgcagtcaatgcagacaaacctccattatcagtgtctcagatcaaagatcgcatcaagcaatttgaaaaagttggtgaggcttacattgctattggtacttcacagactataacaattctgttgagggagcactatggctgtcccctaacagaatggagagcacgaatgcttttcactcttatgcatagtcattcagttctgcaaaatgtaaagcagctcaatccctggtttctgctggatcatgtcactgtccctcatgtttttgtattttatccgtggacagtgcttttgcttttgaggaaaaacacgttttattcattagaatgggttaggaaccaacaattgaaataa

SEQ ID NO: 55265 - DNA, 243 bp, Glycine max
  Peptide Sequence Number=SeqID_172043
atgttactcttgcagcatcctaaatattatgatggtgactacagcatgatgctgaagatacttgttggttgtaaagaaacgggatgcactttccttgtgggtggtcggaatgttgatggtgctttcaaggttcttgacgatattgatgttccagaagaactaaagggcatggtcgtctccattcaagctgaacagttccgcatggatatttcctcacctgaaataagaaatagaaatcactaa

SEQ ID NO: 55266 - DNA, 471 bp, Glycine max
  Peptide Sequence Number=SeqID_172044
atggagcattatgatgtgatggtgggcgggctgggctcaatggagcgaaacggtcacgctcctgttgccgttactacttttctcaatatcctatatccacgtagaccacatctattttgcctcaactttggaacctactttttcttgttggttgattttattaaactgaagtgtgatggagctatggtccaaagtcagagtatgacttcttgtggaggagtcatccgtgactataaaggccactttattcgtgccttcttaagaaaacttagaagttgtttaatacttgaagctgagctatggtccttgctatttggaatgatgatgttgaaggatgcagaaatgcccaatgtcattatcgaatctgattgccttgaagttgtgcaccttgtcaatggtggttcttctccggggcatacttttgttgatcttgttgatgagatttgtaagcttaaagagaagttttcataa

SEQ ID NO: 55267 - DNA, 828 bp, Glycine max
  Peptide Sequence Number=SeqID_172045
atgttggtgaatcagatccaaggctttgtgtcagacccggagatgtacaacctaaccacaggcatggaaatgatagggtttccaaagagtgacaccaacgctgtcatgtggagaagtttcatccccaaaccgggtccttcctcttccaaaaccatcaacgataattccacaactttctaccaccacgactacaacaacaagcatgcagatttcacaccagctgggaatatttctcaaacaagtgccgataatctaatcgtgggaagtcatgattcagcctcgtggcaagacaacatcaacaacaacaataacagcagcaggtttgatgattcttctctaaggtgtgtgtttccttgtgaaaccaacgaaaggcctagccaaggtctttcactctctcttagttcaaccaacccttcctctatcgggttgcaatcttttgagctaagacaaacaggccaacatcttgattttgtttcgtcgagttccagagatgggttctttggaaaaccagtttctcttcaacagcaacagatggtatcacaagatgggtatgtgagttctaattctaaagttgcaagcgtttatcaacaaggacatttcctggtgaagaactccaagttcttggtgcctgcacaagaccttctcaacgagttttgtagccttgacgcaaagcaaagcgacttgggaaagccaacaaaatcgttgaataagaagcagtgggaagaggaaaataacggtatcggttcctcgaagaagcattctctgacctctctagagttcgtggagttgcagaagagaaagacaaagctgctttcgatgctggaagag

SEQ ID NO: 55268 - DNA, 891 bp, Glycine max
  Peptide Sequence Number=SeqID_172046
atggtggcaagggttcatgatatcaatctggttcagaatattcacgagttgtttatcactaaagggtttcaatcagttaaactgagacacatgggggataatttcatgcttcttacaccattggatggtctggagatgaaggaaattgtcaagggccctgaggattggttgaaagaagttgttgaggaaataaaagctcaagacgtgtgccatagttgctgtggtgttacgaggtttatggaaaatggcaatggctcatatattaggagtctcgacttggagtttacttccagtgtatcaaagtgttcatctgatgctggtaggtggttagatgcggacaaggtggtccgagatgttgttccggtatcggcgatgagggaatccaatcttcaacacgtagggggtgtagtagacacagtctcacaccaaactggctgtgaaggtacaaaaggagaccaacatagcggaaagggcaatgatgaccatgatatatatcgtgtgatggagaatggagttgtacatcttaaccttgtagacacgcaacatcaacaggtagaagacacagtgcatcatgagaaccctaagggtatagatgacatgtcaaaagtgttattgcccaacattgagccttgtatggtgaatgaaagtgttgagaagggaactccattaaaagctcgagatggagcgagtatggtagtgaaatattgtgaaaattatggtaccagaggaggagttagactctgtgacagagagattgagttatttaacttgagaaataactgtgcaagacaggttattgaagctacttttgaagctaacgtagtgggggttaccaacatggagaaagatgtagatatgcaaggcaaatcaaacttggctgcttggagatag

SEQ ID NO: 55269 - DNA, 558 bp, Glycine max
  Peptide Sequence Number=SeqID_172047
atggtgctgtgttttccctcaacacccaagaaactggccatgaccatagcagtctccctctctggcgcttccattttagctgttgggatgcacctttcttatgtcaatgttgaaccccagcgagctcgaaccagagatcgcgatgcttttgtcatggagacattgaacaagaagtatggttatacttccccatatgagaaattggctcgcaatggttcttctgttgagagatcacaggaatcctctatgagagagaattatgctcgggctcgcaatgatctgcatattgtccataccacaggaagagaaagaaagagtgaggcagtggtagagagaatcagcagcaaaaaccgctacttgaagtgttacatgtcctccttcattctaaatgtaaagaatagaatttccaagctattgcaattgaagctgggaaaagtaaaaattgcattggcagaatcaagtctactcaggtcttttgctaattctagggatgctgatactgttggagggcagtggaaaattgtagagaagttggtgcaacatgtgcctgcacaataa

SEQ ID NO: 55270 - DNA, 1363 bp, Glycine max
  Peptide Sequence Number=SeqID_172048
gctcctaccacggcccctccccgctcctgcgaggcctacttcgggaacggcttcatgcgccgccgcgacctcctcctctcccgcggcggagccgggtggttccggtgccgccacagcgatacgctccggagctcgggaggaggaggagctgcccgcatttcaaaacggtgcgtttgaggttgacgggggtgaagtcgttgaccgggagtttttggttgacaaaaagtttttggatgagtatgtgccaaggggagggatcgataggcacaccatgcgagacttgatcgccaagattcggatcgtgagagggaaggattttcaatgtgatgagggtttgatcagcgagaaccggatcttgggagggaaggattttgagtgtgacgaggcgaggaagtggaaaatgttacgagttaccgtgcgggatttgattagcaagatacggatcatgggacggaaggattttgagtctgatgagggtttctacttgcagtggattgaggaacctgcccttctggtgacacgttttgagtatgctaatctttttcacactgttacagactggtacagtgcttatgtttcttctagagtgactggtctgcctaatcgaccacatttgatctttgttgacggccattgtgcggctcctcttgaagagacatggagagctttattctcaagcctcagatatgctaaaaacttcagtggttcagtttgttttcgtcatgctattctctcacctttgggatatgagacggcattgtttaagggactaacagaagatatagattgttatggagctcctgctcaagaactatggcaaaaccccgatgaccacaaaactgcacgcctttctgagtttggagaaatggtcagagcagcatttgggctacctttaaacgtacaccgtggtggaaaaccactctttggacacaacattctctttgttcgtcgcgaagattatttagctcatccccgtcatggcggtaaagttgaatcacgactaagtaacgaacaagaagtctttgactcattgaagagctgggcatctaattataaagggtgtaaaattaaccttgtcaatggattgttcgcacacatgtctatgaaggatcaggtgcgagccattcaagatgcatcggtcatcattggcgcccatggtgccggtcttactcatatagtatctgctttgcctaaaactgtgattctggagatcattagcagctatttcagacgacctcattttgcatatatttcgcggtggaaagggttagagtatcatgcaatcaaccttgctggatcacatgcggatactggaaccgtgatcaaagaactggttgacataatgaaaagccttggatgttga

SEQ ID NO: 55271 - DNA, 339 bp, Glycine max
  Peptide Sequence Number=SeqID_172049
atgaagatggaaggagatctccatgacatcaacaagttcaatcagctagtaagcgttgttgttatggcctcactaccaaggtcgtttaaagctttggttcaaacattgcttgtgggaagatcaactttgaatttggatgaggtgactgttactcctagagaaaatgggaaaatgatgagaactgaaaatgttgatgatgaacacaatgcaatagctatgatggaaactgagcgaggaaggaatcattcaaggaaacatgatggtccaagaggaagatcaaaatcacaatcgcgtccacaacgagatatgaatcacaatcgtgtccacaatgagatatga

SEQ ID NO: 55272 - DNA, 691 bp, Glycine max
  Peptide Sequence Number=SeqID_172050
atgactatcaacatcgatatcactattatcattgtcattgacactagtagaggtgtttgcgggctgtatgatgtgtatgggaacttgtttgggcttcttgcagctcatccagtgactccattggtgtcactgcaccaccttgatgtggttgagccaatcttcccaaatgccactagagtagaagccattaaacggctaaccattccaatgaagcttgactcggcatctctcattcaacaatccatttgccatgacagaaataggagatggaccatttcagtgtcatggggttttgctgttcagatatttcgcgggatatttacacagcgggagatggaaatgccttcaagaacatttctcaattggtatagaagagcagattacactgcatatgccttcaacacacgcccgtttagcagaaacccgtgtcagaaacctttcgtgttttacttttcaaaggcaaaactcaattctaccttgcaacaaacagtgactgattatgaaagagatccgattccttctccagaatgtcgatggaatatggctgatccttctgctcttgacaaaatagaggtgcataagaagaaagacccgcatctatgggatagagccccaaggagaaactgttgtagagtgatgaaatcgaacaagacaggaatcttgaagatagaagtggctgtatgtagagatg

SEQ ID NO: 55273 - DNA, 768 bp, Glycine max
  Peptide Sequence Number=SeqID_172051
atgtcacagcagcagcgttcgacgccggcgccgttcttgacgaagacgtatctgctggtggatgaccccgccaccgacgacgtcgtttcgtggagcgaaggtggcaataccttcgtcgtttggaaacacgccgatttcgctaaggacttgcttccgaagtacttcaagcataataatttctccagcttcgttcgccaactcaacacctatggattccgaaaaactgttcccgacaaatgggaatttgccaatgagtatttcaagcgaggacagacggatcttctcgccgagatcaggcggcggaaggtggtgtctccggtgaccggaaaatctaccggcggtggcgttaacatctcggcgtcccactccggcggcgacgacatggggtcgacatcgacgggatcgatggaggcggcaacggcggcgggcgctgatatatcgggcgagaacgagaaattgaagaaggacaacgagaaattgagcggcgagttagcgctggcgaagaaacaatgcgaggagttggtggcgtttcttagagactcgctgaacgtgagccccgatgtgatagagcgcatcattcggcaaggaacgtgtgtgtccagcaacaatgatgcggtgcgttttgatgctattattaataatgatcttgatgacgacgaaaatgcgggtcaaaatgggaaagagaattcaattggtaaatgccgcaagagagggcgccaagactaccctattgctgccactgccaaggaattgaagaccctagtctag

SEQ ID NO: 55274 - DNA, 837 bp, Glycine max
  Peptide Sequence Number=SeqID_172052
atggagatcatacaaaactcaacaaatgttggacgtgccaatggtgaccctgtcatggtcacgaaatgccatattcgtcaaatggttcgtaactacaaaccttcacttttattactctttgaaacacactcttctttaggaaccgacttgggtacaatccttgcttcattcaagagacacaagggcactccggaggcatctggattttatctagttgaggacttttcttccaccctggttgactctatgcctcatgcgattactacctttactgttaaaaaaatgtatcccccaccagttttggtcccttgtactgtcttctgggactatttgatcaccttgggggagcacattcaagggccatggttgatgcttaaggacttcaatgatattattctttcctcagaggtatctgggggcctattttatccctctcgagcctttgctttagcaaatttcttcaacgagtgtggacttctagacctgggtacggtgagaggtaggtttacatggcgcaaaaatatccaaaacggaggccacatgagaaaaaagttggatagatgcatggtgaactcaggatggagacttttcttccctcacggtcttgctgaagttctgaacccgtatggttcagaccacaaccccgtcttggtccactgttttaaatcaccatccatcaagaatacttccttccattttcaagctgcttggactcttcatccagactttaggaatcttgtctctcaaacttgggattctactcagggggatgctatcatgaagctggatggagtgctaacttttttgcagctccaacccaatccaacctggtcataa

SEQ ID NO: 55275 - DNA, 882 bp, Glycine max
  Peptide Sequence Number=SeqID_172053
atggagcagctaagcgaactagggactgattccttggttaaagctagagaaagttctttgttcttttgcgcaatcaaattatcaaccagagcttcatgccattggccgggaataaactccaacatcacaaagaggctagccatcaggctcccgcccagcagaacaaaatgcaacttgcacttacacaagatggagatacaacgacacagcatcaagaagaatgtcctaaacaaatcttgggatagaaatagagttttagccatggcatcaaaaagggaccccaaatctcagcaaaattctctctctccagcagatacagtagagcagtactacacaagcattaatgataaagacctgcgacaattggatgagtgcatatccgaagatgcttgctttgatgactatgccttcaccaaaccattccagggaaaaaaggaagtgatacgcttcttagaacagcttactcattgcatgggccggaatgtgacattcagactgaaacatatatacgagggagatgatttaactgccgtagcgagctggcacttggaatggaacgagaaacaaatcccattcaccagaggttgcaccttcttcaagttatcaaaattaggaaagaacctggtcatctggaacgctgaggtattaattgaatcacctatcaaaccaggaagcatagttttggtaactccgaaaacgccaaggttcttaagaagtcctaatgtaatactaacatggatattgagagtttacaatatatttgtcgcgccttggctacatccactcctagaaggctacataaagctatggggcttctttgttcgattgctcaactctgtaatcactgttgtgatttttatttccaaaactttcttcaagtaa

SEQ ID NO: 55276 - DNA, 537 bp, Glycine max
  Peptide Sequence Number=SeqID_172054
atgtgcacgatcctcggcctcccagaagcttatggtatggctcatgttcctggtttcactcacctacatggcttacactctcaagctggtatccacgtccacgtcatcaagcacgtgcaaccacgcgcctttcatcatcaaccacctctcctccacaacctctttctcttcctcaaatggaacggagtggccggaagcggaatcttcatcttcatcccacaattcccgtgccggaaaggggaaacgggggcagaaaacggagctccggcacctggtgttcggaatcgcggcgtcgtcgaagctatgggaacacagaaagaactacataaagatttggtacaagaaggagaagatgaggggagtggtgtggctggacgatcgcgtgaagaggaaccccagcgaagggttgccaccaaccaaggtttccaccgacacttccaatttcgtatacaccaacaagctgggccaccgctccgcgattcgaatatcgcgcatcgtgacggaaacgctgcgtatggggcacaaggacgtgcggtg

SEQ ID NO: 55277 - DNA, 3456 bp, Glycine max
  Peptide Sequence Number=SeqID_172055
atgccactgcatctgcatccacaagttggtgcacccctctcacacatgcatccatcgcagcctcctttgtttcaatttggccagctaagatatacttctcccatatcacaaggtataatgcctcttggtcctcaatcaatgtcatttgttcagccaaatataccatccagtttctcttacaatcgtaaccctggaggtcaaatgccagttcaaaatgctccagaaacttctgattcctttataaaaaatgagattaggcatcattctgttgacagccaaccaggtaattcaagaaacttatcacaaggttcactgccaagtgagaatgcagaaaatattgctggaataaagcagggtcgaattgagtcttcccatgttcataataatagcagtagaacttctactagtttccaattggataagcgggggaatcaaaatgtagttggaaagagaagcaatatttcatccagtgcaaaagaatcagaagttcagcctgtcactagagatgcatcatataatccagtttcaaaagagaattttatggagtcaaaaacacaatttggtggcaggggaaagagatatgtctttactgtaaaaaattcaaacccaagatcatctggtccagctccaagggttaatcgcccagactctggaggatttatgaggaggcctcgtcggaatatgcagcgcactgagtttcgagttcgggaaaatgctgacaagaggcagtctactagttccgttttgactgatcagtttggattggataataagtcaaatatcaacggaaggggagcaggcatatctggaaggactgtacctaggaaggctatgtccaataaattgggaaaacagacggtagagttagctacagaaaattcacaaggaatggattctggaagcagaggtgaaaaggttgatggaaaagaatcaacgaagactcagggcttctcgcattctggacagagtaatctcaaaaggaacttgtgttctgaggaagacgttgatgctccattgcaaagtggaattatacgtgtgtttgagcaacctggaattgaagctcctagtgatgaagatgactttatagaagtaaggtcaaagaggcaaatgttaaatgatcgacgagaacagagagagaaagaaatcaaggccaagtctcgggttgcaaaggcgcaacggagaccccgttcaggttcgcaaagtgttgtggctgtggccaattctaccaaaggatccatagctggagttgaagtggcaaatagtctccatgctgattttgttgctgctgatgtgttgggaatgacaaaaatggatgcctcatctggatttaattcaagtttattgtcccaagcattacctccaataggcacaccacctcctttgaaaattgatacccagcctgatttaagatcacagataagcaggtcacatcagacaagtctcccagcagtttctggtggtgaaaaggacccgggttctggtgtgatatttgaaaataagaacaaggttctagataatgttcagacatctttgggctcttggggtaatgcacaaatcagtcaacaggtaatggcacttacacagacacaacttgatgaggctatgaagcctcaacagtttgattcacaggcttctgttggcaatatgactggtgctgttgatgaacccagtttgccaacatcatccattttgacaaaggagaaaaccttttcgtctgcatccagcccaattaattccttgcttgctggagagaaaattcagtttggggcagtaacatctccgactgttcttccatctagcagccgtgttgtgtctcatggcattggtcgacctcgatcatctagatcagacatgcaaatgtcccacaatcttactgcatctgataacgattgcagtcttttctttgataaagagaaacatggtaatgaatctcatggtcacttagaagatcatgatgcagaagctgaagctgaagcagctgcttcagctgttgctgttgctgccattagtagtgacgagattgttggaaatggattgggtgcttgttctgtccctgcttcagatggtaaaagttttgtagctgcagatattgatagggtagtagcaggagtaggttgtgagcagcaatcagctaatcaatctagatctgaggagcctcttagcgtatctcttccagcagatttatctgttgagactccgccaatttccttgtggcctcccttaccaagtacccaaaattcttcgggtcaaatgatttcgcattttccttctgtccctcctcattttccttcaggccctccttctcattttcctttctatgaaatgaatcctatgatgggtggtcctgtctttgcttttggacctcatgatgagtctgcatctacaacacagtcacagcctcaaaaaagtactacatcagcatcaaggccaattgggagctggcaacagtgccattctggtgtggaatctttttatggacctccaacagggttcactgggccttttattgctcctcctggaggcattccaggagtccaggggccaccacacatggttgtttataaccattttgctcctgttgggcaatttggtcaagttggcttgagtttcatgggaaccacttatataccctctggaaagcagcctgattggaaacacatccctacatcatctgctgtgggagctggtgaaggcgatatgaacagtatgaatatggcatcttcattgcggaatcctgctaacatgccttctccaattcaacatcttgctcctggttcaccacttatgccaatggcttctcctgtggctatgtttgatgtttctcctttccagccctctactgagatgtcagtacaagctcgatggccgcatgttcctaattcacaacttcctctgtcaatcccattgcagcaacaagaaggggtacaaacttctcagtttagccatgttccttctgttgaccagccgctaaatgccaaaaggtttactagttctcgagcttcaacatcttctgatggggataggaattttcctagagctgctgatgtgaatgtcaaccaattgcctgatgaacttggattggtggacaattcaaatttcactgctaccaagacttcagcacagactgttgtcatcaagactccatccgtgatccccattacagatactgtgaaggttgatgttcagaatggcaatagcagcagtagtaataacaaccagaacgcaagttcttctttcaagaatcagccctcacaatctgaccattcctcaggacatggtaattatcagagaggtggtgtttctcagagaaataattctgggggcgaatggtcccatcgtagagtgtaccaaggaagaaatcaatctctgggatcagataagaacttttcctcaacaaaggtaaagcaaatatatgtggctaaacagaccattagtggggcatcaacagtgtcatga

SEQ ID NO: 55278 - DNA, 237 bp, Glycine max
  Peptide Sequence Number=SeqID_172056
atgtcttggattcagccaccgaagttactccttatgacggtgatgcaatggagatcatacaaaactcaacaaatgttggacgtgccaatggtgaccctgtcatggtcacagagtgtcacacctcatgtcttggattcagccaccgaagttactccttatgacggtgatgcaatggagatcatacaaaactcaacaaatgttggacgtgccaatggtgaccctgtcatggtcacgtaa

SEQ ID NO: 55279 - DNA, 132 bp, Glycine max
  Peptide Sequence Number=SeqID_172057
atgggaaaagtatctgagaaggacatcatgcagggatatcagattgtcaaaatggcaagctggatgctaagaatgcaaggcaccttgctgaaattcgggtataaccaaccaaatcacaaattgtcagattga

SEQ ID NO: 55280 - DNA, 510 bp, Glycine max
  Peptide Sequence Number=SeqID_172058
atgagtaggaatgtaggagacatgcacacctggggaaaattgcttcctccaggggagaatccaaaacaacggcctaactggctatcctgggcaggctattggtttaataccacataccctagtccaagccctccaggagatacttttcccttgaaggtagaagacgttattcgacttcaaatggaaggagaattagaattcagtgtgggtgactgggtatatcttaagagaattggttcagttgcatacaagttagaattaccagagcatgctcgcatccatcctgttttccaagtatgcctactaaagaaggcactggcagcattatcagtggaacaacctctaccactagttctaaccgaggaatgggaattacaaccccaaccagaaggtatcaatgatggagacagagcaggggttcaaaaccctctagaagcaccttatggtcagatcctggccgccaatacccaagtggagactactcctgcaccacaccctaagaaagtttaa

SEQ ID NO: 55281 - DNA, 1833 bp, Glycine max
  Peptide Sequence Number=SeqID_172059
atgttgcatttattgtccaaagctaggagatttaatcacagtcactaccatccgttgcatttagcaatattaaaaggagattgggaatctacaaaggcttttcttgacaatgacccaagtgcattgacagcaaaggtcactgcaattggtgggactgcacttcatgctgcagctgtaggagggcagtggcaaattattgagaagttggtgcaacatgtgcctgcacaagtactttcagatctggacttgatgggttgtacttgcctgcactatgttgcaatgggcgaaagcacaagtgctgccaaggcattggttgctataaatccttctctgacacaacttactgacaagaaaggattcacaccacttatctatagtattacctcttctaaatgcaaagagatggtgtggtactttgttttgaatactacagacgaggaacctggctgtccattctcgggtccttctgctgatcaacttgttgctttgctaactgctgcaggatttcatgatatcactatgtatcttctccagcgctacccaaatttggctactctctcagattcaaatggaagcattatacttaatgttttgtcaaaattgcccacggaattccaaagtggaaataagcttgggttttggaaaagatgcatttaccactgtgtgccaaatgaacttgattttttaccaccaagtcatctgagaggaaatttgaaagattcttatgggaattcaagccatcaccaatctcattttggtggtacaatatggaatgcaattcagaatattgttcctggcataaagctagtcagagagacaaagttgagacacatatcttctgtgagattggtggaatttgtttgcagacaggtttcaaccacaaatgactctgaattctggcagtctcatatgagtgcagacattattttcaatgccacttcatctggcatagttgaaattttaaggatttgtttccagttttttcctgatttggtttggactcacatgccacatgaaggatttgtagctcaaattgccatcaagaatcggcaagaaaaggtttttagtcttatatgcgagatgcctatagtttgcaagtttttaatcctggcattagatgagtcacagaacaccacatcacatttagcagcaaggtttgcttctcctcagctggcatcaatttctggtgcagcctttcaaatgcaaaaagagttacagtggtttaaggaagtagagaaatgggatcaccctcttcataaggaagttaaagccaaagatggtaaaactccttggcaattgttcagggaagagcataagcctttgctagaagaagcaaagaattggatgaaggatacatcaaactcttgtatgttggtggcaactcttattgctacagttgtatttgctgcttctataactgtacctggaggaaacaaccaagacaaaggatttccaatatacttgttagataacacattcatggtgtttattgtgtcagatacattagctttgttttcctccatggcttctctactgatgtttttatcaatcctaacagcacgttacacggaagaagattttctcaggagattacctgagagaataatattgggtctggcttctttgttcttttctatagtaactacaatgatagcatttggagcagctctggatttgttgctaagggagagactgcaatgggtggcaattccaattgctcttctggcatgtgtcccggttgctctatttgcgaggcttcaacttcctttgttcatacaaatgatcatatcaacttatggatctcgcatatatcatcatcaaagtctttggtaa

SEQ ID NO: 55282 - DNA, 2173 bp, Glycine max
  Peptide Sequence Number=SeqID_172060
atgggtggtaaggggctgcctgttaatgatcctctgcttaattttggtagagagaagcgggctttgccaaagagtgaaaaaggtttcttggaggatccgtttatgaaagattttggaggttctagttttgatgggagggatttgttgggtggtcttgttggggtggtcaagaaaaagaaggatgtgctgaagcaaactgatttccatgatcctgtgagagaatcctttgaggcggagcttgaaagggttcagaggatgcaagaacaggagcggcagcgaatcattgaggagcaagaaagggcattggagttggctcgcagagaagaggaggaaagattaaggcaggctagagaacaggaagagaggcagaggagattggaagaagaggcaagagaggcagcatggagagctgaacaagagaggattgaagctttgcgaaaggctgaagaacagaggttagctagggaagaagagaaacaaaggatggttttagaagaagagaggagaaaacaagctgctaagcagaagcttttagaattggagcaaaggattgctagaaggcaggctgaggcatccaaaagtggcagtaatgctccagttgttgtggaggagaaaatgcctgcaatattgaacgaaaaagaagcatcaagggctacagatgtgggtgattgggaggatagtgaaagaatggttgacaggatattgacttcagcatcttctgattcatcaagtgtgaatagggcattggagatgggctctaggtctcacttctctagagatttatcttccacctttggggatagaggaaaaccagtaaattcatggagaagagatggatatgagaattggaacagctcaacattttatccacaagaccaggagaatagtcacaacagtccccgcagagatttatcaattggtggaaagccatttatgaggaaagactataatggtggtgctggatttgtgtcttcaaggccttattataaaggtggaatttcagagcctcatttagatgaatatgctcatgtaaaaccacagaggtggaaccaatctgcagatggagataatctaagcagaaatacagagattgattctgattttcatgaaaattattttgaaagatttggtgatggttggacacagggccgttcccgtggcaatccatttcctcaattccctgagcgtacttatccaaattctgagtcagagggaccctatgccttggggaggtcacggtattctgtcaggcagcctcgagtacttcctcctccttcactaggttctgttcacagaacttacaaaaatgaaaatgaacaccctggcccttctgctttcctagaaaatgagatgcattataatcaggcaaccagaagtgactctacccttccaactggttatgacaatgggaaccgtggacaacctgaagtagtggatgcccggcaagagactactgagaatgaggaccataaagtggaatccacaccgaggtgtgattctcagtcttcactctctgtttcaagccccccaagttctccaacacatctttctcatgatgacttggatgactctggagattcccctacgatattgacttctgaaggaagcaaaaatgaccccctcacagctccagataatgaatccattgcaacacctgctggaaatgaaaatgtagttactccatgtgctgtctctagtggggatgatgatgaatggactactgagaataatgagcagttccaggaacaagaagaatatgaagatgaagattatcaggaagaagatgaagtgcatgaaggagatgatcatgctcaactcaaccaggattttgaagatatgcatttgcaggagaaaggattgccccacttgatggataacctagtattaggatttgatgagggtgtccaggttgggatgcctaatgaaaagtttgaaaggacatcaaaagatgaagaaacaacatttgtggcacaacaggcttctggcatctctctagaagaatgtgtatcttatgataatgcaagtgatgatgacaaggccctccaacctgttaatgatactaaggtgaatcttaacagcacttccagtgtgttccaggaatccgagaagccagctcaagatctggtcattcagcctagtaattctctttcccctgtggtgtctgagagtttag

SEQ ID NO: 55283 - DNA, 243 bp, Glycine max
  Peptide Sequence Number=SeqID_172061
atggagtgtggaattgaaacaattgtgtggtatgcattagttgctcgaattgctttggtgaaacctgagaaagcaaggggcgttgaagattttatattgagagctgctcagatgggtcagataactgaaaaggtttctgaggaaagactcatatcactgttggagcagataaacaaccaaacaacaaggcagacaaaagttacaatacagaggcgtcgaagtgttcttgaggatgatgattaa

SEQ ID NO: 55284 - DNA, 552 bp, Glycine max
  Peptide Sequence Number=SeqID_172062
atgggacctagccattcacattatgtgcaagcacaagatctggctaaagaggcaatgatagtggcaaagatagaaaatcttttggactgcactacttggtcagggggaccaggactaatggatgctgttactgaaggtgctatgctagcaggaaaaccagttggtggattcaagataggaagagaagctggggaatggactgcatctaactttcatccatacttatcatccgaaaattacctcacgtgcaggtttttccctgcaaggaagcatgggctagtggatgctgtagtgaggaacaattcatttgataagactgctgttgttgcccttccttgtgggattgatactttagatgaggtgtttgagatactggcattgattcagctggaatggattggatcaaagcttcatctgcttgaatttttaaatgactgtgagggttggggaactgtctctaaaggagaggttgcatcattgtggaaagtctgtaacagcaactcagaagcttccgtcgtacctagaagaattctatggcatttcttcttgtga

SEQ ID NO: 55285 - DNA, 405 bp, Glycine max
  Peptide Sequence Number=SeqID_172063
atggcagtgaactgttgcatggagagaaagaactcaatgaaaggagaggaagtagagctgcagttgcatggagagagcacacttttctttgggctagcgtgtggtttgtcgggtcaatctagcctaaggccatttggctcaacgaccaaccctttcactaggaacacccattccaaaagaatactgagttctggagtagccttttcgcagccaaaaattcacttccagaatggctatttcagaatggatctgtttaaatctgcaaggtttatctcttgttcacatttccaattcaccaatgagggtggacatgctctgctcgaaactcgattcgagtttgacgtgaacctcttttttttaagctcgaacacgattcagttcaagctcacgaacaactcggtttaa

SEQ ID NO: 55286 - DNA, 600 bp, Glycine max
  Peptide Sequence Number=SeqID_172064
atgattactgtaggatggatcggtgcaataatattggggttgcaactggaaactggggatgaagtgtctttggagaagaccataattcagtggcttgcagcttctcagaagaaagagattcaagcagctggtgtctcgctaagcgagccatatgcgcttagcgaggtacacaactcacttagtgtgttggaaaaccctagaagaggatcagtcagagagatgtgcgctcagcgtgccatcagctcgcctagcgagtcgtttgtcccttatcgtgctcaacacgcccagctcgttagagcgaacggttatttccttccaaatcttcctttagccatgttccgggagaattcccactcaacttggacttatctttctctgaatgatttcttactagggactttgattcatgttgtggtaggttgttcattggatttcgtcacaaacatggacggctccgacgacgataaatatatggtgatggttgttacgaatagcatagagaggccccatgcagatggcatcgtacgtgaagataatgttgcaccagatcatgccttagtgccttctagaagatatataggtagtggaataaaggaatag

SEQ ID NO: 55287 - DNA, 726 bp, Glycine max
  Peptide Sequence Number=SeqID_172065
atggggcttatcacatatggaaagtcagcaatatccacgtatttcttaggcaaactaagcaaagaggcattagtaggtggaagtctagccattggagtggccaacataactggttattctatcatttctagccttgcaacaagcatggatggaatatcctcccaggcttgtggggcccaacaatggacccttattggtcaaactctccaatgttccatcatgattttgaccctaacttgcattaccatttcaatcttatggctcaacattgaacccgtcctcctcttttgtggccaaaaccccaccatatcatctatcgccaccacctaccttggattctctcttcctgaccttattttcacatccttaatcatctctttcaagattttcttgagaactcaagatgtgaccctccctttcatgtttagtgcaactttggcaccatttttacacgccatcatcaataatgtggtcattcacacttttggcctgggaattcaaggggttgccttggttggatcctttaccaatataaaatttcttattatccttttgctttacctatggttctcgaggaattgttctaactcctggcaaggggtgggtaagcgggtcggcctgccccgcataaggccctcccgccctacattcttacatgaaccaaataaattggtctgccctcgccccgcggacccgtgggtcaaacagacttgtccgcgggcctag

SEQ ID NO: 55288 - DNA, 1053 bp, Glycine max
  Peptide Sequence Number=SeqID_172066
atgaccactacacaaagtgttgatcatcaccacccccagttcaattataattccaatcaactagatcactatggccaccaagaaaatttaacagcaaagccaccgatgcaagaaaccttattttcctcgacgtgccccctatttatgtttgacactagttcattagatcaagggacaacaacagtagacaccaccaccaatgtacgaacagaattgttccaagattcattgggtttgagcagtactgaaacgtggaacttgagccaccatcaagtccatgttcttcctcctcaactagcagcaacttttacagcagcaacagttattgataccacgaattatctgccaccattgatagagaacgtggacaacatggtgccaaatatggaagtacagtcttgtagtatagacgaggaaggagaaatggcactagagtgtctacggagacaaggtttgaatgagtgggtggagcatcaacaacaatgtcccaactttcttttctgggacagtattaatgtagaaggacaacttggaggggaagaactagcaccaaacaccttgtatacgtcgccgcttcagcgtagcaacatgatcattcccgagaagaaccgtaaagagatctgcaaatacctcttccaagagggagtttgctttgcgaagaaggacttcaatctggcgaagcacccggagattgatgtgccgaatctgcaggtgataaagctgatgcagagcttcaaatccagagagtacgtgagggaaacatttgcgtggatgcactattactggttcctcaccaacgatggaattgagttccttaggacttacctcaaccttccatccgaaattgtccctgccactctcaagaagcaggccaagcccgccggaagaccattcggtggcccacccggtgatcgccccaggggcccacctcgctttgacggagagaggagattcggcggtgaccgtgatggataccgtggaggtccacgcggacctggcggtgatttcggtgacaagggtggagctcctgctgactacaggccttcttttggg

SEQ ID NO: 55289 - DNA, 1338 bp, Glycine max
  Peptide Sequence Number=SeqID_172067
atgcttctacaggcaacgcctgctgaagctcagaagtttgcaagttccattaaggtcgcaacagaaggaacatcctctcgtggtcaggcaatgtcatctgctgttcttcaagcagaggaagtccaatcaaatttggaaagagaattccctagttttgtgaagtctttagttagatcacacgttgctagttgtttttggatggggctgcctgtgtcattctgtaaaagacacttaccggataaggatacaacattcattttggaagatgaatctggtaaagaatacatgacaaaatacattgcatgtaagacaggattgagtgctggatggagacagttttctgctgtgcacaaattgcatgagggtgatgtggttgtcttccaattagtggaacctaccaaatttaaggtttacataataagagctaataatacgagggaactagatggagcctttctgagtcttgatagttgcataaaacaaaaaatgggaggcaagacttgtttcgctatgcttttaatttcttgtattgtatcaataaagaatcatcaaggatttatgcactctttgttttgcttcttgttctcaggcaatgataatgcagatagtgatgatgtggcatgtaataactcaaagagaaaacatggtaaatctgtccaacaagatgtccaaacgaaaaagaaggccagcgcgtcaagattgagacctaaggcaaggccatcagtcgaacaatctgaaaatgatagtgaggaagctctctcagaagttatggagggctttaaaatgctcgagttcaatgatgtgaaaggttttgaaaatttcagcatcatagttgatggagtaccaatagatgctgaattctctaccgaggttcgaaacaagtactacaggctctgctgcagtcagcatgcctttcttcatgaaaatctcattaagggcatgaactataagctgattgctggaattatattggaaactgtcaacattgctgatgcaatagaagttagtgtgatatgtaccccacgtgcagaattttctaactgggacaaaactttgcttgcctttgagcatttaggcatggatgttgaatttctaagagtccgattacgccggcttgcaagaattgcctatgagaaagatgatgcctctgagaccaaaaaacacttggcatataggaatgagtacagtcgcgcagacgatgaaataaagaacatggaagccaagcttgaagaattgaagggagcatgcaatggttttggtgcttatcttgagagtttgaagtgcagagctgaaagcaatcatatcaagtttcagaaagaggttgttgctccttggtga

SEQ ID NO: 55290 - DNA, 729 bp, Glycine max
  Peptide Sequence Number=SeqID_172068
atgaattttgacaaccatatcggtgaacagggctacaacagaatgggtcatgttagcttgcggcaatatacccaagtgcactcctttggaaaatcgatcgacgaccaccaggataacggtgttgccggggcacaacagactagctatcttcttcgtttcatacttagtacattggcaatcaatacatttggccaagaactgggtgacgtcatccctcagtcctacccagtagaagttttcagagacatgggcgagggtctttgctacgccgacatggccgcaagtgggagtggcatggaatttgggaagagaggatttcatgccggcattgggagtttgtatcacctaagtaagaagctctttaaggctatgatagtcggtgacaatggtaaacctgtggccaagcaagtattgacgccacttcttgacggtggtagtaatcgtgaacagttctcggactgctactatggtcgcatagcctctgataaacctgcgataaaaaccagcaaggcccaagaagctcctcagcgccttagtggttctaggaatgggccactgctgaatggcaacgaccttggtgctagaggctccacacccttattcgaaaacaagtgtcccaaagccactatagatgagaatatcatcgaagaaaacgatgatgaagtggcagagggtgcatacgaatttggtgatacccctgtaagaggtccaacttcgagaagcacctag

SEQ ID NO: 55291 - DNA, 1167 bp, Glycine max
  Peptide Sequence Number=SeqID_172069
atggactatgcaaagcaaatgaaaactcctatgcatccaaccactgtacttggaatggacgaagaatcaaagcagaatgttgggtacgtcatcaaagccaacctcatgttgtgtggcatccatcactttttcaaagaccccaaggtggtggtgcttgaactcatctgcgagttttggaggattgccaaggtgtacagaaacaaagtcattggaggctacttcactggaaaagtacttggcatatcagtaaagttgtctgttgagacaattgctaaagccattagttgtgagggtcgtggcacaaagttcatgaactggggagatgaacttgaagaccacattaggcactccttggcaagagcattaggaaagacatctaccatagtgttgcactcactaaagtatttaaagcccacaacaataaggaaattcttgtatgagacaagtgtaaatgtacaagacaaaatctacttggacgaagtgtttctacaaaagcagaaagccttcagccaagagaacatcttgaagatgagactagtagatgatggctcattccaacaaaaattccaggtggatgatttcatactctctgaacttcatcagaagttaggactcaacattggacaggacgactactttgccaaggctgcacctgctcaacaatgtctgcctctcactctcgttgctcctaaggcaataggtgccatggcccgcgtgtccaaaaggcttgcacctaagaagcaaaagcttttgtcatctgttgaaaacctaagggcacttagtgagactaagaggcggaccttgggctttgcaagaatgtgtaccaagggtggaccttcggtttttggagatggacatgttcaccttgggttttgtcaagcctatggagctgtgtcaaggcttaccaaggatgggccatggattttgtggacttgtaatgatcagcaagcgagaaacttgagtttaacaagtcttgcgtgcaacataagtgttgtgatcttgcatatatggcattcatcgtggatgacatgtattaaagacgatttaccaagggcgaaccttggattttgcgagcccttcagaggattgaccagggaattgttctacctgggttttggacattgtactcttgcatacatgtcactcgtcatgggtggcatgcaatga

SEQ ID NO: 55292 - DNA, 429 bp, Glycine max
  Peptide Sequence Number=SeqID_172070
atggtcggtaatggccaacaattggattgtaacagtgtttgcagagctgtctccatttcaattcaggctacgacgttcgtcgttgacctgcatgtcttgccaaattttggagccaatgtggtactcggtgttcaatggctcaaatcattaggtcctgtcctaaccgattataacgccctatcgatgcaattcttctacaatggcaaactggtgcagttacagggggatattgatgcttccctgagtgtgctctcacctccacaatttttccacctttgccgtaagcacggcgatagcctttattatcacatcactttgctctcgacttcggcccctccatgtccagatgagctacctgaggcaattagagccttactcaccaagtataaggctctgtttcaggctcctcattcattaccgccaccttga

SEQ ID NO: 55293 - DNA, 1744 bp, Glycine max
  Peptide Sequence Number=SeqID_172071
atggattttcctagctctatggaaggttggatgaaggctttgtatgtggtctttgtgttcttctatgctttcttccttggtgctttaaaaggcatagttgtgggtcctattgctgctctgattcttattataggcaacgttggggtgattctggggttgtttcctgcacatgtggcttggactctttacacccttttgaagattcatatgtttgatgcaccaatgaaagctgctattttgattgctttgcctgctttgtttggcttgtggttgggtctaggcgtagctggaagcgttcttgttggagtggggtatggctttttcaccccttgggtttcaacttttgaggccttcagacaagacaatgagtccaagaaattttctcactgtattgtggatggaacatggggaactatcaaaggtagttgcactgtggttagggattttgcagatatgtgttatcattcatacccaagttacttaaaagaactgcgtgaatcacctgcctcagatgagcgtcaaaggctaaggttaattcatgttcccggatgtgtcattgttgggataatggggctagttgtggagattcctcttttcactgcaattgctctagtaaagagcccctacttgcttttcaagggctggttcagacttttgcatgatttgattagcagagaaggtccattccttgaaatagtttgtatccccattgctggtttgacaatatttgtgtggccactagttgtcattgccagcattttgttggctattttctcaagcatttttgttggactttatgcatctgttatagtatatcaggaaagatctttccgtagaggtatagcctatgtgattgctatggttgctgagtttgatgaatatacaaatgattggctctatcttcgcgaaggaacattcttgccaaagccccaatatcgaaagaaaaaggcttctcaatcatcagagttttctgttaggggaaacagtgtgagaggaaacacttctatggagccacctgcaatgcttatgccatgcttagctccttcaagatctgttaaagagaccattcaagaagtgaaaatggtgcaaatctggggaaatatgatgaggtactgtgagatgagaggcaaggaactattggatgctaatgtacttacagcttctgacctctatgaatggatgaagggaaagaataacaatgaagctgccatagttggtgttggcttgccttgttattcactcctacaaacacttgtcttctccatcaaagccaactcatgtggtgtattgctacttgatgactttgaaataacctacttaaacagaccaaaggataagttgttggattggttcttcaatcctgtgatggttctcaaggaacagataagggttatcaaattgggggaagctgaactgagatacttggaaaaagtagttctctttggaagcaacaagcaacgcatggaggcttgggataatggtggtttgatgattcatgatgctcttagagctgctcaaatcgagggaatttcaagaaggatgattggaatgataagaggtatatcaaaacttccaacttataaaaggaagtttcgtcaaattgttaaagctctagttactcattctctggagaaagacgtttcagaaagggctttagttactcatcattctgtggatgtactagatgtttctgaaaaggctttagttactcgttatctggagaaagatccttctggaagatcaa

SEQ ID NO: 55294 - DNA, 753 bp, Glycine max
  Peptide Sequence Number=SeqID_172072
gggaaagtcgggggagagaacgtcttcgtccgcgatgagcaaatggagacgggacttgcatctgtggccaggggaccatttatcgtcacaatggtagcagagcccctggtcgcggcgtacggcgagctcctcagcggagagtcgcttgacagggagtttcggggggagggaaaggggagtgcggcggaggccgaggaccgcggcgacgatcgagcatcttgtcctcctgaagccgggcaagctcgatggcctctccgggagcaagccggagatgaaacagctgagcaaagaggaaggggcgatgccgatggtgcggttggcgaggcgctcaaaagctgtaagaacgatggcgcgaaacgggactctagtgcctgcaacatggccggccacgaagagaagaagccattacgcgatggtgaggcgttcgagctccgggataccctggtaatcgaagaactgggatattttgaatatccagcccaacgggtcgtggccatcgaaacggggaacgtcgagcttgagggctatggtggcaaggcgttcgaagagggattcaatttgggctgtgagggaagagtggatattgtcaatcttggaattgagggattgatgaccttgggagagggaagtgtggctctcggagaggcggtggacagcttcttcgagcttgtcggtggtggtttggcgggtatggtgatcgggcatggcgtcgggggcaggtcggaccaatttgatacgaatctcagtggatag

SEQ ID NO: 55295 - DNA, 1665 bp, Glycine max
  Peptide Sequence Number=SeqID_172073
atgtggtatccgacgaaggtgtcaagcccgtaccagacaagggcactacggggttttctcggtttagctggtttctaccgccggttcattaaagggtacgccaccttggccgcaccactaacaaagctattgggccacgaccaatttgtgtggtccttggaagctgccgctgcctttcaagctctcaaagacgccatcaaccactcaccgatgttggctttacctgatttcaccatccctttcgtggtggaaacggacgcgtcggggttgggcatgggcgtcgttctttcgcaaggtggacacccgatagtcttttttagcaaacaattatgcctgaaattgctaagttccttcacctatgtccgcgagcttgccgccattaaccccgccgtcaaaaagtggcgccaatacttgttggggcaccattttgtgatattaacggatcaccgtagcctgaaggatatgatgaaccaagtgattcaaactcccaaacaacaccgatatctagcaagattgttgggctttgattatacgatccagtatcggacaggcaaaaccaatgtggttgccgacgctctctcgcgatcaatggagttgtccgcagggtctctcttcatcttgtcaatgccggcactgcttgttgaatttcatcaatccccggcatgggggcatatgggaatcaaaaaaaccttgaaccacttagaggacaatttcatttggagcaccatccgtgaggatactcctcaaccttgggaggatttgtcgatggatttcatcgtgggtcttctggcgtatcccgaccatacatgcatccttgttatcattgatcacttttcgaagggccttcacctgggtatgcttcccacgcatcacactgcacatgtggtggctcttcttttcatggagctggttggtaaacttcatggcatgcccagaagtattgtttcagatcgtgacccattgtttatcagcaaattttggcaggagttgttctcccttagcggcaccaaacttcgaatgagttcggcctatcatcctcaaacggatgggcaaacggaagttgccaatcaaagcccccccaacttccctcagtatatcataggaacttcaaaaattgacgttgttgatgacttactaagtcaaagggaagccgtgtttactttgctgcgacgtaagctgttgaagtcacaatcacatatgaaaaccattgcagacactcatcgtcgggatcatgagtttaaggaagttatcgaacgaatgggcaaggttgcttataaactgaagttgcctgagcaatcacacatacaccctgtgtttctctgctccatccttaagccctatgtagaatcctctactcctatagaaactgtggaactaccaccaatggcgtttgacaatcaactgacggttaccctattaacaattatggcaacaaagagtatcccttcagcttcaggtctaaaacagatggtgttggttcaatggctggggttgcatcctgatgaaacatcatgggaggattggtctgtccttaaggctgctcaccaccttgaggacaaggtgtggcttgatgggctcgggaatgatacgaatagcaccaagggtctgcaggaacgcacattaggtagtaggcaccagatcgtgcctttaggtagtggagaataa

SEQ ID NO: 55296 - DNA, 738 bp, Glycine max
  Peptide Sequence Number=SeqID_172074
atggattgggatttgcaagctattgtgggatgcaacaaagcccctgcagccaccgtgatggacaacccgcatctcattttttctcaacatttctgtcctgaagaacaagatgacctactttgcaattttcaggaattctcagaaaccacaacggtggttgatgaattagaagagctttacaaaccttcctaccctcgtcatgttcatgacaaccctcttcccgtcgttgcaaattccccacctatcctagatgaaaaagtcaaagaactcaaaccatcagacaaaacagcatctagatgtaaaaaaagcaagaagcggcagaagaataagagggtggtgacagctgcagatggtgtttcggacccatgggcatggcgtaaatatgggcagaaaccaataaaggggtcaccttatcctcgtagctattatagatgtagcagctccaaagggtgcttagctaggaaacacgtggaacggagtcatttggatcctggagttttcatagttacctacactgcagaacacagcgatcctcaccctacatgcaaaaactcacaacaaagaaagaacagttccacaattccacttccaactacaagaactcgggatgatcaacacacattaatacctgtggtggcggaggctatcgaagatgagcatgaagaaattaaggagcttaagaaagaggaagattttgtagaaggtgttggtttccaagcatcgaagttgaggaactaa

SEQ ID NO: 55297 - DNA, 348 bp, Glycine max
  Peptide Sequence Number=SeqID_172075
atggccataatgaaggcagcaaatagagggcacaatgaagttgttaaatgctgcagtgaagcagtgtggttttggcctacccaaatagagggcaaaatgaaggtgccaaatgctgcaataaagacagtgaatagaggacataatgaaggtgtcaaatgctgcaagaaagatggtgaacagaaggtacaacataagtgccaaatgctgcaattaaggcagcgagtagagggcacaacaaagttatcaaatgcagcaataaaggcaaccaagagggctgcaatgaaggtggctagggttttttccgcagaagcagagttcctagattgggagctttgctatcaagtttaa

SEQ ID NO: 55298 - DNA, 1260 bp, Glycine max
  Peptide Sequence Number=SeqID_172076
atggctacggcgctggagaagaaagcgaaggaggcattcttcgacgacgaattcggtctggccgtcgatctctactctgaagccatacgattggatccgaacgacgccaatctcttcgcggacagagcccaagcccatatcaaactcaacgctttcactgaagccgtttccgatgccaacaaatccatccaattaaacccttccttgcccaaggcctatcttcgtaaagccaccgcttgtatcaaactccaagaataccacaccgccaaggtagcgcttcaaaacggtgccgcttttgcccaagacgattcaagattcgccaacttgattcaacaatgtgatcgctgcattgcagaggaatcaagtggccttactagcaccttgtcttcccatttgagcaatagaaataatgggatgactaaagaagaagctgaaggagacagtttgctttcccaaaagaatgaagccacactaaacagaccaaaatacaggcatgaatactaccagaagccagaagaagtggttgtgacaatatttgcaaaaggaatatcagcaaaagatgtggttgttgactttggtgaacagattgtagcaaaacagatcattcccaacaactgcagagttgaggtgttgtcaaccaaaattgaaatccgtcttgcaaaagctgaagctattaattggacatctctggaatatggcaagaatacacttcccccaataataaataggccgataggccttgggctctccaactacacaactagcttttgtggtgtgattctctcaaggttcttatcaattggtatcagaaccttttaccatgtctcttggctgcaaacaagcggcactggtggtgacaacggcattatagtgttcgcccaggactgtggctgtggagtgcagtgggatgttaagatccaattgcaagttatgggacttgagtcccacaagtatggcattttagtgtgggttcaatctgaaagggcttcatacccatcaccaaaaccaaggacaaaagattgggataagttggaagctcaagtgaaaaaagaggagaaagaagaaaagcttgatggtgatgctgctttgaataaattgttccgtgatatttaccaaaatgcagatgaggacatgaggagagcaatgagcaagtctttctcaaatggaacagtgctatcaactgattggaaagaagtgggatcaaagaaggtggaaggcagtcccccagaaggtatggagttgaaaaaatgggagtattga

SEQ ID NO: 55299 - DNA, 438 bp, Glycine max
  Peptide Sequence Number=SeqID_172077
atgccttgcccacgaatagcaagagacatgcttgtcatctctctccttctgctgcatgtcacaggtgttcgatcagaaccagaggaatccactctacatggcttgagagattgtcctcgctccaaggaattttggcttcgtatgggattcggttcgaatactatcctgacttgccagaatattcaagcttggattttagccgtgattaatcatcgaccatcagctcttattctttctacagtttggtgtttgtggaagtggagaaataattctattttcaccactgagcagtggggagttccttatgtgtgcaatttgacccgtttaacaacaactgagttagaattgtactgttccaagctacctagagtgactatgcatatccttgcgcaaatatccttttgtaaagctaaatgcatatggatcttgattgcataa

SEQ ID NO: 55300 - DNA, 339 bp, Glycine max
  Peptide Sequence Number=SeqID_172078
ggcccctcacctactaccgacgctccacttccccctctagccgttgatcaccatcccctcgtcagccctttagccatactggactggaaatgggatacttcggtcactcctccgctacgcatggtactcgtccagtgggccggtttacctcctgaagatacgtcctgggaatcttggtctgagttacagtcagcctacaacctcgaggacgaggttgtttttggaggcgtgggtgttgatagcattatgcagaacaaggccacagataccaataacagcagcactaacaggcccaagagagtaacccacagacccacatacctggaagacttcgtgtga

SEQ ID NO: 55301 - DNA, 504 bp, Glycine max
  Peptide Sequence Number=SeqID_172079
ctgtttcagatcgcggcggccgcgaagtcggtgctgcgcctcggcctcgacgtcggcggcggcaccggctccttcgccgcagcgatgaggctccgcaacgtgaccgtggtaaccacgaccatgaacgtggtggcgccgaacagcgaggccgtcgcgctgcgggggctcgtgccgctgcacatgccactgcagcagcggcttccgctgttcgacggcgtcctggatctagtgcggtgcgggcgcgccgtgaaccggtggattccgttgacggtgatggagtttctgctgctggatgttgatagggtgctgaggggaggagggtacctttgggtggatcattttttcagcaaaggggtggaccttgagaaggtgtatgcgcctttgatcgggaaattggggtacaagaaggtgaagtgggcgacggggaataagaccgatgccggtggggtaaaaaatggggaagtttacttgactgcgttgctgcagaagcctgtgtccagatga

SEQ ID NO: 55302 - DNA, 555 bp, Glycine max
  Peptide Sequence Number=SeqID_172080
atggccaagtccatacagcaagagcgaagaagcggcaaatgtttcgtatatttgctggcagcctttgtcatcttatgcgcacttgtgttggtttttgcgtccctattgcgcgtcaagaatccatatctcaaattaagatcagctacttccaacaaaatcagttacagcacttcaccttccttcaacgccaccctcatcatctttctcggcatcaagaacccaaatttcggcgccttcagttacaataataacagggtgagtgtgctctatgcgggtgtaaagatcgctgataggcaaatcaatggtggcagggtgcgtttcagagaaaccaaagaaattaatgttactgtgaaattgatgtccgctaaggcacccattagtgagaatctttctattgacattagttcggggtcgttgaatctcacgagtaatgtcaaatttagtggcacagttcatatgctcaagattatcaacatcagaaagaccatagaaatggcttgtgctatgaagctcaacttgacctcgcacacaattcagggtattcaatgccaatag

SEQ ID NO: 55303 - DNA, 870 bp, Glycine max
  Peptide Sequence Number=SeqID_172081
atgtcacacggtggcatttttgtaattaatgaagttataaatgaattttacgtcgcgaaatctaagacgatcataagggaccgtcttagaatggcacatagtggcaattttagccgccacgctctctccttcgcccgcttcgcttgtcgccacgacaagcgctaccattctgtcggcgagattcgcaacgacttccagatcttctctgataatcttaaactcatcagatccaccaacaggaggtctctcacctacacgcttggcgtcaatcattttgctgactggacttgggaggagttcaccagacacaagctcgacgctcctcagaattgctctgccacactcaaaggcaaccacaggctcaccgatgttgttcttcctgacgagaaagactggagaaaagaagcacttgtcatgtgcagcacaactggtgcattggaggcagcttacacacaggcctttgggaagaatatcagtctttctgagcagcagctagtggattgtgccggtgctttcaataactttggctgtaatggtggcttgccatcccggcttgacacagaggaagcatatccctacaccggaaaagatggtgtctgcaaatttacagctaaaaacattgctgttcaagtcattgactctatcaatatcactttgggtgctgaggatgaattgaaacaagtggttgcttttgtttggccagttagtgtggcatttgaggtagtgaaggacttccgattctacaataatggagtttacactagtaccatttgtggtagcacgcccatgggtggtcctggtggaaggcctggttttggtcgtggttccggtggttatggtgcaccaactagttcaaactttccttcttaa

SEQ ID NO: 55304 - DNA, 1497 bp, Glycine max
  Peptide Sequence Number=SeqID_172082
atggcaggtgctttcatcgaatctaagggaggcaaagcctatcctggtgggcttacacggagagtcttttttacatgtttcgtggctgcatttggaggactaatttttggttacgatcttggcatatccggtggagttacgtctatggatccatttttgaagaaattctttcccgaagtgtatgaaaaggagcacgacatgaaaccatctgacaatcagtactgcaaattcgacagccaaactttgaccttgtttacttcatctctgtatttggcggctttagtggcatcacttgttgcatctgtggtgactcgagcctttggaaggcggcttacgatgatctttgggggtttgctctttctctttggagctggactcaatttcttcgctgcacacgtttggatgcttattgttggtcgtctactacttggctttggaattggatgtgccaatcagtctgtgccaatctacatgtccgaggttgctccatacaattacagaggagctcttaatatgatgtttcaattagccatcactattggaatctttgctgctaatctcttaaactatctttttgcccaatacaagggcgtggatgcgtggcgctacagcttgggttgtgctgcagtacctgcattgatgataatctttggtgcattctttcttccagagtcaccaagttcattgattgaacgaggtttagatgaaaaagccaagacagagttgcagaagattcgaggaagcaaagtcgacgtagacgatgagtttaaagatcttgtggctgcgagtgaatcctccaaagctgtgaaacacccttgggcctctttgctcaagaggcactacagaccccaacttacatttgccatagctatccctttcttccaacaactcactggcatgaacgtcatcaccttctacgctcctgttttgtttaaaaccattggctttggtgccactgcttctctcatgtctgccctcatcactggggcttgcaatgcagttgccactcttgtttcaatattcactgttgacaaatttgggagacgcaccctcttcttagaaggagggacacaaatgtttctttgtcaggttttgattactagtttaattggaataaaatttggagttgatggaacaccaggagagttgccaaagtggtacgctactataattgtggtgggcatatggtggttggtgccaagtgagattttcccacttgaagtgcgatctgcttgccaaagtataaacgttgctgttaacatgatcttcacctttgccattgctcaaatctttaccacgatgttgtgtcacatgaagtttggactattcattttttttgcttgttttgtggtggggatgagcatatttatctacaagtttctaccagagaccaagggtgtccccattgaagaaatgcatgttgtgtggcagaatcacccctattggagaaagtttgttaaaccaactgactccaaacctcctagcgacgaggtatag

SEQ ID NO: 55305 - DNA, 1365 bp, Glycine max
  Peptide Sequence Number=SeqID_172083
atggagaacctaatttctttggtgaacaaaatccagagggcttgcaccgctttgggtgaccacggcgaagcaagtgccttacccactctctgggactctctccccgctatcgccgtcgtcggtggccagagctctggaaagtcctcagtattggaaagtattgttggcaaggatttcttacctcgtggatcagggattgttactcggcgaccccttgttttgcagcttcacaagattgacgagggtggcagagagtatgctgaatttctacatcttcccaggaaaaggttcaccgattttgctgctgtgagaaaagagattcaagatgaaaccgatagagagactggacgaacaagacagatttcaagcgttccaattcatcttagtatatattctcccaatgttgttaacttgactcttattgatcttcctggccttacaaaggtagctgtagagggccaaccagatagtattgtccaagatattgagaatatggttcgctcctacattgagaagccaaactgtttaattttggctattacacctgccaatcaagatcttgcaacatctgatgcaattaaaatatcccgtgaagtggatcccacaggggaaagaacatttggagtcttgacaaagattgatcttatggacaagggtactgatgctgttgaaatgttggaggggagagcttatagattaaagtatccgtggatcggtgttgtcaatagatcacaagcagatattaacaagaatgttgacatgattgctgctagacgtagagaacgtgaatatttttctaatacccctgaatataatcaccttgctaacagaatgggttctgagcatctagcaaagatgctttctaagcatttggaggcagtaatcaagtccaaaattcctggtattcaatctcttattagtaaaacaattgctgaacttgaagctgaactgagtcgtctgggaaagcctattgcagctgatgatgggggaaagctgtattcaatcatggaaatttgccgctcatttgatcatatattcaaagaacatcttgatggcgtgcgacctggaggcgataaaatttataatgtctttgacaatcagttgcctgctgccttaaaaaggctgcagtttgataagcagctttcgatggaaaatataaggaaacttattacggaagctgatgggtatcaacctcatctaatagctcctgaacaaggataccgtcgactaattgaatcttctctaactactgtcaggggtccagctgaggcagctgttgatgcggttcattccctattaaaagacctggttcacaaagctattagtgagactctggtttggtcctccttgctgctatgcctttaa

SEQ ID NO: 55306 - DNA, 1152 bp, Glycine max
  Peptide Sequence Number=SeqID_172084
atggaagctttcaccttgctcaaatactggagaggcggcggtgctctcggacacccaccttcctccgacactccctcttcacgcaccgccaccaccaccaccatcctcaccgccgtcgaaaacgaaaatgcaaccgaaagcgacgacgacgacgacggccccttcttcgacttagagttcaccgtccccgacgaagacgctcatgaaaatccaaacgcgaaccacacccaagaagaagaagatgaagatattaacatcgaagaatccgacggcgagagagagtttaagttcactctctccccttcgagcaacgaccgtagtgatccgaacctctcgccgctgtctccttcggacgatctgttcttcaagggaaagctggtgcacgtggacccttccgaacctaactccaagcctcagttcaccgcctccctcttaaaatccgccaccaaattccgcgtcttcatgttgggcctcaaaaagcccaagcccaacgacaaagactccaacaacggttccgattccgcaattccagaggcccacaaagacaagaagcacttcaccgtcaaattcaaagtcgaagaggtccccatcgtctctctcttcagctccaaagccaataaaaaccagaaccaaaagcaaacctcagaggacaaaccttccgaagagaaacgcttctccaaggaagtaatgcacaagtatttgaaaatggtcaagcctctctacattagagtctcgcgccgctacggcgaaaaactcagcttaaaccccgccgcaaaagcaccgcctccgccgcccacggcggaaccagaaggtgttagtgttggtggcggcgaaacaaacgtgaagagtagtactcaaggccaaaaactaccagcagggcttagcgttgtgtgcaagcatttggggaaaagccgttcagcatcttcggcggtggcggcggcggctcctccggcggtgtttgtgtcttcgaaacgacgcgatgattcgctgttgcagcaacaggatgggattcaaggcgccattttacactgcaagagatccttcaatgcatccagacctgagtgtgagtcttctcagctgccgcgttctgtgagccatccatgggacgagataggcatcaatgaagccaaagacaagcgcctttcagcatag

SEQ ID NO: 55307 - DNA, 1239 bp, Glycine max
  Peptide Sequence Number=SeqID_172085
atggcatcgcgcgtcagcattggcaatctcacttcctccgcgccgtatattaattcccctcattttcgctcacaacttaagctttccagcaactcctctttgcacaagccactcatgcgcgacaagactgtgctggtaaccggcggagccggttacatcggcacccacaccgttcttcagctcttgctcggaggttgcagaaccgtcgtcgtcgacaatctcgacaattcctccgaggtttctatccaccgagtcagggagcttgccggcgaatttgggaacaacctctcctttcacaaggtggacctacgggacagggatgcactagagcaaatttttgtttccacacaatttgatgctgtcatacactttgctggactgaaagcagtaggagaaagtgtgcaaaaacctttactatactataacaacaacttgactgggacaatcactctattggaagtcatggctgcccatggatgcaagaagaacatattatttaaattgattgaaggtagttctcacctcacttggggtgagatgtctgagaaggttaggaagctcgtgttctcttcttcagcaactgtatatggttggccaaaggaagttccatgcacagaagagttccctctgtcagcaatgaacccatatggacgaactaagcttatcattgaagaaatttgtcgtgatgtccaccgtgcagagccagattggaaaataatattgttaagatacttcaacccagtcggtgcacaccctagcggttgtattggggaggatccccgcggaattccaaacaatctcatgccatttgttcagcaagtagcagttggccgacggcctgcactgacagtttttggaaatgattataatacaactgatggcactggggttcgggattacattcatgttgttgatttagcagatgggcacattgctgcgttgcttaaactagatgatcctaatataggttgtgaggtttataacctgggaacaggaaagggaacatcagttttggagatggttcgagcttttgagatggcatctggaaagaaaattccacttgtgatggctggccgtagacctggtgatgctgaaattgtttatgcatcaacaaagaaagcggaaagagagcttaaatggaaggcaaaatatggcattgatgagatgtgccgcgatcaatggaattgggctagcaaaaacccttatggctatggagatcaggaggattccaccgtttaa

SEQ ID NO: 55308 - DNA, 639 bp, Glycine max
  Peptide Sequence Number=SeqID_172086
atggcaaagtccttgtcaagtcctgtggcaaacaaatccagcatgacaacagaggaagtgatcgccatgttcccatcacgcaaagaagaaaaagaaagcagcaaatgtttggtgtatgctttggttgtctttgtagccatattgttcatttggcttgtttttgcatctatcgtgttgcgggtgggagatccccagattcagttgaaatcagccaggttgatgcacaatacttataataatcatagtgtttcatcaaattcttcctttaaggtgaccttgctagctcgcgtgtccctcacgaacccaaacttgttctgtcgcttctattacgggaacactagagtgagtgtgctctatggggcttccagtgttggtgcatgggaattggaaggtgcgagattggagggtagagaaaccaaagaaatcgatttcgtggttcacatgagtttcagtactaagctagtggtagtaaagagaaatctaaccaatgatactacccactctgactctgcaggcatgctgaaactcagaagctacgcaaaattaagtggtacagtgcacgtgctgaacatggggaaatggggcaggtgcgagggttttgatgctgatgatgcctcgcgcgcatttgcgaggggatga

SEQ ID NO: 55309 - DNA, 186 bp, Glycine max
  Peptide Sequence Number=SeqID_172087
atggataatgttctcaatgtcaattatatcaaatatgtattaggtttggaagaatttgatttcttctactttgttcagcagtggccaggagcatactgtgacacaaagcagagctgttgctatcctaagactgggaaacctgctatctatcatattttggtgctagaggcactgatgtatgaataa

SEQ ID NO: 55310 - DNA, 228 bp, Glycine max
  Peptide Sequence Number=SeqID_172088
atggaggagattggtgcaggaaacatcgaaaagttagccactcaaacctcccttggttgtctactgatgggtgcgtcggggaaggaatctgatgaaccccttcacctcattccttcagcttctgtgacagttaattatactcctgcaagggatttcaaagaagctcatgggattccccagtggtggaaacctgacttacgcctggaatccaagctctaccaatactaa

SEQ ID NO: 55311 - DNA, 396 bp, Glycine max
  Peptide Sequence Number=SeqID_172089
atgtcttctttcaactatttatcttctttggagattttacacactgataaagattccaccattgtatttagggataatgcatatcatcgaaagtcagttgctgctagtttggtccaatgtgtttatgttctagagaaggacaggcaagaacagcgtgaaggttctgatgctcttgcactgccttggtgggcgttctttcacattcagttgcttcgtacacttgttgttgatgttgatgcttccatctttgctgccattcatgagttcaagcctccatcatctatgtgcaatgacaccttacgtagaggtccacgttatgtaattgccttccgaggaactataaccaaggcaggctcagtttcctgtgacattgagttggatatcaactttgtgtga

SEQ ID NO: 55312 - DNA, 192 bp, Glycine max
  Peptide Sequence Number=SeqID_172090
atggttggagattcaacattaggaaaagaagttcggaatggagaacatctaactttcatcaatgcttccatccaaaaattaccacactccatgtttttctcacctaggatgcacaggctggtggacactgcagtgaggaacaattcatttgatgagatgttcttgctggccggtgggattggtactctatga

SEQ ID NO: 55313 - DNA, 2307 bp, Glycine max
  Peptide Sequence Number=SeqID_172091
atggcagaaactgcagtgtccttggctggtcagcatgcgcttccaaaaatattggaagctgtcaaaatgctgagaggtctcccaaaagaagttatagacattacagatgaacttgaaagctttcaagatttcatcaatgatgctgataaagtggctgaagctgaacaagatgatggaaagcgtcataaaataaaagaaagggtgatgcggctgagagaagcagcttttcgcatggaagatatcatcgatgaatataacatctcctgtaaggataagcaacctgatgatcctcgatgtgcagctttactatgtgaggctgttgccttcatcaaaactcaaatccttcgccttcaaagtgcgtataagattcaggatgttaaattgcttgttcgtgctgaaagagatggtttccaacgccattttcctttagagaaaagatcaactagttctagaggaaatcaagatgccacctggcagaaacttcgaatggatcctctctttattgaggaggatgaggttgtggggctcgataacgatagagctacattgaaatattggttgacaaatggaagagaacaacgcacagtcatctccgtggtgggaattgcaggggtgggaaaaacaactcttgccaagcaagtttatgaccaggtgcgtaacaatttcgagtgccatgcgttgatcacagtttctcaatccttctctgctgtaggattgctgacacatatgttgaatgagctttgcaaagaaaaaaatgaggaccctcccaaggatgtttctaccatcgagtcgttgacaaaagaagtcagaaaccgcttgcgcaacaagaggtatgttgtcttgtttgatgacgtatggaatgaaacattttgggatcacattgaatctgctgtaattgataataaaaatggaagtaggatattaatcacaaccagggatgagaaggttgcagaatattgtaggaaatcatcatttgttgaggtgcataacctagaaaaacctttaactgaagaagaatctttgaaattgttctgtaagaaggcatttcagtatagttccgatggagattgtccagaagaacttaaagatatatctcttgaaattgtcagaaagtgtaaagatttacctctagcaatagtggccattggtggtcttttgtctcaaaaagatgaaagtgcacctgaatggggacagtttagtcgagatctaagtttagacttggagaggaattctgagttaaatagtataacaaaaattttaggtttaagttatgatgatttgccgatcaatctcagatcatgtttattgtatttcggaatgtatccggaggactatgaagttaaatctgatagattgattagacagtggataactgaagggtttgtcaaacatgaaaccggaaaatctttggaagaagttgggcaaccatatttatcagggttggtccatagaagtttggtgcaagtatcctcacttagaattgatggcaaagttaaaaggtgtcgtgttcatgacttaatacacgacatgatccttagaaaagtcaaggatacagggttttgtcagtatattgacgggcgtgatcaatctgtatcaagtaatattgttcgacgcctgacaattgcaacccatgattttagtggaagtacaagaagctcacccattcggtcaattcttatcatgacaggaaaagatgaaaacttatctcaagacttggttaacaaattccctacaaattacatgctactgaaggtacttgattttgaaggttctgcttttagttatgttcctgaaaatttggggaatttatgccacttgaagtatttaagcttccggtatacatggatagcaagtctaccaaaatccattggtaagctcctgaatttggagaccttggatataagaggcacaggtgtgtctgagatgccagaggagattagtaagcttaaaaagctacgtcatcttctggcttattctaggtgttcaattcaatggaaggatattggaggcatgacatccctacaagagatacctccagtgattatagatgatgatggagtggtcattagagaggtaggaaagctaaagcagttaagggaactgtcggtgaatgattttgagggaaagcacaaagagactctgtgttccttgataaatgagatgccactcttggagaaactacttattgatgcagctgattggagtgaagaagcttgtcctatttgggaagttaacaaggtttccaaattggatttcacagttcccaaatcttgtgcaactgcgtttgcgcggctccaggttgactaa

SEQ ID NO: 55314 - DNA, 165 bp, Glycine max
  Peptide Sequence Number=SeqID_172092
atgaattttagggaagcacggagggaagattcgttattaacaccaacacaatacgaagaagttgaaaatagtgttcctacaaagacagacaattttttacaacgggaaaactcaagattccctcaagttctttcttttacagcccgtgaaatggtggatgcatga

SEQ ID NO: 55315 - DNA, 1668 bp, Glycine max
  Peptide Sequence Number=SeqID_172093
atgaaactgaaacatgaagaatcatcatcaccatcatcttcttgttcatcatcatcatcacccatcaaattcctaatgtcaaggcatcaatgcaataccagcatttttggcctctctttctccttcattttctccctatggtgcctcctcctcttctacatcaagcttcgccttgttcatggcactggagctatgttagagttcaatgaatcaggtagctccaacaacagtcttggtcagaaactttcaaaaccctccaactcaattcccgaaacaactagtttagaacaaatgttttggcacgttttaggcaacggtagtaatttggtgtgcaaaccacaacctccacaagaggtaaacaaacttaaacaaattcctgatgagaaacttcatcatcacaattacgatgaatctcgagcgcaagaaaaaacaaaggtcatggactctgcgcttgttaacataactcacaggcttgaatctgatggttctgtgtacaactatgcctctgagtccaaaggtgcaaaggtggtggcccataataaggaggccaaaggtgcaaaaaatatactcgggaaggatcatgacaagtacctgagaaacccttgttctgttgaaggaaaatttgttgttattgagctctcagaagagaccttggttgattctgtgaagattgcaaactttgagcattattcttctaacttcaaggaatttgatttgtcaggaagtttgagctatccaactgaagaatggagcatgctgggaaacttcattgctgccaatgtcaagcatgcacagagctttaagctgcctgaacccaaatgggcaaggtatttaaagttgagcttgattagacattatggatccgagttttactgcacactgagtcttgtagaagtttatgggatcaatgcgatagagcggatgcttaaggatctaattgttgcttctgtggcatccattcctgataagttgcctgttcataatatcactgaccactcttctttgaaatcagaagatggtcaaattgacagaaatggaaaaaaagttgatactaagaatgatactgtggctgctgagatatcaagcaatgataccgctagagagtttgatgcagaagcagtaaaaacaacgatgactgcaaacttgattcttgatcctgtattagaacttagacaacagctaaatggtagggtagcaggtgacactgttctgaagattttgatgcagaaagtgaagtcagtggaggtgaatttatctgtccttgaggattacatcaaagaattgaacaggagacaaggggttaaattactggatcttgacaaagagttctccagattatcagaatgccttggacaaagcaagtcagagatcaaagacctatggcagtggaacacaaatatggaaaaaggaatatctgaggctgagtcttggaaagatgctgtctcatctcaacttaatgaaatagccagagaaaatagcatgctaagatcagacgttcgaaaggttgcaagtaatcaagcaaatatggaaagcaaagaacttgctgtattagcaacgagtcttgtttttgtgtgccttgccgttctcaagatagtttcagtacacatgttgacgttttctgcatcatacaatgcagataagctaggccattctatagttaatgtttaa

SEQ ID NO: 55316 - DNA, 414 bp, Glycine max
  Peptide Sequence Number=SeqID_172094
atgggccgaagaagatttctggccaagattggaacgggcttccttttggcatttggatcaagagccttgcttcaattccaagatcctcctcctccctcaaccgcacctttttcttctcatgttcctttagcgccggcgctgttcgtcatcggagattcctccgttgattgcggaaccaacaattttctgggcaccttcgcgcgcgccccgatcaccttccttacggaaaagatttcgacacccaccaacccgccggaagattctccaacggaaggatccccgtcgattatcttgcgtcttgggcttccttttgtgccaagttatcttgtgcagacaggggttgtggaggatatgattaaaggggtaaactacgcttctgctggtgctggcattattctctctagtggctcttaa

SEQ ID NO: 55317 - DNA, 1939 bp, Glycine max
  Peptide Sequence Number=SeqID_172095
atggctaccaagcattcactaatgtctctctttcacagaacttcatcacagggtgagcacaacccgttaaacatgtccgatgagcagatattggaccaaatttactcaacccatgtccacagtcacacaaagtttgatgtagactctcttttcattcttgttgagaacacccttaggcgttcaactctcattgttgacaatgttgttcagggttccaaagcaagcttggagcaggtagaagacaagattccccaagccaacttcaattctccactctataccctgaagcaaatttattccgagatgtcatgcaagcctccaggagaggaaatagctcatataactacaatggccatacttgtcaagctctcaaactatgagtgggatgcaaaagcagtgctgacactggcggcttttgcaatggaatatggcgagttctggctgctagctcagcatcaaccaacagaccctattgccaaatctgtggctgttctgaagggagttccagtgctcacaagacctgcagcagtgcaaaagcatcgccaagccatcactgagctcaacaatctggtcaaaacaacgttgctagtcattgagttaatctttgagttggagaagcttacaacttttgacacaaaggatgtgcctgctttgttgcccgcaatagaacaaattcctgttgatgtctactgggctatcatcaccattgtggctattgttactcagattgattacctcactactgagtcagggaacaagcaagacctgtcccactatggtcaaaagatcaacatcatacttagcaaactgaggaagcaaatcatgctgtgcagacaacagattgaggaggcagagtatcaccacaggctcaggaaattttttcaaacgcctactgaaattatggaagtgtttaagtttctagtttattcgaaggatgctccacagctactgtttgatggtgccgctaagaccacggtcgaaatcactgagctcaagaagaagcatgtttacttgctgatttccactctagacatcacggaggaagagatttcagtactccgaccagtttatgattctattaaagctaatgatcagtataagattgtgtggattcccattgtagaagaatggaccgaaaagctgcacaagaaatttgagtttttgaaaagcaagatgccttggtatgtggtgcagcattctggacccatagcagggtacaaatacatcaaggaggaatggcacttcaaaaagaagcctatggttgtggtgttgaatcctcaaggaaaagtgcagcatgcaaacgcattccatctcattcatgtttatggaatgaaggccttcccctttactattgcggatcaagagagaattgatagagaaattcactggattggttctgtagtcggggattctcacccccacataagcacatggattagagagcaaaagtacattctcatatatggaggcagtgacaaagagtggatccatcagttcacaaagcatgcaactgcctttgcaaacgacgccgctctgaaggatgcaaagattcatattgagttgttctgtgttgaaaaggaagataaaagcttcctgaggcggttttggagtggcatagaaagcttgtttgtgaccaaggctcacaacacagttgatgcagtgactcaagaagtgcaaaagatgctctcttacaagaatgaaactgggtgggctgtcctatgcaaagggtcatctgtggtgatgagtggtcatggaaccacaatcttgaagacagtggcagagtttgagaaatggaaagagtttgtggtgaaaaaggggtttgagccctctttcaaagagcaccatgaaaggattaggcgcacccatcatcgctgcatacaccttgaaattcctaatgctgctgggaagttaccagagaccatacgatgctcagagtgtg

SEQ ID NO: 55318 - DNA, 231 bp, Glycine max
  Peptide Sequence Number=SeqID_172096
atgcatggctatatcgccaacacaaatagtgagaccacttgctattccgtcagtggcagtgacgtttttgccacatgttgcacgcaggggcttctcgtcagtaatattgacaatttgcatggtaatattacctccaagaaaacatgggtcttgtgcgaaggaatcaaacctatctcaaactcctacaaatttaatcaatgttactggaatgttggcatccctgtaccttaa

SEQ ID NO: 55319 - DNA, 306 bp, Glycine max
  Peptide Sequence Number=SeqID_172097
atggttgccattgtcaccctcaaagcgctgaccgctatatttctcgtcattgcaattagagtggatgggcaatgcactctgagcaatcttgaagtgcaccaatacgatacaggaagaccctatcagggtacaagtttgtttgctgtgaccatcatcaatagatgcactccactgtgcgatcaaagcaatgtgaagttaaactgcactggatttaagaccgtgaaacccatagacccttcaattttgaatgtctctggtgatgtttgtattgtcaagaatggccaacctatcactatcgatgatcct

SEQ ID NO: 55320 - DNA, 624 bp, Glycine max
  Peptide Sequence Number=SeqID_172098
atggctatctcttgtagtagctacatcacgggggaagagatttcagtattcgaaacagtttatgattcaattaaaactagtgaacagtataagatcgtgtggattcccattgtggaggaatggaccgttgagtacgacaacaaatttgaggattttaaatgcaagatgccttggtttgcggtgcagcattctagaaccatagcaagcctatatatggttgtggtgttgagccctcaaggaaaggtgcaacactcaaatgcattccatttgatccaggctcatggaaaaagagctttccccttcacatttgtcaaacaagaacaaataaacaatgagatctattgggttggctccgaaataggcaacatttaccccatcataaacacttggttcaccaagaatgttagcatccttgcaagtgatgccgctataacggaggcaaatatttccatagagtggctttgtgtggaaaaggaagacaaaagcgtgatgaggcgcttttggggtggcattgagagtttgtttgtgactaaggttcacaaggcagttgatgcagtgactcaagaagtgcaaaagatgctttctttcaagaatgaatctggatgggacggatctccttattag

SEQ ID NO: 55321 - DNA, 345 bp, Glycine max
  Peptide Sequence Number=SeqID_172099
atgtcaatgtctaccaagtctctcctccaaaatgctgagaatgagcaaaagccactaaccatgcatggatcccatgcaagcttggagcacatagatgacaagatcccccaattggattcaccactttgtctcctgaagcagatttcttttgagatgtcatgcaagtctccaagagatgaaattggtcacaaaacaacactagccatacttaacaagctctcaaactacgagtggaatgcaaaggcagtgctgacaatggcggcttttgcactcgaatatagcgagttttggatgcatgctagctcagtcccaacaatcctcttgcaaaatctgtggctatactga

SEQ ID NO: 55322 - DNA, 240 bp, Glycine max
  Peptide Sequence Number=SeqID_172100
atggatgcaggtgcagcaaaggaactgatggcatatttggtcaagctacagtcctcactttcagaagtcaatcagagaaacgggtgtactggtgtactagaaaacaatatgataagattggaatcaaatcgctttagaaaagtcatggtgtcatcatccagttgtaccaatggacttctttggcttacaagatacataagtgctacaactgctgagttgtatgattttgatgatgagaat

SEQ ID NO: 55323 - DNA, 1566 bp, Glycine max
  Peptide Sequence Number=SeqID_172101
atggctagggatcagttgcaagtgcttaatgcactcgatgttgccaagacacaatggtaccatttcacagcaattgtgattgctggaatgggtttcttcactgatgcatatgatcttttttgcatctcccttgtcaccaaattgcttggccgcatatactactttgaaggccacgacaagcctggctctctgccatcaaatgtttctgctgccatcaatggtgttgcattctgtggaacccttgcaggccagcttttctttggctggctcggtgacaaaatgggaaggaaacgtgtctacgggatgacccttatgctcatggtgatatgctcaattgcttctggtctttcttttggcaaagaccctaaagctgttatggctactctttgcttcttccgtttctggcttggatttggcattggtggtgactaccctctttcagccactatcatgtctgagtatgccaacaggaagactcgtggggcattcatagctgctgtttttgccatgcaaggttttggaattttggctggtggcacggtggcaattgtagtttcatctgctttcaaggccctgtaccctgctccagcattccaggttaacccagttttgtccacagtgccacaagctgattatgtttggaggataatcttgatgtttggtgcactcccagctctgctcacatactattggcgaatgaaaatgcctgagactgcaaggtacactgccttggttgccaagaatgccaagcaggcagctgcagatatgtcaaaggtgctgcaagttgagatagaagctgaacaggagaaagttgagcaattggacacaagaagagggaatgaatttggcttgttcacaaaacagttccttcgccgccatggacttcaccttgttggaacagccactacttggttcctgttggacattgcgtattatagtcagaatcttttccagaaagacattttcagtacaattggttggattcctgaagcaaaaaccatgaatgccgttgaagaggttttcaaaattgctagagcacagaccctcatagccctttgcagtaccgtacctggttactggttcacagtggcactcattgataagatgggaaggtttacaattcagttgatgggctttttcttcatgacagtgttcatgtttgccttagctattccataccaccactggaccatgaagggcaaccaaattgggtttgttgtgctgtactcattgaccttcttctttgccaattttggtccaaatgccaccacattcgtcgtgccggcagagattttccctgcaaggctaaggtctacatgccatggcatatcagctgcagcagggaaagcaggggcaatggtaggggcttttggctacctgtatgctcagaatgccattgggctgagaaatacacttatagttttgggtgtgattaacttcttggggatgctgtttacattcttggttcctgaatctaaaggaaaatccctggaggagatgtctggtgaagctgaagaagagactactgctgctacaagagaatcagcaatggaggctggtctagaa

SEQ ID NO: 55324 - DNA, 1194 bp, Glycine max
  Peptide Sequence Number=SeqID_172102
atggaacgtggggttcttgatagtatcattaataggctgcttgaagtcagaggcagaccagggaagcaggtgcaactttctgaggctgagatcaagcagctttgtcttgtctccagggatatcttcttgaggcagcccaacctcttggaactcgaggcaccaattaagatctgtgtctgggtggattataacacgaataagaatctttctagaaacttaattatcttcatggggacttcaggaagcaaaagttttgtggatggatttgtccagtatggaaatgaaactatcttctcaatgttgttttgtttgtgtaatatgaagaaacagagcggagttccacgagatgtccatggtcaatattccgaccttctgcgactttttgagtatggtggattgcctcctcgttctaattacttgtttctaggggactatgttgatcgtgggaagcaaagtttggagacaatatgtctccttctggcttataaaataaaatatcccaacaactttttccttctgaggggcaaccatgaatgtgcttctataaaccgcatctacggattttatgatgagtgtaaacgaaggtacaatgtgaggctttggaaagtgttcacggaatgtttcaactgcttgccagtggcagctctaattgatgaaaagatactttgtatgcatggtggactctctcctgagttacacaatctgaatcagataaagagtttgccgcgtcctattgaagtgcctgaaactggtctactatgtgacctcctttggtctgatcctagtagtgacattcggggttggggagagaatgaccgcggagtttcctatacttttggtgctgatagggtgacagaattccttcagaagcatgatcttgatttgatttgcagggcccatcaggtcatggaagacggatatgaattctttgctaacaggcaacttgtaaccatcttctcggctcctaattactgtggagagtttgacaatgctggtgctatgatgactgttgatgagacacttgtttgctcttttcaaatattgaagcctgtagaaaataaaaagcctaataagtttgcctttgggagcacaactacagttaagcatagtactccaacaaaaaccaaggttctagcagtggaaatagcctttccgctcacttggataaggttgcatccatctaaccctccctag

SEQ ID NO: 55325 - DNA, 1611 bp, Glycine max
  Peptide Sequence Number=SeqID_172103
atggcaggaggacaactaggagtgcttaatgcactcgatgtggcaaaaacacaatggtaccacttcactgctattgtgatagctggaatgggattcttcactgatgcctatgatcttttctgcatttcccttgtgaccaagttgttggggaggttatattacacagacataacgaacccgaagcctggtgttcttcctcctaatgtgcaagctgctgtgactggtgttgctctatgtggcactttagccggccaacttttctttggatggcttggtgacaagttgggaaggaaaagggtttatggcttaactcttatgcttatggttgtgtgttccgttgcctcagggctctcttttggagacacccccaagggtgtcatggccacactttgtttcttcaggttctggcttggctttgggattggtggtgactaccctctatcagctacaatcatgtctgaatatgccaacaaaaagactcgaggggcattcattgctgcagtgtttgcaatgcagggttttggaatcctggctggtggaatagttgccttgattgtgtcatctgcatatgaccacaaatatgatcttcctagttacaaagacaatccagcaggttcgaaggtggattcgcttgattacgtttggcgtatcattttgatgtttggtgcagtcccagcagggcttacctactattggcgaatgaaaatgccagagacggctcgttacacggcccttgtagccaagaatgcaaaacaagctgcttcagacatgtctaaggtgttacaagttgaggttgaagctgaagaggataagttgcagcacatggttgagagtgaacaccaaaagtatggcttgttcagcaaggaattcgccaaacgccacgggctgcacttggttggaaccacagttacttggttcttgttggacattgccttctacagccagaaccttttccaaaaggacattttcagtgccattggatggatccctcctgcacaagacatgaatgcaatccatgaagtttataggattgcaagagcacaaacactgatagcattgtgcagcaccgtgccagggtactggtttacagtggcctttatcgatatcatgggccgtttcgccatccaattgatgggtttcttcttcatgacagtcttcatgtttgctcttgctataccttacaatcattggaagaaccacaacaatattggctttgttgttatgtactcattcacattcttcttctccaactttggtccaaatgccaccacatttgttgtgccagcagagattttcccagcaaggctaagatctacttgtcatggaatctcagctgctgcaggaaaggcaggagctattgttggtgcatttgggttcttgtatgctgcacaaagtacgaaccccgataaagttgatcatggttacccaactggtattggggttaaaaactccctcattgtgcttggtgtgatcaacttctttggaatggtattcaccttgttagtgccagaatcaaagggaaaatcactggaagagttgagtggggagaatgaagatgatggtgctgaggctatagagatggcagggtctgctaggacggttccagtttaa

SEQ ID NO: 55326 - DNA, 506 bp, Glycine max
  Peptide Sequence Number=SeqID_172104
atggcagaaactgcagtgtccttggctagtgagcatgcgcttccaaaaataatggaaggtatcaaaatggtgagagatctcccaaaagaagttagagacattacaaatgtcatcgatgaatataacctctcctgtgaggataagcaacctggtgatcctcgatgtgcagctttactatgtgaggttgttgccttcatcaaaactcaaatccttctccttcaaaatgcgtataagattcaggatgttaaatcgcttgtttgtgttgaaagagatggtttccaaacccattttcctttagaaccaagactaacaagttctagaggaaatcaaaatgtcacctggcagaaacttcgaatggatcctctctttattgaggaagacaatgttgtggggcttgatggccttagaggtacattgaaaaattggttgacaaagggaagagaaaaacgcactgtcatctctgtggtgggaatccctggggtgggaaaaaccatcttgccaagcaa

SEQ ID NO: 55327 - DNA, 990 bp, Glycine max
  Peptide Sequence Number=SeqID_172105
atggagctcatcattccaattcttatggactacatcattgctccggctttccataactcatacttggaagctatggttaaaatattcacaacttgttcagaaagaacaatattgaagtttaataagcttcttgaaggagagggttatgatggacctgactcaattgaattggatcttgaggcagagttttctagtttggctcttgatattattgggcttggtgtgttcaactatgactttggttctgtcaccaaagaatctccagttattaaggcagtctatggcactctttttgaagctgaacacagatccactttctacattccatattggaaaattccattggcaaggtggatagtcccaaggcaaagaaagtttcaggatgacctaaaggtcatcaatacttgtcttgatggacttatcagaaatgcaaaagagagcagacaggaaacagatgttgagaaattgcagcagagggattacttaaatttgaagttgagggatgatttaatgacaatgcttattgccggtcatgaaacaacggctgcagttcttacttgggcagttttcctcctagctcaaaatcctagcaaaatgaagaaggctcaagcagaggtagatttggtgctgggtacggggaggccaacttttgaatcacttaaggaattgcagtacattagattgattgttgtggaggctcttcgtttatacccccaaccacctttgctgattagacgttcactcaaatctgatgttttaccagattctggcattgcactcttgccaaatgtgctgcatgctagccacaaaagcacaattccacagcatcttttccctgttgctctcgaaacatctagctggatagaaacagagttcaaagctaggtggacagatacaatgttccccagacagaaactaccgtgcaaaaaggggcttgctacttgttttagagctactgtggagttgaacatgaacaaacatcaactgtga

SEQ ID NO: 55328 - DNA, 1422 bp, Glycine max
  Peptide Sequence Number=SeqID_172106
atggaatccatgtttcaagaagaagggtcatcttctgtaacttcttcttcatctcttcagttcttttccatgatgtctctctcactttcacctagcttaggatcatctccctatcaaatgaaatgcgaggaaaggggtttggtattgatccatttgttgctcgctggtgctaattttgtagccaccggtgatttacaaaatgcaaacctcacacttgagcagatttcccagcatgcctctcttgatggggatactatgcagcgaattgcttcatatttttctgaagcactcgctgatcggatacttagaacatggcccggcatccatagggccctcaattccaacagaatacctatggtttctgatgaaattcttgttcaaaagctcttctttgagcttttacccttcctgaagttctcatatattctgacaaatcaagctattgttgaagccatggaaggggagaaaatggtgcatgtaattgatctcaatgcggctgggccggcgcagtggattgctctcctccaagttttgagtgcacgttctgaaggccctccacatttgaaaatcaccggggtccatcaccagaaagaggttctggatcagatggctcataaactcactgaggaggcagaaaagttggatatcccattccaattcaaccctgtgctcagcaagttggaaaatcttgatttcgaaaaacttggggttaaaactggggaggcactagcaataagttctattatgcagttgcactcccttttggccttggatgacgatgcctctcggagaaaattgcctcttttgtcgaaaaactcaaatgcaattcacctgcagaaaggtctcctaacaaaccagaacacattgggagatttgcttgacggctatagcccgagtcccgattcagcctcagcttctgcctcatcctcgccagcgtcctcatcggcttcgatgaattcggagagctttcttaatgccttgtggggtttatccccaaaagtaatggttgtaactgaacaagactttaatcacaactgtttgaccatgatggagaggctggcagaagctctattttcttatgctgcatattttgattgtttggagtccacggtctcaagagcttccttggacagaataaaacttgagaagatgctttttggtgaggagataaagaacatcatagcttgtgaaggatgtgaaagaaaaaaaaggcacgaaaggatggataggtggatccaaagacttgacttttctggctttgcaaacgtgcctattagctattatgggatgctgcagggaaggaggttcttgcagacctatggctgtgagggttacaagatgaaggaggaatgtggtcgggttatgatgtgctggcaggagcgacccttgtttttcataacagcttggacaccaaggaaataa

SEQ ID NO: 55329 - DNA, 1689 bp, Glycine max
  Peptide Sequence Number=SeqID_172107
atggggagagtggttgtgggggtggcggtgacggtggcggtggcgacgtgcgcgttggcggcggtggtggtggggcggagagtgaggagccggaggaagtggaagaaagtggcgaacgtggtgagggaactggaggaagggtgcgacactagggttgggaggttgaggcaagtggtggatgccatggccgtcgagatgcacgctggtttggcttctgaaggtggctccaagctcaaaatgcttctcacattcgtcgataatctccctaatgggacagagagaggaacatattatgcacttcatcttgggggtacaaattttcgggttttgcgggttcaattaaatggtcaaccatcttcagactttgaacatgaagtagaacgacaacccattccccaacatgttatgactagcacaagcgaggatctctttgattttattgcgtcttcattgaaggaattcattgctaaagaaggagatggttccaatatttcacaggacagaagggagcttggatttacattctcctttcctgtgaaacaaatgtctgtatcttctggcattttaatcaaatggacaaaagggttttccatcgtagatatggtctcagagcagccttttaactgttcagaccaaattagtttttcgaagttgctatttgtgttttccccatcaaaacagttaccaccgagaaatagaaatgaagaatctattcaagttgtacttggtccttcagtagcagtgtgtaaacataatagccgtgttttattaagaacaaaatctgtttgttgtcaggtaggaagagatgttgcagcatgtttgcaagaagcattgacaaggaaaggcctagatatgcgggttgctgccttggttaatgacactgttggaacattagcagttggacattatcatgatccagataccgttgcagctattataattggtactggtacaaatgcctgctattgggaacgagttgatgctattatcaagtgtcaaggccttcttatgacatctggacgaatggttgtcaatatggaatggggaaacttttggtcctctcacttaccaagaacgtcgtatgacattgacttggatgctgagagcccaaatccaaatgatcagggttttgagaaaatgatatcaggaatgtatcttggtgacatcgtgagaagagtcattctcaagatgtcattagagtcggatatgtttggaccaatttctcccaagctttcaatgcctttcataatgaggactcctttgatgtctgccatgcatgaggataattctcctgacttgagagaagtagcaagaatccttaatgacatatttgagattcctgatattcccttgaaggcaagaaaatttgtggtgaaggtgtgtgatgtggtgactcgtagagctgctcgattggcagctgctggtattgttggtatcctgaagaagattggtagggacgggagtggtggcatcacaggtggacggagtagaagtgatatgaaaatgagaagaacagttgtggcaattgaagggggattgtattctaaatatgcattgtttagggagtacttgcgtgaagctctaaatgaaatattgggagaagatattgccaagcacgtaattctaaaggtcaccgaagatggatccggcattggggctgcactgcttgctgcctcttattcatcctaa

SEQ ID NO: 55330 - DNA, 153 bp, Glycine max
  Peptide Sequence Number=SeqID_172108
atgggtgggagggcatttgaatccgcacctcccattatgaatctttcacctccccaaggaagccgaatggacaaaaatgttttgtcttcttcctctagtaacccaacccacgtcaaccctccacccaacaattcctccaacatcctctattaa

SEQ ID NO: 55331 - DNA, 1248 bp, Glycine max
  Peptide Sequence Number=SeqID_172109
atggcgcctgatgctgccgccgccaacggcaaaaagagaagacgctatcttcctcataacgtctctcttctcttgtcttttgtggcttttgtttgcacttctaagtttcttctctttattttgttgccgaggactgaggttgttgttttcatgaatttttttcagaaggcagtgaagaagaagggttcgtaccctctgcggccaggcgtgcaaggttttttcatcacttgcgatggcggcagagaacaccaagcctctcgtgaagctctcaatattctcgattccttttatgaagagctagttgatggggaacattcaagtgtaaaggagttacccagcaaacctttaaataaaaaaatcacgtttgcagattctgactcttctagtagcgatgatgatgatgatgatgatgaggaggaggaggtgcaggagggggatgaggaaaagggggacaaaaagccaaaattggatacttctaatgacgacaacaccagtcacgatgatggagtacctgaaaaatcagatcctcataaagttgatgaaccacacactcaggaagtagatgaaacttgtgataataaaggtgcgaatgacaatcttaagactactaaagggacagctgatggtctaccagctgtgaaacagtgctgcaaaacaaacgtgcctgcatgtaattttagtgacaaagtggaacagaagtctattgataagttaattgaagaagaattcaaagaattgggagacaagaataagtttttctcagaattccctacatatgcacatgcacatacttgtgcaactaatgctgagaggtgctttgtcaagcttgattctggttgtaatggtgtagtatttgttcaaatgcggaagaaagatggagaccgaagccccaaggatatagttcatcggatagtgacatcagcagcatcaacagggaaacatatgtcaaggtttattttgagaattttgccaattgaaatcgcatgttatgcttcaaaggaggaaatttcaagagcaatcaagcctcttgtggaacagtactttcctgtggaaactcaaaatccacacaagtttgctgtactgtatgaggcacgggcaaatactggtgttgacaggatggaaatcatcgatgctgtggcaaagtcagttcctggaccccataaagttgatctaaaaaatcctgataaaactatagtagttgaaattgccagggtaagaaagccatgttgtgtctggaatttaagttaa

SEQ ID NO: 55332 - DNA, 2421 bp, Glycine max
  Peptide Sequence Number=SeqID_172110
atggcttccaatgccacatctaaaaatgcttgcccaccgccaatgaaagccacatcaaacggcgcgtttcagggtgacgatcctcttgatttcgcgcttccccttgctattttacagatatgccttgttcttgtagtctcaaggggactggcatatcttcttaaacctttaaggcaacctagagttattgcagaaattattggaggaataattctcgggccatcagcacttggacggaataaaagctatatgcagaatgttttcccacccaggagtcttacagtattagatactttagcaaacattggccttatattctttctattcttagcgggcctggagttagatcttaaatctctgcgtcaatctggaaatcgagttcttgctattgctatggctggaataagcctaccctttgtaataggaattggttcatcatttgttctaaaacaaacaattgccaaaggtgcagatagtgcagcattccttgtatttatgggtgttgctctgtccataactgcattccccgtattagcccgtattttggctgagttgaaacttctaaccacaaatgttggcagaacagctatgtcagctgcagcaattaatgatatagctgcctggattctgcttgctctggccgttgccttgtcaggccatgaccgatctccactcgtgtcattgtgggtcttcttagccgggtgtggttttgtcatttgtgcaatccttattgtccctccaattttcaaatggatgagccaacgatgccatgaaggtgaaccagttgaggaggtatacatatgtgctacattagctgctgttctggctgctgggtttgtaacagatgctataggaatccatgccatgtttggtgcttttgttgtcggaattttggtcccaagtgatggaccgtttgccagtgctcttgtggagaaagtagaggatcttgtgtctggtctatttcttccactttattttgtgtcaagtggattgaagactaatgtagccaccatcaagggggcgcaatcatggggtcttctggtttttgttatatttacagcttcgtttgggaagattcttggaactcttgttgtttcacttttctgtaaagtaccttttaatgaggctttggtgttggggttcttgatgaattgcaagggtttggttgaattaatagtcctcaacatcggtaaagatagaaaggttttgaatgatcagacttttgccattatggttcttatggctgtctttactaccttcatcaccactcctctcgtgactgctgtgtataagcctgcaaggaagggaaaaatagttgattacaaatatagaacaattggaaggaaaaatgcaaatagccaactgaggattcttacctgcttccacggtgcaagaaatattccatcaatgataaatttgattgaggcttcaagaggaatccggaagggtgacgcactttgtgtgtatgcaatgcaccttaaagaattctctgagaggtcctcaacaatattaatggtacataaggcaagaagaaatgggttgccattttggaacaaaggccatcatgcagattctaaccatgttattgtggcatttgaggcttacaggcaactaagccaagtgtctattcggccaatgattgcaatctcatctatgaacaacatacatgaagacatttgtgcaactgctgagaggaagggtgccgcagtcattattcttccatttcataagcatcaaagattggatggttcactaaatatcactagaaatgattttcgatgggttaacaaaagggtactagagcatgcaccatgctcagttggaatctttgttgatcgtgggcttggtggtacatctcatgtctccgcaagtaatgtttcatatcgtgttacagtgcttttctttggtggtggtgatgatcgtgaagcccttgcttatggagctcgtatggctgagcaccctggcatcagattgctggttattcgctttgtaggggaaccaatgaatgaaggagagattgtaagagttgatgtgggtgactccactggcaccaaattaatctcacaggacgaggaattcctcgatgaatttaaggcgaaaatagccaatgatgactccatcatctatgaagagaaagtagtaaaagatggtgcagaaacagttgctattatctgtgagttgaatagctgcaatctgtttcttgtgggttcaaggccagctagtgaagttgccagtgctatgaaaagaagtgaatgccctgaactaggacctgttggtggtttgttggcatcacaagattaccccacaacagcatctgttttggtgatgcaacagtatcaaaatggggcaccaataaattttactatctcagactcagaaatggaggaacacgtacctgatcgggattcggaatctgcttaa

SEQ ID NO: 55333 - DNA, 1545 bp, Glycine max
  Peptide Sequence Number=SeqID_172111
atggagagcattgaaattagcattcctactaaacctgagctgcatgagagtggcacgaaatctggagccaacaaagcttggcttcgagatcagattcagagtgtatgggatttttgcaaggaagacactggtagagaaatatttgcactcaaagctgggctggctgttcttcttgtgtctttgcttatattatttgaagccctatgccaagtctttgggccaaatattgtatgggccattctcactgctgtccttgtattcgaagacactgttggagcaacgtttaatcgaggatttaatcgagcactgggaaccttggtggcgggaatcttggccattgttgttgctgagacagcactatcctgtggccatgtcgctgagcctattatcattggccttagtattttcatgatcgccgtcataacttcgtacatgaaaacttggccaccgcttgtgcagtatgagtacgggtttagggtggcactgctaacctattgcttgatcatagtttctgactatcgaatgggaaatccaattagaactatgttcgatcggttgtattccatcgccattggaggaataatatcaatgttggtcaatgtctctatttttcctctatgggctggggaccagttacataaagaattggtcaaaaactttcattcagtggcagattcacttgaggaatgtgtcaagaaatatttagaagatgtaccagagaagtctaaagtcaccatggctagcatagatgcatttccagacgaaccggcttataagagatgtcaaagcagcttgaattcagggtcaaagcttgagactctggcaaaatcagcaaaatgggaaccaccacatggtagattcatgcacatttcatatccatgggcacaatatgttaatgttggggcagtcttgcgatactgtgcttatgaagttatggcactccatagcattgtacacgctgaaattcaggtaccctacaaattgcgggttgtgttccaaactgaaatccaagaggcatcaaaccaagctgcagagatagtaaggattttgggaagagacattagccgcatggagtggagtctgaaaaattcccacattaacaggcttcatagctctattaagaggctgcaacgttctatgtacttccaatattcttatctactgacatccacttttgaaccccctatccttgataactcttcaaagtcctttgcaaacaatatttcacatatcttctaccatttaccgtatcaaagggagatggcagaacaagtagaatgttatcatgagataacgaggaagcagttgaaaagactatattcttggccacctagagaagtggatgcttttgaagaagatagtgagaaaaacattaagttgttagctggggagagaaaggcgaaagccttagagagtactgcaattttgtcattgactaacttcgctttctcgctcgtggagtttgtggcaagagttgaccatttgatagaggcagttgataagctttccaagatggccaagttcaagcctaacgatgggttatag

SEQ ID NO: 55334 - DNA, 1308 bp, Glycine max
  Peptide Sequence Number=SeqID_172112
atgaacaagaccagagacatttcggttattggtgggactggtgactttttcatggcaaggggagtggccactctgtggacggatgcttttgagggtgaagtctatttccggcttcgagtggatatcaacttatacgaatgttggaacccgagaaggccaccttctcgccaactggtttctcttgatttctttgtatctgatatcaaatatgtgaatggtggcgcggggcttatccaaggcagcagcagagcgaaggaagtagaaatgcactctcactcacacccacatgccttgccacgcccacattcactactcccttcttcttttcttcttcttcttcctccttcctctctccgcatctccaatactaagaggctgcagtcctcaactttcgccctctcccaaaatgaaaccaaattcccaacgcagccttacaagaattccaacaattcgtctcaatcacttgctcacatctccaattgcaaattccccttggctcggccccttgtttcttcttctcatcccgctagtactaattcatccaccaagcttctcaactctatgctgctcttcgccttcctcacacttcaaccctcttatcctgcacttgctgcttcttctgacttctccactatatttggggatattggtgacttaagcacaggttttgcttcagcgtttctgctaatatttttctctgaactgggagacaagacctttttcattgcagcgctactagcagctaggaactcagctggtgttgtttttattggaacatttggcgcacttgcggcaatgactctgatatctgttgtccttggacgaacctttcattatgttgatgaaatcttgccattcaggtttggagaaactgatttacccattgatgatattgctgctgtttgcctattggtgtactttggggtctctaccctgctggatgcctcatctagcgatggccaaaaatcagatgaagagcagaaggaggcagaactagcagtttctgaattttctggaaatggtgctgggatactatctgctgctagcacagttgccagtacttttctcttagtttttgttgctgaatggggcgacaagtcatttttctccacaattgcccttgcagcagcttcttctccccttggagtcatagctggagcactggctggtcatggtgttgcaactttgctagctgtacttgggggttctttacttgggacgtatttgtcagagaaggttattgcctacatcggaggtgttctctttctcgtctttgccgcaataaccttatttgaaattgtgcaatag

SEQ ID NO: 55335 - DNA, 2013 bp, Glycine max
  Peptide Sequence Number=SeqID_172113
atggatgtgaggttccagaacttgagtttcacagctaactgttctgcaaatgcattcaagattttgggtaactcaatgcaagttgaagtaaggggagctgattgtagtacaaataatatcttacaacttgattcccatggttcttcaatttcaaagggaatgaaaagaaagtgggatttaattgatggatgtatgggtctgagcattggctcttctttgtctcttggactttcaacaagttcctcggacagcaaggagagttcagctactgcttgcactgctttgtcttcagccaaagagattgatgaggaatcgtccatgcctatggatattgaactggactttacacttcatcttggctgcgagaaggtaaagagcccaaaaaaacttgctagttcaaatttgaagatatttgagttgcagcctaaggttgatttggagttgagcctttccacacggccctctgaatcagatattactagtgtttgtctaagtccttctcaggccccatctttccgattgaacatggagacaccattagtattcagcaggacaccaaatgcagatgagggatcaacttcatgtagatggaaaccagggcttgtttcacttaatgcaagtgctagtgtaatgttaaaccaggctgaaaagaagtttgatcataatcccattgttctagatctctcatcaacgagaccagaaagttcagtcactagtacttccagactaacacaacagaaacaaccactatattgcaatagcaattctaagacatgtcaagttgagggatgtggaaagggagccagaggtgcttctggacgttgtatatctcatggtggtggtaggaggtgtcagaaacctggctgcaataaaggagctgaaggccgtactgtatactgcaagtctcatggagaaggcaggggatgcgaatatcttagttgcactaacagtgtagaaggacatacaaatttctgtattgctcatggtggtgaccagagatgtagtcatgagggttgtttccgagctgccagagggaaatctggatcgtgtattcggcatggtggtggcaagagatgtgaaatagaaaattgtactaagaactcagaaggcttaccaggtctgtgtatctcacgtggtggagggtgtagatgtcaagcttctggttgtacagaaggggcacagggaagcactatgttctgcaaagcacatggtgggggaaaacgctgtacagcaccagggtgcaccaaaggtgctgaggggaccacaccactttgcaaaggccatggtggaggaaaatgctgtgcagaccacggtggtggaatttgtactaaaagtgtgcatggaggtaccaacttctgtgtggcacatgggggtggaatgaggtgttctgtacctgactgcatgaagagtgccaggcaacaaagcgattattgtatatgtcatggaggaggcaagagatgcaagtttgaagggtgtggaaagagtgcaccaggtggcactgacttttgcaatgcacatgggggaaggaagagatgctcttggggccatcctgggtcagaatatatcaatcaacagggtggctcttgtagttcatttgcaagggggaagacaggtctgtgtgcacttcatagtgggctagtgctggataagagagttcatggaggtgtaaccttgggaccagttattcaggatagtcatgttagtaaactggatgaaccgaagcagatagtcattaaccaagatattgacgtagatatgatgaaaatgggtagcccacgggcagctggtgtgataacttgttctgatgttaaactaaatgaagttgcaagtactcgtctcccatctggggaagatggtcacacaccaatgtcagtagcagttcctgaaggcagggtgcatggtggaagtctgatggcaccgctgatggggagttctggccttggtacaagcagtgggagagatctattgagtgatcaatctgagacaattgaagctggcatcctgccccagtaa

SEQ ID NO: 55336 - DNA, 994 bp, Glycine max
  Peptide Sequence Number=SeqID_172114
atggtttcacgtttcagtcctgatcgagtaaacaccaagaagcagcagcgcagtaacgacaccgtttcgatggggaactgtaacagcgaagcctcttcccaaactcagccacattccgatcaccatccccaaccacgctccaactccaacggcatcaccgtccttcctcccaattcgaagccctccgttggccgggtcttgggccggcccatggaggacgtccgctccacctacaccttcggccgcgaactgggccgcggccaattcggcgtgacataccttgtgacccacaaacacaccaaacaacaattcgcgtgcaaatccatcgccacgcccaaactcgtccaccgcgacgacttggaggatgtccggcgagaggtgcagatcatgcaccacctcaccggccaccgcaacatcgtggagctcaagggcgcttacgaggaccgccactccgttaacctcatcatggagctctgcggcggcggcgagctcttcgaccggatcattgccaagggccactactccgagcgcgccgccgccgacctctgccgccagatcgtgacggtggtccacgattgccacaccatgggagtgatgcacagggatctcaagccagagaacttcctgttcctcagcaaggacgagaactcgccgcttaaggccacggacttcggtctctccgtgttcttcaagcccggcgacgtgtttaaggatcttgtcgggagtgcgtactatgttgctcctgaggtgctgcgtagaagctatggacccgaagctgatatttggagtgctggggttatattgttcattttgctctccggtgtccctcccttctggtcaaaaaaggaacaaggtatctttgatgctattcttcgtggccatattgatttcacatcagatccttggccttccatatcgagtagtgccaaagatctggtcaagaagatgttacgagctgaccccaaacaaaggctctcagcagttgaagtccttg

SEQ ID NO: 55337 - DNA, 231 bp, Glycine max
  Peptide Sequence Number=SeqID_172115
atggagtcgtttgttcgtccaaaaatcacttgtttgaagatcttgatgggtattgggtttgagatggtttggcccaacatgctacctttgtctcatggagcccgaaaaagtgtaccagcaatgagaaaaaccctaaaactacatcaagaacatggacccaagccttttctcttttgcggacctgaagctggaaacgaccttgcccagtgcctcagggttattctatggtaa

SEQ ID NO: 55338 - DNA, 862 bp, Glycine max
  Peptide Sequence Number=SeqID_172116
tgttctgtcttatgctgatttgttcgaggctaaagcatgttgttgtttccttgcttttggggaagttgaggatgagtcgaagtattccaagaagtgcttgcaatcaggaaccgatgtttgtatagatcaaaaaattgttgtggaagcctccgatctcttgcaaaagacacataaagtatcagaattaatcaatcattctgatgaacttttgcaaagaagaatagctgctgatgcagagagagtattgaaacatataaatgaggcattgatgatgagttcatactctgaaaaattacttgaaatgaaagcggaggctctttttatgcctgtgttggataacttttgctttaaatatcagctatgtagatatgaggaagtgatccagatgtgtgatgaaaccattggttctgccgagaagaattcttatccattggatgctgattgcaaagtgagagatctgaatagttcacagctttcaaaaggcttatatttcaggctttggcagtgctcaatgatgcttaaatcctactttcacctacgaaagcttgaagagggtctttctttactggaggaacaagaggaaaaggtatcagccataaacaagcttttcaaaataattggagaggcatatgcaatcctgtcacaccctgccaagcgatcacagtatgattctgaagaagaaatgagaaattcccaaaagaaacgccatgcaaatagcatgaacagaaataatgtcattgatcaaactgacaataggaggcactggaaagagtccatggcaacaatctggaacattgaatgtggtcaagttagtgatgtgttgtatctaatgcatttgagaccaacatgcacgcagatttga

SEQ ID NO: 55339 - DNA, 2697 bp, Glycine max
  Peptide Sequence Number=SeqID_172117
atgagtaggaacgattccaagtacttctccaccaccaagaagggtgaaatccctgagctcaaagaagagctcaattctcagtacaaggacaaaagaaaagatgctgtcaaaaaggttattgctgccatgactgttgggaaggatgtctcatcattgttcactgacgtggtgaattgcatgcaaacagaaaatttggagctaaaaaagctagtctacttatatctgataaattatgcaaagagccaacctgacctagcaatacttgcagtgaatacatttgtgaaggattcacaagatccaaatcctttgatccgtgccttagctgtacggacaatgggctgcattcgtgttgataaaattactgaatatctgtgtgatccccttcaaagatgcctaaaggatgatgatccatatgttcgtaagacagcagctatttgtgttgccaaactttatgacataaatgcagagttagtagaggacaggggctttttggaatccctgaaggatttgatatctgataataatccaatggtggttgctaatgctgtggcagcacttgccgaagttcaggaaaacagtagtagacccatctttgagatctccagtcacacactgtcgaagctccttactgctttaaatgaatgtacagaatggggtcaagtttttatattggacgctctttctagatacaaggcagctgatgctcgtgaggctgaaaacatagtagaaagagttactcctcgcttacagcatgccaattgtgcagttgttctatcagctgttaagatgatccttctgcaaatggagcttatcaccagtactgatgtggttcggaatctttgcaaaaagatggcccctcctcttgtgacattactctctgcagaacctgagatacaatatgtagcattgcggaatatcaatcttatagttcaaagaagaccaacaatacttgctcatgaaattaaggtgttcttctgcaagtacaacgatcccatctatgtaaaaatggaaaagttagaaattatgataaaactagcttcagaccgaaatatagaccaggttctattggaatttaaggagtatgctactgaagttgatgtggatttcgtaagaaaggctgttcgagcaattggtcgttgtgccatcaaattggagagagcagctgaacgatgcattagtgttttgcttgagttgataaagataaaagtaaattacgtggttcaagaggcaatcattgttatcaaagatatatttagaagataccccaacacatatgagtccataattgcaacactttgcgagagcttagataccttggatgagccagaagccaaggcatcaatgatctggataattggtgaatatgcggaaagaattgacaatgctgatgaacttcttgaaagtttcttggaaaatttcccggaagaacctgcacaagtccaactacagttgctgactgctactgtcaaacttttccttaagaagccaaccgaaggcccacaacagatgattcaggttgttttgaacaatgctactgtggagacagataatcctgatttgcgagatcgtgcatacatatattggcgtctcctttcaactgatccagaggctgctaaggatgttgtgttagctgagaagcctgtgataactgatgattcaaaccaacttgaaccttctctacttgatgagcttcttgccaacattgctacactatcttctgtttatcacaagcctccagatgcttttgtaactcgtgtgcattcagctcagagaacagaagacgaagactatgctgagggaagtgagacagggttttctgagtcacctgcaaatcctgctaatggtcctgcatccccacctactgccaggcaatcagcacctacatctgcaataggtgcaccagccacacctccacctgttgcacctgtgccagatttacttggagatttgatgggcatggataattctattgttcctattgatcagccagctactcctactgggcctccattacctattttactacctgctgcaactggtctgggtttacaaattagtgcacaactgactagacaagatggtcaaatattttatagtttgttgtttgagaacaactctcaggttccacttgatggcttcatgattcaatttaacaagaacacatttggtcttgcagctgctggaccccttcaggtttcacagttgcaacccagaatgtcagctaggacactcctccctatggttatgttccagaatatgtcgcaaggtcctcctagctcagctttacaggtcgctgtgaaaaacaatcaacaacctgtgtggtatttcagtgataaaatctcattacttgtattcttcaccgaggatggtagaatggaacgttccagttttctagagacatggaggtcccttccagattcaaacgaggtttccaaggacttcccagccattgtgattggcaatgcggacgcaacactggaacgactggctgcgtcaaacatgttctttattgcaaagcgcaagaatgcaaaccaggacgtgttttacttctcagccaaactccctagagggataccattcttaattgaacttaccacattgattggaaaccctggcgtcaaatgtgcaatcaagactccaagccctgaaatgtcagcacttttcttcgaagccattgagactcttctcatgggttaa

SEQ ID NO: 55340 - DNA, 550 bp, Glycine max
  Peptide Sequence Number=SeqID_172118
atggattatgaatatgcgatagagattcaacgtgtcatcccaaagacactctgtgtgacattggaccatagatccaagactaagagggtgaagcaagctttgcaaggacaaatgatggagatcaagttagctcaaggtggattggaggctacaccaaaatgggataatcaagtggaggcacctgaagaaaaagcaaataagatgaaatcattcttcatttatgcagtgggcaactgggacgctgaattttatgccaaggtcaatgatgatgtctatgttaatcttggccacaaacaaggaacttcagaggcagcacctgtaccagaagcaagacccataccactttctgcagagcacctaatgaccaccttggcttgcactgccaccaccgagatcgtgaggaagaagaggactggcggcgccgctttccggcctccgcgccggccgaagtgctcgcgggtctcaaaaatcgcagcggctctcatgaaccggaggaaagggaaccccagcgggccccactccattgaagaacttgtgagagacagagagg

SEQ ID NO: 55341 - DNA, 423 bp, Glycine max
  Peptide Sequence Number=SeqID_172119
atgtatagtaatactttatcaagatcgacatctgctgctgtattggatgtgctgatgatggctgcagataaatttgaggttgtttcatgcataaggtattgcagtaggatgttgaggttaatgcctatgacctgtgagtctgccgtactttatttggatcttccttcaagcattttgaagtcagatgcaattcaaccactgatagagacagcaaggttgtttcttgccatacactacggagacataacaaaatgccttcagaggatgttgtctatgagtttgtgctcaagtgggctaggatacattatccataaattgagctcccgaaagcttaagaaggtcttaacatgcaacgacttaaatcctgactacgtaatgttcacatcgaaagtggttttacaaaaactgtcctacctgatttaa

SEQ ID NO: 55342 - DNA, 2589 bp, Glycine max
  Peptide Sequence Number=SeqID_172120
atgtcatcatggtggaaaaagtcttcatccaaagatgtaaaaaggaaagaaaaaaggaaaagtattattgatacaatacaaaggaaattaaatagatcaagagggtctaggagacatcatagtcacactatctcagagaagggaaccacattccttgtgcctacaacatcaccatcaccctcaacacatgtctcccgcctacaaagttttgcagaaagacctcttgctcagccactcccactcccagggacgcatcgcctctccaccaatcgtgcaaattctggaactagtgtaacatcaaaaccagaaagcaccaggggctcaaaatcatctctatatttccccttaccgaaacctggttgtgtttttaacgggggagaacctacagatgctgaggaagatattggcactgcatcaatttctagcggcagctctattgatagtgatgaccaatgtgactcacattttcttagtcctctggcatctgactctgaaaatggaaaccgagctaccgttcacagtactgtcagtggggttcacaaggatcagccgcccattaccatcccaaaaaactcaagggtatcctcaaaaccagctcctcaactgtgcaatcatcaaattttatctaacacacccaaaggggcttctttgcatatgccgaatccacaaatagcttgttcaggtggtttatggagtgctccagacagttcaatgtcaagtccttctagaagtccactgagaacgtttggttccgagcaagttttgaactctggattctgtacaggaaagccatatccagatttagcttctggacactgctctagtccaggttcaggccataattcagttggtggggatctgacagtgcagatattctgcccacagaacaggtgtagccctgagtgttctccaatacccagtcccggaatgaaaagtcccggtttcagttccaggatacacagcagtgctgtctcccctcttcatccatgtgctggaagtgctacattagaatcgcccacaagacgccctgatgatgtgaaacaacagactcaccgattacctcttcctccaataacaatccctaattattgtccattttctccaacatattctgcaactactactccttcagcacctcgtagtcccagcatagcagaaaatctaacaagccctggctcacgctggaaaaagggacaactgcttggaagggggacatttgggcatgtatatcttggttttaacagtgaaagtggtgagatgtgtgcaatgaaggaggtaactcttttttcagatgatgctaaatcaagggaaagtgctcaacaacttggccaagaaattgcattgctaagtcatctgcggcatccaaatatagtccaatattatggatctgagacggtagatgacaaactttatatatacttggagtatgtctctggtgggtcaatctataagttgcttcaacagtatggccagcttagtgaaattgttattcgtaattatactcggcaaattctgttaggtcttgcttatttacatgctaagaacactgttcatagagacattaaagcagcaaacatattggtggatcctaatgggagggtaaaattggcagattttggcatggcaaagcatataagtgggcaatcctgtccattatctttcaaaggaagtccttactggatggcacctgaggtgataaaaaattcaaatggttgtaatcttgctgttgatatatggagccttggctctaccgtttttgagatggctactacaaaacctccttggagccaatacgaaggggttgcggctatgtttaagattggaaacagcaaggaccttcctgcaatgccagatcatctatcagaagatggaaaagattttatcaggcaatgcttgcaaaggaatccagtgcatcgtccctctgctgctcaacttctgctgcatccatttgttaaaaaagccacactgggaagacctattctgtctgctgatccttcagaagcaaaacctgattttgtgaatgctatgagatctctggccattggacctgcaaaacataatttagccttagtttcagaagcagctggtacatatctgtctagaagctcgagaactggctcaggatcaagtgaagcccatacaccaaggaacatttcatgtcctgtgtcccctcctgctgggagcccacttttgcctcctaggttactgcatgtgactggacggctgtctccatctcccatatctagtcctcacactgcatcaggctcatctacaccactcactggtggcattggtgcagtcccttttcatctaacaaagcagccaatattctcacatgaaggtatcaatgtgatacaaagacctcaaaatgctcttaattcaaatggaagcactgcttatcaggagccaaattgtgacccactttggaggattctgaaaagcacttttgcttgcccggatatagtttcatccaacaatgatgctcttggaaaccataataggagggttggccagggactcccaagagaattttacgatgggaagtcatatttagcggatggtgtatcgcagcagctgttaaatgatcat

SEQ ID NO: 55343 - DNA, 219 bp, Glycine max
  Peptide Sequence Number=SeqID_172121
atgaatacgacttccggagaaagtgataacagagcagccgcaaccgcaaccgcaaccgcaaccgcagctggagttgaacttaccaaagacaagaatggaatacccctactccttcttcgaaacaaccgtggagcttcagctacggttagtttgcaaggaggccaggttctttcttggaaaacagaacgccgtgaggagttactctttataagtaacaag

SEQ ID NO: 55344 - DNA, 126 bp, Glycine max
  Peptide Sequence Number=SeqID_172122
agccatgacagatgaagaaagcgacccacatcgcccaaataataatgaagccacgatttcagaggaagcagaatacacaaataagaaaatgaaacctaagatgttgaagaatgaagatatgatgcc

SEQ ID NO: 55345 - DNA, 2121 bp, Glycine max
  Peptide Sequence Number=SeqID_172123
atgacccttgcattaactttcggattttacctcctaattcataaaactatccagcacaaggttaaaaagaagtatcgatcggcatacatttttggtcgggaacagaggcattcacctccaatccaatactatccagcacatataactcactttgtaactccaatttttccaaccccgttaaaaacaggcattctgttagcatttgcattggatgctatattatatgacaaacataggtggcacaatcttctatgcaagtttctgtgtgtccgcttctgctttttggagaaaaccagtggtggttggcttgagtgtgtgcagcagaagcagctggttctctgccggatgatggaacgcattttgtgcttcatctacttggtttctctcattctcttccaagcaaatgcagcagagcccatctcagacaagcaagcattgcttgacttgttggaaaagttgcctccttcaagatccctgaattggaacgcaagctcttccccatgtacctcctggaccggtgtaacctgtaatggagataggtcacgagttatagccattcacttgccaggtttcgggtttcacggaaccatccctcccaacacaataagccgcgtcacggggttgcaaacactcagcctcagatccaacttcataaatggtcatttcccttgtgatttttccaatctcaaaaacctttcctttctctatcttcagtataacaacttcacgggtcccttaccggacttctctgcttggaggaacctctctgttgtcaacttgtccaataattttttcaccggcaccattcctctctcgctctccaatttggctcagctcactgccatgaatctcgccaacaactcgctctctgggcaaatccctgtctctctcctccagaggtttcccaactccgcattcgttggaaacaatgtctctcttgaaacctctcctttagctccattttctaaatctgcaaaacacggcgaggccacggtgttttgggttattgttgctgcttctcttattggtctcgcggcatttgttggttttatctttgtgtgctggtcgagaaagaagaagaatggagattcatttgctctgaagttgcaaaaggtagatatgtctccggaaaaagtagtgtcgagggacctggatgcaaataataaaattgttttctttgaggggtgtagttatgcgtttgacttggaggatttgttgagggcttctgctgaggttttggggaaggggacgtttggtgctgcgtataaggctgcgctggaggatgctaccactgttgttgtgaagaggttgaaggaggtggctgttggaaagaaggactttgagcagctcatggaggttgttgggaatcttaaacatgagaatgttgttgagctgaaggggtattactattccaaagatgagaaactcatggtatatgattactacactcaggggagtctctctgctttgttgcatggtaaaagaggagaggatagggtgcctttagattgggatactcggatgaaaattgctttgggtgctgcacgaggccttgcttgtattcattgtgagaatggggggaagcttgtacatggcaatatcagatcctcaaatatctttctcaatagtaaacaatatggttgtgtatctgatcttggcctggcaaccataatgagttcagttgccataccgatctcgcgagccgctggttacagagcacctgaagttacagacacgaggaaagcgactcaaccttctgatgtttacagctttggtgtggtgttactagagcttctcactgggaaatcccccgtctacacaactggtagcgatgagattgtgcacttggtgagatgggttcattcggttgtgagagaggagtggacagctgaagtgtttgacttagagctgataagatatcccaatatagaggaagagatggtggaaatgttgcagatagccatgtcatgtgtggtgagggttcctgatcagaggcctaagatgttagaacttgtaaaaatgatagaaaatgtcaggcagattgagatagtagtgaatcagccatcaatatcatctgagaaccaagtggaaagttcaacacagacccctttaaccacttaa

SEQ ID NO: 55346 - DNA, 408 bp, Glycine max
  Peptide Sequence Number=SeqID_172124
atgcataaacataaccttgtgtttactgttgatagtgaagtgagggtagaagggttggaaactcttgactatcttgacaatctgcaccagaaagaacgtttcacggaacaaggagatgctttgacatttgaatcagaggtagaccgggtctaccttgattccagcaatacggtagctgttctagaccatgaaaagaagagaacatttgtgatacgaaaggaaggacttccagatgttgttgtttggaatccttgggaaagaaaatccaagtccatagtagatttaggggatgaagagtacaaacagatgctatgtgttgatggtgcagcagttgaaaaatcaatcaccttgagaccaggagaagaatggacaggccgcttggagctctcagttcttccatgttcatga

SEQ ID NO: 55347 - DNA, 264 bp, Glycine max
  Peptide Sequence Number=SeqID_172125
atgaaaccttctctcctccaacgcctcctcatgtcccaacaagcctcagcactaactcaggatttcattgcacatcacacaacattgactcttttgaggagatgtttccaagttgatgactcaattggaagcaatgaaccctaccatgagtttaggcgattcagtgctcaaaagaacttggagtggaagattcgatctgaagatcttgctaggaaacttaaggtcattatgatcaagaaagttaggtatttagcactgatgtaa

SEQ ID NO: 55348 - DNA, 155 bp, Glycine max
  Peptide Sequence Number=SeqID_172126
gtatttcgccggtgcctgagagtgtgttgttctacgatgatgattggtctagtgagtttctcactgcttgtgaggattttggtttcaacagaaatcgtgactttttccaagatatcgacgatttgtttgtttcggatcccctccttgctctctga

SEQ ID NO: 55349 - DNA, 477 bp, Glycine max
  Peptide Sequence Number=SeqID_172127
atgtatatatgtgaaacccaaaatggagtgcaatttcaggaggatctctactatccccatcctatgatccaagatatgctatggggatttcttcatcacgtgggagaacgtgttatgaattgctggcccttttctatgcttagacagaaggcattagaaatcgcaataaatcatgtacgttacgaggacgagaatagtagatacctttgcattggaagtgtagagaaggtgttatgtttgattgcgcgttgggttgaagaccccaactcagaggcatacaaacttcatttagcccgaatccctgattacttttggctggctgaagatggcttgaagattcagagttttgggtgccagatgtgggatgcagcatttgctattcaagcaatacttgcttgtaatgtgagtgaagaatacgggcctacacttcggaaagcacactccttcgtgaaggcttcgcagaaaatcttatcttaa

SEQ ID NO: 55350 - DNA, 435 bp, Glycine max
  Peptide Sequence Number=SeqID_172128
atgtttggatcagcattgagctacattgccttaaggatactcggagaagggtctcaagatggtgaggaacgagcaatggacagagctagaaaatggatccttgatcatggtggtttagtggctattccatcatggggaaagttctgggtcacggtacttggtgtttatgaatggtcaggctgtaatccacttccaccagagttttggttgctacccaaatgtagtcctattcatccagggaaaatgttgtgctactgtcgcttggtttatatgcctatgtcatatttatatgggaagaagtttgtgggccccatcactagcttaatcagatccttgagagaagaagtatacaacgagccttatgatcaaatcaactggaataaggcccggaacattgttgctaaggtccacaaaatctttatatttcatctttaa

SEQ ID NO: 55351 - DNA, 270 bp, Glycine max
  Peptide Sequence Number=SeqID_172129
atgcaatatacagcctatttctatggacaaggttcaaggaagtatttacgaaatataaggctaagacaagaaggagggcttcgaaccattgggcgattcgagctggtgtatggtcgagtcgaagtcaaggcagcaagatttctggacttagcacaatttctgacaaaacttcacaaaatcagtttgacttcgagcaatgtggataaccgttctaaggagcagttatgtgcatgtaaggtgtacgtagcaggacacttggcattaggatag

SEQ ID NO: 55352 - DNA, 780 bp, Glycine max
  Peptide Sequence Number=SeqID_172130
atggctactgatctagttggggaagaaatggaagcagagcgattatatgacgctgttaatgtcatcctttctttacaaagcagtaatggtggtttccctgcttgggagcctcaaagagcataccgttggttagagaaattcaatccaactgaattctttgaagacaccctcattgagatggagtatgtggaatgcactggatcagcaatgcaaggtctggctctcttcagaaagctatacccaaagcacagaagaaaggaaatagatcactgtatttccaatgcaatccattacattgaaaacacacaaaatcctgatggctcttggtacggttgttggggtatttgctatacctatggtacctggtttgctgtagtgggactaacagcctgtggaaagaactaccataatagtccttccctacgcaaagcttgcaaatttttgttatcaaagcagcttccaaatggtggatggggagagagttacttgtcgagccaaaacaaggtttatacaaacttagaaggcaaccgtgcaaacttagttcaaacttcatgggctttgttgtcccttattgatgcaggacaggctgagatagatccgacacccatacaccgtggaataaagttactaatcaattcacaaatggaagatggagatttcccacaacaggaaatcacaggagtatttatgaggaactgtacccttaactactcatcgtatcgaaacatctttccgatatgggccctgggagagtatcgttgccgagtcttgtgtggttaa

SEQ ID NO: 55353 - DNA, 1842 bp, Glycine max
  Peptide Sequence Number=SeqID_172131
atggctgcaggttctgctggtcctcaactgaaacatgttacatgtgcaattgtgctgctaccattctttgttacaatgaccactagtgctgatatattccttgattggcacgtttccgctgacttcaatttaaagcctgtgtccactgatcaaccggtaattacaatcaatggcatgttccctggaccccttataaatgcaacaacaaatgataatattcatgtcaatgttttcaatgatttggatgatcccttgctgtttacatgttttaggagtagcgctaaacttaaagaattttggttctggtgtaggaatggcatacagcaaaggctagactcatggcaagatggagtgtctggcacaaactgccctatccaacctggcaagaattggacttatgatttccaagccaaagaccagattggcacattcttctactttccttccatcaatttccttaaggctggtggagggtttggtccaattcgagtcaacaatcgacccttgattagcgttccttttccaaaacctgaggcagagtttgatcttctaattggtgactggtacatcagtagctacaaggacattaggtccaggttgaatacggcagatgttccttctcctgattggatgctaataaacggaaaaggaccatatatgaacaatctttctcaatcatatgagaccttcaatgttacacaaggcaagacatatttgcttaggatatcaaacgtagggacagcctggagcttcaatttcaggattcaaaatcatcaactggttttggttgaaactgaaggttcttatgtcaatcaaatagagctggagtctcttgatgttcatgtaggccaatcctactcagttcttgtcacagcaaaccaaaatgctgttgattactacatagtagcctctcctaaactgagtaatgccacaaataataacactcttgttggcgttgctgtgcttcattatgacaactctaccacaccggctaatgggtctcttccaagtggtccagatccatttgatctgcaattctccatcaaccaagcaaaatccattaggtggaacctcaccactggagctgcaaggcctaatccccagggaatgttcaatgtaacaaatgtgacaataattgaaactttcattctaaacgcatcaacagcaactattgatggattatctcgctattctgtcaacaatgtgtcttacttgatcccagatacaccactgaaactagctgatttcttttccaatggaactggtgtatatgaacttgatgctttttctaagaacacttcaaatgctaacgccgtgcgtggagttttcgtagctagtgcattacataaagggtggactgagatagtgctagaaaacaatttagacatcattgatacttggcatttggatggatatagcttctttgttgttggaatgggggaaggagattggaatccagaatcccggtcaagttataacctttatgatcctgttgctcgctccactgtgcaagtgtaccctggagggtggagttcagtgtatgtgtaccctgacaaccctggaatgtggaacctaagatcacagaacttgcaaagctggtatttaggtgaagagctctatgtgagggtttatgatgctgatcccaaccctgccaaggagaagccacctccacagaatctccttctatgtggcaagtatcagccaccaacccctcctccctcagtgtccccagcaccaaatgctccatcatccaacgcatatgcatataatccacatagaacaaggtctctgattgctatgatcaccactgctatatgtttgttctatattgatctccattaa

SEQ ID NO: 55354 - DNA, 177 bp, Glycine max
  Peptide Sequence Number=SeqID_172132
atgcttctctctctcatcttcactctttacatacctctcgctgtccatgcccaatccctagctccagcaaccagccacggggcgtccatagatcaagggattgcgtatatatttgctgatgatgttggctttggcactcacttatatcatccactcctccaccttctgagaaagaag

SEQ ID NO: 55355 - DNA, 991 bp, Glycine max
  Peptide Sequence Number=SeqID_172133
aatcaacatggaagcaccagaagaactctctttggggggctcaaaagatcacaccaacattgtcaaaggaaaaagaaccaaaagggtaaggccacaatcccctatgccattctccatcacctccaattcttccaccggagaaggagaaaaagaagaaggttgcaacaacggtgatgatgacaacaacaacatgaaaaatgaagatatcaataacatcaacagctctcccacctcttctgcaggattacaagacagcacagatgaagaggaggacatggcgaattgcctcatccttctagctcaagggcaatcacgggaatccccgaaacacgcggaggaggacgccggcatgaactccgccaagtacagcagtagaaaattcttggaagctgctaccttggggtctagcagggcagggtactatgtctatgaatgcaagacatgtaacagaacctacccttcatttcaagcacttggaggccacagggccagtcacaagaagcctaaggcattgatggctattggcctagagaagaaacagcaacaccttttgtcaacagatgaggaagagtttcaattgaagaccaataagtcaccattttcccttcaattgaatacaaaggggaatttgtacagcaacaacaacaagtccaaggtgcacgagtgctccatctgtggtgctgaattcacatcaggacaggcattgggtggtcacatgagacgccaccgcgctccggtcggaaccaccacccccgccacactctccttcacccctttggctttggaaccagaagaagatcaccccagaaagaaaaggaatgtgttgaatttggatttggatctcaaccttcctgccccagaagatgatcatagagaatccaagtttgccttcacatccaagcaacaacaacatcaacaaccacaacaacagcaacagccacaaacaagtcttgtcttccccgcaccagctttggtggattgccattactaa

SEQ ID NO: 55356 - DNA, 675 bp, Glycine max
  Peptide Sequence Number=SeqID_172134
atgaaccttccgtattcatatcaggaagatattgaatctaagaaaaaatcagtttttgctaaaccaataatatggagaaagagaaactgtttaggcacaatcaggaatgctgctaatgtctgctgtgttcagttctctgctcattcctcccatttgctggcctttggatctgcggattactcaacatattgttatgatcttcgcaatcttagaagtccctggtgtgtactggctggccatcgtaaagctgtgagctatgtcaaattcttggactctgaaacacttgtttctgcttctactgataatacattgaagatctgggatctcaataaaacctctcctgtgggtgcatccattaatgcttgcagcctaactctgtcgggacatactaatgagaagaattttgtgggtctatcggtggctgatggatatattgcatgtggttcagaaacaaatgaggtttacacctactatagatcgcttcccatgccagtcacttcacacaaatttgggtccattgatcccatttctggtaaagacactgatgatgacaatgatggtttaaagaaaaggttccatgtgacggcgactttcttacatttgcgagttcctggagttttgcgcttgtcactcaagcactctggccaatcccatcaacctgctgggagcatataa

SEQ ID NO: 55357 - DNA, 2931 bp, Glycine max
  Peptide Sequence Number=SeqID_172135
atggatgaagactttgttgatgaggcaacccaattagaagttgccgaggaatcacagcgccaaaacaaagattcaccccacccggaatgccgaaaaatcttaaaatccctagaagccttcatccctgttaagcaggactactcccagataccacctcgggaatatgatggcattctacatggtaaaaatgtagttgaaggtattgatcatgcagatacatcacagcatcctcatgtaagcctttttatggatgatgctgatgttatggttgaagagttaacagtaaaaagttacaatggctcaagtttggatattggtacatcaaacaaccgagagcagatatataatcggcagaaccattggcaaaatctttatcagctagcaagtaattcaggaattggaaattcactaagtgatattggaaccagaaacagtgtcccagctacatctagtgctcgggaggatattggatcctcatctttccctgagatgttagctagaaaatctctcagtgatggccagagcaatgtcatggaacacttggcatctgctgaaaataaagagggtgcaggtgatgttcgtcaaggaacacggaaaaaaattatatcccaatcaggatttgctgagtttttcataaaaaatacactgaggggtaagggtattgtatataaaggtccatcttctgatggcttctgtgttcagtccagagagcaaaactggatgaagattggcattgatgcagatcagaataggatgaaaactggcattggtgcggatcagaatcggctgaagactgtcattgatgcggatcagaatcagctaaagactggcattgatgcggatcagaatcggctaaagactggcattgatgcagaccagaatcagatgaaggctagcattggcacagatcagaatcagatgaagaatcacagtggtactgatcagaaacagatgaagactggcattgttactcacttgaactctaatcaatcagtgggctatggttccaaaactgcaaagtttccttcttattgtggtgctatgcctagatctggcaggtctgattgtgttggtgtgactttgagagaatggttgaaacacgggcaccacaaagcaagcaaggtggaaagtttgaatatatttagaaagattgtggatttggtggacatttgtcactctcagggagttgcattgcataacctgtgtccatcttatattaaattgtcgccatcaaaccagatcatgtaccttggtttacctgttcaaaaacagatggtggatagtgttgtaaattctgaagttgttcacttagataattcttttattagaaaaaggctgtcagagcaagtaacatttccctcccttgatatggggtcaaagaaaaaaaaatttaatgagaatgtgagagttactggtggtgacttgtgcctcgaaactgcaagtgataggaaacttcatagtcatacagttggatcacaagattattacaatgaatatgaggaaggtacccaattttctaaatataacattggaagaatgtctagcatccctcgcgtatctaatgcaggtcaaatgccattgacttcatgtgaaaaatttgaaaataaatggtacacaagtcctgagggaggttacacaacatcatcaaatatctattgtcttggtgttctcctttttgagttacttggtcattttgactctgaaagaacacatattgcagccatgtctgatcttcgtcataggattcttcctccaattttcctatcagaaaatcctaaggaagctggcttttgtctttggttgttgcatcctgaaccatcatcacgcccatcaacaagggtcaaggggaataaatgggccaacctcttgatcagtttagtcacaggaaacacatttggaaaatttattccaggaggaagagggacatgtattgagaaggtacagggctgggaaatccttcaatctgaattgattaatggattgcaagagttgtttagtgaggaattgtcatcaagtattgaccaagaagatgcagaatctgaattgttattgcatttcctcgttttgttaaaagagcagaagcagaacaatgccttcaaactggtagaagaaatcaagtgcttggaatcagatatagaagaggtggagaggaggcatgactcaagaaaatccttggtttcctcaggcttgcagaatgattactcttgtcagaaagagattatgcctcttaaaaaggaatctttgagtttggaaatgctgccctcgatatccccaatctctaattcaaataaagtgagattgatgagaagtatatgccatcttgaaggtgcttatttttccacgagatccaaacttcagctttctgaaacagatgcttcaactcaccctgataaagatatactaagaaatcgtgagaaccagaatgtggcccaaaaaagcgaggaacaacctaagaaagatactttaggggtattctttgatggtttgtgcaagtatgcacgttattgcaagtttgaagtgcggggtgtactaagaaatgttgattttaacaatcctgcaaatgtaatttgctctctaagctttgaccgggatgcagattactttgcttctgctgggatatctaggaaaataaaaattttcgagtttagtgcactttgcaatgactctgttgatatccattatcctgcggttgagatgtcaaacagatcaaaactcagctgtgtttgctggaataactatattaagaactatctcgcttctacagattatgacggtatagtgaagttatgggatgctagtacaggtcaagaattttctcaattcactgaacatgagaagagggcttggtctgttgacttctctgcagtatgccctacaaaatttgccagtggaagtgatgattgtactgtcaagctgtggagcatcagtgag

SEQ ID NO: 55358 - DNA, 993 bp, Glycine max
  Peptide Sequence Number=SeqID_172136
atggcttcagatgatggtgtcaaacctccgactcacgagcttctcagcatctgcaagtctctcgtcgccggtggagttgccggtggagtgtcacgaactgcggtagctcctctggagagattgaagattctgctgcaggttcaaaatcgccaagatataaaatacaacggaacaattcaaggcttaaaatatatatggaaaactgagggttttagaggaatgtttaaaggaaacggaactaattgtgctcgtattgtcccaaattcagcagtgaagttctttagctatgagcaagcttcactgggtattttatggctctaccagcggcaacctggaaatgaagaagctcagctcactcccattctgcgtcttggagctggcgcatgcgcgggaatcattgccatgtctgccacttatccaatggacatggtacgaggaaggctaaccgtccagacagaagcatctcctcgtcaatacagaggaatttttcatgctctttcaacagtcttccgggaagaaggccctcgagctttgtataaaggctggctaccttcagtcataggagttataccgtatgtgggtcttaatttttccgtatatgaatctctgaaagactggttgattcggtctaaaccatttgggatgaaagctcaagactctgagctaagtgtgacgacaaggcttgcatgtggggctgctgctggaacagttggccagactgtggcttacccacttgatgtcattcgccgaagaatgcaaatggtgggatggaaagatgctgcttcagtagttgctggtgaggggaagagcaaacttgagtatactggcatggttgatgcattcaggaaaactgtgcagcatgaaggttttggagcattatacaagggcctagttcccaattcagtgaaggtggtcccttctatagctattgctttcgtgacatacgagatggtcaaggacattcttggtgtagaaatgagaatatctgactga

SEQ ID NO: 55359 - DNA, 330 bp, Glycine max
  Peptide Sequence Number=SeqID_172137
atggccttcccggagaaggacgccggagctaattttgtcctccaatccaaaggtgaatggtggcacgcgggtttccatttaacgacggcgatcgtgggtcccaccatactgacgctaccgtatgcgttgagagggttggggtgggggttgggtctgttttgcctaacggcgatgggactggtcacgttctactcttactaccttatgtccaaggtgctttatcactgtgagaatgccggtcgccgccacatccgctttcgtgaactcgccgctcacgtcttcgaacaattaaatcccgactttttcctgcagatatgtgtgtcactttaa

SEQ ID NO: 55360 - DNA, 2088 bp, Glycine max
  Peptide Sequence Number=SeqID_172138
atgtcttcgtcgaaagatgcagacccaagcctgggttacctgactcgcaaggacacggaggtgaagcttccgcgtccaaccagggtcaagaacaaaacccccgctcccattcaaatcaccgccgagcagattctccgcgaggcacgtgagcgtcaagaggccgagatccgccctcccaagcagaagatcaccgaccccaccgagctcggtgagtaccgtctccgcaagcgcaaggagttcgaagacttaatccgccgcgttcgatggaacatcggcgtctggatcaagtacgcgcagtgggaggaatcgcagaaggacttcaaacgcgcgcgttccgtctgggagagagcgttggaggtggattacaagaaccacaccctgtggctcaaatacgctgaggtggagatgaagaacaagttcataaaccacgcaaggaacgtctgggaccgcgccgtgacgcttctgcccagggtggatcagttatggtacaagtacattcacatggaggagatgcttggcaatgtcgccggcgccaggcaggttttcgagcggtggatgaagtggaccccagaccagcaggggtggctctcttacatcaagtttgaattgaggtacaatgaaattgagcgcgccagagggattttcgagcggtttgttgagtgccaccctagggttggggcttggattcgctatgccaagtttgagatgaagaatggcgaggttgtgaggtcgaggaacgtgtacgagagagccgtggataagctctccgacgatgaggaagcggagcagttatttgttgcttttgctgagtttgaggaaaggtgtaaggagactgagcgtgcaagggccatatataagtttgctcttgatcatattcccaagggaagggcggaagatttgtatcgtaagtttgtggcatttgagaagcagtatggggacagggaagggattgaggatgctattgttgggaagagaaggtttcagtatgaggatgaagtgaagaagaatccgttgaattatgattcctggttcgattacataaggttggaagaaagtgtgggggataaggagagaatcagggaggtttatgagagggcaatagccaatgttcctccggctgaggaaaagcgctattggcagcgctatatctatttgtggattaattatgcactctatgaagagcttgatgctggagacatggaacgaacaagggatgtatacaaggagtgtctcaaccagatacctcaccaaaagttttcgtttgcaaagatatggcttctagcagcccagtttgaaatacgtcagctgaatctcagggctgcccgtcaaatattaggaaatgccattggaaaggctcctaaagataagatttttaagaagtatatagagatagaactgcagcttggtaatatagatcgatgcagaaagctgtatgaaaaatatctggagtggtcgcctgaaaattgttatgcttggagcaagtatgcagaactggagagatctttatctgagactgatcgagctagagcaatttttgagcttgcaattgctcaaccagcattggacatgcctgaactgttgtggaaggcatacattaactttgagactgctgagggtgaatttgagagagcaagggcactttatgaaaggcttcttgatcgaacaaagcacttgaaggtatggataagctatgcggaatttgaggcaacagctatggctatggacaatttagacttaacagaagaagaacaaaagaagcaatgcattcagagtgctagaagggtgtttgagaaagctcttaactacttcagatcatcagctccagatttgaaagaagaaagggcaatgctattggagaaatggctcaacatggaggctacgtctggagagttgggtgatgttagcttagtccagtctaaactgcccaagaagctcaagaagagaaggcatgttgccactgaagatggttctactagaattgaagaattcatcgactatttattccctgaggaaagccagacaaccaatctcaagatcttggaagctgcttacaaatggaagaagcaaaaattgtcttctgatgattaa

SEQ ID NO: 55361 - DNA, 1092 bp, Glycine max
  Peptide Sequence Number=SeqID_172139
ctggggaagctggttgaacatgtattggtgttttggacatggcaataaccgaaagcgcatcggacatgcagtccttgttaccggaagaacagcttctggcacagatgctgctgcaacagtaaattcaacacaagcacctattatcccattccacttttctgcacctccctcatctcctgcatctttccttcactcggaacctccttcagttgcacaatccccatgtggtcctttctctatctttgccattggaccttatgcacacgaaacacaattagtttcgccacctgttttctcaacattcaccacagaaccatcaactgctcctttcactccccctcctgagtctgtccacttgactacaccttcttcacccgaagtgccatttgctcaactgcttgaccccaacaccaaaaatagtgagacctatcagaggttccaaatttctcagtatgatttccactcctatcagcttcatcctggaagcccggttggtcaactcatttcaccaagatctgctttctcaccttctggcacatcatctcctttccctgacactgactttaactctcgtggctccctcctccttgactttcaaataggtgaccctaccaagcttctaaactttgataaaccgtctactaatgaaaaccacaagtcacatcaaggttctggctctctaacccctgattctataagatccacaactcaagctggttttcttccaagtcactgggtttctgatatcataatgtccccacgtccaagaaaaaatcacccgaatgagattagtgtaaaccatagggtctctattgaagtgtctgcccaagaagtattaaaatgtgtggaaaacaaggcagtggcactttcaaaactcaaaactgatgcaccaggagaagataaaaaagataattcaatagaagtccttgtctctgaaactcccaatgatgcaccacaacagactgcggacaatggagatgtggaaagggctcatcataaggatgaatgtataatattttctgctgctaaagaattcaactttgataatgcagaaggaggggattctcctgctcctaatatagttgctgactg

SEQ ID NO: 55362 - DNA, 888 bp, Glycine max
  Peptide Sequence Number=SeqID_172140
atggtgacagtgataatgatagttctatctcagcttccctctttccattccctgagacacatcaacttgtgttcgctatttctcagcctgggctacacagctcttgtggttggtgcctgcattcatgcaggtacatcggagaacgtccctccaagggactattccttagaacctaagatgtcatcaagagctttcagcgcattcacttccatctccatacttgcagcaatatttgggaatggcatattacctgagatacaagcaactctagcgcctcctgctgctgggaagatggtaaaaggccttgtaatgtgctatgctgtaattggagtgacattctactcagctgcagtttctggatattggatatttggaaacaagtctagttcaaacattttcaacagtctgatgccagatgatggaccttctttggctccaacttgggtccttggccttgcagttatttttgttcttctccagctctttgccattggcctggtttattctcaagtggcttatgagataatggagaagaagtcagctgatgtgaatcaggggatgttttccaaaagaaatcttattccacgcataattcttcgatcaatttacatgatactatgtgggtatgtggcagctatgctgccattttttggagacatcaacggtgtggttggtgccattggtttcatccctttggatttcgttctgcctatgcttatgtacaacatgacatacaagcctccaaaatcatccttcacttattggattaacacctcaattatggtggtcttcacgggtgttggaataatgggcgcattctcttctataaggaaattggttcttgatgcccaccaatttaagctctttagcgatgatgttgttgattaa

SEQ ID NO: 55363 - DNA, 249 bp, Glycine max
  Peptide Sequence Number=SeqID_172141
atgactgcttggtggatacatcacatggtgggaacggctgacgtagggctaaagggatcccaccagcatgcacgacgagatagcggaggtggagacgcgtggcggatgatgaaatcgttgccatgcatggttcagacgcgccagactagggcaaggtgtagggcacagctaggcacagtggctctcgccactttcactggcgggacaacatgttggtcacgcagctgggactggcgagtttggtcttga

SEQ ID NO: 55364 - DNA, 987 bp, Glycine max
  Peptide Sequence Number=SeqID_172142
atggaaagcgacaggaattgggagcagaacgcactcatcagtgagctaattcaggggttggaggtagcaagaaagttgaaggaagacttgagttcagcctcttcggttgacgctagggactcacactcactactgcagaggatattgtcttcttatgacaaggctttgctttttctaagatggaatgaatcagtgtccatgcaacaaccaactaaaacttcttcaccacagtcaccactatccattgacaaaactcctctgagggaagacgctgaagaagatcatcaagaacttaaacacaattcgaagaaaaggcaacaattttgtttcagaaagatgatgccgaaatggacggaacatattagagtgaagatcgagaacggcgttgaaggacccctcgaagatggttacagctggagaaaatatggacaaaaagatatccttagtgcaaaatatcccagaagctattataggtgcaccttccgcaaaacaaaggggtgctttgccacaaagcaagtgcagagatcagaagaagaccacactatctttgacataacttaccgaggaagtcacacatgtaagcgaaacgatgccgttctgccgccaaagtcaccagattatacacaagacggctccttgactgtcaaaacggataacataacggcaccttccgcttcgtttggatgcatggcgcaagataactaccacgacttatttccttctttggtcttagagaatgatccattttttagcaccctttcccaaacatcctcgttatctgcaaacacacctgaatcaaattattttgtgtctccgactttcctcgaacatgaattcgatggggtctgtaacaagccctgccctgattctgaacttgcccggctggtttcagctgatacatcaatcaccagttctccaattttcgactttaatttctcgctcgatgcagtgggaattgattatccaaatttccccttcaatatatga

SEQ ID NO: 55365 - DNA, 141 bp, Glycine max
  Peptide Sequence Number=SeqID_172143
atggagaaagggctttgcttctcatctgcagcaacatctaagcgtcttcctttgacagttttcagtttccgtcaacgtggatggacaaggtttggccctgttgaacaaacgttcgagttattggagaggctttatatatga

SEQ ID NO: 55366 - DNA, 180 bp, Glycine max
  Peptide Sequence Number=SeqID_172144
atggggcaaattgcctccaaggggctccttttacaaacgacacgtggagggaggaaatcgccagtagctttggcgagatacatgcatgaggaaatcgccagtcaaaccagcgatttaaggctgacatggcaggtctcgccaggggcaatggcgagaccaaactgctgcagttcaggctag

SEQ ID NO: 55367 - DNA, 714 bp, Glycine max
  Peptide Sequence Number=SeqID_172145
atgactggttcaggatctccttgtggagcctgcaaattcttgagaagaaaatgtgtgagaggttgtgtttttgcaccttatttttgccatgagcaaggtgctacccattttgcagccattcataaggtctttggtgcaagcaatgtctcaaagcttcttgctcaccttcctgtgagtgaccgttgtgaagctgcagtcacaatctcatatgaagctcaagccagacttcaggatccaatttatggctgtgtctcccatatttttgcactccaacaacaggtggtcaatttacaagcacagctagcttatctcaaggaacaagctgctcagagttgtctcgatggctctatcaatgaaaaccctagtgaaaaattatttgaaaaatcttcttctgctttacctcaagatcttcaaagttggtttaatcaggtgggaaattccaacctggggccagaatttcttcctaacatgtgtactaatttatcaacacaacattatgggaacaatgccctcatggaagatctaaaccctattggaattaattatgaaacttcaggagccatggaaggaaacaactcctctagcttcgatgatagttctaataactactccatgtcctatgacatgcaaacaaacaggaggacatggggttttcatgaagtggaggatctacattcagtggcttttggatacggaactcgatcacattcatga

SEQ ID NO: 55368 - DNA, 1191 bp, Glycine max
  Peptide Sequence Number=SeqID_172146
atggagggaatgcgagacagaaactcacagcttgaactccaagaccaagagggtactaatattgggtcctctttgtcaaagctgatattaacaagtggcacaaacaccctcgattcaattttctcgaattgccccacaacaacaaatggcagcactagaagcaactccgtgttggattatttagagccctttgggtctttggggtatgagcctttggggtcttccgtgtacctccgccaaagggacatcctccaaaagttctaccaagaaagccgaggaaatgggtcttataatgttcccacttcctccttgagtaattcgttgacgaacccttgcaagaaaaagctgtacaggggagtgaggcagaggcactggggcaaatgggtggcggaaattagactcccacagaacaggatgagagtgtggttgggaacctacgacaccgccgaagctgctgcctacgcctacgaccgcgccgcgtacaagctccgtggagagtacgcgcgtttgaacttccccaatctcaaggaccccaccaagctaggtttcggtgactccgccagattgaacgccttgaagtcctccgtcgacgccaaaattcaagccatatgccagaaggtcaaaagggagagagccaaaaagaatgccgccaagaagcttcacaatagcactgaccctaaacgcggccagagtgagaagccctcctcctcgtcctcgccgtcgccgtcgccgtcgccgtcgatttttaacgataattgggcgaaccagttgttttctccggccgtttcggaggatgggttttggaagggggagaattcgcattcgccggcctcggttttgaccgagtgtcaaacagaggaaacagagttgttgttcgaaggttgttctctggctagattgccttccttcgaccccgagttgatttgggaggatataagatattttactgatctcctaacattgattggaactccgcttgtaaatattctgtttggttgcgttgcagcttgggagaggggaatgacaaaacacatatttcaccaagacgaacaacaaaatacgtgcatatttcgccaacaggaacaacgaaataagtgtaggtcaggtcaggtgcaatgtgcagcacgtaggggtgcagtgtgtagagtgaatttcgtcatccgcattggcgaaataggcgcagtatgttga

SEQ ID NO: 55369 - DNA, 273 bp, Glycine max
  Peptide Sequence Number=SeqID_172147
atggagaagaaggagaacccttctcttcaacgttttcactgtaatttactgctaccatcaaatttacagtcacataatggtgtgcaaatagaaaggcaacgcgtggataggtttgtggaacgtgggattgactctgaaaaaggtgtaatttggcagtatatgattaataaatgccaagatggcagtatacggcgctccactcccaccccatccccttttctttcaccacgtagcacccttatctctgccaaatacgacctaaatttctcgtga

SEQ ID NO: 55370 - DNA, 351 bp, Glycine max
  Peptide Sequence Number=SeqID_172148
atgaagaacgtgttaatagtagcatgcttgcaggcacaagtaatgcaaatgaaggcacaactagaccagaaccagatggagtccaggaacttggagaatcatgggccagataatgttattagacaaccattcaatccattttgtttcacttccatgaataaccccacatctcctcagagctcacttgattcaattgattatagcagcatcaatgatggaatgagcatgcgagatgtacaaagaagagaggatttctcactgcaagcttgtaattttaagaaaagatcttataacaatgacttggatgagttgcaagaattggcactcaggatgatgaggaactgtgactag

SEQ ID NO: 55371 - DNA, 321 bp, Glycine max
  Peptide Sequence Number=SeqID_172149
atgacttctgcaactggtaatgacactggctctgcaggttcttcttctggctttggatctccctgtggggcatgcaagttcctaagaagaaagtgtgccgctgattgcatttttgcaccttacttttgctcagaacaaggagctgctagattcgctgccattcataaggtgttcggtgctagcaacgtttccaagctgctcctgcgtataccagctcaccaacgttttgaggcaatgctcacacttgcttatgaagcacaagctcgcgtcagagaccctgtttatggttgtgtctcccatattttcaccttgcaacaacag

SEQ ID NO: 55372 - DNA, 231 bp, Glycine max
  Peptide Sequence Number=SeqID_172150
atgggtattttggagtgtgatggaggtctggatgctgagatatatgaggtcttaatggtggtgattggtggttgcgaaattacaatggtctccatgatgttgatgaggaaggtgatagatggagttgaatgcatgtccttcaaagtggaggatgtatacttggtagtggctatcaagtactatcatggttgtccgaaaatggaaagaaaagacagaggattagggagttaa

SEQ ID NO: 55373 - DNA, 165 bp, Glycine max
  Peptide Sequence Number=SeqID_172151
atgaccacgacggcaaagcagactgagtggtggcgtcttagattggtaggcacagcaaaaatggcaacaaagagtggcagtaattatcgcgagacagagaatgagaaagcactggtcagtgatgaaaggaggtcagatggatttagattgaaagtaacttcttaa

SEQ ID NO: 55374 - DNA, 297 bp, Glycine max
  Peptide Sequence Number=SeqID_172152
atgagtggtggaacagttatgggatcctttgctccatatcaagcatttgcagtcggtggtcccagtagtgtgcgaggctatggtgaaggtgctgttggtgttggacaatcgtgtctggtatctacaagtgaattgtcatcaatcccattgtgctccctctgcaaatccacggtgaagggacgatcacactcctccatcacttcctcctacggtgatggcaacgatgcttccacccacactgtgtccttggacgcggtaattgccaagaggtcaagttttttttcgggtggaagatga

SEQ ID NO: 55375 - DNA, 315 bp, Glycine max
  Peptide Sequence Number=SeqID_172153
atggagggaattgtgacgaaatgcaatggtcccttcaccttcaccgacgaacgggactgctacaataatgaggttggacatgcaacaaagggtatacaaaatgaaggagatgagatgcaagcttccaacaagcaacaaacaccaaaactctaccaattgtccccccaactggactggtggaggggtagcctctttgggcaaagccatgatcaatggtgccagctagacttgcaatgggtttcaatttttatggtactcatgcaatacagtggtactggtatactagcccaagcactggcatctttttctacttga

SEQ ID NO: 55376 - DNA, 486 bp, Glycine max
  Peptide Sequence Number=SeqID_172154
atggacatggatactgaaaataacgatgtggttgatgctcacagagaaacaagctttatgcaagtattcccgtgtactcaaaagactatgatgaagttgtggttggataatggatatgaagatggtcgtaacaacagagttgctctttttgatggtattgaggagggtggcatcagagcatcgtctctttactcctcaacttcttcccatgaaattgatgaacatgataatgaacaagcattggatggattgcaagatagagttaatctgctgaaaagattgtcaggtgatataaatgaggaagtggatagtcataaccggatgctggatcgtatgggaaacgatatggattcttcgagaggagtcctctcaggcactatggataaattcaaaatggtatttgagacaaaatccagccgaagaatgttttcacttgtagcatcctttgtcgtgctttttcttataatatactatctgactaggtaa

SEQ ID NO: 55377 - DNA, 294 bp, Glycine max
  Peptide Sequence Number=SeqID_172155
atgggtgcaggtcaagctatgaaaagaatccctcgcatcaagttccctcagagacatcccaaaccttcttctgtttccataaaacttcgtaccccattgcccggaggctcttcgctatgcgaaggttctacacctgagactcaagcttcgtcttcaacaactgatgtcagtctagcgttcttttcaagttcaaatgcctcaacctcagttggagggaaggcctctcttcaacccaaaagaactccagtgtccaaagaggagattgaggcaattttgttgggtggctgcttctaa

SEQ ID NO: 55378 - DNA, 282 bp, Glycine max
  Peptide Sequence Number=SeqID_172156
atgtctctatatcagatggcaaccaaacctcttacaaccgaggctattgcgcttacagaaaagaagatggacatgacattagatgacataatcaaaatgtctaaaaatacgaagaataagaagccaagaagggttctgggggctcttgcaaaaagaaggtctaatttccagggaaaccaatttcctgctgcagttgaagttgcacgaaaagctgttactgctcctctgcacaatagagtccctaatcgtaatagggtggctaactggaataaaacaaggtaa

SEQ ID NO: 55379 - DNA, 432 bp, Glycine max
  Peptide Sequence Number=SeqID_172157
atggctagtgccgggaatatattgttcagaaaagaggcagatggccacactttgctcattcccattgaccatggctactgtctactagagaaagtaagcagtcctcgttcttttccttgcaatttaatttcccctgcattaccatgtgcttctgcttgtgcctctgacactcggagtatagtggatgattgcacatttgattggctttattggccgcaagcgcgtcaacattactcccctgatacagttgattatatcaaatctctggatgccgagaaagacatagagcttctgaaatattacaagtgggatgtcccgattgagtgtgcacaaacactctgcatctctacaatgctattgaagaaagaggttgagagaggtctcactccttttgacattggaagcattatgggtatggaaaatttgaactag

SEQ ID NO: 55380 - DNA, 1248 bp, Glycine max
  Peptide Sequence Number=SeqID_172158
atggcatcgcgcgtcagcattggcaaccttacctcctccgcgccgtatattaattcccctcactttcgctcaccacttaagatttccaacaacccctctctgcaaaacgcttcgcataaggtacttatgcgcgataagactgtactggtaaccggcggagccggttacatcggcagccacaccgttcttcagctcttgctcggaggtttcagagccgtcgtcctcgacaacctcgaaaattcctccgaggttgccatccacagagtcagggagctcgccggcgaatttgggaacaacctctcctttcacaaggtggacctacgggacagagctgctctagaccaaatattttcttccacacaattcgatgctgtcatacattttgctggactgaaagcagtaggagaaagtgtgcaaaaacctttactatactataacaacaacttgactgggacaatcactctattggaagtcatggctgcccatggatgcaagaaggacgtattatttaaattgattcaagttatttctcacctcacttgggatgagatgtctgagaaggttaggaagctcgtgttttcatcttcagcaactgtatatggttggccaaaggaggttccatgcacagaagagttccctctgtcagcaatgaacccatatggacgaactaagcttatcattgaagaaatttgccgtgatgtccactgtgcagagccagattgtaaaataattttgttaagatacttcaacccagttggtgcacaccccagtggttatattggggaggatcctcgtggaattccaaacaatctcatgccatttgttcagcaagtagcagttggccgacggcctgcactgacagtttttggaaatgattataatacaagtgatggcactggggttcgggattacattcatgttgttgatttagcagatgggcacattgctgcattgcttaaactagatgaacctaatataggttgtgaggtttataacctgggaacaggaaagggaacatcagttttggagatggttagagcttttgaaatggcatctggaaagaaaattccacttgtgatggctggccgtagacctggtgatgctgaaattgtttatgcatcaacaaagaaagcggaaagagagcttaaatggaaggcaaaatatggcattgatgagatgtgccgtgatcaatggaattgggctagcaaaaacccttatggctatggagatcagggctccaccgattaa

SEQ ID NO: 55381 - DNA, 1374 bp, Glycine max
  Peptide Sequence Number=SeqID_172159
atggagaacctaatttctttggtgaacaaaatccagagggcttgcaccgctttgggtgaccacggcgaagcaagtgccttaccaactctctgggactctctccctgctatcgccgtcgtcggtggccagagctctggaaagtcctcggtgttggaaagtgttgttggcaaggatttcttacctcgtggatcagggattgttactcggagaccccttgttttgcagcttcacaagattgatgagggtggcagagagtatgctgaatttctacacctccccaggaaaaggttcaccgattttgctgctgtgagaaaagagattcaagatgaaaccgatagagagactggacgaacaagacagatttcaagtgttccaattcatcttagcatatattctccgaatgttgttaacttgacactcattgatctccctggccttacaaaggtagctgtagaggggcaaccagatagtattgtccaagatattgagaatatggttcgctcctacattgagaagccaaactgtataattttggctattacgcctgccaatcaagatcttgcaacatctgatgcaattaaaatatcccgtgaagtggatcccactggggaaagaacatttggagtcttgacaaagattgatcttatggacaagggtactgatgctgttgaaatgttggaggggagagcttatagattaaagtatccgtggatcggtgttgtcaatagatcacaagcagatattaacaagaatgttgacatgattgctgctaggcgtagagaacatgaatatttttctaatacccctgaatataagcaccttgctcacagaatgggttctgagcatctagcaaagatgctttcgaagcatttggaggcagtaatcaagtccaaaattcctggtatccaatctcttatcagtaaaacaattgctgaacttgaagctgaactgagtcgtctgggaaagcctgttgcagctgatgatgggggaaagctgtatgcagtcatggaaatatgccgctcatttgatcatatattcaaagaacatcttgatggcgtgcgacctggaggtgataaaatttataatgtctttgacaatcagctgcctgctgctttaaaaaggctgcagtttgataagcagctttcgatggaaaatataaggaaacttatcacggaagctgatgggtatcaacctcatctaatagctcccgaacaaggatatcgtcgcctcattgaatcttctctaactactgtcaggggtccagctgaggcagctgttgatgtggttcattccctattaaaggacctagttcacaaagctattagcgagactctgtttaataggtttggtcctccttgcagccagcgtctttaa

SEQ ID NO: 55382 - DNA, 489 bp, Glycine max
  Peptide Sequence Number=SeqID_172160
atgaggatgttgcggtggatgtgtggtaagactcgacaggataaaattagaaacggagctattagagagagagttggagtagcgcctattgtagagaagatggtggaaaatagacttaggtggtttgtgcatgtagagagaagaccggtagactctgtagtgaggagagtagaccagatggagagaaggcaaacaattcgaggtataggaagacccaaaaagactataagagaggttatcaagaaggatctcgaacttaatgatttggataaaagtatgcatacacatctatatcatatctacttagaccatgcaactgcatcgatctcagcttgtgcactccggtataactcaagcctctttgagagggcacttcgcctttccatgattgcaggatcctcattcagcaatgaggacagacgcttgggctgcaaagacgatttatgcagactatcagtgtttaatttatcaggaaaatacataaactaa

SEQ ID NO: 55383 - DNA, 1638 bp, Glycine max
  Peptide Sequence Number=SeqID_172161
atgaaactgaaacatgaagaatcatcatcgtcttcttgttcatctcccatcaaattccaaatgttaaggcatcaatgcaataccagcatttttggcctctccttctccttcatattctccctatggtgcctcctcttcttctacatcaagcttcgcctcgttcatggcactggagctatgttagagctcaatgaatcaggtagctccaacaacagtcttggtcagaaacttgcaaaaccctcctactcaattcctgaaacaactagtttagaacaaatgttttggcacgttttaggcaatggtagtaatttggtgtgcaaactgcagcctccacaagacgtaaagaaacttaaccagattcctgatgagaaacttcatcacaattacgatgaatttcgagcgcaagaaaaaacaaagggcatgaactctgcgcttgttaacataactcacaggcttgaatctgatggttctgtgtacaactatgcctctgagtccaaaggtgcaaaggtggtggcccataataaggaggccaaaggtgcaaaaaatatacttgggaaggatcatgacaagtacctcagaaacccttgttctgttgaaggaaaatttgttgttattgagctctcagaagagaccctcgttgattccgtgaagattgcaaactttgagcattattcttccaacttcaaggaatttgatttggctggaagtttgaactatccaactgaagaatggaacatgctgggaaacttcattgctgccaatgtcaagcatgcacagatctttaagctgcctgaacccaaatgggcaaggtatttaaagttgagcttgattagtcattatggatccgagttttactgcacactgagtgttgtggaagtttatgggatcaatgcaatagagcggatgcttaaggatctaattgttgcttctgtggcatccattcctgataagttgcctgttcataatatcactgacacctcttcattgaaatcagaagatggtcaaattgacagaaatggaaaaaaagttgatactaagaatgatactgtggctgctgagataacaagcaatgatactgctcgggagtttgacacagaagcggtaaaaacaacaatgactgcgaacttgattcccgatcctgtattagaacttagacaacagctaaatggtagggtagctggtgacactgttctgaagattttgatgcagaaagtgaagtcagtggaggtaaacttatcttcccttgaggattacatcaaagaattgaacagcagacaacgggttaaaataccagatcttgagaaagagttgtccagattatcagaaagccttggacaaagcaaatcagagatcaaagatctctggcagtggaacacaaatatggaaaaaggaatatctgaggttgagtcttggaaagatgctgtctcatctcaacttaatgaaatagccagagaaaatagcatgctaagatcagatgttcgaaaggttgcaagtaatcaagtaaatatggaaaccaaagaacttgctgtattagcaacgagtcttgtttttgtgtgccttgcagttctcaagatagtttcagtacatatgttgacgttttctgcatcatacaatgcagataagataggcattctatag

SEQ ID NO: 55384 - DNA, 807 bp, Glycine max
  Peptide Sequence Number=SeqID_172162
atgatgagtgtgagagttattgtgtaccttttatctactgtactagtagtatcttccacatttgtagaatcaagagcattgcttcaattccaagatccttctcctccctcaactgcaccttcttcttctcctgtccctttagcgccagcgttgttcgtcatcggagactcctccgttgattgcggaaccaacaattttcttggcaccttcgcacgcgccgatcaccttccttacggaaaagatttcgacacccaccaacccaccggaagattctccaatggaaggatccccgtcgattatcttgctctgcgtcttgggctcccttttgtgccaagttatcttgggcagacaggggctgtggaggatatgattcaaggggtaaactacgcttctgctggcgctggcattattctctctagtggctctgaattgggtcagcacatctccctcactcagcaaattcagcaatttacagacacacttcagcagtttatattgaacatgggcgaggatgctgcaaccaatcacatatccaattctgtcttttatatttctattggaatcaacgactacattcattactatctgctcaatgtctccaacgtggataatttgtacctaccctggcatttcaaccactttttagcatcttcactcaagcaagagataaagaacttgtacaatttaaatgttaggaaagtggtgatcacgggacttgctcctattggctgtgcccctcactacttgtggcagtacggcagtggaaatggagaatgtgttgagcagataaatgacatggcccgttga

SEQ ID NO: 55385 - DNA, 1710 bp, Glycine max
  Peptide Sequence Number=SeqID_172163
atgtcggtttctgaggttgctgtgagaccgattttgaaaaaatcggtgcattggcaagggcgttgctctggcgaatctatccggatatatctaaccgtagacggtgcgttgagaccaatgcgtgtattggagtctgactccatagcttcggtgaaaatgaggattcaagcatgcaaaggaatcgcagggaagaagcacaagctggtctatggtggcagagagcttgcccgcaaggatgcactcatcaaggattacggtgtcactgctggcaatgttcttcacttggttctccgtctctctgacatgatcttcattgttgtgaggactgcctgtgggaaggagtttgagtttcagattgatagacatagaaatgtggggtatcttaagcaacgcatcaagaagaagaagggagaaggtttcattgaccttgagggtgatcaagagcttttctgtggtggggaagagctccatgaccagaggctcttccgtgatatatgcaacactgatgatgctgatggtgtcattcatttggtggttcgaaattcagcaaaggttaatgccaaaccagttcacaaggatttggagctttcggttgttgctgatggctctgctgagggagagaaagagaatcaggtgacaccaaagataccaccacctggtttagatttctggttggaaccagtttttgtaaatcctaaggtcagtttttttccttttctttgggacttgattggctccacattcgatggtttgaagaaagggaataaccctatcagatcctccgagggcacaggtgggacttacttcatgcaagattcagcaggtatggagtatgtttcagttttcaagcccatggatgaggagccaaatgcggttaataaccctcaaggcctaccggtttcctctaatggcgaaggtttaaaaatagggacaaaggttggagaaggagctatgagagaagttgcagcatatatattagatcatccaaaagctgggccacggttggtgacaggtgaagcactaggctttgctggggttcccccaactgttatggtccagtgcttacaccaagcctttaaccacccagatgggtttgattactcctcaaagcattccaaggtggggtccctgcagatgtttatgagcaatgatggtaactgtgaggaccttggaccaggggctttttctgcggaggaggtgcataagatcaccgtgcttgatctaagaatggctaatgcagataggcatgctggaaatatattgttcaggaaagaggcaggtggtcacactttgctcattcccattgatcatggctactgtcttccagagaaatttgaggattgtacatttgattggctttattggccccaagcacgtcagccttactcccctgatacggttgattatatcaaatctctggatgccgagaaagacatagagcttctgaaatatttcgggtgggatgtcccggttgagtgtgcacgaacactccgaatctccacaatgttattgaagaaaggggttgagagaggtctcactccttatgacattggaagcattatgtgtagggaaaatttgaacaaagaatctgtcatcgaggagattatttgtgaagcccaagaatcattgctacctggcatggaggaatctgtgtttcttgaatctgtctcccagatcatggattcccgccttgataagctttcaaaatag

SEQ ID NO: 55386 - DNA, 459 bp, Glycine max
  Peptide Sequence Number=SeqID_172164
atgtcggcattggttgagcattggcgaccagagacacacttttcacatgccaattggttacctgtagacggtgaagctgttatttgccgtggttgtcctaactgggggcaattatgcgaacagttcttgggagttagaccaacttatcctgacataaaggggagtagggtgaagttgagttggctcaaaaaacattttaacaacgtcaaggaacatgcccacagccaattgcaattggagcactttacacgtgcttacatattacatttgtttggaggatggcttttttctgaccattcagggatatacgcatcgctaagtgcatggcatcaatcaaaccgtgtcctttgccaatttaaaatgcaacaacatattctggctccaccacttcaccaggagaaccttcatggtgtcactccaaaaggaaagaacacaaaagattgggcgcatgtccactga

SEQ ID NO: 55387 - DNA, 987 bp, Glycine max
  Peptide Sequence Number=SeqID_172165
atgggcaaaggactcataccagcagaccttgatacttggaagcaaaggagaagaggagagggttatgatggacctaactcaattgaattggatcttgaggcagagttttctagtttggctcttgatattattgggatcggtgtgttcaactatgactttggttctgtcaccaaagaatctccagttattaaggcagtctatggcactctttttgaagctgaacatagatccactttctacattccatattggaaaattccattggcaaggtggataatcccaaggcaaagaaagtttcaggatgacctaaaggtcatcaatacttgtcttgatggactcatcagaaatgcaaaagagagcagacagattagatactacttcgatttcatggaaacagatgttgagaaattgcagcagagggattacttaaatttgaaggatgcaagtcttttgcgtttccttgttgatgtgcggggtgctgatgttgatgatcgtcagttgagggatgatttaatgacgatgcttattgctggtcatgaaacaacagctgcagttcttacttgggcagttttcctcctagctcaaaatcctaacaaaatgaagaaggctcaagcagaggtagatttggtgctgggtgggcacaaaggtgataaagatggttatgcaattcctgctgggactgatgtcttcatttctgtatataatctccatagatctccatatttttgggaccgccctcatgactttgaaccagagagatttctagtgcaaaacaagaatgaagaaattgaaggatggggtggtcttgatccatctcgaagtcctggagccttgtatccgaacgaggttatatcggattttgcattcttgccttttggtggcggaccacgaaaatgtgttggggaccaatttgctctgatggagtgcactgtagcgttgactctgctgctgcagaattttgacgtggaactgaatcggtggaactag

SEQ ID NO: 55388 - DNA, 1083 bp, Glycine max
  Peptide Sequence Number=SeqID_172166
atgggtttcgctttggcattcacagcttcttctacttgctgctcaaatctacaatctcagtctctgttattcgctgctgctgcattgagatcaaaaccgtgtctctctctctgcaacacttatcgacccaaacgcattcggaagcgttctccaattgttggcgctcaatctgaaaacggagctctcgttacttccgagaagcctggcactaattacggaagacaatacttccccctcgctgctgttgtaggccaagatgctataaaaactgctcttttacttggggccattgaccctgggattggaggaattgccatatcaggaaagcgaggaactgccaaaactgtaatggcacgtggactgcatgcaatactgcctcctattgaagtagtagtaggttccatagccaatgcggatccgacctgcccagaagagtgggaagatggtcttacagaatgcctggaatatgattctgctggaaatattaaaactcgtattatcaagtctccctttgttcagattcctcttggaatcacggaggacagactcattggatcggttgatgttgaggagtctgtgaaaacaggcacaactgttttccagccaggcttgcttgcagaagctcatagaggtgttttatatgttgatgaaattaatcttttggatgagggtatcagtaatttgctccttaatgtattgagtgaaggagtaaatactgttgaaagagaggggatcagtttcaagcacccttgcaggccccttctcattgccacctataacccagaagagggtgctgttcgtgaacatctgctggaccgcattgcgattaatttaagtgcagatcttccaatgagttttgaaaaccgtgttgcagctgttggaattgccacagagtttcaggagaacagtagccaagtatttgagatggtcgaagaggaaacagacaatgcaaaaactcagtctatcaagttcttatgttcaactacccatgatgttggagttataaagttggctaggtggttaaagggagaaggggggagggagtggtcatgggttcaaatctctcccactaacaaaaactaa

SEQ ID NO: 55389 - DNA, 1596 bp, Glycine max
  Peptide Sequence Number=SeqID_172167
atgtttcaagaagaagggttatcttctgtaacttcttcacctcttcagttcttttccatgatgtctctttcagtttcacctagcttaggatctccctaccaaatgaaatgcgagcaaaggggtttggtattaatccatttgttgctcgctggtgctaattttgtagccaccggtgatttacaaaatgcaaacctcacacttgagcagatttcccagcatgcctctcttgatggggatactatgcagcgaattgcttcttatttttctgaagcactcgctgatcggatacttaaaacatggcctggcatccacagggccctcaattccagcagaataactatggtttctgatgaaattcttgttcaaaagctcttctttgagcttttacccttcctcaagttctcatatatcctcactaatcaggctattgttgaagccatggaaggggagaaaatggtgcatatagttgatctctatggggccggaccggcacagtggatttctctcctccaagttttgagtgcacgtcctgaaggtcctccccatttgagaatcaccggggtccatcacaagaaagaggttctggatcagatggctcataaactcactgaagaggcggaaaagttggatatcccattccaattcaaccctgtgctaagcaagttggaaaatcttgatttcgacaaacttcgcgttaaaactggggaggcactggcaataagttctattctgcagttgcactcccttttggccttggatgaagatgcctcgcggagaaaatcgcctcttttgtcaaaaaactcaaatgcaattcacctgcagaaaggcctcctcatgaaccataacacactgggagatttgcttgacggctatagcccgagtcctgattcggcctcatcctcaccagcagcgtcttcatctgctttgatgaattcggagagctttcttaatgccttgtgggggttatccccaaaagtcatggttgtaactgaacaagactttaaccacaactgtttgaccatgatggagagactggcagaagctctattttcttatgctgcatattttgattgcttggagtccacggtctcaagagcatccatggacagattaaaacttgagaagatgctttttggcgaggagataaagaacatcatagcttgtgaaggatgtgaaagaaaagaaaggcacgaaaagatggataggtggatccagagacttgacttatctggatttgcaaacgtgcctataagctattatgggatgctgcagggaaggaggttcttgcagacctatggttgtgaggggtacaagatgagggaggaatgtggtcgggtgatgatatgctggcaggagcgatccttgttttccataacagcttggagaccaaggaaaattgagttattctcattcccccaggtagcaaatcccatagcccccaaccacgagcatcactttcgacaattcctgcattatctgatcagatggcaacggttcactggaactgccaagagaacaagattgggaaaagagaaagatagtgctcatgtttgtcattttatgagacattgggaactttacgaaaagttagattaa

SEQ ID NO: 55390 - DNA, 1310 bp, Glycine max
  Peptide Sequence Number=SeqID_172168
gagtggaacctgtacccgacaaggtcagagcaatccaccaatggccaacacctcgaagctttagaactcttcacgggttccttggtctcgttggattttattgccactttatcaaaggttatgccactctagcggctcccctgactaatgctttgacacaacctcacttggtttggttcccagaagcagaaaccgcctttcaaaagctcaaatgtgtcgtgagtacaacgctagtattgcaacttcttaattttcttattccattcacgatggaaactaatgcgtcaggcgttggaatgggcgcggtgctatctcagtcgggtcaccctctcgcattttttagcaaacaattttgccctaagcctcatctagcttcagcttatgtccgtcagttagctgccatcacgactgccatcaagaaatggaggcagtatttgttgggccacgctttcgtaatcctcacggaccactgtatcgccgatgcgctatcacgaattccaaaggagacacacgcttccttattggtccatcctgagttcattgctctcaaacaggccttgcaagataatccgacaaccggtgtgcctactttgcccattgccagtgcccttacgacagtgggaagacctatcattagattcattgtgggtctcccaccttatcgggggcacactaccattctcatggtcgttgacaaattttcaaagggggttcacctgggtatgttacctcccaattatacaacgcacattgttgccttgttgtttctggaaatggtggggaaactccacggcatgcctcgcacttaccatcctcaaatggatgtccagatggaggtcatcaagagagtagtggagcagtacttacgcgcttttgttcattcgagaccaaccacttggggaaaattcctgatgtgggccgaatggtcctacaacacttcaattcactccgcaactggtgtctctccattcgaaataacatttggccgaaaaccacccaacattcctcaatacatcacaggatcggctcaggtaattgcggtggatgagttattgattaatagagagatagtcttcgctagtttgcagaagaagcttttgaaatctcaagcacgcatgaagagtctagcagatacccacagaagggaggtccactttgaagttggacaatgggtcatggaagcttaccaccttgaggacaaggtgttgcttgatggggtaggaaatgatgggcccaagttcaatgatcagggcaatatgttggcttgtctgtcagtaatagagtattatgttagtgcttgctgtagtggg

SEQ ID NO: 55391 - DNA, 270 bp, Glycine max
  Peptide Sequence Number=SeqID_172169
atgcttacggatcaagtgatccgtaaacaacccagcaacttcccgatagcgatttccgccatcgccggcaacaatggtggaagaagcagaaacgcgaaggagaaacttacctcaaagaagaagaagaaacgcgaagaagaagcagacccccaccttcctcctaatcacgacaacaatggcggcaacggcttgggagcttcacttgggaggcgaagaagaagaagaagaacgaagaagatgcaaaatctcgaagaagaagcagaagaatga

SEQ ID NO: 55392 - DNA, 1119 bp, Glycine max
  Peptide Sequence Number=SeqID_172170
atgtcccggaacggacaactctcctcttggccaggccttttgcatgcgttagaagcccgttttgccctgtctcaatatgacgaccctttcgacacactttttaagcttacacagcgtggaacagtcagcgagtaccttgctgaatttgaatcactagccaatcacattattggccttcctcctactttcttgatcaattgcttcgtctccggcttgacttcgaaaatctgtcgagaagtccaggcttcacagcctttgaccatggttcaagtcgcgaccctagcgcgtctccatgaggagaaattagaagactctcgacacctttttcgtagacgtcctcctggcccaaccctttccccaggacctctttcctctcgcactacccctttgttaccggcacctgctctgttgcccacacctccaaagtccccagccatccctttcaagcgattgtcaccagaagagcttgcctcgcgccgagagaaggacaaagaggataacctttcgagtgatttttcctttgatctgagtgacgataacgacgaggctaatgggccatcaccagcccaaatcagcttacatgcactttcgggccacatggccccagaaacattacgtctattgggccgtattaacaggcacaaggtgtggatattaattgatgtgggtagtacccacaattttatccaggaatgtttagtgtctatcttgggcttaaacgcacagttcacgcaacctctaatggtcatggtggggaatagccatgagctcaaatgcagtaagtggtgcagagacatttcccttcaagtgcaagaccaaagcttcatcatcaatttccatgtactttcattgtgtggcgctgacctcatcctcaacgttgaatggctgaagttattaggtccaatcctcacggactacaatgacctcaccatgaagtttctgcatgatggaagagttgttgagctgagaggggaacaggaaggtgtagtccattccattacagcgcaccagttacaacgtctcataagaactgatggggcgagtcaattttttcatttgcatattgagcctccttcaacccaaatgtcttacacaccacaccaaaacccagaaatttag

SEQ ID NO: 55393 - DNA, 1083 bp, Glycine max
  Peptide Sequence Number=SeqID_172171
atggcacccgatgccgccgccgccgtcgccgccaacggcaaaaagagaagacgctatcttcctcacaataaggcagtgaagaagaagggttcgtaccctctgcggcctggcgtgcaaggctttttcatcacttgcgatggcggcagagaacaccaagcctctcgtgaagctctcaatattctcgattccttttatgaagagctagttgatggggaaaaggagttacccagcaaacctttaaataaaaaaatcacgtttgctgattctgactcttctagtagtgatggtgaggaagaggaggaggaggaggaggaggaggaggaggaggaggaggaggccgtgcatgatggggatgaggaaaagggggacaaaaagccaaaattggatacttctagtgacgacaatgccagtcatgacgatggagcaggtgaaaaatcagatcctcataacgttgatgaaccgcacactcaggaagaaaataaaacttgtgataataaagggaataatggcaatcttaagactacaaaagggacagcagatgatctaccagctgtgaaacagtgctgcaaaacaaacgtgcctgcatgtaattttagtgacaaagtggaacacaagtctattgataagttaattgaagaagaattcaaagaattgggagacaagaataagcattcagaaacacgtgaacatatttgtgcaactaatgctgagaggcgctttgtcaagcttgattctggttgtaatggtgtagtatttgttcaaatgcggaagaaagatggagaccgaagccccaaggatatagttcaccggatagtgacatcagcagcatcaacagggaaacatatgtcaagaaacactaacgcagtgttgactacttctaggtttattttgagaattttgccaattgaagtctcatgttatgcttcaaaggaggaaatttcaagaacaatcaagcctcttgtggaacagtactttcctgtggaaactcaaaatccactcaagccatatttaacaatgatatttttacctaatgctccaacttctacactcagtgagacttactgccaaggttgcgaagattga

SEQ ID NO: 55394 - DNA, 132 bp, Glycine max
  Peptide Sequence Number=SeqID_172172
atgacaatggcagcaatgtgcaatggtagctttggcaacagtgccaacagtacaagagacaatataggtggtgctgatcgtggccacagggagcacagtgacaaccagttattgaatggtgcacttcgttaa

SEQ ID NO: 55395 - DNA, 552 bp, Glycine max
  Peptide Sequence Number=SeqID_172173
atgaagtattctggcaaggggagtttactagcggacattgctttgagaagtgtgaacaacaatcctttgtccaacacgtctcctcgcttagcggtcagctcacgcttagcgcgaataaggcccacaaagaagcccaaaggcgcgcttaacgcgaaagtccacgctaagcgcaagatcgcagacacaagaggcgctgaaagtgaaaagataaagagcaataaagatatactcttctctgtttctaaactaccttcagctcaagatttgaggagatatgactttctgtggtggactatccagatcatcatgatgatgatttggcaactatggagcctaagatggacatgcagtttattctcaatactggaggacttgctcagcaatgacatagtaactggaaatctagaggatgaagttataattggtgattgttcacaagttgatgtgtcagtaaaggatttggcagcagaccctgatgattggagtgaccaattgcaggaccttgggtccaaacatagagggatgagaagtgtactattatcatgtccttag

SEQ ID NO: 55396 - DNA, 717 bp, Glycine max
  Peptide Sequence Number=SeqID_172174
atggggagagtggttttgggggtggcggtgacggtggcggtggcgacgtgcgcgttggcggcggtggtggtggggcggagagtgaggagccggaggaagtggaagaaagtggcgaatgtggtgagggaactggaggaagggtgtgccactagggttgggaggttgaggcaagtggtggatgccatggccgtggagatgcacgctggtttggcttctgaaggtggctccaagctcaaaatgcttctcacattcgtcgataatctccctaatgggaccgagagaggaacatattatgcacttcatcttgggggtaccaattttagggttttgcgggttcaattaaatggtcaaccatcttcagactttgaacatgaagtagaacgacaacccattccccaacatgtaatgactagcacaagcgaggatctctttgattttattgcgtcttcattgaaggaattcattgctaaagaaggagatggttccaatatttcacaggatagaagggagcttggatttacattctcctttcctgtgaaacaaatgtctgtttcttctggcattttaatcaaatggacaaaagggttttccatcggaaatatggtaggaagagatgttgcaacatgtttgcaagaagcattggcacggaaaggcctagatgtgcgggtagctgcattggtaaggaagtactttcatttacctactgttatgttatga

SEQ ID NO: 55397 - DNA, 804 bp, Glycine max
  Peptide Sequence Number=SeqID_172175
atggggctattaggcaaagtggcattggtcacaggtggagcatctggaattggagaaagcattgtgcgtctcttccatatccatggtgctaaaatttgtatagctgatgtgcaagacaatcttggaaagcagatctgtgaatcccttggcgacgaagcaaatgttgtttttgtccattgtgatgttacagtagaggatgatgtttcccatgcagtgaacttcactgtgggtaaatttggcacccttgacatcatagtcaacaatgctggaatctccggatcgccttgtcctgatatccgcgatgcagacttatcagaattcgataaggtgtttagtataaacgcaaagggagtgtttcatgggatgaagcacagcgctcgagttatgatcccaaacaagaagggctcaatcatttctttaagcagtgtagcaagtgccttaggtggcataggaatacatgcatacacaggatccaaacatgctgttttagggctcacaaagagtgttgcagctgaattggggaagcacagtataagagtgaattgtgtgtcaccttatgctgttgcaacaggtttggctttagcccatttgcctgaggatcagagaactgaggatgctttggccggttttcgcgattttaccgggagaatggccaacttgcagggggtagagttaactactcatgatatagctaatgctgtgctcttccttgctagtgatgaagcaagatatataagtggagagaatctcatggttgatggtggcttcacgagtgtaaatcactcactccaagtttttaaatga

SEQ ID NO: 55398 - DNA, 444 bp, Glycine max
  Peptide Sequence Number=SeqID_172176
gcatcagctgattcagattatgatggcagaggagttgaacattctgtttcgtcatctgaaatcaagaaggcctatcacaaagctgcacttagacatcatccagacaaggctggccaatctttggcaagaagtgacaatggagatgatcagatatggaaggatattgttgaagaaataagcaaagatgccgataggcttttcaaaataattggagaggcatatgcagtcctgtcggacactgccaagcgttcacagtatgattctgaagaagaaatgagaaattcccaaaagaaacgccatggaaacagcatcaatagaaataatgtcattgatcaaactgacaataggagacactggaaagagaccaatggcaatgcagttgaacaagctcggttcatcggttcttgggatttctttgggatattggaagaatttttcttttga

SEQ ID NO: 55399 - DNA, 2718 bp, Glycine max
  Peptide Sequence Number=SeqID_172177
gacaaaagaaaagatgctgtcaaaaaggttattgctgcaatgactgttgggaaggatgtctcatcactgttcactgacgtggtgaattgcatgcaaacagaaaatttggagctaaaaaagctagtttacttgtatctgataaattatgcaaagagccaacctgacctagcaatacttgcagtgaatacatttgtgaaggactcacaagatccaaatcctttaatccgtgccttagctgtacggacaatgggctgcattcgtgtagataaaattactgaatatctgtgtgatccccttcaaagatgcctaaaggatgatgacccatatgttcgtaagacagcagctatttgtgttgccaaactttatgacataaatgcagaattagttgaggacaggggctttttggaatccctgaaggatttgatatctgataataacccaatggttgtcgctaatgctgtggcagcacttgcggaagttcaggaaaacagtagtagacccatctttgagatcaccagtcacacactgtcgaagctccttactgctttaaatgaatgtacagaatggggtcaagtttttatattggacgctctttctagatacaaggcagctgatgctcgtgaggctgaaaacatagtagaaagagttactcctcgcttacagcatgccaattgtgcagttgttctatcagctgttaagatgatccttctgcaaatggagcttatcaccagtactgatgtggttcggaatctttgcaaaaagatggcccctcctcttgtgacattactctctgcagaacctgagatacaatatgtagcactgcggaatatcaatcttatagtacaaagaagaccaacaatacttgctcatgaaattaaggtgttcttctgcaagtacaatgatcccatctatgtaaaaatggaaaagttagaaattatgataaaactggcttcagaccgaaatatagaccaggttctattggaatttaaggagtatgctactgaagttgatgtggatttcgtaagaaaggctgttcgagcaattggccgttgtgccatcaaattggagagagcagctgaacgatgcattagtgttttgcttgagttgatcaagataaaagttaattacgtggttcaagaggcaatcattgttatcaaagatatatttagaagataccccaacacatacgagtccataattgcaacactttgcgagagcttagataccttggatgagccagaagccaaggcatcaatgatctggataattggtgaatatgcggaaagaatcgacaatgctgatgaacttcttgaaagtttcttggaaagtttcccagaagaaccagcacaagtccaactacagttgctgactgctacagtcaaacttttccttaagaagccaactgagggcccacaacagatgattcaggttgttttgaacaatgccacggtggagacagataatcctgatttgcgagaccgtgcatacatatattggcgtctcctttcaactgatccagaggctgctaaggatgttgtgttagctgagaagcctgtgataactgatgattcaaaccaacttgaaccttctctacttgatgagcttcttgccaacattgctacactatcttctgtttatcacaagcctccagatgcttttgtaactcgtgtacattcagctcagagaacagaagacgaagactttgctgagggaagcgaaacagggttttctgagtcacctgcaaatcctgctaatggtcctgcatcaccgcctacatctgcaacaggtgcaccagccacacctccatctgttgcacctgtgccagatttacttggtgatttgatgggcatggataattctattgttcctgttgatcagccagttactcctactgggcctccattacctattttactacctgcttcaactggtcagggtttacaaattagtgcacaactgactagacaagatggtcaaatattttatagtttgttgtttgagaacaactctcaggtttcacttgatggcttcatgattcaatttaacaagaacacatttggtcttgcagctgctggaccccttcaggttccacagttgcaacccggaatgtcagctaggacactcctccctatggttatgttccagaatatgtcgcaaggtcctcctagctcagttttacaggttgctgtgaaaaacaatcaacaacctgtgtggtatttcagtgataaaatctcgttacttgtattcttcaccgaggatggtagaatggaacgttccagttttctagagacatggaggtcccttccagattcaaacgaggtttccaaggacttcccagccattgtgattggcagtgcggatgcaacagtggaacgactggctgcgtcaaacatgttctttattgcaaagcgcaagaatgcaaaccaggacgtgttttacttctcagctaaactccctagagggataccattcttaattgaacttaccacgttgactggaaaccctggcgtcaaatgtgcaatcaagactccaagccctgaaatgtctgcacttttcttcgaagccattgagactcttctcatggaatatttgataaatatcctggacagatttttcattggagatacgagttgtgaaaacgggtgtagtggtggatggtggaaaatcaaacctatgccatcacaccctaatgctaaaaagtggattcgtggcaattga

SEQ ID NO: 55400 - DNA, 288 bp, Glycine max
  Peptide Sequence Number=SeqID_172178
atggtgacacgactggaaaagaggcacaatgctacatgggggagggagggagaaacgaacaacgaggagaaaaggttggatttaggcgttttgggtttagatatggacgatgatgatattttatgggcggatttggtaggtgatgacaacaatgagggagagaaggaagacacatatatggagacaaagtccaactgctttcggtgctcgtcatttagaatcgatgttcttgatcaaaatgaggtagtgacgatgatgatggagtatccacagagcgaggaagcgtga

SEQ ID NO: 55401 - DNA, 2097 bp, Glycine max
  Peptide Sequence Number=SeqID_172179
atggcatcagaagatatggccaacttgaaaattgaagatagcaaagaccaaagagatggtggatttgtgttcacatccaaacaagacaataataattcttcaggctcatcattccttcagcttggtgatgctcatgctcatgccattgataaattcaaattcggtgcaaggaaggaacaaagtggcaacaataaaagtagaccaaaactcaagttatctacccctccccagggatatcatgattttatttggaagccaaagaatgagtcatttggtttttttagtgtggatgccacatcaattgatcagtgttcgaataagaatgaatgtgaagttgtagacatagagaataaggaggaagcttcagattgtggtggaagcttcaagtctgccaatgatgaagtggacataacaaatgatggttcaagacatatgagtggctttacattttctgcttctcaagtgcaatcatctagctctagcctcaaacgccaccccaataagataaattgggtaaaagttggtcatgctcatcaaaatgatacttacaactccactcctaatccattatcattttctggaacttcctctcttttcacttcagggcaagccaatacaaggggatctgaggtgcaagggataaaggatgaatttgcttccatttctgctacaacccttgcggctgaggaagcctgtgaaaagtggagactcaaaggaaaccaagcctacaaaaatggaaatttgtctgtggctgaggattgctacacacaaggagttagttgtgcttctaaagttgaagcgtctcagagatgccgaagggccttgatgctgtgttatagcaaccgtgctgccacacgcatgtctcttggtaggatgagagatgcagtagaagattgtaggctggctgctgaaattgatccaaatttcctcagggtgcgacttagagctgcaaagcctcctatcctatgtcaaagagggttggctctaatgggtaaattgaaaggcattaacaagaagattatcaattatattcttcctacaggttgtctttcattggaaagttatcattgtttccttgctatgggggaagctgaggatgcgtcaaagtattccaagaggtgcttgcaatcaggaaccgatttttgtgtagataaaaaaattgttgtggaagcctccgatctcttgcaaaagacacagaaagtatcagaattaatcaatcattctgatgaactgttgcaaagaagaacggctgctgatgcagagagagcattggaacttataaatgaggcattggtgataagttcatactctgaaaaattgcttgaaatgaaagcggaggctctttttatgctatgtagatatgaggaagtgatccagctgtgtgatcaaaccgttggctctgccgagaagaattcctatccattggatgctgattgcgaagtgagagatctggatagttcacagctttcaaaaggcttatatttcaggctttggcggtgctcaatgatgcttaaatcctactttcacctaggaaagcttgaagagggtctttctttactggaggaacaagaggaaaaggtatctgccataaacatgagtggaagcaaggttttggaatcactaatgccactagctgtcactgtacgtgagctcttgcatcataagacagcagggaatgaagcgtttcaggcaggaaaacatgaggaagctgttgaacattatacagctgctttatcatgtaatgtggaatctctcttatttgcatctgtctgttttggtaatcgggcagctgcatataaagcattaggtcaaattactgatgccatagcagattgcaatctggctatagctcttgatggaagatacttaaaggcactttctaggcgtgcaacttcatatgagatgatcagagattatgaccaagcagcaagcgatataaggagagttgtctctcttctcattaatagaaatcagcatggcatatctgatagatcaatcagctatgccaatgatttgaaacataaccaaatttggctttccgaaatagaagaggaagccaaaaaggggatacctcttgatatgtacctcattttgtaa

SEQ ID NO: 55402 - DNA, 1119 bp, Glycine max
  Peptide Sequence Number=SeqID_172180
atggtgtacttggagcactgtctgcttccaagagttaacgcttattcaaggattgtcaatggtcttctgaaaaccgctttgggaccacctacagggtcaaccactgctttgtctccagcacaggatattactttccgacatgaatctgtgaaatgcttggtcagcattattaagtctatgggagcatggatggaccagcagataaggataggagatttagatctagcaaagagccctgaaagcagtagtgcagcagagaatcatctaatactaaatgtagaagaaggaaatgcttctgatcatgagctacattctgatgtaaattctgaattttcagatgctgccacgttagagcaacatcgggcatataaaatcgaacttcagaaaggcatatcactttttaatcgaaaacctccaaaaggtattgaatttttgataagcaacaaaaaaattggttgttctccagaacaagtggcactgttcctgaagaacactgctggccttgatgaaaccaagattggtgactatttgggagaaagggaggagttttctctaaaagttatgcatgcttatgtagattcctttaacttcaaagggatggattttggtgaagctattcgattttttcttcagggcttcaggttgcctggtgaggcacaaaaaattgatcgtatcatggagaagtttgctgagcgctattgtaaatgcaaccctagttcttttagcagtgcagatactgcctacgttcttgcttactctgtgataatgcttaatacagatgctcataataatatggtgaaagataaggtggtggtagttatgatgacaaaggctgattttgttcgaaacaaccgaggaatagatgatggaaaggatttaccagaggaatatcttggggcactttatgaccaaattgttaaaaatgaaattaaaatgaatgctgattcttctgcacctcagaataaacaagcaaatagcttcaatagattgctgggattagaaggtatactcaatcttgtgaactggaagcagagtgaggaaaaagcagtgggtgcaaatgggcttctcattcggcacattcaggagcaatttaaaactaattcacgaaaatcagagtaa

SEQ ID NO: 55403 - DNA, 606 bp, Glycine max
  Peptide Sequence Number=SeqID_172181
atgaggagtaaagctctaaacctggttcatgtccttgatagtgctgctgctactacaactgcacctgctctggatttcggtgccttgagcgtttctgatggagggaagcagttacttgataacatattatgcattaatatgagtggattgactggacctattcaatttgttttagatagatctcctctaaatccatcatatggcattcttaatgtaattgctacagttcaatacaagttcattctgtttggagatggacacaagaacccaagctactgtgatcttgtcaacatgattacttctgatgtttttgatgctgccgtaggtgacattgcgattgtctctgtccgaacaaagattgtggattttactcgaccatatatagagtcggggctagttgtggttgctccaaaaacacacttagtccacttggttgagttgtgtccatccatgtcttgcatttacatactcacttccctcacatgcatctcacccccgaaagtgacagacatgttgaattgggccacatttgttgttgatccccctcatcatcgctccaccgacatcactctcacactcgatgtgtttagcatgcaatttccttaa

SEQ ID NO: 55404 - DNA, 510 bp, Glycine max
  Peptide Sequence Number=SeqID_172182
atgcacagaagcacggaagagaacagtctacgagggctaggaacctccataagagagaaggataaggaagaaaaattgtattatttttctgctgtcctctattacatactaagcatcccttatatagaggcactagccaagggtgccactatgaaaacagaagctcagcaccttctaacagattctgttaaagggaatccaccaagggtttgtgcccgtagtggtgcttttgctggtggcttggtacttctcttgggccttccatcgtgggtctcgggtctgtcttcatccatagcttgggcctcagtgaataagttcaaggaaacaagaaaggatatgagagcagaagatgcggaggggcacggagccgccagtgaagaagcggacagagagcgcccgtacgagaaacctatggatgtggaagagtgggggagaacggatggcgatgctgctgagaaccacggttggcgaggtgaagggaatgacggggtgttgcgtggtgactggtga

SEQ ID NO: 55405 - DNA, 735 bp, Glycine max
  Peptide Sequence Number=SeqID_172183
atgtacttaaaaagagttgctatgtatgtgccctttcctgaatccaccaaactttctagaacagtgtatgtatacgctgatacttgcaaaggagtctcttatgttcatttcattttattctcaccaactttattttatgcaggggcaaggatgttgtataatccacatgatatcttattgagaagaaaaattgaggagcaggctgaattgcagcaagtccttgaacttcaagaaagaaggctgaagaatctacagcttccagacttcaagaataatcccattcaccatcaccaacgcagtctttcagtgggtactcctttggttttgccccatcaacttcatagtcatattaacgatgcaggtctttctcctgatagcattaaaggagatattacaggctacagtggcagcttcacttctaccaattctttaggtattgcatctgagcagcagcagcagctacagaaagaagttgatccagctcacattgatgattctgagagcaggaatttaatggagagtggaaatgccgaaggcgtagatcttagtaatagaagtgtggggcaggcccttcctgatagtctctttgcttcaccaacaaaagcagctggaggttatcatgctgacttctctacattggcagaggtcaatgagagtgctgtattttcagctagctcatcttctcaggacaagctagaaccgacaacctcttctagtgatgtggcctcccattag

SEQ ID NO: 55406 - DNA, 321 bp, Glycine max
  Peptide Sequence Number=SeqID_172184
atgtggggttatttgactactttgactacacgaccaagtaaactattattgaaagatcatgcaacagggtgtccagaattcaaaaatgctcataaagtcaaaggtcatctttcccttcagaaaggaggatgcaatgaggtgcatgacatagaagatcttgtaaaagttggacaattgacttcgtcagcagtggcaaaagtttgtagaagatccagagttgtttcgcctgacaagcctggctcaagtaatattaaacatggatctgaaaagaaaaagtggtgctgtcatgatgaatgctctcaattgctcctcaaaagctag

SEQ ID NO: 55407 - DNA, 1404 bp, Glycine max
  Peptide Sequence Number=SeqID_172185
atgggttcatgcgaagccacaaatgtggttctctccaagattaaaaactttgatcctgaaaatgcttcaaaaatcatgggttaccttctcatgaacctggaagaatctgaacttattcgtgttgcttgtagtcccgacactgtgctacaaactctcgtactgagggttaagagccacttgggtctcactctctcgaccccttcgtctccttcgcaatttcctccttctccacttaaccccatagcaagactcactggtacttcctcgaacccattttcaagaggaggacccaccaatggttttgacttcactagaaacccggcttcaccttcctctcactctcatgcctggaacttcccaaacaacaaccccattagtccaaagtccactcctttactctcttacgacaacatccgagccctctcaccccgtgtcaacggtgattgtgattttgttgacgagcagcaagtgaatgagtactttcccttcctcaatgactcctctaagaacgaagatttggtcgatccgcgactcgaattgggcgttggggctcaaaattggcactctggggactcacatttgcacagaaggagctactccgccagtgacgttggttttgggtgtgatgaagcagcccctggacttggatacaagccatgcctttactttgccagagggttttgtaaaaatggcaccaattgtaagtttcttcatggtgcttttactgattcactggatgccattgttggctctcccagtaagcttgaggggatggaacagcgtgaggagtttgttaggttcaaggccccccagcttcaaagaatagcctctggaccttctgcggccgcccgcgagaagtactatgagtttttgatgcaggagtcccaaagggctgcagcagccttcatgatgggggaagaattctataactttggctgggataggccagaaaggaatgacttcctaggcgcaatttccggcgaaaaacccaactctgcttcgcgacagatttatctgacctttcctgccgaaagtacattcaaagatgaagatgtttccgagtacttcagcaaatttggacctgtacaagatgtgagaattccatatcagcaaaagcgaatgtttgggtttgttacctttgtctacccagagacagtgagactcatattatccaaagggaatcctcattttatctgtgattcacgtgtacttgtcaagccctacaaggagaagggaaaagtccctgacaagagacaacaacagcaacaacagcaattagagaggggagatctttcaccatgtttaagcccctctggctttggctctaaagaaccttatgatttccatcttggtaatcaaatttctcatattgacattgttgagatcctacatcaactcagatag

SEQ ID NO: 55408 - DNA, 564 bp, Glycine max
  Peptide Sequence Number=SeqID_172186
atgagatgtggggggaaaagagatagggttgaaaggggtggttgctgcaagaagaagaagtttcgggaaagggggagaaaggatgagagtctacatcttgaagcctattctgattctgattggtctgacgatttggttgataggagaagcactataggacaaatcttcttgttgtctggatctcctatatcttggagcttaaagaagcaaacggtagtgacactatcaactggcaaagcagaatacattgcaatgtgttcaactgcttgtcaggcactatggttaacttccttgcttaatgaattgaaggtgtctgttggtaatgttgttgacttgcttgtggacaataaatcaactatagccttggccaagaatccagtatctcacggtagaagcaagcacatagacaccaagtttcatttccttagggatcaagtgaacaagggcaaggtcaaattgaagcattgcaagatagaagtgcaattggcggatataatgactaagtcattgaagattgaaaggtttaagaagttgagagggtccttgaatatagtttgtttctaa

SEQ ID NO: 55409 - DNA, 639 bp, Glycine max
  Peptide Sequence Number=SeqID_172187
atggcgattggagactttgtttcttctaaagaacaaattgatattattctggaagggaatctgactgagcaaggtttatctcagttctttgactctaatggtggtaatcgctgtgttgcttgtcccactggcagaggtggctgcagacctgcagtggccgtaatggtggtcatggaggccatggcagatattcaagtgttcaatgtcaagtttgtcgcaaatttggacatgatgcttctgtttgctatcatcattttgatgaaaactgtgcctactatgtctctgaatccttcttcagtcaatcctccactacatcaaggacatgtttctgttgcgcttcatgctataccaccgcaggctcccttcataaaccctaatttctcaaataattttttgcaccccactcctcaagctatgcttaccagcactaacctcaaggttcagcaagttggtaccctaactcaggatgatttggataagaatattagaaaacttatgaatgagcttgagtgtgcaaatcggaagtgtgaaatttatcggtccaacctgctttccgttttgaaagctgttgaggatcacaagctagagttatcagttaaggtggaaaacatcaagataagcatgaaagatggcatctaa

SEQ ID NO: 55410 - DNA, 1602 bp, Glycine max
  Peptide Sequence Number=SeqID_172188
atggaatacaggaaaatcaaagacgaggatgaagttagggatgcgggcgttgaggacgttggaaaatcatttttgctgtcagtcccagataacgatttgacttccgagggagaaaccaaaattgacagccacagggagaaagtaaagtggaagcgcaagtcagttgttacacttgcattgactgttcttactagttcgcaaggcattctaatcgtttggtccaagagagctggcaagtatgagtatagtgtcactactgctaactttatggtggagactttaaaatgtgctatatcccttgtggccttgggaagaatatggaaaaaagacggtgtcaatgaggacaacaggaagaaagtagttgtttactttgtgaatctgattgaaaatttaatacttcatcctatactactaagcacagttgcacttggtaatcaaaacatttggttatatggtcttacaaggttgactacaaccttggatgaagttatagtgtatcctattcctgcagcactttaccttgtcaaaaatttgcttcagtattacatctttgcatatgtagatgctccaggctatcaaatattaaagaactttaatattatcagtacgggtgtcctatacagaattatacttaagaaaaggttaagtgagattcagtgggctgcttttgttctactcgctgctgggtgcactacagcccagttgaattcaaattctgatcgtgttcttcaaactccctttcaaggttgggtgatggcaattgtcatggctctcttgagtggttttgcaggagtatatactgaggctattataaaaaagcgtccttcacggaacataaatgttcagaacttctggttatatgtcttcggcatgtgtttcaatgctgttgcaatgttggttcaagattttgatgcggtgatgaacaagaggggcttggtcaaggacgagtcagcttctctctcactaaaaagtgttagtttaggaggggctcagtcaaggatgagcctgcttctttctttcactataggtcgaaagaagtcttttgtgtctaggcctgtgactcgttcctacgctaatgggattcttccatggatattcattcattacagttctcatgattttcaaccatgcactcaggctttagagcaaattcaagacagcaggggaatttgttatgctgagttgacaaatcagttgggagtagagtgggaatataaggaggaggagtgggtgcgaggcatgctgggctttctcccagcagtccattctctggttgcatccctgtatgagcttaggctcagttcttttgaattggccaagagtcgtacactggcttctgttcttggtgttctattattcaaccatttcccctcctttgcttggatgcttcttctgtttcttcctgaaatgaaaggttacttgagatgtggactgtggagtatgagtgacaaaaagatgaaacaacttttgatggttgatgaaactgtgaataagcaaatctcgggaagtggaattgctgtatcaatggtaatgaagtatgctgacaacattgtgaaaacccccactattctttacggacaaaactttagtgatgctcgttag

SEQ ID NO: 55411 - DNA, 1842 bp, Glycine max
  Peptide Sequence Number=SeqID_172189
atggcgcgaatatggaacaaggagagaagatttcgaagcaaatactacctacaaattagaagaagagcagcgcgggattcaaaccaaccaacaccagggctcatggactcaagtgaagggggatcatcatcatcgtggagggacagaccagacatcacctctttctatttctcccattttcctgattatgtccgcgaaaaagatctctggaagatttttcaggagtggggaaaagtatgggaggtgtttatacctacgaagaggaataaacaaggccatagggtagacaacactcaaccggggactcaaggtagagcaggagttaaactcatggagtatgtagtaaatgagcagacgaaacaccataacattttaccgccaaagctaaaatcatatgcggaagtggtgagacacaatcgcacgcaggaaggaaaggagctacatggcacgccggaaggaaacgagctacaggggctcacgacggggaacgttgcagagtccattattatccaaacgaaaaaggagaaaacaaaatggcttgacaatgtttgggtgggtcgtttaaaaaacaaaggaatgttcgaaaaggtggaggaggagatgcaggggatgtttggaatggacgtgaaacccgcatattggggagaagatatggtcatcttccatgaaatggatgacgacacggctgacaaaatcaaccaacaggaactcggtaaaggagggactcctttctcttctattcagaagtggacgccggagttgatgccgtcatatcgcctaacctggcttctcatttggggcgttcctctgcaagcttgggaaacagaacacttcgcaaccatagtggagacatgtggggaacttgtggagctagatgcggcaacggaggataaggtgaggatggacatcgcgcgggtcctggtacgcacgaaggagaaaccatcgatagctctttcggtgaacgttgtagtggacagaagtcggcactgtctggagattcgtgaggacatggcctctgggtggagtcggacggcacgtttcaaacctgaggagggctttccgccgtctcctttctctacggaaatggatgcctcggatgcagagccaaacaacctggtcccttgtggagttcctcccgaacgtagttccggtgactacttcggagactcccccacccagtggccctcgcctggtatggtggaaacgggtcggagatgctgggaccatggttcccgtcggtggcggaatcacggtgaccccaagactggtgatgatgtgtcgacatgcagatggtacaagtcagctcatggtcctgtgaagctgacacctaggagagaggaccaacagcattgcaacggccatttccctgtggatttacatggtaaaggaatgccagaccttaggctttcctgcactagccaaaatcagatgccatttgcggaaattgtagctgctgaaaaggtcaaagacgtttcagaggagggaagtatccatcgggttttggaggaatatcctgtggtcatgaattccgaggaatatccagcagtcaaccacgattcaaaattgccgggattgactgaaacggacaatagttcccaagacttgcagggggagggggtaaagaagttattgggcttggaaaacagtggcccaggtacaaatggtggtaaaacaagctttgtcttcaaagtgtatagaagaaaaaaggagtgtggaacagcaaaatccacggcccaactaaatctgaacccagtttttaataagactggagaagggggtgaatcagagaagttgggtacaattagtaagaccaaacttaacaacgaaggaggcatttctcgg

SEQ ID NO: 55412 - DNA, 1455 bp, Glycine max
  Peptide Sequence Number=SeqID_172190
atggctaagagagatggggtctcggtcggagaccaaactccgaggaaggtcatgatgttgcaaattgtatcgagaaatagagtggccaccttgaatgcgttgggtaggcttgtgatgaaatcgagtgagagatcttcccaaatgcctgatggaagtaggagagttcttgatgaaggattgggcgttttgccagagatgctcccaggtgtccgccaaggggagtcaaatgaaacttcgttaggagggaattgcgaaaaggattatcgtcatcaagccaaatgctacccttgtgtaaaatcaactgatcatgcaattggtagtcagggtacacctctggaagttttcccaagtaatattgctgctccggcgtctaaattatttggttcatcaattccttcaagcttcgatgtagaggctcgttgcaactttggagtgaactgcttactgaagaaagcgataggtctgtcctgttgcatcaacactatgcctatggttgtgccggatgcgtcaatctcaatctcaaaagcttgtgagaaatcaggtgggatcaatactggtgcttgtgtcatagcggacttcaatgcgtcaaaggctagctgggattcaggggacaatttgaattgctcatggcacaggagagctgtgaaagggggagtcactgaagataaggatatcatcaaaaaacaccgtgacgaattgacgcaaaaatggttgaagcaccgagttcatggtagcttgaaagatcgaggtgagatatggtggacgatttggcgaggtggtggtagggaagacgggttgaggaagatagcgtcatatttggacgacgtggatccagtgtggatcaggcgtcaaagatgtttaggtgatgtaggtaacggcccaaccgggacatccgtgcgaagctcggccggtaagcccaaatggtggaacttcatagacaagggacaggtatttggccacccatggttggatgaagttgtgggtgctgccactgtcgatgaggacggtgaggcgattcgggccgatgaagccatatatacgaaaggtggctggtgccgagatacccgaagaggcatgcaagctgatcgtaggggtggggttgtcggggtcaggaggatcggtaaggtcagggtccgtgaggtgggttgttgttgtttgggtttccttggtgtcggcgatgaggaggaggatacagccgtggcatcgggttgtcggggattaggtaggggaaggagtgggtggggtgggtttgggtttgggtggggtggtttgaaaactcggcgtctatcctggattttgtcctcctggagtttggctagggcggtggcctacgggagggagatgggctgcaggtacgtcggcgccaattgtgtctccagtgcctgcaagaatcctgaccaggatgcgacaatgttggtactggttgaggaggtggtaccgagggttcgtgattaa

SEQ ID NO: 55413 - DNA, 461 bp, Glycine max
  Peptide Sequence Number=SeqID_172191
gttcttcgtggaagagggatcaaagtccagtgttagcgtttcatggtcttgtttcttctagtagtagtggtagaagtttcatgggttctttgacccctattagaagcttcaggggtgggaccagtggtttgcttgatgggtttgtgaggaatgcgttgaggtcttcatgtttggactttgacttagacgttggtgattcttttgctatgtttgatgagttgacctttaatttggaggatgatttcgtggaggttgagaaagcacacaaagggcagatgcgggctagtacggatccttacttgcagcattgtttggagactgttgtgttgctggctttgattggtgccaattccactattgtggtggtgggactcttgcatgacttgctcgatgatgtttttctgacttatgattatatagttgggatgtttggtgttgatgttgctgatttggttgaaggg

SEQ ID NO: 55414 - DNA, 1056 bp, Glycine max
  Peptide Sequence Number=SeqID_172192
atggactttcttaactttatgcttaacttgttggtccctccaggcagtatgctcaccttggctttctcatggccagcactttgcttcctcaatgtttgtgagtggctttataatagtatatatggtgaggatatcgataataaagtcgtcataatcactggggcatcttcaggcataggagaggcaagttctctttatattatgcatcaaattgcatatgagtatgctttgaggagagcaaatttaacgttggtggcacgcagagagcacaggctaagagggatcgctgagaatgcaaagagattgggtgcaagacatgtgatgattatggcagcagatgttgtgaaggaagaagattgtaggagatttgtcaatgaaaccataaatgtctttggccgtgtagatcatcttgtaaatacagtgagtttgggacatacgttctgctttgaagaagttacagacacatcagtattccctgttcttctggatattaatttttgggggaatgtttatccaacatttgtggctcttccttaccttcatcaaagcaacggtcgtattattatcaatgcatcagttgaaagttggttgcctatgccaaggatgagtttatatgctgctgcgaaggcagcattagtgaacttctatgagacactgagatttgagttgaaagatgaggttggaataacgatagccacacatggttggattggaagtgaaatgacgcggggcaagttcatgctagaggagggtgcagagatgcagtggaaggaagaaagagaagtgcatgtgatgggtggaccagtagaggagtttgcaaggttgatagtatcaggggcatgtagaggagatgcatatgtgaaggtgtttgctccaagagttcttaactgggcattcaggtttcttatttcgccacaagggacaagaagagcttcttcttatgtagggactggcaaacacattgaagctgtgggtatggtgagacctatggctatgctggagggaacctcacctacacacactggccagctgatcagccagcacaagctcgattaa

SEQ ID NO: 55415 - DNA, 1053 bp, Glycine max
  Peptide Sequence Number=SeqID_172193
atggagcagaggctggcaaatacatggcgaatgcctcgcaacgacaacaaattcatagaaaccgctctcctttccgacctccgagtcgacggccgtcgcccctccgactaccgcaagctcaccatcaagctcgccaagcaagacggctccgcggaggtccatttgggccaaacccacgtcatcaccttcgtcaccgcccagctcgtccgcccctacagagaccgccccaacgagggctccctctccatcttcaccgagttctctcccatggccgacccctccttcgagcccggccgccccaccgacgccgccgtcgagctcggccgtgtcgtggaccgcggcctccgcgagagccgcgccatcgacaccgaatcgctctgcgtcctctccggcaaactcgtctgggccattcgcgtcgatattcacatactcgacaatgccggaaatctcgttgacgctgcgaatatcgccgcgttggtttctctgttgactttccggcggccggaatgctcgttgaccggtgaagacgggcaggatgtggtggtgcatcctcccgaggagcgcgacccgattccgttgattattcatcatcttcccattgctgttacctttggatttttcagcaatgaaaatctcctcgtgatagatccgacgcaccatgaagagtgtgtgatgacagggcgcatgactgccacgcttaattcaaacggcgacgtttgtgcaattcaaaagcctggtggagagagtgtctctcagagcgttatcatgcactgcttgaaacttgctcatgttaaagctactgatattacaactaagattaaggatgcagttgaaatacacaacaatgaaaggatgctacggaagattaaacgccattcttcgtccgctgctgtggatgtatgtggtgccacagctggatttgggggaaaacaaaatccactagatggcgatgatttggaatgtcgagccacaccatcaggacaacaacatagtaaggatggagcctcaaagaatttcaccggtggtccctcgagttggtatgatactagctag

SEQ ID NO: 55416 - DNA, 237 bp, Glycine max
  Peptide Sequence Number=SeqID_172194
atgtgttgcacttaccgatgtgtttattctgtccccaagatgtttgcatttccaatccgcttctgtaaccgaagggttgtggggaagaaggaaggtgacgaaagaaggaacgagctgaacaagaagaaggaatcgaaacggttgggaggtgtgggaatcgaaacgattgggaggtgtgggaatcaagatgttttctacaagcagcaagaagccgtgggactaaaatgctcagcataa

SEQ ID NO: 55417 - DNA, 1905 bp, Glycine max
  Peptide Sequence Number=SeqID_172195
atggggtgcatatgctcaaaaaactcttcagacaaagacaacgttgatgaatatgagaaagagaaagaaaaagaaaaagagtcgaacaagtcttcagtgcaactggttgctcctgctgtctcaactgcacagttagatggtggtagcatggatggttcgacgccccgaatggctaagtcatcatcacaagtgactagagggtttgtcaaagtgccatcagatgataaaagcaaccactttgatgccacaagaagccagcaccagaggtgcaacaccatgagtggtggtgtaggtgaaagaaagccactgatgagtagaatccttagcgtgcaaaattttgcaggagaacatgttgatgctgactggccagtgtggttatctttagtggcagcagaagccatcaaagggtgggtgcctcgacgagcagactcttttgaaaaattagaccaaattggacaaggggcctatagcagtgtgcataaagctcgtgaccttgagaccggtaaaattgtggctttgaagaaggttcgcttttcaagtacagaaccagaaagtgtccgattcatggcaagggaaatctatatattgcgtcaacttgaccatcctaatgtcatgaagcttgagggtattgtcacgtctaaaacgtccaccagtttgtaccttgtttttgaatacatggagcatgaccttgctgggctagcaactattcatggcgtgaagttaactgaaccagagataaaatgttatatgcagcagctgcttcgtgggcttgaacactgccacagtcggggtgtgttgcaccgtgacatcaagggttcaaatcttctgattgacaacaatggaaatcttaagattgcagattttggtctttcaacagtgtatgatcctgataaaaaacaaccattgactagccgtgttgtgactttgtggtatagggcacctgagcttttgctcggtgctacagattatggagctgcaattgacatgtggagtgttggttgcattctagccgaattgctggtggggaagccgatcatgcctggaagaacagaggtggaacaaatgcacaaaatttttaaactttgtggttcgccatctgaagactattggcagagaacaaaattaccccatgcaacaagttttaagccacaacacccttacaatcgccaagtttccgaaacatttaataaaaacttttctcccacggcattggctcttgttgatacgctacttacaatagaaccagaaggtcgaggatcagcaacttccgcacttgagagtgagttcttcacgacaaaccctttaccttgtaatccctcaagtttacccaagttttcaccaagcaaggattttgattccaagcgtcgagaaaaggaagctacaaggaaaaatgtggaatctgttaaaggatgtggaccagcatctgtttttagggaagcagcagataccaaagtactgggttcaccagattatatggctcggggaaatatttctatgcggggcaagtcaaatactagaatgtcccgtcttaaatatcaatcagaagaggatggcgagtctaaagacaatggtgaagcaagcatgataagtctacacaataagggctacacacattctacttcaatgatgcacagccgtatggcagcaggaccaacctcattgaggaagaattcagaattacagacacagagctctcatgtgaatcatgcagcagcagaattatctacctcttccgttaaaaaggaaccgggcatgtctgttcgtgaacctgggatgggttatatgccgaagaaaaataggatccactgctctggaccattgtgtggcaacattgatgacatgcttaaagagcatgagcgattaatgcaagatgttttccgtagcgtcaaaaaaaccaatccgtga

SEQ ID NO: 55418 - DNA, 2820 bp, Glycine max
  Peptide Sequence Number=SeqID_172196
atgtcaatgttccatttgacatttgccatctggggactcttgtctgtcagctgctttatagttgtggtttgtgcttcatggtgcccatatcaaatttttcaacaaagcaaccaacgatttcagcagaagactgataagttttgggtgttcagtgaacaaactgaaacatgggttgaagcaaaactgccctatgatctgctctcttgtgttaacggtgactgtagaaaagtggggtcaatacttcagacagataagaagagcacacaagaagtattggagctaaaacacaagcttgatgaacaaaagagaagtgttgagaataaggatagtaagttggaagcagaggatgtggttctgccccagagaaagagaatttccttgagtaaaatatccgagacatctgtgtggatcactggtgaaagtgggtctatctatgagaggttttggaatggaatggaatgggtgattgtccctcatgacttgcccgtatcagcaggaagtgccatatcaatttttgtcatcaatcagacgattcttgctctatcagaagcaggaaaattgtatcagattcgagtgcaactcggtgaaagctcacaaccaatttgggttgaattcacacctactgatccagagaaaaatcttttaatgaagtctggagttgcttcgcgcgatgaacagagagcctatttctgcacaaagaatggatcactagtagaacttgcttgggttgagccctccagatggataaatcatggccaaccagctggagcaaatgtagcagcaatagctgatgcttcttcaacaagagaagtagtatataccataagttctgctggagatctttatgaatatgacagaaaatcaaaaccatcatggaagaggcacatatggcatgaaagaacagcacaagctgctcctttgatgccatctaaagggtgtagtttacctggattgagtgatgatcattctgaatctctgttccttttaacaaaggaaggcactttggtagagagaaaattgcatcaaaggaagtggaaatgggtagtccatggccgaccccaggatcaaaatttaacatgtattacaccagcactacaagatgaatcaagtgaaacatcgtccatttctttattcttcactacatcattcgggtctgtctttgaatatcaaattgtaaaacaattaggccttgttccaaataatcaatttccaggagcatggaaaagtcatcagcatcctctccatgcaaaagcagcaagaggtatagctggcttgcaattgtacattggcaggatactgtttcctctaaatgatggcagaattgcagaattacatccactaggacaaggtggtgaaagttcagggccatctcagccacaaaacatccgaaggaaagcatcaacaaaatatgtttggtccatattagatgtgccagagagtgaagggtggaatgcagaatattgcacaaacgaacgtggcctcagaaactgtctcacaggcataaaagatgagtcagaggaatcagtaataagtttagtaacaggtaggagaaagcaaagccaaacacagaatcattatttatctgtaggcacttcaggtggtggtagactgatacaatcttcagaagaatacaatacaccagatgactggattattagtaactttcgcttgcgattgatggatttagggaagtcatttttcttaataacagatgatggtttgatttttgaatacattagcattgagagtgcatggatatggctgaagcatgagagttctacagccatgaaaggtatattgagtaactataatggaagcttattcatggttgatgcatatgggagtctgctccttagagaaagaagtggcaaggagttagcatggaggaattgcactgctgtgaggaaaggaagaaatgttattggaggtcaaccttgggatggattaccaggccaagaaaggaaggttacaactgaagatactctcttctttgtgagcaaaactggaagactaatgaagttaatggtttctttgaagaagttgaaatggaaagattgcagaaatcctccagatgctaaggttgcatgtatagtagaccaggaattgttcaggaaaaatatagtatttgtcatcggaataaatggtcgcctatatcagtataacaaagtgactgatttgtggcatgagcattaccattctcagcatttggttctatcacagttttctggaacagttataagaccatcattaaaaacactctcaggctccctcttcatgctttcaagagaaggtggccttgtcgagtatcaatggagttcattgtatggatggaactgggtggaacatggaacacccaatagaggtgtaacacttgttggttcaacaggtccaagctttgaaggcaatcaattatttttgataggttcagatggaaaagtataccttagatacatggacaaaatggcatggaagtggaaggactgtggttttccctatgtaggaaataagctcgttgaggcacatagacacggaggattccagaaagagaaagtagattgtattgatgaagattctgcatcatacttgaagaaggaccaaggaaactttggtgacctgagcattaaatgtgactcaaaggtggcttctacaagaccaattccattttctgaaggttctgtcttatttgagctcagagatggcaggttggcagaaattcaattggtagggaagagagaatgggtgtggtcccggatcattggcactccagctagtttatgcttagaaaattattggactactgtagcatacaacctttcgtga

SEQ ID NO: 55419 - DNA, 993 bp, Glycine max
  Peptide Sequence Number=SeqID_172197
atggtgatcctggcctttaagagtttttttaaatttgtgtttgcttatgtctggagggcgagccctggtgcagcggtaaagttgtgccttggtgacttgttggtcatgggttcgaatccggaaacagcctctttgcatatgcaaggtagcaagaagaaaaagaggggccaacgtgctattggaggtgataagagtggaagaggtctccgccaatttagtatgaaaggtcatgatgatatatttccttactggctttatttcccatctattggctgtccagtgtgtgagaaggtagaaagcaagggaagaacaacttacaatgaggtagctgatgaacttgtggctgaatttgctgatccaatcaatggtgtttcaactcctgatcagcaacaatatgatgagaaaaacattcgtcgaagggtgtatgatgctttgaatgttctcatggcaatggatattatttctaaggataaaaaggaaatacaatggaagggtctccctcgtactagtctaagtgatatggaagagctaaagtcggagcgtcttgggctaaggaatagaattgaaaagaaagcagcctatttgcaagagctggaggagcaatacataggtcttcagaaacttatacaacgaaatgagcaactatatagctcaggaaatgctcccaatggaggtgtatctttgcccttcattctggtgcagacacgcccccatgcaactgttgaagtggaaatatcagaagatatgcagcttgtgcattttgatttcaatagcactccctttgagttgcatgatgataactatgttctcaaggcaatgaaactttgtgagggatctcataatgataatacaacagacaatcctacagatggtggtgaaggttctagcatatatgcacaggttcctacttctgtttcaaaccctccaaataggcctccttcatctccaccactccctggaatattgaaggcaagagttaagaacgagcattga

SEQ ID NO: 55420 - DNA, 498 bp, Glycine max
  Peptide Sequence Number=SeqID_172198
atgaagcatttggatctactattgaatttggcacaaaaacacctcacgaaagcgtcattggattcaatgcgagagcagacaagtccagaaaacatagctttgagcaaacagcagagcataatgtttggcagtacaaaggcatcatcgctgccagtgtcgtcgcgttcagaggaaggaggccttcgcagacgtctttcttcgctgtctctgaagatccaagacagcccaacatggtcattttccagatccaagtccctctcatccatgggtgactatgtaaggacatgctgggcctggatcctctccaggaagctcatctttgccacagatctcgaaatgaacgaccagaaaactaagctccttggctcccccaacaggggcacttggagccatgttttctataagctgcgctctgagatcagaaggttcatctctacttctgatcacgccactcttcccaaaacctaccacaggtcctcacctcaagtcttctcataa

SEQ ID NO: 55421 - DNA, 366 bp, Glycine max
  Peptide Sequence Number=SeqID_172199
atgaaaagttgtcagatacaagcggttggtaaaacaaaagttgctgctgctgttgaagaaatgaatggttgtcaatgtaaggagacaatattgtggcaaatgcaatcaaatatgtatcctgactatgatgtcttggtttcaggaaagtatgttggaaatcggccgataaaactacgcaagagtaagtggaaggagatgacgcattatgaagcactggaaaaacagaaggtcacaactttctttgtcaatgatttgaaattgctctcaataatcacattcaaaagaaaccgaaactgccaaggaaagtgtgctgcacaagtgacaaaaggccagaatctgtgtaaatcagattactattttaactaa

SEQ ID NO: 55422 - DNA, 954 bp, Glycine max
  Peptide Sequence Number=SeqID_172200
atggcaaatcaaagtgctctagtggaccctctagtgaagctctttggtagtgtccatgagaagctcccagaaacaggaagcacacttttcccacactttggaagcatgtttagtgttgggggaaatcaacctaggaatgaagattgggatgaagaaagcattgccagagagggagatgattatgtatctgatgctgctgacaccgacgattctgatgacaatttgcagagtccattgatctcacgtcaagcaacaagtgcggaaagggacatgcctgctcctgcccagggaagcatgaggcaaggtagtcttttgcaaggagaacctgctggaaactcagggattggtggtggatggcagctagcatggaaatggtctgaaacagaaggtgttttcaagagaatatatttgcaccaagaaggtggtcctggatctagacgtgggtccatcatttcacttccaggctgtgatgcgccgacactaacagatggtgagattgtccaggctgccgctctagtgagtcaatcagccctttacaacaaggagcttatgcatcagcagccagttggaccagccatgattcatccatcccaaacagctgcaaaagggccgagttggagtgaccttttagagcctggagtgaagcatgcactgattgtgggggtggggattcaaattcttcaacagttctctggtataaatgtggtgctctactatacacctcaaattcttgagcaggcaggtgttggttatcttctttcaaacctgggcctcggttctacttctgcgtcttttcttatcagcagcgtgacaaccttgttgatgttaccctgtatagctgtggccatgaggctcatggatatatctggcagaaggtggatgtatcctggagatgattttctcatggtcatactgtttccattgcatattttccctatgagattgctgaggtga

SEQ ID NO: 55423 - DNA, 1359 bp, Glycine max
  Peptide Sequence Number=SeqID_172201
atgaagctgaagacatatgcgggtcttagtatcattgcaactctggctattatatatcatgcgtttaacagtaggggccagttttatcccgcaatggtgtatctgtcaacttccaagatcagtttggtgcttcttctcaatatgggtttggtctttatgtgtattctatggcaattaaccaagaaggtgttcctgggttccctccgagaggcagaggttgagaggcttaacgagcaatcctggagggaggttatggaaatcctctttgcaatcaccatttttaggcaggacttctctgtcacattccttgcaatggtcacagcattgttgttgattaaggctttgcattggttggctcagaagagagtcgagtacattgagaccactccttcggttcccataaactatggtattcccttgcaccttatacgggagctgtatgagacgtttaggaacttcaaagtccgtgttgcagattacatacgttatcgtaaaatcacttcaaatatgaatgatcggtttccagatgcaacccttgaagaacttaatgcaagtgatgcaacctgcattatttgtcgtgaagagatgacgacggccaagaaacttgtatgtggacatctttttcatgttcattgtctccgatcatggctggagcggcagcacacttgccccacctgcagagccttggttgtaccaccagaaaatgggacaacttcagctgcagggcagcaaggatcacagtcagatgcccatcaacagggaacaactgggacaggcagtggaagcactgctcagactgaggctactgatagtttgagtcgacatcaagctagactccaagctgctgctgctgcagcttcaatatatgagaagtcttatgtgtacccctctatgaattcttttgtatgctctcctggatacactcttcatcccccagttcaaatatatatggctgaatcttctgataaggaccgtaatggagagcaaacttccagtgaagaagcacaaaggcagtttcttatcgctggtagaccaccaaatctatcctttcctccaatgcaaaacttccattttctaccttcccaagcacatgcatcccctgtgaattatggagaggggtttgaaaatgatccaaatatcccaaactctcagcttgaagcttatagaaaacttcttcaatgccagattcagaacctacagattctgcaaaatcagctcgagatgctgcagaggataaaggctgatagaagtgtagatgagggcacgccatcatcagatagcagaggcaagagtgtcatttcctcatcatctggatctggtcatggttatcgtgaggatattcgagatggaaaagcataa

SEQ ID NO: 55424 - DNA, 1128 bp, Glycine max
  Peptide Sequence Number=SeqID_172202
atggcggggtcggagccttctccaaaaatccttctagcaaagcctggactcgtcaccggaggtcccgtcgccggtaaattcggccgtggaggcggcggcgatgacgactccccgcagctccgttctcgtcttccgtctgtggcatccctcaaccttctctccgactcctgggatttccacatcgatcgctttctcccttttttgactgagaatacggactttactgtgattggagtgattgggccacctggagttggcaagtccactattatgaatgaactttatggctttgattcaagttcccctgggatgctaccaccttttgccatacagtctgaagaaaccagagctatggcaaggcattgttccacgggcattgaaccaaggatttctactgaacgtattattcttctcgatacccagcctgtatttagtgcttctgttttagctgagatgatgagaccagatggttcttcaacgatttcagtgctaagtggagaaaccttgtcagctgaattggctcatgaacttataggtattcagggagtccatgatgatagtttgtggcatttgatgttgacggttgacttgttgaagcatggcatctcagacccatccttgatgacttcttccctgtcacagagctctagttcagggcttgagaaagataagcttcctgaacatgaagaatacatggctactcctgtgtttgtacacaccaagttgcaagatcaagactttactcctagtaattttgtgcagttgaggaaggcactcatgcagtatttcagaccatcctcttttgtgagagaacaaaacaaacctgaagagcatgtttcatcttctttggttcgtggcagtcaaatggattctaacttgataaaattttatgcgatccctctcaagaaaaaagatgaaaatccaagtgctcagcatgaaagttacgtttctgcactatggaaattgcgtgatcagattctatccatgaagtcaccttctttcacgagaccagtgtcagagcgtgaatggttaaagaattcagccaagatatgggaacaggtaaagaactccgcaacgatattggagtattgtagaactcttcaacattcgggtatgtataggagataa

SEQ ID NO: 55425 - DNA, 800 bp, Glycine max
  Peptide Sequence Number=SeqID_172203
atgttggataaacagggagctgtgagacccgcgaaacctgcagataggccggatgatgaggtcgatgatccgctatatctaatgacattgaccattccacaactttttctgaagccattgcaggttatgtgggatgctaccttgtttggcctatttaatgaaaactttcccttgtacataaagcatgaagatctgtctgaaattgcacatggtggtcaatgtctcagcatatctgttatacagttgtggattctgcatatgactgagacaagtatgcgagctgggaatatcgatgtgtatggattcctcgagccacagtctatccagagatctggccaatcacaatttgaatcagaaaattacattaagaactggatgcaaaattcaaaacgagatgtgtacctaggagcctacttgaatggtgcacattggcaaatggtcgtcattttgcctaaggaaaatgttgtcatttggttttgttcgttgcataataagccagacaactacctcaaaggcatgattaataggtcagtgttgttttttaatatatttgcattagcattagtcagtgctttgaaaggacttgacgatactcaacaaagtaaatccaagactcctgctaggtggattgttgttaaatgtaatagacaaaaaggaagcactgagtgtgggtattacgtcatgcattggatgtcaactataatcttaggaaatttccagaataattgggaaatgtatttcactgatcctagaccattggaaccagaaagattgaaggcacttcgcatccagtgggcaaa

SEQ ID NO: 55426 - DNA, 576 bp, Glycine max
  Peptide Sequence Number=SeqID_172204
tatcaagggtttaaccgcctgagatctttgtctcaacacattggagggtacatcctttgtggtacaagtagagggtacatctacttgggtttgactgagaacaagagagggtacatctcttatggatcagttctagtggagggtacatccactaggttcaaagagaacaagagagggtacatcccttgtggatctttgcttgtaaaaggatttttacaaggtgatcactgggaaagttcagattgctctatgcattctgaagctgaagcactagaacatatgaagaaaagagatagaggccatcaaagtgtgtcattggataataagataggagattcaactgtggtcaagatgagtgagaaaaataataatgttgatgtcggcgattgcatgattcttaatgaccatgaaggagaagagcattgttgtggcaaaggaacaaatgcgaggagattttcttttttgccaagaagccaagagaagataggagattcggctaaagttgtgataaaacaagacatgaagggaggagagcataaatatgggtttaacaacaataaacgtgataagccatag

SEQ ID NO: 55427 - DNA, 399 bp, Glycine max
  Peptide Sequence Number=SeqID_172205
atgggggagacacatgaaattccccaccacaatctagctgacttcgagccttggctcggatatgccactgaagggcaagcagttggtggtataccctttgaaaacactttggagggccctcagtttcgcccacaaccacaaccattgcgttttgtggtgggaagagcccctcctgctatggccgaaaagggaaaggcggatcatctaaaggaaaggctcagggccattgaaggaggtgaagattatgcctttgctaacctagaagagttgttcctaatacccaaacatggtcattcccaagttcaaggtgccggactttggcaagtacaaggggactactcgctccaagaaccatctaaagatgtactgtcggaagatgggggcatacgcaaaagatga

SEQ ID NO: 55428 - DNA, 183 bp, Glycine max
  Peptide Sequence Number=SeqID_172206
atggaagagagagaacggaagatcttcagaccagataaattttcggcaagattgccattttcgactggcgatatcccaccccacatgaacaaagaggaaaagaccgaaacacccagcttcctctccaaaaacacttccctcgagaaaatcctattggtccgtgatcgtacgtttgatctttga

SEQ ID NO: 55429 - DNA, 441 bp, Glycine max
  Peptide Sequence Number=SeqID_172207
gctatggtggcattattccatgacatgatgcataaagagattgaagtctacgtgaatgacatgattgctaaatcaaagaccgaggatcagaaagaaatagaggtagaccgagataaggtaaaggtcatccttgaaatgcctgagccacacaccgagaagcaagatcaaacggtgcttcatgaatccttctgcgctcgtttccctggtgcccggaaggccccttgtcttcaagaagttcacgacatgcgagatgaactaatctttgctagaaaggacgtgttgtgccttggtgtgggtggctcaccgtttaaggcagtacatgttgaattacaccacttagttggtatccaaaatggatctagtcaagcgataaaggggagtgccttagcagattgcctggctcaacaacccatcaacaactatcagcatatgcatccataa

SEQ ID NO: 55430 - DNA, 123 bp, Glycine max
  Peptide Sequence Number=SeqID_172208
atggacttcatggttaccactaaggagcctgaatttcttagagatgttgatgggacggaacatagttctaattcagctgaacaattaattgctgagacatttgattggagtcatgatgcctag

SEQ ID NO: 55431 - DNA, 306 bp, Glycine max
  Peptide Sequence Number=SeqID_172209
atggatcttaccctagaggagcttcaatttctgaacatccctgacattctacgagaatcaatctcgtttcctaagagctcactccctcctcacacatcctctcatattgcaacaatccctaaaaattgtataatcacgtacatgtcatggcccgacaacaacacccttgtgcgaatgatgctgatttcgtgttacaaaatcgagccactggtgattttgcattgtaaaaacactgctggaaaaatcaccctcacaaaatgtgactgccacatcatctttaaagttgctcttgaccgtaacaactaa

SEQ ID NO: 55432 - DNA, 216 bp, Glycine max
  Peptide Sequence Number=SeqID_172210
atgcggctgttggaggaaacagagggcggggatgcggagaaaggagggggtggtgtggggaatgattgggtgtgctgcgtgtgcatgggaaggaagaaaggcgcggcattcatcccgtgtgggcacaccttctgtagggtgtgttcgagggagctgtggttgaacagagtggaaaaggctgcgacaaacaacaaagccaagtctcggatcttttaa

SEQ ID NO: 55433 - DNA, 246 bp, Glycine max
  Peptide Sequence Number=SeqID_172211
atgccatttccgcctcaaaaaagaaagaaaacacagacagaatggtctagacattcgtgccatctgctcaggaaaaggaagaggaacaaaagggaaaaggacaaacggctagctaattctgggttagttaatgctgatcaaaattatactcctgtaaagaggattacttttggagttttgtcactttgtcataaggaatacaatgctatcgtagggaagccaacaaaactcgtacctgatcagtga

SEQ ID NO: 55434 - DNA, 909 bp, Glycine max
  Peptide Sequence Number=SeqID_172212
atgggaggctcatgcttccatgcgcttcgtttgaggaggttcaagagtaaggctctgccagaaccctgttcatcttccaaaacccggttggattctgacttggagaacatggagagaagaagatttgatagcttggaatcatggtccatgatattggactctgagaatgtggagacatgggaagcatcaaaggaggatcaagaagaatggactgctgacctttctcaacttttcataggtaacaagtttgcttctggtgctcacagtagaatttaccgtggaatttacaagcagagagccgttgctgtcaaaatggtgagaattcccacacagaacgaggagaggagaggcttgctcgaacagcaattcaagtctgaagtggctttactttcacgtctctttcatcctaacatagtgcagtttattgcagcatgtaaaaaaccgccggtgtactgtatcataacagaatacatgtcacaaggaactctgaggatgtatctgaacaagaaagagccatactctctttcaatagaaactatattaaggttagctcttgacatatctagaggcatggagtaccttcattcgcaaggtgtgattcacagagatttgaagtcaaataacttgcttctcaatgatgagatgagggttaaggtggcagactttggaacatcgtgtcttgaaacgcggtgtcgggagaccaagggaaacatgggaacatatcgttggatggcaccggagatgattaaggagaaaccttacactcgtaaagttgatgtctacagttttggaattgtgctttgggaactcaccaccgctcttcttcccttccaaggaatgacccctgtacaggctgcttttgctgttgctgagaaggtcagatctcagattcctatacctaaattttga

SEQ ID NO: 55435 - DNA, 396 bp, Glycine max
  Peptide Sequence Number=SeqID_172213
atgaagcttgactgctctaacggccaggctcctctcgccgccgatgtttctccgccgcaggaagacggctccgaggaggagatattcgtgccgccgctcaacttcgccatggtcgacaacggcatttttagggctggctttcccgattccgccaacttcggattcctgaaatcactccgtctccgttccgtaatgtgtttgtgccctgaaccgtatcccgaaacgacttcggaatttttgaaggccaacggaataaggctttatcagttcgggatcgatggctgtaagggctggcttctcttaagtttcaggcttaattccattttgaaagtgaactctttgaccatgaaaacctcacaaactagagcaattgatggtaactttcaattgaactaa

SEQ ID NO: 55436 - DNA, 2310 bp, Glycine max
  Peptide Sequence Number=SeqID_172214
atggggaaatcagggggtagaagaaagaagggtggttccaacgccaaccaaggtggtggcgttgataattcgggttcaggtgcggcagccccaacggctaacggtggggtggaggtgaagaaggcgaatgagctgaaagaagaagggaataggaggtttcagaataaggactatgcgggcgctcttgagcagtacgagagtgctcttcgtttaacccccaaaacgcaccctgacagagccgttttccatagcaacagggctgcgtgtttgatgcagatgaagcccattgattatgaggctgtcattgccgagtgcaccatggcgctccaggtccagccacgctttgtccgggcacttctccgccgggcacgggcgttcgaggcccttggaaagtatgaaatgtctgtgcaagatgtacagttcttgctggcagctgatcctagcaatcgcgacgcattggagattgcccagagattgaggactgcattggggtcgcgccaggaggcccagcaggacctccatagtcgcccctccccagctgcccttggtgcttcggctgtccgtggtgcccctattgctggattagggccttgtttgccggctcggcctgtggcaaagaagggagcgcattcggcagttggatctgttgtgtcgcccaataataacaaaccagacaagtcacagccagttttaccaactgaaaatggttctgacaccaagtcccagttgccaaaactggtattgaagtcttcaaatggttctgcaaagccacctaaccctaaaaaggaagatcacaaggaactgtcatcgaccattcatgggcagcgttcggatgttgcaattcggtggagaccattgaagcttgtttatgatcatgacattaggcttgcccagatgccggtcaattgcaattttagaggactaagggatgtagtaagcaaaaggtttccttcgtcaagttctgttctgatcaagtataaggattgtgatggtgatttggttactataacctctactgatgaactcagactggcagagtctagtgttgatagccatcttgtgaaagaacctggggaagataaaagtgattctgtagcaatgctgagactgcatattgttgaagtcagtccagagcaggagccacctttattggaagaagaggaagaaaaaccagttgagaatgaagggggcatgggagaagagaatggatctcattcttctctcggcgaatctgtctctgaagtagctgataccgtcaaggttgataagactgtgaaggatactccaaaggaaaagccaggaaccacaggagatactgaatgcaaagaagtggagatggatgattggttgtttgagtttgctcagcttttccgctctcatgttggtattgatccagatgctcatattgacttgcatgagcttgggatggagctttgttctgaggcacttgaggaaacagttactagtgaggaggctcaggatctatttgacaaggcggcttcaaagtttcaggaggtggctgctttggctttcttcaactggggtaatgttcacatgtgcgcagctaggaagcggattcccctggatgagtccgctgggcaagtggtagtggcagagcagcttcaagtggcttatgaatgggtcaaggaaaagtattctttagcaagagagaagtatgtggaagcattgtcgatcaaaccagacttttatgagggactgttggctctggggcagcaacaatttgaaatggctaaacttcattggtcttttgctcttgctaagaagatagatctatcaggctgggattctaaggagacacttcaactttttgacagtgcagaggagaagatgaaagctgcaacagatatgtgggaaaaactggaggaacagagggcaaaagagctaaaggactcaaatgcaaccaagaaagaagaattattgagaagaagaaagaaacaaggtgctactgaaggtgagtcctccagtgttggaggtcagggtgaaatatctgcagaagaagctgctgagcaagcagctgtcatgagatcacaaattcacctcttctggggtaatatgcttttcgaaagatcccaagttgaatgcaaattaggaatgactggatggaaggaaaacctggatgctgcaactgaacgctttaagcttgcaggagcttctgaggcagatgtttcgatggttctaaagaatcattgctcaaatggagatgcaaaagatggagatgataaaaaggttgagaacccacagcacaataagactgttaaaccagagatcaacaaggctcatcaagtatga

SEQ ID NO: 55437 - DNA, 249 bp, Glycine max
  Peptide Sequence Number=SeqID_172215
aatgaaaggcctccactgcctgctagttgccagccagcacttgcccatctgataaagcgttgttggtcagcaaacccttcaaagaggccagatttcagtgacattgtgtgtactctggagaagtacgatgaatgtgttaaggagggtcttcctctgacccatcattcaggcctagtcaacaaaaatgtcattattgagcgcttaaaaggttgcgtccctatgagctcttccatacctgtacaggcttga

SEQ ID NO: 55438 - DNA, 180 bp, Glycine max
  Peptide Sequence Number=SeqID_172216
atgaccgaaatatggaacaagcactgctcacaggaagacgaagaagcaaatgcaaagaggaagaggaagaaatggcgtcaggaaatgaagagaagaagcaaatgtgtcggtgaagggcttttatgccttttcaccacacctactgggtgccccagcaaaattgttaggtgcacaaagtaa

SEQ ID NO: 55439 - DNA, 208 bp, Glycine max
  Peptide Sequence Number=SeqID_172217
caaccagctcgccttggctaaagatcttagttcagccctaagcaagcaactcgcttgggcgagttgcaattcacctgagcaagtggatgccttcaagatcatgcatttgtggaagaaaggagatccaatagcattcagtagtgaggaaaacacgcaaaggctaaggaagaagaaggagaaaaggaaaagtggagtcgaggtgttgtag

SEQ ID NO: 55440 - DNA, 378 bp, Glycine max
  Peptide Sequence Number=SeqID_172218
atggcagaatctatatctagcttctggggtccagtcacgtccaccaaagagtgttgtgaaataaattatgcttattcgtcttacattgctgaattttttaatacaatatccaacattccaacaatacttttggctctgattggtcttataaatgcattaagacaacggtttgagaaaagatttagtgttcttcatgtttcaaatatgacacttgccattggaagcatgttgtaccatgctacgctgcaacatgtgttcagattcagaacctatgctatgacaacacaaacagattggtcttataaatgcatgtctgacagtggtttgctcaatttcatccacaccaaggttggtgctgccgccatggcagctatttga

SEQ ID NO: 55441 - DNA, 1039 bp, Glycine max
  Peptide Sequence Number=SeqID_172219
atgggaaggactccggtcaggtttgagagggtagcggcggcctttgacgctgacgtggcgcgtgtgaggctctgcaatagcagcgagaatgagcagcactcgccggaggactcggctgatttgtcagatctggtgaaatcgttcatggagagagggggagagggagaagatgcggttggtgttcgttcggatgatggggttgagaattttgattctgagaagagggagattttggagggaatatttgatgatgacgacggggatgccaaagaaaagattagaagagaagttcaacttgcatgggggcttgttgccgaaaaggataactcatcaccccaattcaaacaacagttgatgtctctcctacggtacagaggttttgatgctgggctctgcaaatgcaagtgggaaaaaaatacaagattcccagctggtgactatgagtacatcgacgtaaattttgcaggaaatcgctacattgttgaaatttcccttgtcacagaattcgaaatagctcgttccacagaccaatatgccgcgttacttgatgtttcccctctaatatttgttggtaaaatggaagaactcaagcaggttgtgaggctaatgtgcactgctattaagggttctatgaaaagcatgaatatgtatatacctccgtggagaagaattgggtacatgcaagctaagtggtttagttcttacaaaagaataacggacgaggttgcaactaacagggcatcatcagcttttttcactacaaggtccattggatttgatgcaaggccagcaaaccgccaagaagttatgcttgatagtgagtctactatgggaactgcttttgctgttaagaagtattctaagaaaggaatctgcaagtgtacccattgcaatagggataatcatgtcgtggagacatgttttaaactccatggttatccggattggcatccaaaaggcaaaactactccaagtaccaaggtagacgctacttccaagagccatatttctactgctgttggatttgtgaccaagtcag

SEQ ID NO: 55442 - DNA, 338 bp, Glycine max
  Peptide Sequence Number=SeqID_172220
ttcaagagggaaaaagagaagaatagaagaagaagaagaagaagaagaagaagaagaagaagtgagaagtgagataaaggggagcaataaggaagtagaaaggaagtaccttgtagaggaaacacacgtcctctaccattgtagttcaagagagagtaagaaaagaatagaggaagaagaagaaataaggagtgagagaaagggatcagaagcgaatgggaatgggaaaggaaaaatgaggagtgagagaaagggattagaagagaatgggaatgggaaagggtgccataatgagaaacaacagccagttggacaggtgtcaacaggacatagctcag

SEQ ID NO: 55443 - DNA, 1080 bp, Glycine max
  Peptide Sequence Number=SeqID_172221
atgggagcacgaaagagactctcttcttccgaacctccttcttcttctcctcccgcaacaaatgaaaacacaaacacaactgccaaacccaccataacagaccctccaatcgcgcctcccaaatggggtcttcttctgaagctctctctctttttgctcccttacttgtacctcctctttcaccactaccccatcgagccggagctccgaagttcgatcctcatcaacgccggaatgagcctcgcggggctcttcgtcacggtcaagatgatccccgtcgcgtcccgctacgtccagaagcggaacctctttgggtatgacatcaacaagaagggcacccctcagggaaccgtcaaagtgcctgagtcattaggtatagttgttggtattgtcttcttggttgtggcaatcttgtttcagtattttaacttcacagcagattcgaattggcttgttgaatacaatgcagcgctagcgtgcatctgtttcatgacattgctaggatttgttgacgatgtccttgatgtcccatggagagtaaaattactactcccatcaattgctgcacttcctttgttaatggcatatgctggacacacaactatagttataccaaagccacttgtcccacacattgggattgaggttttggatcttggatggatgtataaactatatatggggctattggctgttttttgcacaaattccatcaatatacatgctggaataaatggccttgaagttgggcagactgtggttatcgcatcagctgaaattgataatactgtggatgtgcagatcctgatacacaatattatgcaaattggagcatcaacagatcctgaatataagctagcacatgcattttctatttacttagctcagcccttgctagctacctctttggctttactttcttacaactggtatccctcttcagtttttgttggtgatacatatacatactttgctgggatgactatggctgtgattggtattttaggccattttaggcatagaatcatagatatacaggggattctaaatttggaactccagtcttgctttctgttctaa

SEQ ID NO: 55444 - DNA, 195 bp, Glycine max
  Peptide Sequence Number=SeqID_172222
atggatccctcgaaggtttgcccagttttggagtggcccactccaaccaccaccaaagaaatccgtggatttttggggcttgtagggtactacagaagattcatctatgattatggccgtggaatcgaggctgtcttgatgcaaaatcgtcaagccattgcatatttcagtaaagccctcgcccctaagacataa

SEQ ID NO: 55445 - DNA, 471 bp, Glycine max
  Peptide Sequence Number=SeqID_172223
atggattatagagctctggctcctcgagatttagccaagtcacgcaccatcaagttggagggtgaactgattggctactccatctttctgctcgtggaaagcggtgcgacacacaacttcatcgctcgtgaattactgtcctcgttgaatatggaggtgacacccacggatttgttcaatgtgggtttggctaatggctcaaaatgctcttctcagggcatttgtcatgttgtctgtgtcaaggtgggcagctacaccgtggtcgtggatgcttgtttgttagatttaggaggagttgacataattttagggagagcatggctggagactgtgggacaaactaccaatgattggcaaaggaagaccattagtttcgacaatcacaaccaaacaatctcgttgcagggataccatcttcacgagcatcctcaaacctttgcactccaaggattgctccagagcttggcttag

SEQ ID NO: 55446 - DNA, 207 bp, Glycine max
  Peptide Sequence Number=SeqID_172224
atggctgacaagaaagtgaatgagttggctctagtgcttgaggatgccaaggatgatgtcgttgaaagcttcactaaaggtcttgatgctgcaaaagatcaagtcaactttttccacaagggaatcgacttatctagacttgggtacttcaaggtcgttcaaggcaatcagatcattgaccatatggcaactattgaagataattaa

SEQ ID NO: 55447 - DNA, 966 bp, Glycine max
  Peptide Sequence Number=SeqID_172225
atggcgattggaggccattcaggtttcactaagacatatagacatttgggaacattgctgaggatgagcacaacttatcaccctcagactgacagtcaaacggaggtggctaacatgtgtttggagacctacttgcgttgttttgcttctaaacaaccaactaagtggcatctctggctttcatgggccggatactggtacaacacgtcattctattcagctattggtaagactccctttgaggtcgtctatggactcgcccctccatcgctgcttccttttctgcccggagaaacatcagtggactctatagcctcggtgttgtttgatagagacaaggccctctgtcagttgaaagttcatctgcactatgctcaacaatccatgaaaagggaagcagataaacattgtcgtgaggtgtctttcgtagagggggaatgggtgtttgttaagctgcgtctccatagacagctcacagtggcccgctatataaatcccaaactctcaactcattattttggaccatttcaaattttatcacaagtcagagaagtggcatataagctcaagcttccaaaatccatgaaggttcatccggtttttcatgtatcacaacttaagaaatccatgacagctaattccaatgcatctgctttacccctggtcagacctatggaagaatcagattcccccttccccaaatcagtgttggccactcatgaaggcaaaagtgatggtagttgcacagagtggctgatcctttggaagtcccagttggtggaggaagctacatgggaatcagaatcctctacttggactagatttccttcatttagccttgaggacaaggcaaatgtgttaaggggtggcaccactgatacagaatgtatcaaagactcatatgaaatgcctcttaaagctctgtctcatcatacctctcacgacaattcacatcttccagaaaag

SEQ ID NO: 55448 - DNA, 693 bp, Glycine max
  Peptide Sequence Number=SeqID_172226
atgagagaagaaaaagaattattgaacaaaaagcttaaattggtggaggccaaattgaaaaaagttgaagacaaagtgaatgaattttctttggcacttaaggatgcaaaagatgacgtggttgaaagctttaccaagggttttgatgctgccaaggatcaagtgaaatttttccacaaagatattgacctgactggacttggatacttcaaaatgatccaatacaaccaaatcattgatcatatgatcaaacatcaatcccttaagattaatgattgtcttagagaccaactcaatagggcctttattacaaggatcgggatacaatcaggatccacaaccctccaacctcaagcacttgagggcgtaaaaaccaagcttcgggtgcaaaagccaaatggcaacaatggttgccaggggttacaaccgataatattggaaagtcatgtctcgcgactccaatcacttccatggaaggcctataaattcagattcgctagtgttggtgtgttggtagtgaagttcacgacaacacaccaagtttttggaaacaagactggagcccgttactccttggatcaacaaggggggagaagctctcatactaggagagaggtagcaattgaggggagatattggagaagagaactcatattccaaacactatccttatgtgaaggtggatgttcttga

SEQ ID NO: 55449 - DNA, 462 bp, Glycine max
  Peptide Sequence Number=SeqID_172227
atggattattttagaaaatggatcgaggtagggccaatagctaccattacttctgataagtcggaggaaaaacgggggaaatctcagggaaccgctagagatgccgctatcgctgtcgaaagacacgtgagtccgcttagaggggtagagggtgtcacaccgcacaccataatcactaacaatggcactcaatctgcaagcttgatggtcaaaaaattttgtgcaaagaaaggagttcgtcttgtattttcatcagttaagcaccctcggacgaacggtcaagtagaggcagccaacaaagtggcattaaacaaactgaagaaaatgattgaaaagtccgatttcaattgggtagacgagcttccacagatctatgagcccacgttcaaagaaactatttttgatgaaaacaccgtgaaaattgatcatttagtccaacttgacatgattcacgagacttag

SEQ ID NO: 55450 - DNA, 537 bp, Glycine max
  Peptide Sequence Number=SeqID_172228
atggaggtgtgggtcggagtaggagaggactttataccagtgccatgtcatgcccttcatacaaatctgagcaaaggaaatacgcatttctggttggggtgtgttggactgaaaaataggtctccactttggctaaccacccaacagggccagtgtcggaaaatgggggtagttccacggaggacaaagcggactagcggaggaggaagaatgagactcacacatttcagtacaaaggaaggagacaaagtgcgagagctcactaacggagtagaagactttgggcctacggtgatacaatttgaagggcttatcccatttagaagcctgattcctaatagtgttgttgttgtcttcttgctattcctttccaccatctccacaagatggtccttggaagggatgagtgtaaaccagagggagaatttctacttaccagaatcttttccttgtgaggtaaatgctttagctaatcaaattaaagttttagacatggaagttgagcatgttactatgatatgccaggattatgtatag

SEQ ID NO: 55451 - DNA, 766 bp, Glycine max
  Peptide Sequence Number=SeqID_172229
atggagacgaaaagccactcaggaagtggaatcagccctagcgcctcaccggaattcgagttctggatggttcgaaacccctctttcccacaaccaaacattctctccgccgatcagctcattgtcaacggggtcctccttcccctccacctcctaaacaaacccgacccatctcctgctataaccgactcctcctcctcctcctcctccgccgccaccgcgtccaagcgctggaaggacattttcaaaaagagtgacaagaaaaacacagacgccaagaagctcaaagagaaaaaaagcggtgtcacaacttcagcggagctcaacatcaacatatggcccttttcccggagcaagtccgccgggaacgcggctacccgacccaaaccattcgttccggcgacccggaaagccaacagcgcgccgtgttcgcggagcaattcggcgggagagtccaagtccagaaaatggcccagcagcccggcccggcccggggtccatttaggaaggagcagcccagtctggcaggtccgccgtcccaagaatccagtaccggaacctctcaaccctgacatcaacaagtccaagcgagaaagtcaccggagcaaggtggtcggcgggagtggcagctcgaaaacgaaggttttgaatttgaatgttccaatgtgcattggttacagacatcacttcacctgcagaagcgacgagaacagtgccattcgtgtcagtaacccaaacccacctcatgctcatgccaatgttggtg

SEQ ID NO: 55452 - DNA, 249 bp, Glycine max
  Peptide Sequence Number=SeqID_172230
atgtcagagcaacaatatcatgagacaatggaaatatggaaatcagagtaccgaaattgtgggaccattactagtggacacccagttggaccccaccaaaaggatatgataagaaagtggctggaagctagtgtagtgtgtgtgtggcccgtggggacgaactccattggggaaatgtggaagaagcaccaaagcaagaatagagttgaggctgttaatggcgtttgtttggaggcaaaagcaaaatga

SEQ ID NO: 55453 - DNA, 352 bp, Glycine max
  Peptide Sequence Number=SeqID_172231
gcgtgctagggaggctgagggagggttcaaaggttcagaagttgagggaattgagagaaaagagaaagaagaagaagaaaaaagaagaaaagaagccaaggcgctaccaaatcgcgatcgtgatcattccctacatcattcctatggaagcaatgccttccaagattattttgatgatgccaaagaatcaagagttaagcaagttccaaagaataaggagtcaaaaagcttcaacaatcaagttttcaagattcaagattcaagaacaatcaagtttcaagaatcaagattcaagaacaatcaagatcaagattcaagaatcaagagaagactcaatcaagacaagtactaa

SEQ ID NO: 55454 - DNA, 285 bp, Glycine max
  Peptide Sequence Number=SeqID_172232
atggatgaagggcacgatacaaggaatgtggttttggttcctacggcgagggaatataggtgtgcgagaagctactatccagttcttgtgtgctcccttttccaattaacagagaagcttaacgagatcgaactcaacctcgagggcgttaagttcaaactcgcacgttactattcatgtttcggatattttcaaggattgaagaaggattgggaggagcattccacatttcgaagtcggcgcgaacctgataccgttgttctgagaggcatgtcgtcgcggtga

SEQ ID NO: 55455 - DNA, 591 bp, Glycine max
  Peptide Sequence Number=SeqID_172233
atgaacaactcaaagcaacagaagcagcagcatcagcttcaacaaagaggatgcaaggctttgtgttgcagttgcaggttcagtgtttcttcctctgaggaagcagaaagctcatcagcctctgacaggttcccttctgtttcaagccttgcacatgccatggtgcaagagagacttgaccaaatgattagagctaggcatgtagagagaagaaggcagcagagcagagaagggaccaagtttgttgtaatggtagcaatggagaagagctcttatgatccaagagaggattttagggagtccatgatggagatgattactgcaaaccgccttcaagacgccaaagatcttcgtagtctattgaactattatatctcaatgaactctgatgagtaccatagtcttatccttgaggtttttcatgagaagagacgtggcttgtcgggttgttactcacttgcccaaaacaagcagaaaattatccagaaattggttgatcacatcaatccgggaaaagtgatgccattacaacatttaagtgtcaaatgggagggaccattcttaatcttaacaaggtcgatagggtattaa

SEQ ID NO: 55456 - DNA, 462 bp, Glycine max
  Peptide Sequence Number=SeqID_172234
atgtctggaacatttgcaatcgcgaacacatctgcaaccaacatgctccgccaccgctcctactcatcgctaccaccaccgaggtgtgcatctcgcacgaatatttgtgaggagcagcagcaaaagaataataatgaagaggaggaagaagaagcgtcgaagctgttggagatcgagaacggtcttcgcctagtcccgcgtgtgaagctcaacctcacggtgtacccttccacgcccctcacactttcccacccaatcgacgaatggaagatgaaacacgcactcatcgacttcctccattcctctcactccctcacgctccccgaggacgaagacctccagaaacgcaagcgcggcaaccccgagggagcacttggcagaggaagagttgaagcggcgtggtgccactcttcgagaaaagggaaagagctttgttccatggagggagggcgcagagagtga

SEQ ID NO: 55457 - DNA, 135 bp, Glycine max
  Peptide Sequence Number=SeqID_172235
atggcggcttgtggtggccaccggtggtcgatggaattgtgcttagcacgcttgtctcactgtgcgagatgtctgaaagctttttatttaaatcccaactatgaaagtgtgaagacatgggttatgaacctatag

SEQ ID NO: 55458 - DNA, 168 bp, Glycine max
  Peptide Sequence Number=SeqID_172236
atggtgtactctgtatttaaatctcttcgacccgtcgctttaaaaccggaaatttccgtcgtttcagatgaaatttcggcagggagaggagtgaatacggacagtcagagtgcgggaacagccaagccaccactagccaccactcagcgccaccctcctcctccgtga

SEQ ID NO: 55459 - DNA, 921 bp, Glycine max
  Peptide Sequence Number=SeqID_172237
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccaagggtggtctgtgctactgtgggtccctctcccagccacaaatcagagactattcaattctagagaccctccccatgaatcatcatccctttgttcaaaaggcagagtctttcaggtagagcttttcaggtggaggctggtgaaaagtggagctgtgtatcttcgtccattcttccaggcaacagtaatccactggattaaggtcatgggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 55460 - DNA, 486 bp, Glycine max
  Peptide Sequence Number=SeqID_172238
atggcactaaaggatatgtgggctcctttagaggggctggttaagaccttcttctcttcttcctctttctctcattctttgtctgcctttccttcctcagattggtctctttcaactttctcttcttctccttgtgctctcctctggcttctagaagtattctttgcaattcaaactacaagcgctgtcaaattcatctgccaaattatggaaagcgctggctggagggaaacatacaagaaaaggaagaaacaaatgctgaagaaggttgaggaactcaacaccctttatggaattgaagcatgtgccatagtttatggccacaatgatctagatcgagccagagttttggccatcccattgggggaatggggagtccaaagggtggtggaaaagctcaggatcatgcctgaattggaaagaagcaagaagatggtgaaccaagcaggtttcattggacaaagaatcctgaagggtaacgagcaa

SEQ ID NO: 55461 - DNA, 189 bp, Glycine max
  Peptide Sequence Number=SeqID_172239
atgacccttcaagggctcttggagacttcactggcattaggaatcactactctcgcaacacatggtgagaagaagtggcaccataattatagatgtgaccgtggcaccctcttctccagggtttcatacctactgatatttgtcccattgtgtcctaactttggaaatatcagatttgaacatctttag

SEQ ID NO: 55462 - DNA, 963 bp, Glycine max
  Peptide Sequence Number=SeqID_172240
atgccgcaaagctcaaaaccaacagtcactcctctctctttttctctccacacttgctatcttcacactcattgctcagcttgcttctcttcccttccaattctcaatcccaattcactcttctattcctcccctccatgctccaccgcactttcacctctctaccgctcgtccgccaagcgccacctccgtccctccgctcactcctccaacctccgtaccgccctccgcctcctcctcttccaccgccccacctcctcctcctcctcccgtctcgccgacctcctctccaatcgccacatcctcaccggcgtcatggcagaagcgatcgcaaagcagcgcggcgtccccaacaacgacgccattttggaggaagtcacgattgcgcttagcacagtgctaacgaacgtcatggaggtgcacaataacgaatggcgcgccctcggaatctcggttttttaccacatcttttcttggatcaaccacagttgttcccccaatgcctgctaccactttgtcctctcttcttcttcgcattccaaggaagccaaacttggaattgctccacacctacaagtgaatttttatttaaatttttgccttttcctcaaaaaataccagtcaattgaatttaaagatattgtcaacattggacgcactcatactcaagatgcaacacctttgactcttgggtttactacacaagtgaagtacggtattgatagagtaattgacactttgtcatgcatgtatcagcttgcccagggtggtacagctgtagggactggattgaataccaagaaaggttaccatgattcaataccaaaaagaaaggacattatctggaatgacgagcatgcccatattccaccgttgattttaatttattatggatctgatggcgcaaattctgctaagtatactatggcagtagtaggagggcgagccctggtgcagccgtaa

SEQ ID NO: 55463 - DNA, 408 bp, Glycine max
  Peptide Sequence Number=SeqID_172241
atgaccgccgtcggggttcatgactgtcgtgagtctgagcatcctccattggagtccgacatcaacacaaggtacccaacaacaccaacactgaactttcaacattttaggaacaggaacaggaacctccatactccacaatttctcagtcagatgggtgaaacatatttgtcaatatttcaccatttaagtggccatttacgtcccaatcacatcactattaggaaaaatacaagccaagaagttgtgagacgggatgaaagtgaatttgatgcaagtcctgaatcacatccttgggagtattatgagggacaaaacaaccagcatatggatctagaaacagaggctttgcacttgcaaagaagtgatactatgagacatgttgatcttgtccactatgtgacatga

SEQ ID NO: 55464 - DNA, 216 bp, Glycine max
  Peptide Sequence Number=SeqID_172242
atggcagtagcgaatgtgacagtttccaatataaagggtagactgaagttaggggggatcaacatcggtgcttcagtcatggctcttttcaaagtatcaaaggcgagttgggcatcatcggaccaattgagctggtccttcctcaagagcaaagtcaatggtcttgctatggaagtgaaatttgttctgagccagcacgttgaagatttcctctaa

SEQ ID NO: 55465 - DNA, 354 bp, Glycine max
  Peptide Sequence Number=SeqID_172243
atgactaccccatcaagccaatgtctaaccctcaccatgcctaatttcgttttcatggatcagttccgccaatctctccacaacaatagcgaattcaggcacttattgcagcaaatttgcaatgctccgacggtgcactcgaatttcacgattcaacatgacctaattttctatcaccgaaagttgtggctcccctttgtcgactccttcgtcctcactcttgctgaatttcacactactcctttgggcagacatttaggcattgcgaaaactctccgttgcctgcaagataattttttctggcccaacatgcagaaggatgtgcgcgcattcgcaagtaaaatattaaactag

SEQ ID NO: 55466 - DNA, 270 bp, Glycine max
  Peptide Sequence Number=SeqID_172244
atgaagggagatttgaagcttgaagagacaacaatggtggtgaagaaaatgagaaaaagaaacatggaggaagaagcaaaagggcccacctttacctttgacttgaccacatactcagccataaaagaagaaaaaaaaactggacctttttggatgctgaaatcctgtctcagtttgagtgccgcctctccgattccagttcttcgcgtttctctgcacccgtcgggacctgttttcaaaggtaggcaatgtatatatcaaaacgcttag

SEQ ID NO: 55467 - DNA, 189 bp, Glycine max
  Peptide Sequence Number=SeqID_172245
atgccctttcctttattgctgctggggaagctgatggcgcaaattctgctccatgggactcttcatgccactatttatgaagtcgataagctcaaaattggtggaggcaactttttaaccaagtttattgataatcttgcaatggtatcagcactgcctctatcactgccttctccaaatagagaataa

SEQ ID NO: 55468 - DNA, 615 bp, Glycine max
  Peptide Sequence Number=SeqID_172246
atggggagaacgcatgaagcatctcgagaccacaatctggtggactctaagcctcaccttgaatgtgccgctgaggggcaggcattttgcattgtacccctaccaaacagtttaaagggccctcagtttcgcccacaactacaacccttgcattttgcggtgggaagagtccctcctactgtggtggaaaggggaaaatttgatcatatagaggaaaggctgagggccattgaaggaggcagagattatgcttttgttgacatggcagagttatgcctagtgcctgatgtcatcatccctccgaagttcaaggtgccgaatttcgataagtacaaggggactacttgccccaagaatcacctgaagatgtacaacaggaaaatgggggcatactcgaaaaatgaaaaaatgttgatgcatttcttccaggaaagtcttactggggcagccgtcacctggtatgctaatctggaaccttcccgagtccattcttggaaggacctaatggttaccttcattaggaagtatcagtacaattctgatatggctccagatagaatgcagcaacagaacttgtgcaagaaggagcatgagtcgttcaaagaatacgcctag

SEQ ID NO: 55469 - DNA, 219 bp, Glycine max
  Peptide Sequence Number=SeqID_172247
atggcaaaaaagcgaagaggtgtgaataggagaacaggcaaggaggcgaacagacaagaatgcgaggaagagagtagctcgccattctcgcaccgcaaacccttaactcctcactcctcagcttcctcttccacttcttccttcacgaatggacgcataatgcctcgctcctgttcccctttgacgtcgtcgttttacaactttggtggcggtggatga

SEQ ID NO: 55470 - DNA, 285 bp, Glycine max
  Peptide Sequence Number=SeqID_172248
atgggtgaggaatgggtgatcaaccatctacaaaatctttctatgcatcttcgccttccatgtcttcttcttcagcatcacgccctccttgtccaccaccttcatggtgtagaagtaggtgtcgtcgaagttgtagtagtcatggcagaggtggcaaaggcagacacggttgatgttgtcaacattgatatacgtgacagagaaggcggaagtcacaaaagggtgggattggaggttactccatgcctgtggttgttgaagtttgaagaagatgaaaaaggctag

SEQ ID NO: 55471 - DNA, 591 bp, Glycine max
  Peptide Sequence Number=SeqID_172249
atgaaaccccaccccctccattatcgaaaacctaccatcccttatcccatctccgtctccgctcactccgaatcatttccaaaaaccaccatagaattggagaaaaacgagaagaacgatatctttgaggggcatgaggcaactgtatattctgtctgtcctcatcacaaggagagcattcagtttatattttcaactgccattgatggcaaaattaaagcctggttatacgataatatgggttctagggttgattatgatgccccaggtcattggtgtactacaatgctttatagtgctgatggaagtagaaataaatccactggtgttgtgcagtttgacataacccaaaatcaatttttggctgctggtgaagatggccaagtcaaattttgggatatggacaacattaatcttttaacaagcactgatgcagagggtggactacagggattcaaaattcttgctaatgctaatggtcttagatcgttgagaacagttgaaactccaagatttgaagcattgaggtcaccaattgaatcttctgtagtcaaggttgtgatattttcttcactttttcttgttttttga

SEQ ID NO: 55472 - DNA, 228 bp, Glycine max
  Peptide Sequence Number=SeqID_172250
atgcaagttggttacttcaccatgaagttattttctggcccaagactccaatgtcctccattttctattttatgggacttcaaggcaccggttacagcgcaaggccaaggggtcgcccagggttttgatggttgtttgtcagttccagaaacaaaagccacaatgaaggggcaaaatggtcatttcctagagttttctgaccctaaactcgcccaggctagcatctag

SEQ ID NO: 55473 - DNA, 366 bp, Glycine max
  Peptide Sequence Number=SeqID_172251
atggaagacagagatattaaaagtagcaatatcctcttggataaagaacttcaacccaaatttgctgattttgggtcggtgaagctccttccaggagaccaatctcatcttagcacaagattagctgggacattgggatacacagcacctgagtatgcactccatagtcaattatcagaaaagggtgatacatacagcttcggaattgtagtcctagaaatcataagtggtaaaaagaattctgatgtgaaggttgttgacgatgatgcggaatggagaaggaatagagagaggagacgccacttcaaggagaagatgagtctagaagaagctcaccaccataggaggccatggataagagcttag

SEQ ID NO: 55474 - DNA, 237 bp, Glycine max
  Peptide Sequence Number=SeqID_172252
atggctttttctataaatagccatacagggggagagtttgatggaaggggaacagaagaaggagaggaagaaatgcagaaagagaaagaaaagaagaaaagaaggaaaaaaaaaagcacagtcgaagcgctgctgaatcacaatcgtggatcattccctacatcatttctctcgctagccttgtaccccgtgcaacagtcggctatcaccccttgtgacgggcacgtagggtgctaa

SEQ ID NO: 55475 - DNA, 642 bp, Glycine max
  Peptide Sequence Number=SeqID_172253
atgcttgaaagttttcaacaacaagatcaaatgtcagttatggaattgtacatagaaaaggatgtgactggtggttctatgtttcattctgcaaattctcttacatcatgtggaaataatttatctaataatgaggcgcaaccgctaagaaatatgagcaatttacatggtgacgaagatgatgatgatgatgataattatcttgtgtctaaatcatacgttgaagagtctttagacgaagatgatagtattgacggtatatctgatacagacgatgaagtcacacatgattcaacccctaagaattgttcacccagcagaaggtataatttcctctataaaaaaataggtgtacaaggaattcaaaatccattttggaatgatgctttgcattataacaatatcaactggagtcatcctgatgaggaggacatttgtggtttggagatgccatcaagttttaatgttggccaagaattatatgttggcatggattttgatagtaaagatgcggtcaaaaatgcagtcaaacaatatgttatgaaggtgcatcaaagtttcaaagttgttgaaagcaaatcaaacaagcatgatcagagaagatccatcaataaaagtttctttgattcaagaaaggattaa

SEQ ID NO: 55476 - DNA, 324 bp, Glycine max
  Peptide Sequence Number=SeqID_172254
atgttagacaagttcaacataagcaatgtgaagcctgagagtactccattagcaaaacattttaaattttttatagatcaatgtccaaagacagatgctaaggtggagtacatgccaaaggttccctatgctagtgcggttggttgcttgatgtataatatggtgtgcactagactagatttggcatgtgttatgacagaaagtctacaacaaggtatgtctttacttttggaggacaaagttgaagtggaatgtaagggtcacatgttgttaggttacaaatggggttggggtgcgggagcaaagctcccacagaatgcgtaa

SEQ ID NO: 55477 - DNA, 610 bp, Glycine max
  Peptide Sequence Number=SeqID_172255
atggagaacagaatcgatacgatggaagagcgattgggaaacgtggaagcgacggtggtagaaatccgtcaactgctgcgggaacagaacgagagacctcgccggagacagggaagacctctaggtcggggagatccacgtaacaatgacgacgacgggagtgatagtagcacgttatcacatggatcacgtttccgaccacgacggcacggtggtggtaacgaacggaggtattttggcgggagaaggaagttggagatccctgtttttaagggtgatgatgcttacgggtggttagttcgtgttgaacggtacttcaggctgaatgaagtacgtgaacatgataaggtggatgcagtgatgattgcgatggaggacagagcgttgaattggttccaatggtgggaggatcaaacaccattgaggagttgggaagagtttaaggaggcagtgattcgaaggtttcaaccgggaatactccacaatcccttaggacctttattgagtctgaaacaagatagcaccgtcatggagtatagagaaaaatttgagatgttggtagccccattgagaagggaggagaggggaatgcttgatatctactcctcaa

SEQ ID NO: 55478 - DNA, 1872 bp, Glycine max
  Peptide Sequence Number=SeqID_172256
atgatactgcagcagattattaagctcctgaccttaactttgatatggtggagcagtattaatgttgaatgtgcagttgcggggacacgcgacacacgtgtgataaactctggatgcagcacaatcaacgcttccaacccgggtagtttctttgggaatgtcaatgagacaatctcagagctgagaggagaaattaggaaccaaagcttgcactttggcacatcattgaaatccaaaggagatgtcaatacatatactatgtttcaatgcagaaactatctctccagaaatgactgtcttgcttgcatcaacactgcctccacccaaatccgggatatatgcaaaaaagccaacggcgcaagactcatctacaatgactgcttcctcaggtatgagagtgagaggttctaccaacagaccaacgaaatcggtggtggggtaacatgtgggaacaagagcacaaatgccacaggttttagagaagttggacaacaagcactactggacctacaaaaagcaacacctaaaattaaaggtttctatgcagctactaagacacaggtggctggtggtagtgcaaatatttatgccattgcacagtgtgttgaaactgcttccccacagaaatgcctggattgcatgcaagttggatacaacaacttacaaagttgccttcccagcacagatggttcagcatatgatgctggctgtttcatgagattctccaccacaccgttctttgctgataatcaaaccattaatatcagaccctatttaaaagaaggaggttcaagcaagaagtgggccattataggtggcgtcgtaggaggtgttgttctcctccttgtgttgtttgcctggagattgtttacaaaaccaaagagagctcccaaagctgacatattgggagcaactgagttgaaaggtccagttagcttcaagtataaagatttgaaagctgcaacaaaaaatttcagtgctgataataaacttggagaaggaggttttggtgctgtatacaagggtactctgaaaaatggaaaagttgttgctgtgaagaaactaatgttggggaaatcaagcaagatggaggatgattttgaaagtgaagtgaagcttataagtaatgttcatcatcggaatctcgttagacttcttggttgttgcagcagaggccccgagagaatcctagtttatgaatatatggcaaatagcagccttgacaaattcttatttgcaaggggactagcatatctacatgaggagttccatgtgtccatcattcatagagatataaagaccggtaatatccttctagatgattatctccagcccaaaattgcagattttgggttggcaaggcttttgccaagggatcgttcacatctcagcacaaaatttgctggaacactgggatacacagcacctgaatatgcaatgcaaggtcaattatcagagaaagccgatacctacagttatggtattgtggtcctagaaatcttaagtggtcaaaagagtaccaatgtaaaggttgatgacgagggtcgcgagtaccttcttcaacgagcatggaaactgtatgagagaggcatgcagttggagcttgtggacaaggacatagaccccaatgaatatgatgcagaagaagcgaagaaaatcattgaaattgctttattatgcactcaagcatcagctgcagccaggccaacaatgtctgaattaatagttctactcaaaagcaagagcttagtggagcaccttcgaccaactatgccggtgtttgttgaaacgaatatgatgaatcaggaaggtggcagctctcctggtacatctaatgctactatctccatttccgttctatcggccagatga

SEQ ID NO: 55479 - DNA, 435 bp, Glycine max
  Peptide Sequence Number=SeqID_172257
atgaatgaaaactggcaattagagcctgagccagaggaagctttagacacaaggaagaatgaacagggagtagtggaagtcttggtgaaatggaaagaccttccagactttgaaaattcctgggagccagtggaaaagctcagatcagaatttcctggatttcttcttgagggcaagaagagttttgaaggcgggggaattgataagcaacagatagtatacacgaggaaacatggtaagggaagtgtaggggatcatcccactagaggagtggcagagagagaaaggagggctgtaacgttatatgctgagggaataatcagtagtggggggcatgtatggattcagttagaaactgcatgggagttttctaagcagctcgaaatgcttagcctgttttctgcatttttcatttccattgtccatccattgtaa

SEQ ID NO: 55480 - DNA, 411 bp, Glycine max
  Peptide Sequence Number=SeqID_172258
atgaagtgtcatcacctggtggattataaattcctttatggtgtgcttgcctcaagattcattaacaacttcaatgttgatgtctctattaagattgttgactttaccaaagcctctagtgagattaccaaaaggcatctcaagaagcttggaatgaggtttgttgatcatgaatggataatgggtggaatccagaaccatgctaagattgaagggcaaaagggtcatgtttgcaatattttagagtaccatttgcccagtctagcaactaactcgcatggactagtgaagtttcttcaaacttattctaacaagcctgtagctagaaacattgaagggatggaagaagatgctaaagatgaagctccacaaggcctgcacatcaatggagtccttttgagtcccttatga

SEQ ID NO: 55481 - DNA, 424 bp, Glycine max
  Peptide Sequence Number=SeqID_172259
atgttggtatttgatgcctattcgttggagaaggtgacaaaggtcatggagatgaccaccaagttggccttgaacaactccgacactggagaaagtccccttagcgttccgattaccactaaaaagttggttgtgtccaagatgcctcaaacaaacacatcctcaaaaacccctaagcccagaaaccaaggggttggttcagggtacatcctttgtggtacaagtaaagcgtacatctacttgggttgtaatactgagaacaagagagggtacatctcttgtggatcagctcaagtggagcgtacatccacttggttgttcaaagagaacaagggagggtacatcccttgtggatctttgcttgtaaaggattttataaggttattggaaatctcaagaactgtgggttgcttggggactggac

SEQ ID NO: 55482 - DNA, 132 bp, Glycine max
  Peptide Sequence Number=SeqID_172260
atggcagttctattgcttggaggaccagttgcaacctcagctgctgcaatttcccaagaggatgagaagaaagcatgttgtagtcttgctgaatgttcgctcttctgcaatgctaatcagcaagtgtactga

SEQ ID NO: 55483 - DNA, 306 bp, Glycine max
  Peptide Sequence Number=SeqID_172261
atggtgtcttctcattggcataagtggcacgttcaccggtgtggaatgaccgaactcgagggaggaagagggagtctgcaacaacagggcttcagcaacgtcggaatgaggcgcgtggcgaaggaggaggaggaggaggacgaggagagtgagatggagacagagataggaaccgagggtttatggtggaagaagtgtgagccattcggggaggcatggtcgttctccggcagtgcagtggggatgctaaacgaatcatcagagagaccagtcacaaaggttttatggtggtggcagggaaagtga

SEQ ID NO: 55484 - DNA, 192 bp, Glycine max
  Peptide Sequence Number=SeqID_172262
atgaagagagtggcaacttttgaaacaggcagtttaagaaagaaagtgtgtctgtgtgacactgattatagacgcaacgcagcactttgtaggctaagtgtctgttccatgcttcttagatgggttgaggatgctgttgttcgctacctgacccgaaaaaatgctcgaagtgatgctcctggaaacatctga

SEQ ID NO: 55485 - DNA, 141 bp, Glycine max
  Peptide Sequence Number=SeqID_172263
atgatgttgatgtgtcatatgacactagtggccttaaagttagccaaagtgattaactttaggttaacagatggatacctcatgggagaagcttggagtttggagctacttgcttggaggaagattaaagtagttttgtaa

SEQ ID NO: 55486 - DNA, 184 bp, Glycine max
  Peptide Sequence Number=SeqID_172264
atgcagaactatcaacatgcaaagagatctaattctgcaaaagccaggatcaataggaaactcattgcatctgattcatcagaaagtgtaaattttgaatccacacaaggttcagactctaattttttaactgcctatgaggattgccaatctccaactaatcagcctgtaatcaacactgaag

SEQ ID NO: 55487 - DNA, 1393 bp, Glycine max
  Peptide Sequence Number=SeqID_172265
atgaaccaccttctctcccaaacgcagcctcaaccacaaggtgccacgtcacacttccacggccactttcagctttcacaaccccaaacccacgtgctcgcaccacaacaacagccacaccctcatcctcatcctcaagtgcacaacaatgcaaacaccaacgcccacgtggcagcacccacacctcccaagcgtgcaagtcagaaacccccttcacgccctcagggctcctccaacgccagccaatcctctgcgttcaagaccatggaacttaccgtggcgccgccccggaaaaagagaagctttccctataataaggtggttccggaaaaggtggcaaagcttgtgccagaatccgcaatctacgccaagttgctgggactcgagactcaaatagactctgctttggctaggaagaaaatcgatgtgcaggagaatgttaggaaccctcgctgtgttaggaaaacgcttagagtttatgtttacaacactttttcgaatcaggtgaaagtggagcctgggaagaatggtgtggaggagccttcttgggcgcttaggataaccggaagggtgttggaagatggtaaggattctgtggcggaagggatttcgacgaaggaatatccaaaattctcggcttttttcaagaagattaccatatacttggatcagggtttgtaccaggataaccatgttgttgtgtgggatagtgcccgttctgcggctgcacagcagcgcgatggttttgaagtgaagaggaaaggagacaaggaattcactgcggtggttaggatggcgatgaattattcgcctgacaagtttgtggtttctccgcaactggctagagttttaggggttgagtttgactcgcgagctaggatcatagctgctctttggcactatgtgaaggctaagaaactgcagagcccgaatgacccttcgttcttcatgtgtgacacttctctccagaaggtgtttggggaagacaagatgaaattctctgtggcttcgcagaagatatcgcagcatttgtcacagccacggcctatacacctggagcataaaatcaagctttctggaaatggtccagccggaagtacgtgttatgatgtgcaggttgatgtgcctcttcccctagagaaggatatgtctgcattcttggcaagcactgagaggcacaaagatattgatgcttttgatgaactgatctgtgattcaataaagaagattcatgaacatcataggagacgggcattttttctcggctttagtcagtccccagcagagtttattaatgccttgatcgcttctcagagcaaggatctgaagctcgttgctggagatgttagccagaatactgaaaatgccaatgtgctgattctacatcaacctg

SEQ ID NO: 55488 - DNA, 126 bp, Glycine max
  Peptide Sequence Number=SeqID_172266
atggaaggcaactatggtgttggacgctttcagacggaggaaaagggagcaacggtagtggcagttttagacggaggttccatggaggacagtcgtgggatatttgaaaataaggaggtgcaggag

SEQ ID NO: 55489 - DNA, 867 bp, Glycine max
  Peptide Sequence Number=SeqID_172267
gaacgtgtccgtcctaggttttgtcgaggctcaccaagggtggaccttgggtttgatgagcctccttgggttttccttgctctgttgttcttagaaaaacaacctccttgtcgacggttccccgaccttgacaaggatcatgacatttgtgtcggatataagtcgaaaaggaatttcgttggctttaaggatgatctggttagctacctccgcctgactgttggtctgggggtgtttgatagaggttatgagatgcttgacacccaaactgtgccaaggggagctcatgctatggagattatcaggaggggtgcatggaacgtctgcgaattcttagcatcgtctgcacctctttgtgaaatcgaggatctcttcatgaagttttcgcatgacatagtttggttgttggctgttcaggcatttaagcaaggcttggagtgttccctaaatgatggtttagagatgcctagtctttttggagctagccaacttggagagcagtctaatatctattggcaacttgcccttggacaagctgggagctttgatgttgagcttgagagcttgctccaaagtgaaattgtcaagcccttcaaggatgatgcctgctccacttcccttcatattggacacttcgtccatgtagaggttccaccagtctggggtggtttagtcattgccagcaaagtctgccatgaattgggtcttcatggggtcgtgcagttcatattagaggcgccaagccgaggtaataagttccagcgctaccttctcaatcatttggtaccgcttctcggcatcatggaagatgttgctggtgaaatagatgggaagttgatgtttcacgtcttcctatacgagggttga

SEQ ID NO: 55490 - DNA, 156 bp, Glycine max
  Peptide Sequence Number=SeqID_172268
gattctttggaggagcaggcgtcacagggttcgtttgtcccccatggtcgtcaagatgtcctgactgttgccattgggcgaccagaacacccttgtcgtgtgcgtgctgctggagccgatgtcacaatcaagcaatacttcggctttgctccatga

SEQ ID NO: 55491 - DNA, 330 bp, Glycine max
  Peptide Sequence Number=SeqID_172269
atggtacacaacttgtccaacttctatcgtgcaaaatctaaatgcctatgcaaagtaacagagacgatccaattcatatggaaacggttatgtgaaggttgttaccgtatgtggttcatttttcaaccagcattcaaactcatttcaagtttattattaacaaaatttaagtgctttgaaggaaaattgatggaaaaagttgaagaaaaagttgaagattgggatagcttgcttagtgtgcaagacaggcccaacacgtttcctcgcatagcggccagctcacgcttagtgcagaagcccgcactaagcgcgaggtcacatgaaaattaa

SEQ ID NO: 55492 - DNA, 426 bp, Glycine max
  Peptide Sequence Number=SeqID_172270
atgccaaaaggagcagaagcagtgcatgcagcaaatccagatgttcttatgattctatctggcctaaactttgacatgaacctatcattcataagaaatgaggcagtgaaactcagcttcaatgggaaactaatgtttgaggtccactactacagcttcagtgatggtcaggcattgacatcagggaatccaaaccaagtgtgtgggcaagtcacagagaatgtgatgacaagggcagggttctcgttggaccaagggtggccattatttgtgagtgaatttggggtggacttgagagccacaagtgtgaataacaatagacatgaagcttaccttgagtggcagccagaggcgatgcagagtgggactgagaaagaagagtcacgaggcaatgtggttgcagtgacaatagggtttcaacggtag

SEQ ID NO: 55493 - DNA, 348 bp, Glycine max
  Peptide Sequence Number=SeqID_172271
atggtggaagaagggaatgtgacagatattcttgactcaaaggtggaaacttatgaaaatgatcaaaggctacttcctgcaagaaacaacacaaattatcaacaatcatggagcctatggcacttgcttgattacaggctcccaaatatgccagtgcttaataggtcaatattttcaagccgtataagagcaggtgttgatcccccaaaaaataagaacctggcggggaagttcaagcaagagtctgtttctgcactcaagccagaatacttggatcatgcattgcccaacttcaagacccttctcagttgcttgaaactagaacagatgctgaattatataggataa

SEQ ID NO: 55494 - DNA, 177 bp, Glycine max
  Peptide Sequence Number=SeqID_172272
atgggaaacgacctaggatcacttcctagttactgcattttaatccttatcattagtgcattcatggcaacttctttgtcttttgcttgcttctctacggcagctttagttgcaaggcgtaaagagtacctctactgcttgcttttgggaagcccttgccaccattgtgaaagctga

SEQ ID NO: 55495 - DNA, 612 bp, Glycine max
  Peptide Sequence Number=SeqID_172273
catcaaattgccaagggaatcactgccaaacaagtccagcattggccaaagaaagggaagctttcagcagggaagctaagtgtgaagtatgcaattctacacaggattggtgctgcaaactgggtacccaccaatcatacttccactattgccacagaatcttttgctgtcaaattacccattgccttccctactgtattgtgtggcattatgttgagtcagcatcccgatatgttaaactacactgactctgtgatgaaaagagaatctcctctatccctgcattacaaactgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagagaagaaaatggagctggaacgcctgatcgaaaggttctcagagagtggcattgatgatgaagaagcagctgaggaagaaggagaagcagctgaagaagaagaagaagctgctgaggaagaggaagatgcagcagaagatacagaatccgatgatgatgattctgaagccaccccatga

SEQ ID NO: 55496 - DNA, 972 bp, Glycine max
  Peptide Sequence Number=SeqID_172274
atgccgcgaattgaatctagtactacaattatatctgctatgaatgtacaattgtctgaacctacatctcctaggtgtccatccactccatccagtgcaagggctattgcagctgcagctaatggagcggcttttgctctagaacttgaagccttaggcctcggatctgctgcaacaactgcaggaaacttttttgaggatctcacttcttctgaactttataagaataccaaggttcgtgatatttcagggacattccgctgggcgccgtttcttgctttagagagatcaaactcatttctaaccatgctcttgctgctttctaagtacaagatgaagagtgttcctgtgttggatttaggctctggtacaattgataacattattacacaatctgctgtgattcatatgctggcagaatgcgctggacttcagtggttcgaaagttggggaaccaagaagctatctgaagttggtcttcccctggtgacaggaaatcaaatcatcaaggtttatgaggatgaaccagtcctccaagcatttaaagtaatgaggaaaaagagggttggaggggtgcctgtaatcgaaagagagaccaaaaaggcagttggtaatataagtttgcgagacgttcaattcttgctaactgcaccagaaatctatcatgattatagaggtattacagtaaagaacttcctgactgaggttagaagctacttggagaagaataaaaatgcatccccaatgttaagtgaatatgtcacatgcaaaaaggactgcacaatcaaagaattgattcagctgcttgatcaagagaagattcatagagtctatgtagtggaggatgatggggatctgcaaggactaatcacactaagagatatcatctcaaggctagtacacgaaccgcgtggctattttggtgatttctttgatggcgttctaccgctgcctgcaaacaccagagtttaa

SEQ ID NO: 55497 - DNA, 1140 bp, Glycine max
  Peptide Sequence Number=SeqID_172275
atgaagatagaagaacgtgttaacatgaatctggttctggtagtggcctggttggtccagttgaacattgtttatggctttgctcacattcatggttttggagagcaaccactctccaggattgccatccacaaggctgttgtttcactccacagtagcgcttccatcacagccaccccttctcttcttggcacaaagggtgaggatacacaatgggtgacagtagatattgattaccctgacccatctgcagatgattgggttggagttttctctcctgcaaagttcaatgcatcaacctgtccacctgtgaatgatccaaaagaagtgattccatacatatgctcagccccaattaagcctaagcttgtggcagtttccaatttcatatcatttgtcaatcctaaagtgcctctatatccaagacttgctcagggaaagtcttgggatgaaatgacagttacttggactagtggatatgacataaatgaagctacaccctttgttgagtggggtcctaagggcaaaacgcaagtgcaatctcctgctggaacattgacattcggtcgtaacagcatgtgtgctggaagttcacctgcacgaactgttggttggcgtgaccctggtttcatacacacaagttttctcaaaaacctttggccaaatttagtgtatacatatcaattagggcatctattgtctaatggttcttatatttggagcaagaaatattcattcaagtcatcaccatatcctggacaggactcattgcaacgtgttatcatatttggtgacatggggaaggccgaacgtgatggttcaaatgagtataatgcctatcaacctggttcacttaacaccactgaccagctcatcaaggatttagaaaatattgacattgttttccacataggagatattacttatgcaaatggatacctctcgcagtgggaccaattcacagctcaagtggaaccaattgcatcaacagtgccatatatgattgccagtggtaatcatgaacgtgattggcccaacacaggatccttttatagcactacagattcaggtggtgaatgcggagttttggcgcagaacatgttttttgttccagctgaaaacagagcaaacttttggtaa

SEQ ID NO: 55498 - DNA, 423 bp, Glycine max
  Peptide Sequence Number=SeqID_172276
agtcatgttcaacccggatcgtatgagtgtggatactatgtcatgcattggatgtggtgcatagtcagcggaggattgaagaacaaatggaataagtttttttctgatggaacaccattagacgaggagacaatgacgacactacggaagaaatgggcagcctattttctacaacttcaaaagatggatgtaagcggtatccgcattatggtactccatttcacacattgtgtaattaagaacaacaaaaataagttgaagaaaagaattccttggatggtatatacaacaggcaaagaagtgaatttggaacactttataaaatctcctacaaatatagttgttcttgaaggtgagtgcttggatgctggtggtgatggaggggaattggagtcttttctgttgtccatgacagacctataa

SEQ ID NO: 55499 - DNA, 321 bp, Glycine max
  Peptide Sequence Number=SeqID_172277
atggttgagaggaaagatcccattaaagatgcccgtcaggtgtttggtctgaatccaagaattttagtgatgaagggtgaggacccatcccaaaacggtggcgtggaatctgtcaagcagaagataaatttcactgcaacaggaagcttattggagcaagatatttctacaaagagcttagtgtacgtgactatgaacgtagctggttcacatactttatcaaccgcaggtggtaactttgttcctggagctagtgtatttggcttcggcaatggaattgcaagtgctggatcaccaaaagctcgagttgcagtgttatga

SEQ ID NO: 55500 - DNA, 486 bp, Glycine max
  Peptide Sequence Number=SeqID_172278
atgtacccattgtccattcttgcagcgcttattgcgactatggaactcttgttcctgagaaggcaaagagaaaaatgttggtctgttttggtggtggaactgacaagggctacaacagttcccagcttgttctacggcaagccttacacctgtccaaagtcgttcagtttagcagatttcaattatccagcaatcacaattcctcagttagaccctggacattctctgaatgttactcgaactgttaccaatgttgggtctccaagaacgtatagagtgcacatcaaggcaccaccacaagttgtagttacggtcgagcctaggaaactgaggttcaagaaaaagggtgaaagaaaggagttgagagttaccttgaccttgaagccgcaaactaagaacaccactgattatgttttcgggtggttgacgtggactgatcacaagcaccatgtcaggagtcccattgcagtcaaaatagcacattaa

SEQ ID NO: 55501 - DNA, 555 bp, Glycine max
  Peptide Sequence Number=SeqID_172279
atggaggtcgaactcaaagagctgcacgccgatcttcaatctctgagccaatcgcttcccgatccatctcaccatgatttgctccgcaagattcaattgcgtgttggggaccttgcgaagcttgcagaggcagcacctgttcgacgctctaaagttgaggatatgagtgctgaggttgtagatagcaatccttatagtcggcttatggcacttcagagaatgggtattgtggacaactatgaaagaatacgcgatttctccgttgccatagttggagtaggtggtgtaggaagtgttgcagctgagatgctaactagatgtggtataggtagacttttgttgtatgattatgacaaagtggagctagcaaacatgaataggttgttctttcgtccagatcagtttcaagaacttccctgtatccataccataattgcgcaatataatgttttaactttccaggttggtatgacaaagacggatgcagctgtacagactctttcagacataaaccctgatgttgcacttgaggcaagtattttgcattgtatatag

SEQ ID NO: 55502 - DNA, 3849 bp, Glycine max
  Peptide Sequence Number=SeqID_172280
ttctttgatcacatcaatgaggatagcaataaccaaagtgatgaccaaagcgatgacgagggtgctggcagaccaacgacacctccgtcacctccattgcagtatcaccaacctagatcaatggagagcagtgacatatccagagttgatagtgcaagagccagtggctctaacatatggaggaacaacagcatggatgttttctcaacatctgaacgcgaagatgacgaagaggctctcaaatgggcagccatagagagactcccgacatatcttcgaattcggagaagcatactcaacaatgaagatgggaaaggtagagaggttgacatcaagcaactgggcctcacagagagaaagattattgtggagaggcttgtgaagatagcagaagaagataatgaaaggttcttgctgaaactcagggaaagaatggacagagttgggcttgatattccgacaattgaagttagatttgagcatataaatgtggaagcacaagtttatgttggaggaagagcactgccttcaatgctgaacttttttgctaatgtaattgaggggttcttaaattatcttcacataattccaagtccaaagaaaccgttgcgtatacttcagaatgttagtggaatcataaagcctcgaagaatgacattgcttttggggccaccaggttctggaaagaccactttgctgttagcgttggctggaaaacttgataaagatttgaatcattcagggagagtaacatacaatgggcatgggcttgaagagtttgtgccacaaaggacttcagcttatataagtcaatatgataaccacattggagaaatgactgtgagagaaactctggctttctcagctagatgccaaggggttggacagaactatgagatgttggctgagctactaagaagagagaagcatgcaaagattaaaccggatcctgatattgatgcctatatgaaggctgcagcactaggaagacaacggacgagcgtggtcactgattatattctcaagattttgggacttgaagtgtgtgctgacattatggtaggagatggaatgataagaggtatctcaggagggcagaaaaagagagtcacaacaggggagatgctggttggacctataaaggtgttattcatggacgaaatatcaactggtttggacagttccacaacttttcaaataatcaattctatccggcaatccatccatattctgaatggaactgcacttgtgtctctgctacagccagcaccagaaacttatgaactttttgatgatataatactattaacggatggacaaatcgtgtaccaaggaccaagagaaaatgtggtagagtttttcgaatcaatgggttttaagtgtcctgaaagaaaaggagttgctgacttcttgcaagaagtgacatcaataaaggatcaatggcaatattgggcacgtaaagatgaaccttatagctttgtcactgtcaaggaatttactgaagcattccagctatttcacataggtcaaaatcttggagaggagctagcctgtccatttgacaagtctaaatgccatccaaatgtattgaccacaaagaagtatggtgttaacaaaaaggagctgctgagggcttgtgccagcagggaatttttgcttatgaagagaaattcatttgtctacatattcaaagtcacacaactcatttatttagctgtcatgacaacaacattatttctacgaactaagatgcatcgcaatacggtggaggatggaggaacttacatgggtgcccttttctttgctgtcaccgttgcgatgttcaatggcatatcagagctaaatatggccatcatgaaacttcctgtcttttacaagcaaagggaccttcttttctatcctgcatgggcttattctcttcccccatggattctcaaaataccaattgccctcatagaagtagctatttgggaaggcatctcttactatgccattggctttgatcctaattttatggcatcttcgctatttcggttgatggcagcattcggaagggatgttatagttgcaaatactgttggaagttttgcattacttatagttctggttttgggaggatttgtgatttcgcgagagaatgtgcacaaatggtttgtgtggggttactggtcctcaccactgatgtatggacagaatgctatagctgtgaatgaatttcttggtcatagttggagaaaggttactcctaattccaatgaaacactaggagttttgatactgaaaactcgtggatttttcccagaagcttattggtattggattggagtaggagcattaattgcattcagaaaggatcaagcagggctatcccaagagaaattgattgagagaaatgcttcaacagctgaagagttgattcaattaccaaatggaaaaatctcttctgaaacaaagattgtagaagaagcaaacttaccatccagatctttttctggaagacttagtgatgataaagctaacagaagtggaaggaagggtatggttcttccttttcaacctctatctctcacatttgatgagataaaatattctgtagacatgccacaggaaatgaaaaagcaaggagtttttgaggaacgtctagaacttttgaagggtgttagtggtgtctttaggccaggagtactaacagctctgatgggcgtaagtggtgccggtaagactacattaatggatgttttagctggaaggaaaactggtggatatattgaaggaggtatcacaatatctgggtacccaaagaggcaagaaacatttgctcgcatctcaggatattgtgaacaatttgatatccactcacctaatgttacagtttatgaatctttattatattctgcatggcttcggttaccccgtgaagttgatcacgcaactagaaaggtgcagatgttcattgaggaagttatggagctagtagagcttaattcaataagagaagcgcttgttggattgccaggagagaatggactttcaaccgagcagcgcaagaggcttacaattgctgttgaactagtagccaacccatcaataatattcatggatgagccaacctctggccttgatgctagagcagctgcaattgtaatgagaaccgtgaggaataccgtgaacacgggacgaactgtggtttgcaccatccaccagccaagtattgatatatttgatgcctttgatgagttgggaggggagcaaatatatgctggtccattaggccaccactgttccgatctgattcagtactttgaggctattcaaggagttcctaagatcaaagaaggttataatcctgcaacctggatgttggaagttacatcagcaggcacagaagcatctcttaaggtcaacttcaccaatgtgtacagaaactcagaactataccggagaaaagagcaagatcttttcaatgctatgggttcaatgtatgctgcagttaccttcatcggagtacaaaatggtgcctcggtgcagcctataatagcggtagagagaaccgtcttctacagagagagagctgctggaatgtattcagctttgccatatgcacttgcacagtggtactattggatctgccctgttgcatggaccttgaacggattggtggcttcgcaatatggagacaacagggacaaacttgagaatggtcaaagggttgaagaatttgtgaagagttattttgggtttgaacatgaatttcttggggtagttgcaattgtggtggccggtttctcagtgttgtttgcacttatcttcgcctttggaatcaaagtattcaacttccaaaaacgatga

SEQ ID NO: 55503 - DNA, 673 bp, Glycine max
  Peptide Sequence Number=SeqID_172281
atggcacgagagtggagaccggcgttttgcatgttgatttgttcattggatggccagtggaaccatgatccttggttcaaggaagatcacttcgtggacagtgttaggtttagtatcgtaccggtggaaggggactcgcacattctacctttttacttagatttactgttggtattgagtcagtacccgatgttcagctatatgtgtgtttcatcgactccaccttctccttctttgtcatctgcagcgactgacattgttatgatggtagaggagtatgtttcgccatcccccaatagtgagattcctttatctacctatttgttgtatgatccagttgcacaaacaagttttcttatgctcgtacatccaattggttggatacctgttttggacgactatgctgatgatgacaatgatgaggaggaggatccgtgggtgatgagtgagggaatgattgtgggatgtgtgaccgcagagcatgtggtcaaatccttccaaggagagagggggaggggtgccgccattgctgctggcgagatgggaggggataggagagagagagtggcggttgcgggacaggggggagagggatccgccactggtttctgcgggataggggcaaagaagacccgcctttcaagctggcgggataggggtctgttcatggctg

SEQ ID NO: 55504 - DNA, 552 bp, Glycine max
  Peptide Sequence Number=SeqID_172282
atgaccacaagagttagtgcatcgacaaactcttcttttccgtcgttgtccatgactgaagaagatcagtctaacttatctgataactttgctattgatttcttgggtattctgaaattgaattttgatttgtactttctgaaacaatcacaagaatttgtagaaacaatcacaagatcaaaaggtggtggaaacagaaaatccaacaacagcagtggcaacaacaacactaaatctcaaaaaagaggttcggatgttaagagcgctttgttcgttgaaggcagtttcttgtttggttggcatctcccttcgcatacccaaaatctagggagaatttttgggtccaataacaaatctgggagccagcataaagcagaagaagaatctgcatctaaaagtgggtttgcaaaatcttcagggagggtggaggatatgaatgaggtgttgttagagatggaggacagtggatttttgagttttgtgtttgatgatcattcgaatagtgctgggttcaaaggattgaaaaggctgaagagattctggccaaactag

SEQ ID NO: 55505 - DNA, 648 bp, Glycine max
  Peptide Sequence Number=SeqID_172283
atggcgagatgcttacttcatgacaaagatcttccaaaaaaattctgggcagaggctacaagcacttctgtttttttgctgaatagattgccaacaaaagctctttcaaaattgaccccatttgaagcttggtatggtttcaaaccaaaattgatgaacttgaaagtctttggctgcttgtgtttctcttatattccacaagttaagagagacacgcttgataaaaaggtggaagcgggaatctttgtaggttatagctcaacatcaaaagcctatagaatattcttgccacaaagtaataaagttattgttagcagagatgtgctattctttgaagaagaaaaatggagcaaggaaagtgagaagcttcaagttcaggaggagagcgaagaagatgtggatgaccagccagttagaggaactagatctctctctaatatttatcaaagatgtaatgttgctgaaatggagcatgtagactacaatgaagctgcaatttcaatttctaagaaccctgtgcaaaagcaaggtgacgtgcaactgctgtattgcaaaactgaaaatcaacttgctgattttttaacaaaatcacttcctcaagcaagatttgagtatcttcgacaaaaacttggtgtatgctgtcgttga

SEQ ID NO: 55506 - DNA, 1975 bp, Glycine max
  Peptide Sequence Number=SeqID_172284
atgggtggggtaggtaagaccacacttgctgaacatgtgtacaatgactcaaggatggaggaggctaattttgatataaaggcttggaatgaaagacgagaagaatgggaagctgttcaaacacctctcaactatggggctccaggaagtagaattcttgtcacaactcgcagtgaaaaagttgcttccactttgaatgctgatttgaaggagattgctacaacgatagttgaaaattgcaaaggattgcctttggcattgaaaacaatcggaaattacgagtttgacaaggatggtttaattgagttgtggatgactgagaattttatacaatgccctagacagagcaagagtccaggagaagttggtgaacagtactttgatgttctattatcgaggttggaagttgataaaggaaaatgtatacccaaaacaacccgtcattttttcattttcaaccgaagaggtactaaagtgaaaaagatgccaatgcatttgggagaactgaagaatcttcaagactgtaaatattgccttcttttgccttctgtcgggcttttgccatttctcaagcacctggctattagagggtttgatgggatagtgagtattggtgctgaattttatggtagtatatctttaccatttgcatccttagaaacattgatattcagttctatgaaggaatgggaagaatgggaattagaatgtccgaagctgaaaggtctgtcagagcaacttcttcactcaaaggaactaagtgttcataactgtgggaggctcgaaaggattgggcacatcatatctgatatttctcttgaagagttgaacatcatttcttgcccatattcgaatattcccatgagtcgttgctacgatttcctccaagaagtagtgatcactgatgcctgtgactctaatgatttttccgttagatttcttcccaaaactttgtattcttcgactgttctggaggattgtccacaagtgaagatgttctcagatggaggttttccatcaaacctaaataacgtgcaactctctagtttcaaacttatcacctcaccgaaagggaccttgggagccaacacctctctaaaaaggttgtatattcgaaaagtggatgtggagtcttttccagatgaaggatttctgctactgtctcttacatttctagaaatacgtgattgcccagatcttaaaaaactggactacaagggtctctgccaactttcctctctcaaggaattgaggcttgaaaactgccccagcctccaatgcttaccagaggagggatcaagcagtcaagtgtcacagaaattgccatcaacttctttggtggttgaaagtgttatttatgtcagagatgatgacaaagaaatgatcattaattggctcacatatgaaactggcaactataagcagctatcaataatttctattgtgggcatgagtggggtgggtaacacaacgctcgcccaacatgtatacaatgatacaaggatggaggaggctgattttgttatcaaagcttgggtctgtgtttatgatgattttgatgttttgacactgacaagaacaattcttgaggcaatcactaaatcaaaagatgatagtggatacctagaaatgggtggaaggagaaggttttgtggcaaggtggaagggaaatcctcattaatagtgcaatctattccctcttgcataatggggtgcttcaagcttccacagtccttgtgtgatgatattgataagatgatggctagattcttcttgggtggagtagcagcggcgttcaataaggagctgttagctaggaagtggtggcaccttattaactttgaggactctctcgtggctcctctacttaaggccaaatactaccctcataagggtcctttggaggcctcccgtggacatagactgagttacatatggtctaatatcatgtcctctagagatttgatgatggatg

SEQ ID NO: 55507 - DNA, 657 bp, Glycine max
  Peptide Sequence Number=SeqID_172285
atgaactctcgcgaggctactttagcggccacggcaacggtgattggcgccttggcctccgcaatcggtttccgcttcttctaccgttctcaaacgcacgccaaatcctctctaaacggcaccgttttctctccccgcgaccctttcgacccctccaagcgcaaaggatacttatcgtgggatgactattttatggcaattgcgtttttgtcagctgagaggtccaaagaccctaataggcaggttggggcttgtttggtgagtcaagatggtgtaattcttggaattggttataatggatttccaagaggttgttctgatgacaagctaccctgggcaaagaaatccaggactgggaatcctttggagacaaagtacccttatgtttgtcatgcagaagtaaatgctattctcaacactaatcatgcctctgctgctggacaacggctatatgtgaccatgtttccgtgcaatgaatgtgctaagatcataatccagtcaggagtttctgaagtgatttattttgtggagaagagactagaaaattcagatactgcatatattgcctctcacaagctactttcattggctggtgtaaaggtcaggaaacatcaaccactgatgaatgaaattcatctgaagtttgaggagcactag

SEQ ID NO: 55508 - DNA, 246 bp, Glycine max
  Peptide Sequence Number=SeqID_172286
atggctcagtcctatttcagaccaagaagacctttgatttggtcacgtctcagtttaagcaaatcttggtttaggtgggtagattggtgtaggtataaacatacaatagttgtgttttgtgacaaaaattcatgcgacttagtccttattggagccagagcgacacaagtggaggtggagacgaagtggtgcaagcacaagaagagaagtggtggcggagcaacacatgaagatgaggtttggtga

SEQ ID NO: 55509 - DNA, 321 bp, Glycine max
  Peptide Sequence Number=SeqID_172287
atgaatgatgacaatgtgccaagtactggtctgagaatgcttttcatggaaactattgatatgtccatctgttttgaaggactaatatttggtcaaaaaggttatagacaaaaggtgaaggacattgttcaaggtgctttattccctgaagctggtatagataatagagttggtcatgcagggggaaatatgcttaatgcaaagagtcacatggagaaatccgattgtgaaggcatgctcaacgtaagtcacgcgttgagcacgaggttactgtcatactcactaagggcagcaatcgcgcttagtgtgaaggttgcgtga

SEQ ID NO: 55510 - DNA, 294 bp, Glycine max
  Peptide Sequence Number=SeqID_172288
atgtcttgcctactagcttatttcacttgtgtgcctaattatcatgttcatatctttgaagcattgtatgccacttgtgtcatgctagcagctggtgtctcgctaagcgaggcttgtgcgcttagtgagaatcatgtgctaagcgaggcactcagcccgcttagcgagttgggggaatctagaggagaatctgagaagcatctgcgtgctcagcacgtcatcagcgaggcgtttgtctcttcctgctctaagcacgcccagctcgctcagcggattttcactaactcgcgctaa

SEQ ID NO: 55511 - DNA, 771 bp, Glycine max
  Peptide Sequence Number=SeqID_172289
atggcattcaagaaaaggaaagccacaacatcccaaccccaggagccctatgatactaccagattcacttttgagggggcctgggaacgtcattctcagaacattcactcccggaacatccttctagagaggaatgttaatctttttgtcacagaatatgacgaattccgccgggagatgatcaggcggaactggcacaaggtcttgacccagttcatggacgggcacattgatgtggccctgttcgatgcggcatcactgaatgcctttctagagatgccatcagtcattcagccaggggagcagagaaccctggaagctcctgaggaaggatcagatgacactggcccagacttagagtgtgctctcatactccaaccttgccctcacttctcacacgctagttatgaagatggacatggatgtgggcttcctcatctcgcatcagatttcttagatggcccaatccaactcctcgagactcggctttctagccctcatttccgcactctgcgtggcctgaggaggacttgcaaggcacgggctagaggatctgagggtccatcttcagctgctctccctgctcctgctccttctaccacaccagctccctcttcatcttctctagttcagaccgacacctctactccaccatcctcagttccagcatacacctgggatccttggcttgttacagatcaggagacaccccagccagcccaggatgctccctcctcacctcatggcgagcctgcaccagcccaggattag

SEQ ID NO: 55512 - DNA, 246 bp, Glycine max
  Peptide Sequence Number=SeqID_172290
atgaaactgcccaaggcagttaagccttatttttggcagtttcgattgcctcgcttagcgcagttcaaactcacgtgcttagcaggaagactcgctcagcccaatccgaaaatatggcattccaaagaagaaattgcgcttagcgcgaagggcttgctcagcaagaccccttcagctaatgaacaggggttgttgcgcttagcgcaagaagtgactcgctcagcgcgtaaaggaccattcgcttag

SEQ ID NO: 55513 - DNA, 609 bp, Glycine max
  Peptide Sequence Number=SeqID_172291
atggaggtgcaggtgggccaattagctaagaaactggctgaaaggtccacaagaagttttgtggccaacattgagaagaatcctaaggaagttgcaaggcggttctctctagaagccaaaggagggagaatgctgagaaagaaaaaagggctaagtgagtattggaggatgaatctaagaattgctcctactaggatgacccttcagctagcaaaccactccatcacaagaccatatggtgtagttgaagacgtcttggttaaggagaaggatctcaaagcctgtctggaggacttagaccgattgaaggatatttccttaggggagtatgcctttgaagaattgaagaaagacaacctagcagagaagcccaagatggagttgaaagttgtacctaatcacctaaagtatgtgtttttggaagaagatgaagacaagccagtagtgatcaacaatgacttatcctcagttgaagaagcacgattagtagaagtactcaaaaagcacaagaaagctattgggtggcatatctcttatctaaaaggaatcaatctttcctactgcatacacaagaccatgatggaggacgactatagaccagtaagataa

SEQ ID NO: 55514 - DNA, 642 bp, Glycine max
  Peptide Sequence Number=SeqID_172292
atgacaagcctcagtgccacaacaaaacctacagaagttcaatcaccatcagttacaaaggctgttctgcctacaggaatagcagttttggtcaagaagattgagtgggaagagaggagcagcaaggttgcgtcagaatttataataagactgggaaatgcaaggcacaagaatttagtcagattgttggggttttgccacaacccgcatctattctatcttttgtatgattacttgcctaatgggaacttggctgagaaaatggaaatgaaatgggattgggctgcaaaattcagaacagtagttggaattgctagaggactttgcttccttcaccatgaatgttacccaactatacctcatggtgacaaaaaggccagcaacattgtatttgatgaaaatatggaaccccatttggtagaatttgggttcaagcaagtattgaggtggagcaaaggctcatcacccaccacaaataagtgggaaacaggcgcgagctccactgcacggaacggatgttggcgagggaccgcgaggtttgagggagacctcgagggagagaggggtttgagggagagctcgaggttgagggagagaggggttagacctaggcaaaacaatggtggaggcaacaaaggttga

SEQ ID NO: 55515 - DNA, 411 bp, Glycine max
  Peptide Sequence Number=SeqID_172293
tcggagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatgcccgtctatccgctacaaggtcaccgctcgtgcgtcgaaaagggaaagggagtcaagaacttccccgattgctagccaaggccaaagcagtggcggacacctactccgcccccgaggagatccacagacttctcagctattgtcagcatatgatagacttaatggaccatatgattag

SEQ ID NO: 55516 - DNA, 1029 bp, Glycine max
  Peptide Sequence Number=SeqID_172294
atggtggaagatgaagccaaggacattaagaatgttcctttaggacctatacacaaactaatagcagagaacaccaagtcaaacagtttggttataaagaaaccacatgtggtgattcctcctcatatcatagcagaagccatatcaacgatccgtgatattgacattagatggtcaggtccaataacacagaaagaaatggaatatgttgaacagtatgtcttggcaaagtaccctgaatatgccggcctaattgaaggggatgggaatggtatagacatgtctagctttattatcaatgaggagccttcagaacccttatcagatgacaggaagaaatcgccaagagggacctttagagaacctttgtttggcagtaatctccctgaaatggataagactcaattggagccatcaagactactagatattctcaacaaaaagtcctcctttccaggaagtttcatctcaatccctgaaatccaagcccaaaacaaggttttgaagcattgtgggttgcctgatgatgaatatctggttctcttcactccaagctacaaggatgcaatgatgttggtgggggaaagctaccctttcgttaagggaaactactacatgacaattcttggtgaagagaaagactatatcagggaatttgcttcttttaaggagtccaaggtgattctggcacccaagacttggctggatttgaggataagagggtctcagcttagccaaaattttaggagaaagtgtaaggtcagcctgaaaggtttatttgcttatgaagcagacgtgaacgggacaaatcattgggtctcagaggctcataggaactactggcatgttctgcttgatgcttctgcattggtgctgggaaaggacaggctacatcttggtcttcacaggcctgacttcttagtctgttgtcttcatagcactcactccaatccttcaagaatcacttgcctcttggtgagaacgaaatcttttggcacctccactgcttcttctcaggtcaatggctga

SEQ ID NO: 55517 - DNA, 933 bp, Glycine max
  Peptide Sequence Number=SeqID_172295
atgaaagggatgaatctcaccaaaaagaaactcatccctatccttgttttgatcctttcagtcatatcaatcctcagacttctgagcctcaatgtcaagactttgcctttttcggctaggatatctgttttgtccccagctcctcaacacaattgttctcaacctttgtccacctgcaacaaaactgcatcacatgcacctgaatcctcagatcagcctataaatactcccaacatcaccaccaccctgactgagaaagaattcaaagttctttctgatctcattgctcttaaatccccatgcaacctcctcatatttggctttcaaccccagtaccttatcctctcttccatgaatgcagctggtagcaccatctttctcgacgaagaccctgataaaataagcaaggtaagaaaaatctccaacaacactcaaatatacaaacttgagtataacatgccagcaaaagcaggttacaaacttctcaagaacgcaaggctgaacccagcgacatgtgtaccaaatcctagattccttcaaaaatcaaaatgcaagcttgcattgaaaaacttgccatcgcaagtgtatgagaagaaatgggatgtcatggtggtagatggtcccaatggggattcaccagagtcaccaggaaggatggggtccatttacactgctagtgtactagctagatctggaaatacttcagatgtagtagtacatgatgtagatcgtatgatagaaaaatggttttcatgggagttcttgtgtgatgggaatttgttgtattctaaagggaagttatggcatttcagaatcaaagttcactcaaattccacaagattctgccctgctgaggaagtggctcacatgatacaaagtgtgaggcaaaattcttttcagatgaaaagagatcacttcctccaaggtgactga

SEQ ID NO: 55518 - DNA, 291 bp, Glycine max
  Peptide Sequence Number=SeqID_172296
atggccgacgaagttgtggttgttccagatcccacccagatcaatgttactgacatttcactggctgattacgttgaagttgcggcatccaagcacgccacatatgttcctcacaccaccgaaaagtacttggtgaagcagttcagcaaggtgcggtgccccattgttgagagtctcacgaactctctcatgatgcacggtagaaacaatggcaagaaactcatggctattaggatcatgaagcatgctatggagattattcatttgttgactgaccacaaccccatttag

SEQ ID NO: 55519 - DNA, 768 bp, Glycine max
  Peptide Sequence Number=SeqID_172297
atgtcatttggcttatgtaatacaccggccacttttcagaagtgcatgctagctatacttgctgaaatgctagaaaagtgcgccaaagtttttatggagaatttctcagtctttggtccttcttttgactactgtctgactaatctcgagcttgtgctaagacattttattgaagaaaatctgtgtaaagaatttgagcttatgtgtggcgctagcaattatgtagttggtgtagttctaggacagtggaaggacaagaaggagatgctggccatagtctacgcattagagaagttcaggtcatattttgtctgggatgacccatatttgttcaaaattggagtggataatcaactaagaaggtgtgtcaccaaagaggaaactagaagcatattatggcattgccactattctccttgtggtggacattacagtggtgataggacagttgctaaaagagcagggggcatctctcggaggaatgagatgccattacagaacataattgaagtagaaacaaatggccagacagaggtttccaacagagagctaaagaggattttagaaaagactgatgcatccttaaggaaagattgggttgtcaacttatcgatagagctggagcataaggcttactggcaaaagctaccgctgttagagctgaaggaaatgatgctcaatgcttatgaatcctccaagatttacaagcagaagatgaaggtgtatcatgatagaaggctactaaagaggaccttacagctaggataa

SEQ ID NO: 55520 - DNA, 453 bp, Glycine max
  Peptide Sequence Number=SeqID_172298
atgggaagaaatgaggctgcccagatccatgtccatttatatcaccaacccataaatgagtcgatcatgcttgatgttgacattggaagtgtgagaggtaggagcaaggttgaagtagcaaaggaggctccaagtctgggcgagggtggtgaggtcttttcgcaaaatcttccacggagcccgtcgatgtttggagtgaactgcctgcccagtgtggaggtactaggaggaggcatggcaggtgaggcttatgtgtcattgcctctgttgaagttccctatagaattcattatacatcatggaggcgagctccatgttcctctccagaagaatgtttcggaggtgaaagttgtcctggtagcagagccaagctgcctcaaaaacaaagtgagaggagtcccaagtgggctcctctatttgaggttaattgggggatgctctatgcttcgttga

SEQ ID NO: 55521 - DNA, 1128 bp, Glycine max
  Peptide Sequence Number=SeqID_172299
atgttcagcttagcaagcacttaccagctaagccaattatgcagaggttgcagttctgcaacttccgctaagcggcttcaactgtcactaagcggaagtgtctatgttgtgatggtgatcttagcggaccatgtctcgatggcttctaggaaacgtaaaaataatgtcctggggagaaacattttacccgagaggaaagtagagatatatcaaattgagctagatgagtttaagtctgaattggagaggcgtaatttccataaatgcctcaccaatttagtcgatggcagcatagacttggctttggtgaaagagttctatgcaaatttatacagttctgaggaccgtccaccaaagcagtctaaagtcagaggtcatttggtgaaaattgatgctgaaagtctcaagatattcctggagacacctgtggtattagccgaggggcagaccttacccgcatactccagatactgtaggttgcctacagactacagagagatagaggctgccttatgcatacctggccgagggtttatcttcaactctgaggaccatcctgggaagattcttaggaaggatctgactacactagctcagatgtggagtgtcctctcatactccaacttggcccccacatcacacacttctgacttgacagtggatagagctatgctgatctttggcctagtctctcgcatggatatgaacataggagcgttgatctctggccagatgacctctatagcccagtctagcacttctagacttgagttccctgctctgatcaccgcattatgtagagacagaggggttgtctctgatagcctcacttttgagcgtctgagcccgttcattaacttggcctacatcaagaagaactattcgaaccccgaggatctaacagtttctatccgaggggttaggagggcgagggctaggccaactgagctcccttccacttctgcggctcctactctagcatccacgtcagtagctccttctattccagcccagacagattctcagcgctttgaagccatgcttcatagtatccatcagggacaaattattcttttacagagtttacaggtggtggcgtctccaggatctattccctcagtcgagtag

SEQ ID NO: 55522 - DNA, 224 bp, Glycine max
  Peptide Sequence Number=SeqID_172300
cctggcccgagactcagcccccccttcatagggaagacgaaggtctcaccgctcaggtaccacagcagagggaggatgagtcatcagagacttccatgccaaagcccctaatcagaaggaagagggtagttgaaacacaagaagctgcagccacgtctaaaaaatctcttgaggacactgctgagccttcagaacctgtggcaaatacgacttcaattcagtag

SEQ ID NO: 55523 - DNA, 679 bp, Glycine max
  Peptide Sequence Number=SeqID_172301
atggcaggcggcacgggagggcatgtgtatccggccatcgccgtggccgacgcgttgcatgcgcaaggctggaaaattgtctggctcgccactgaagggggtatggaaaatcgcctgattgccgacaagccctatgacaaagccatgatgaccatgcaaggcgtgcgcgggaaaggcttgatgggctggctgactttgccggtgaaactggcccgcgcatttgcacaagccagggaggccatgaaacagcatcagcccgatgtggtgttgggcatgggtggttttgctgcgtttccaggcggtgtcatggccagattggcaggagtgccattggtgattcacgagcaaaactccattgccgggctgaccaataaagtattggccaagattgcgagccgtgtattgactggtttccccaatgcattgggcaccaaaggtgagatggtcggtaatcctgtgcgcgaggtgattaccaccttaccagtcccggagcagcgttttgccgaacatcatggcgtgttacgggtgttagtcgtgggtggtagcctgggcgccgtggcgttgaacaccttgctcccgcaggcgtttgcacaattgcctgtcaatgcgcgtccgcagatcattcaccaggccggtgagaagcaaattgaagcgcttaaaaagaattatgcagaggcag

SEQ ID NO: 55524 - DNA, 1017 bp, Glycine max
  Peptide Sequence Number=SeqID_172302
atggggtttttccatctgcaagctctgggttccaaggcaaggagagcactgcgagcattaaagggattggtgaagttgcaggcattggtgagaggtcacattgagaggaagcgcacagcggagtggctgaaaagagtgcaagtactcttacatgcacagccacaagtttctgcagggttgatcctgcatgcctcaccttcgggttcaaagttatctagccacctccatggtccagaaacacccgaaaaatttgaaagccctatcagatctaagagcatgaaacatgagcactcacctatactcaagagaaatggctccaaatcctgtgtccagatcaatggctatcaagagatgtgtgggagtagatcagagagtcaagtgaatgaacaatcatggaactcaggaagatcattgaatagaacatacagctccaatgatgaaagaaatgacagagttcttgaagttgattctggaaaaccacacttcacaataaagcgcaaaaatctctctttctccacaggttctgatctttatagtaagagtttgaacagcacaaaggaatcaacatctcttcaatctggtcaaagttcatgctgtgaggttcagtctcacagttacacctcacaaaaagtgaatgaggttgaggagagtccattctgcactgctgacaatagtccacaatatttatctgccacttctaaagatggtggcttcaaaagaagcccttttactcctactaagagtgatggctctagaagctacattcgtggttaccctgattatccaagttacatggcatgcactgaatcttcaaaggcaaaggccagatctctgagtgcaccaaaacaaagacctcaaagtgagaagtctggttcatctaatagatactcacttaatggatttgatatgtcaagattggccacacaaagggcaatgcaagcaagcttcaccaacaaagcatatccaggttctggtcgtttggacaagcttggtatgcctgtgggatacagattctga

SEQ ID NO: 55525 - DNA, 1108 bp, Glycine max
  Peptide Sequence Number=SeqID_172303
atgaagtgttcaaaggttcaagatgaaaatatagaaaaccttgagatggacctgatggtgtgggctatgctttggttgttcagcttaccatgcagagagagtgtgtgcatcccaagtgagcgtgagacacttttgaagtttaagaataatctcatagatccttcaaataagctttggtcttggaatcataataataccaactgttgccactggtatggagtcctctgccacaaccttacttcccatgttcttcagcttcacctccacacttatgattctgctttcgatcattcctatggattcgatgtgaatgcttacgagagatcccagattggtggagagataagtccttgtttggctgatttaaagcatctgaattacttggacttgagcgccaatgaattccttggtacggcaattccttctttccttgggacaatgacttccttgactcacctcgacctctctgatagtggattctatgggaagattcctcctcagattgggaatctctcaaatttggtgtatcttgacctgagagaagttgccaacggaagagtaccctctcagatcgggaatctctctaagcttcgatatcttgacttgagcgacaattatttccttggagaaggtatggcaattccttctttccttgggacaatgagctccttgactcagctcgacctctcttatactggattcatggggaagattccatctcagattgggaatctctccaatttgctctatctcggccttggaggtcattctagtcttgaacctctgtttgttgaaaatgtagaatgggtatcaagtatgtggaagcttgaatatcttgatttgagttatgcaaacctatccaaagcatttcattggctacacactctccaatctcttccttctttgacccacctatatttttcagaatgcacactccctcactataatgaaccatccttgctcaacttctcatctctgcaaactctccatctttacaataccagttattcccctgccatttcttttgtccccaagtggatattcaaattgaagaaacttgtttctcttcaattacagggtaatgaaatccaaggtccgattcctggtg

SEQ ID NO: 55526 - DNA, 4173 bp, Glycine max
  Peptide Sequence Number=SeqID_172304
atggatggtcgcgccttgtcttggttccaatggatgaacggtaaccgccagtttacttcatggcaaggcttcctacaggcgcttcaaactcgttttgctccgtcgcagtacgaggatcccacggggacccttttcaaattaacacagcgaggcacggtggctgaatacctcgccgccttcgaggaacttgcaaaccgtacgattggccttcctcctccctttttacttagctgctttgtttcgggactcacccccgaaatccgccgtgaggtccaggcccaccagcctcttacccttgttcaggcggcgggcctggctcgtctgcaggaggaaaaaattatggacgcgcggccccagcaacgccccaaaccacctccaccttttccctctccctccttaacacagccccttcctctcagaaccattaaccctagccccacccctcttttacctagccctccccatcccacaccacccgccgtcaagcgtttgaccccggaagagattgcaacccgcagggagcgcgggttgtgtttcaattgcgatgagcgctaccacagggggcaccgctgctcttctcgtgtttttctcctcatctctgaggatgaagaccctccaccacttcaaatacctcagcccaacccgcaacccgaacccgaaacacccatacccgacccgatagacccgtacccggcccaaatcagctttaactctttagccggaaatgtcgcgcctgaaacgttgcgtttcatggggaccatcggaaaccgccatgtggtactgctggttgacggcggcagtactcacaatttcattcaacatcaacttgtttctcaattaagcttgatccctcgcaccaccacccctttgcgagttatggtggggaacggacaacaattagagtgcaccagcatctgtgaatccgttccggtcaccattcaagccactgaattcatcgttgacctccatgttcttccaattgcaggagctaatgtggttttgggcatccaatggttgaaatcattgggccctgtgctcacggattacaactcactgcgcatgaaatttttccatgcaggcactttcgttgagcttcagggggacacagagaccactttgaactccttatcatcctcccagttccatcgtcttcttcagcatcaacccgagagtttatacttccacattgctgtcctccatgacgacacttctacactcaattccgatattgaccccgtcattcaggacctcattaatcgctttcaacctctcttccaggtccctgagaagcttccgccggcgcgacccaccgatcatcgtattcatcttattcctaatgccaccccggtgaatgttagaccataccggtacccacattttcaaaagcaggagattgaaaatcaggttgaactcatgctccaaaagggcttaattcaacccagtaatagccctttttcctcaccggttttactcgtgaagaaacaagatggtacatggcgtttctgtgtggattatagggccttaaattctctcacagtgaaggatcgatttccgctacctactattgatgagctcctggatgagctcgagggtgcccgctgcttttctaaattggacctacttcaggggtaccaccaaattagaatgcattccggtgatatatctaaaatggcgttcagaactcatcatggtcattatgagttccgtgttatgccatttgggctctgcaatgccccttcttcattccaggcaaccatgaattccttattccggccgtatcttcgtcgattcattatagttttcttcgacgacattcttatatatagcgccacttttgcagagcatctcactcacctcgaagtcgcctttcaggtattgctaagccatcattttgttctgaagctttccaaatgttcatttgcacaggcccaggtcgagtacttgggacacatggtgtccttcgaaggagttcaacccgttccttccaaaatttcagcaatacagcaatggcccattcctcagacgactcgagctgttcgaagcttcttaggcctcgcaggcttttataggcgcttcatcaggggatatgcttctcttgccgcccccttagtagccctcaccacttcagacaagcttcactggtcagccgaggttcaggctgcttttgataaattgaaatgtgctttatcacaggcccctgttcttgcattgccggattttagcttaccctttcaggtggaaacggacgcttccggggttggaatgggggcagtgctttcccaacaaggccaccccattgctttttatagcaaaccattcactgctaagcttctaagggcatctacgtatgtgcgtgagctatttgccatcaaggcggctgtaaaacgatggcggcaatatctccttgggcatcgttttatcattgtcacagatcataagagccttaaggaattgcttactcaggctgttcaaaccccggaacaacatacttatctagctcgattaatggggtatgattaccaaattgtatatcgctccggcagtcataatcaggccgccgacgccttgtctcgtctcccggagcaaagatcttccttgatgatactctccgtgccctgtctcacgtttatctcagagcttcgtcaacaattggattccctgcctgagtatgtagcccagaggaacgcgattctgcaacaccccctgagtcatcctcatttctccattaccaataacttgatccttcataagaatcggatttgggtaccccgaggatttccgatgatacctactttaatcacggaatatcactgcactccgactggaggtcatatgggcattgccaagactcttgctcgtatcacagaaaacttctattggcagggccttcgggatgacgtaacccgatttgtttctcagtgtcttccctgtcaacagacaaagtatgaaacgaagagaagcgcgggtttattatgccctttgccggtaccccaccgtccttgggaagacctttctcttgatttcattgccggactccctccataccatggcaatactgtgattttggttgttgtcgatcgtttttctaaagggcttcatttgggcatgctcccgacatctcaaacagctcacgcggtggccactttattcatggaaatagtcggcaagattcatgggctcccccggagcttggtctccgacagggatcccctatttgtcagccaattctggcaggagttattccggtacagtgggacgcagctccgcatgagctccgcttatcatccacagagtgatggtcaaacggaggtcatgaacagggtaattgagcaatatttaagggctttcgtgcacagcagaccgaggacttggggaaagcttctcctatgggttgaatggtgtcacaacaccgcatggaatgccgccaccagttcgaccccgtatgagatcacattcggacgaaaaccattcaattttcctgattatctgatgggaacctctaagatagtcgcggtggaggacatgattaaggagagggaagaaacgttatgcatcattaggaagaaacttctaaaagctcagggagctatgaaaaagtccgctgacaacaagcgccgggaagtggtctaccagcagggagattgggtccttcttcgactccggccacgtcgccaagcttcagctaagggagtctttgaaacaaaagggaaactagcaaagcgtttctatgggcccttcgagccatttcacggcgacccaacctctcccggaaccaatgaggtcactaaattgcctattcaattttaccagaatcaacccctcgcaattccgttagccattttggatcatagaaggcatcctcagacaggagaatgggaagtcctagtgcaatgggaaggactctcgccggacgagacttcgtgggaagattggaattctttacagcaagattatcaccttgaggacaaggtgactctgcaagggccaccgaatgatagaatagcaaatgcagaggaagaaatgaacgaagccacagaggacccgagcacacaagccaacacagaggagtcaaacatacaagtagatacaggggagcctaattcaaaggtgcgaatagcaagtaaatccaagaggaaggttgtcaggcccgcttacctcaaggattttgtgtaa

SEQ ID NO: 55527 - DNA, 2076 bp, Glycine max
  Peptide Sequence Number=SeqID_172305
atgggtcgtgagtttgcggatggcttcttcaagggtaaggggagagtcagccatggaggagggatcaacgagagcaccaagatgataggggaagaactagaagactggtttcgaggaatatcagcaatatcctttattgttattctgatcatcctacgtggcagcactaagagcaacagctatattcccatacgccttcagaacataaaaaatctagacctgcagaacaaccagctcagtgggccacttccagattcattaggccagcttaagcatcttgaagttctaaatctcagtaataatacctttacttgtccaagtccctcaccatttgcaaacttgtcatccttgagaactttaaacctggctcacaaccgactgaatggaaccattcctaagagttttgagttcctcagaaacctgcaggtattgaatcttggaactaattctttgactggtgatatgcctgtaactcttggaactctctcaaatttagtgatgttagacctttcatctaatttgttagaaggatctataaaagagtcaaattttgtaaaacttttgaaattaaaggaactacgtttgtcttggacaaacttgttcctcagtgtcaactctggatgggttcctccttttcagcttgaatatgttttactgagctcctttggaataggtcctaagtttccagaatggctaaaaaggcaaagttctgtgaaggttttgacaatgtctaaggcaggtatggcagacttggttccaagttggttttggaattggactttgcaaattgaattcctggatctgtcaaacaatctgttaagtggagacctatctaacatctttctcaattccagcgtcataaatttgagttctaatttgttcaagggtacattgccaagtgtgtctgcaaatgttgaagttctgaatgttgccaataactcaatttccggaacaatttctccctttttatgtggaaaggaaaatgccactaataagttaagtgtgcttgatttttcaaataatgtcttatatggtgatcttggtcactgttgggtgcattggcaagcattggtgcatttgaacttgggtagtaacaatttgtctggtgttattccaaactccatggggtatctatctcaacttgagtctttgttgttagacgacaaccgcttctctggatatattccttcaacactgcaaaattgctctataatgaaattcattgacatgggcaataaccaactttctgacgcaataccagattggatgtgggaaatgcaatatctaatggttcttcgtctaagatccaacaatttcaatggcagcattactcaaaagatttgtcaactttcttcccttatagtgctggatcttggcaataacagcctgtcaggatccattccaaattgtttgaaagacatgaagacaatggctggtgaagatgacttctttgccaaccctttaagttattcatatggctctgacttcagttataaccactacaaggaaactcttgtcttagttcccaaaggagatgagttagagtacagagacaatctgatattggtgagaatgattgatctttcaagtaataagctgtctggagcaattccatctgaaatttccaagctatctgctttgcggtttttgaacttgtctagaaatcatctgtctggagggataccaaatgacatgggaaaaatgaaattgttagaatcccttgatctctcactaaacaacatttcaggtcaaatccctcaaagcttatctgatttgtccttcctcagtgtcctgaatctatcatacaacaacttatcaggcagaattcccacgagcacccaacttcagagctttgaagaacttagctacactggaaatcctgagctttgtggtcctcctgtaacaaaaaattgcacagacaaggaagagttgacagagagtgcttctgttggacacggtgatggtaatttctttggaacatcagagttttatatcggtatgggagttggatttgcagcaggattttggggtaagaaggttacatgggaaattgtgagtttacatgttaactgttag

SEQ ID NO: 55528 - DNA, 411 bp, Glycine max
  Peptide Sequence Number=SeqID_172306
atgtgtatgattcaaaagttggggatggaggctgtcaaagttaccgaattgaactatccattttataagacttatgggatgacgatggctggtctaagggcaattggctatgactttgactatgatgactttaacagttttgttcatgggagattgccatatgatgtgctgctgaaaccagatcatgttctcaggggcattttgcaaagcccgcttgttaggaaagttcttaggcttcaagccagacatgtggtgaagaaatgcaacagaagagtacaaatttggaaagtcaaatggcaacataaaaaaggtgttaagtattccacaaatatatcgtataggaactatgttatgttctgggatgacaagtttggagcacatggattatctgcagaacttttccaagcttaa

SEQ ID NO: 55529 - DNA, 579 bp, Glycine max
  Peptide Sequence Number=SeqID_172307
atgggttttctccttgctgcaaatggtcttttggttctttacattgccatcaacttgttcaagatttactatggtgatgattggggtggtctttttgaggccatcactagttatggtcttggtgggtcttctatggctttgtttggaagagttggtggaggtatctatactaaggctgctaatgttcgtgctgatcttgttggaaaagttgaaagaaacatccccgaagacgatctaagaaatctagctctaccattaccacaccttaaagttggatatttaactgcacctcctgtggggacatcgattgcacctcataatgactggaagcgatcaaatttccttttggatcacgaaaagcttcaacagagaaggcttcagttctggggttacagtgataggggcaaaatagctccatcagcctatcatatggcaccaaggagtgaagctccaagtcaggttcctcctcctgttcctgaagcaacagttggagctattggtgtctcacttgtgagtgtgggattggatggaacaacagctaagaagaaatctgattctattttagcaagggagtgttga

SEQ ID NO: 55530 - DNA, 615 bp, Glycine max
  Peptide Sequence Number=SeqID_172308
atggacatgctggactgcaagaggatgaagtcatcctccaatttggaaaaattgggaaggacttgtttacaatggattaccagtaccctatctcatcatttcaagcatttgcaatctgcctcaacagcttcgctaccacggttgcttgcgaatgatgcatgtttgaacatgtattcatctgaaaactcaaacattctaaaattagaaactatctttggacaagaaatggatagagagaaaacaaatgaatggtcacggaatgaacgagctggtggagacgttagtatgaaccttgattggaaaactggaattgcagccaaggattgggattcagttgctaaaaaagaaaagattgagaaaggtcaggatgctgatgcaagctccattggagcttgtaggcctaggatcttcttcatcaatggattcctttgcttcttggaagatgaatggcagcggaataaagaaaagaagagagagaggagacgccacttcaaggagaagatgagtctagaagaagctcaccaccataggaggccattgataagagcttggaggaagaaggagatgagtgaagggagagggagagaagagcacgaaattttatgctccaaatga

SEQ ID NO: 55531 - DNA, 384 bp, Glycine max
  Peptide Sequence Number=SeqID_172309
atggaggcaacctcaggaacacgggtcctagcatattttggggacccaatcaagggccccgtggtggggaacttggggggggggggggggggcagaggaagggagttttgtggtcctcactccttcacctactttagtctcttcactgatcagcttgtgcagtgcatttcacgtgttactttgtctatgaacattcttacaagttcactagtagttgtgataaagcaattgggcttgtcgtatgcaagaacaaacacccgtaaaacgcgccttctccctactacatgtaaggctttcacatgcacaattgagagaggtgttggacagcataggtcaacgacgtttcagtcctatttaccttttggacccgtaacaaacaagtga

SEQ ID NO: 55532 - DNA, 717 bp, Glycine max
  Peptide Sequence Number=SeqID_172310
atgtcatcatcagtctttcaaggtggtttcaacttcagctcaaaacttcaaaatcttgatttgcataattgtagtcttacggatgaaagttttcttatgtcatcttctttcattatgagttcttcatcttctcttgtttcccttgatctctcctcaaatctgttgaaatcatcaactatattttactggctctttaactccaccaccaatcttcataagctttccctttatcataacatgttggaaggtcccattccagatggatttgggaaagtaatgaactctcttgaagttctttacctctacggtaacaaactgcaaggcgagattccatctttctttggtaacatgtgcgcattgcggagtttagacctctcaaataacaagttgaacggggaattttctagcttcttccgaaattcttcatggtgcaacagagacatatttaaggagttggatttatcttataaccggttgactggcatgttacctaaaagcattggatttctatcagagttggagtatcttatcttggctgggaattctttggagggtgacgtcactgaatcccatctttctaatttttccaaattaagatacttgtacttatcagagagctcgttgtctctgaaatttgtcccgagttgggttcctccattccaattagaatcattgggaatcagatcttgcaagttgggccccacttttcctagttga

SEQ ID NO: 55533 - DNA, 336 bp, Glycine max
  Peptide Sequence Number=SeqID_172311
atgcgtttgaaggtgaaagaagtgatggaagacatcgttgcggatcttaagtgggcagtggtggaatatcagagtgaggtggaagagtgggttgaatacttactggtggttgaggttggacgggtggaagtggcattggggattcagaatgagagattcaccaaggctattgaattgagtagcgatagcttgttacatggtgcatttgaactcttcattcttagccctttgcttctcaacaaagctgtccatagccagtccaatcatctcctttactttagttttagttactacttctggaggagcaaaattgatttgagtgtgttaacgttttaa

SEQ ID NO: 55534 - DNA, 1395 bp, Glycine max
  Peptide Sequence Number=SeqID_172312
atgaagaagaagaaggtgcaatggttctggacttgcgttcttggttccattgttttgaggctcattctactctactttcccaaaaacctcaacctctcttctcgccccgaagtctccacccccctcaccagcctccgtcaccctatgccgaatctcaggctcttgttcgtgttgccaggatcaatgtaccatggttcccctttgttattgacacttctcggtccgctcacagttaaaagtttgaaattcctatggtataatgactttgaatactttgttgatgctacagaattgaaggacaacctgatcatcttttatgcagatgtggtcagtgcaatgcttatttgtgctgctggtgaaaaactcaaggtggcatgcagttcaagcttgcaatcccttggccttcataatttgtcagagaattcagagcgtctcccttcaggagattttgctgctcttgtatacttatggaatcctttcacaatagtggcatgcgttggtctatccacatctgcaattgagaacttgatggttgtgttatcactctatggagcatgttcactcattgccattgaatttacaagtcttcatccatctgttttcctattgctatacttagcagcaagcatattagattttggaaatgctagactagctccgctggcagcttttgggtgggtcatggctacacacttgtctctgtaccctgcaatccttattatcccagtgatattgctattgggatatggtcctgatgctcctcctaggaaattattctgtcaaaggaaaaatcttgaagttggcaactctaccccaagtgatagttgttcagaagaggaagcaaagaatcagctaaaggtggcaaatgtattctcatggaggccagtggtgttttttttgttctggactttgctgtggtcatcctacgtcttggtcctttgtggcatatgtgtccaacagtatggtggtctacatgagttgttcaaaagaacctatggctttattcttaccacacaagatctgtctccaaacattggtgttttgtggtacttctttgcagaagtttttgattttttcagaaatttcttcctgatagtatttcatgggaatattctattgatgatagcaccattagccttacggcttaatcaccggccgtgctttctagcttttgtatatattgtgatatcttctatgttgaagtcttatccttcagttggtgattcagctctgtatttgggtttacttgggttatttgcatatgaactcaaagatatgcagttttcattcttcctgttttctggctatgttggggtttcacttcttagccctgtgatgcacaatctatggatatggagggtatggaattttgtggtgttctaccctttcaaatag

SEQ ID NO: 55535 - DNA, 303 bp, Glycine max
  Peptide Sequence Number=SeqID_172313
atggaaacgcaaacgacattgagggagaagagtgcttacctcgacaatgtcggcgcgctgaagaagaagaacgaaccaatgggccaagaagcagaggagaagacggcgctgcaaaatggagttgggtggaagaagaagaaggtcgtgaaagaagaagaagaaggtcgcatatcaagttgggtgaagcttgctgggtgcacaagagaaacaagaagaagaagatcacagaagaaggaagaagtgctgggtgcaccagcaataatgcttggtgcacctagcagcccccctttattaaacctctaa

SEQ ID NO: 55536 - DNA, 873 bp, Glycine max
  Peptide Sequence Number=SeqID_172314
atgagtagtctagagaaaaatgttcctcagaggttgaaaaactcaatgaaactgatgatgaagaagacatgttcaagttgctgttctaaaaagaaaggcaaattccaaagctcaaacctctcctgccccaaagaaagcaagaattgccccaaagaaagcaagaattacctacaacaaaagaagttgtcattccttccactgttccatgaagagtcaagaccaaagccaccaaagctaatcccaagaatggactacgctcaaatatatgttcgctatcaagcaactacttatccacctggattgcacatctcaaaggccaccaacatcaagataattgcaaataagatgtgtccttggttacctatttgggatgccttctcatctgtttatgatggaagtgacaatgctaatcaccatgacttcattcaagtgttgtgtccaatcaggatgtatcatgagaccaccacttatgatctcaccaaaatggaggaaagaaagttcaaagatcatatgctcaagtccaagtcgaggcttctgccaaagttgtggacaaaaaacattgttcatgaggtcattattgacatcactaacactagtgttatggatgagacccttaagctacatcaaggagaagatgcacctgacactatcattatttactctatcagttcagatcctactccactcaactatgctcatcccactgctatgactggaaatcaagtccaagagatgataggtcaagcaatggattcctttgccaaacaacaaaggcaagtaaatgagcaattcaagatacccatgcagaatgctattacaatgcaattctccaatcttggtgttgttctactccaaaatctacaacaagcttaa

SEQ ID NO: 55537 - DNA, 309 bp, Glycine max
  Peptide Sequence Number=SeqID_172315
atgacgatgcgagtgagggctttcaaagcagaactcaaacaaggtgaggtgagtagctcaacttcagcacaacacagagtcacgagtaagcctattcctgaaattccagaggatttgtaccatttgattaagaaggcagtttcaattaggaagcatcttgagaggaacaagaaggacaaggactccaagttcaagttgattcttattaacagcagaatctaccgactcgctcgctactacaagactaaagaagctcccgctagtttggaagtagtaagttccaagttcccacccattaccctactatga

SEQ ID NO: 55538 - DNA, 219 bp, Glycine max
  Peptide Sequence Number=SeqID_172316
atgacctatttacatggcagtttagctctgtttgaatgttacttagaccagctcatgtacaaagagcatccactggcagatttgatgttgataggcagcacaaaagaacccaacttccaaccgaatctaggatttcaaaatgaagttaaggaatcttgtgaagataaacatcctatcaagagtgtcacatacaagtttgacaagactctatctccatga

SEQ ID NO: 55539 - DNA, 390 bp, Glycine max
  Peptide Sequence Number=SeqID_172317
atggcatccagtcaaagttcagaagttggagcgtccactcaacatctagatgatcctcaagaagaagcaagcaaacctattagactcttcatgagaagaaatcttctagaaagccaaatcattggtgatccaatagactgtgtacaaacaagatcatcacgagggcacactgcattgatttcaaaggtagaacccagacatattgatgatgtaatgcaagacgatagttgggtaaaagctatatgggagaaacttgaccaattccaaaagaatgatgtttggaagttagtagagctactgaaaggaaaaaaggttgttagagaaaaatgggtctttcataacaaactagacgaaaatggtaatgttgttatgcacctatggctcttctag

SEQ ID NO: 55540 - DNA, 357 bp, Glycine max
  Peptide Sequence Number=SeqID_172318
atgtcagttgaaattatagacactttacccagttttggaaagttgaaagaattggaaacaaaattagcagccaaagaagtctcactaccaccagaaccatcctcagatgatgataatgccgtgaacttgatggtaaaaatgccagatggcaatcgtcgtggacgtcgattcctaagatctgataggctacagtctctttttgactacatagatattggtagggtggtgaaaccaggcaattacagactggtgagaccatatcctaggcgtgcttttagtgatggagaaagtgctgcgacattggatgaacttggcctaaccaacaagcaagaagctttgtttttagagttaatctga

SEQ ID NO: 55541 - DNA, 324 bp, Glycine max
  Peptide Sequence Number=SeqID_172319
atggataaagtcaaagtatttgaagcacatattgattacattagcgcagccacaccgttcttgctctcactctcgcgctttcgttctcacaatcactctcgtgctctcattctcgctctcactcacaggtctatttactctcgttctctcactctcgtgctctcactcactcacgaaaggactttgtgttggtgtgagaattctgccacagccttaagcccccaaaataagaatatcattcttggttttcaaaaatgggtatatgcattgtgtcttttaactaatacttcatggcatgtactcgaccaaactcatatgtcttga

SEQ ID NO: 55542 - DNA, 279 bp, Glycine max
  Peptide Sequence Number=SeqID_172320
atggctcgtcatcgatgtcatcgcttgaaactcagacgacacgttgtcaccattattgagaagccacataatcacttggatatgcaccaccacttagactccaaaggccaacatcaaggaaaactaatcgattacaggtacatgcatatgcctgtgcagattcaatcctaccccccaagggcattggatagaagactccaagaagattgggccagagatgcaagagaaggtcctatggttctcttgaggcttagggtagatttcaggcccatgagctaa

SEQ ID NO: 55543 - DNA, 516 bp, Glycine max
  Peptide Sequence Number=SeqID_172321
atgatggcacatcactttgcatttgatgttttgatgatgccatatgatcgtgatgatttgatgtcttatgaaaatgcgcttctcaagtttaattcaagacaacaatccaagaatacaagatacaacatcaagaagatctctagtattttaggaagggaattccaaattgaaatagcaaaaggtttgaccaagaaatttaagttaaaaagtctttttcaagagatttattctctggtaatcgattaccagaggataacttgtaaagggattttacaagatagtggaactctcaagcgggttgcttggggacaggacgtaggcacaaggatatttgaggtcacttttccaacattgtggatattccccattttgagaagattgcagaagctgcaacttccaaagatcgaagcatgggacattctagaaaagggaaatgtcggtgcaaatcaattgaagaaagtaaggtttcaaaccatgaggcgtcaatacgagctaatgcaaatggaggatacataa

SEQ ID NO: 55544 - DNA, 222 bp, Glycine max
  Peptide Sequence Number=SeqID_172322
atgtccaacaaggagtgtgtgggattgcatttcttgggtattatggactacaacaatatcatcttcagaggcgacgccgattgggtggcgcggcggcggcggttcagggtgacatcgctggtgtttggtggagcggtggttgaggtagaaaggttgggattgcggcgcaaagagaaagaagaggtaggtcagcaggcttacgttatgggtaggtgtccatag

SEQ ID NO: 55545 - DNA, 270 bp, Glycine max
  Peptide Sequence Number=SeqID_172323
atgagagtaagtggtgatgaggtcttaatcactaagaccaagagtcagttagctcaggagctagcagaccgctctattaccagatcatatggtgtagctgaagatgttctgattaaggttcgccaattcacttttccagtggactttgtgatcacggacaaagaagaggactctgatattcccttaatactaggccgaccattcatgcttactgcaaaatgtgttgtggacatgagaaataaaaacttggagatgagtgtggaggactag

SEQ ID NO: 55546 - DNA, 243 bp, Glycine max
  Peptide Sequence Number=SeqID_172324
atgggctttggagatggtgtgagaagtcgtaggcgatgcttgagtgggttaggtggaccaaatgaaaagatggagcaaaggttggggttaacatggcaagtggtgattcgaggaggttggttggaacagattgtgcttgtttgcaaagattgggagaaagtgaataatgcaatcctatcccccaagggaattggatataagacttcaaaaagattgggccagagatgcaagagaagaccctag

SEQ ID NO: 55547 - DNA, 486 bp, Glycine max
  Peptide Sequence Number=SeqID_172325
atgatgaaggagtttgagatgaccgatatcggaaaaatgtcatactatcttgccattgaggtaaagcagaaagaagatgaaatcttcatttcactgcaaagctacgcaaagaagatgcttaataaattcaagatggatagatgcaagccaattggaacactgatggagtgcaaaatgaagttatcaaagttcgacgaagcaagaaaactggatgctatagatttcaagagtttggttacaatgacattgactgggctagagatgaagatgatcagaaaagtactagtggatatatgtttttcatgggaaatacaaccttcacttggatgtcaaaaaagtagtcgatatatagtcattcttttgacttgtaagccaaaatacgtagcagttgcttcatgcatttgtcatgcaatatggctcaagaatttgttaaaagagttgggcatgtcacaagaagagttgaccaagatctttgtcgataattaa

SEQ ID NO: 55548 - DNA, 468 bp, Glycine max
  Peptide Sequence Number=SeqID_172326
atggacgtgaagtctaccttcgtgaatggagtcctcgtggaagaagtgtacatcgaacaaccgttgggattaaaggtgaaattagaagaagacaaagttctcaagctaaagaaggctttttatggactaaaacaagcactgagagcatggtacagtcgcattgacaagtacttccaagtaagcatgaatggtcggcctagtattaagggaatatcagagtcctcttctttgtccgtgatcacaaagtccactggaaaagtgaattggcgaaccttaatcagaacatcttcagctacaccatatgatctgcgaagaaaccaccgtcattatcgtgaatgccgtctctgtccacctggaggatcagatccaaactcaaactccaacccacatttccggattgcctattacttcggaaacactctagcattggcgaccttcactgcagaaccaacttggaagtataattaa

SEQ ID NO: 55549 - DNA, 741 bp, Glycine max
  Peptide Sequence Number=SeqID_172327
atgggttcaatgagccagttcagcgaactggttcagctaaacatattcattaatggcttgcgaccccattccaagcagcttcttgatgcatccactagtggaaaaatcaaattaaagacacttgatgaagctatggagttgattgaaaatatgacagctagtgaccatgtcatcctccgtgatcgagcttacacacccataaagaagagtcttcttgagctcacctctcaagatgcactattagctcaaaacaagctcctagccaagcaaatagaggccctcacagagacgctgaacaagctccctcaacagttgcatgcagtgcaacctactcatcttttagtcatgcaaattgggggatgcaacatttatggtggggtccatgagtcaggcatgtgcatggctcaaaatgatgcatctaaagaagtcaactataagaccaatccaaaccaccaagggcaaaaaggagaaaatttgaaaggtgccgaagctgctatctcactaagcctggaccatgcgcttagcgagtatcaaccgctaagcgagacatcagcccacttagcgagtaagaggaatcttgagaagaatctatcacgccagcacgcgctcagtgcgtcatcagctcgcccagcgagaagtttgtttcttctggcacttagcgcgaaaatggcactaagatacaaaattcacttactcacgctaagcgcaaaaatggcgctcagcgtgccttcgaggacataa

SEQ ID NO: 55550 - DNA, 216 bp, Glycine max
  Peptide Sequence Number=SeqID_172328
gattgcatcacggtatctacagcacttggttcgccagcaggcggccaaccaccgggggcagatcaatttagggctgaggtcgcatggcccagagattggcccgaggcccaggaaggggaggcgcctgcagaggcttccggcgatgcagaggaggcccgcatagatgaggagatgatggatttgctcaatttcttgggagggagcagagccacatga

SEQ ID NO: 55551 - DNA, 906 bp, Glycine max
  Peptide Sequence Number=SeqID_172329
atgggtcttcgcttttcgtcttccgaggcggcggcgtcggaatcggcatcgccatcgtccagtttgggcgaattgcccgagagctgcgtcgcccagatcatgacctacatggatccgccccagatttgcaagctcgcaaccctcaatcgcgcttttcgcggcgcttcctccgccgatttcgtctgggagtcgaagctgccgcccaattacgacatccttctccgccgcatcttcgccgatttcccctcccatttgggaaagagggggatttacgccaggctttgcaggctcaattctctcgatgacggcaccaagaaagtttggctggatcgtggcatgggtaaactgtgtttgtgcgtttcggccaagggactctccataaccgggattgatgatagaagatactggaaccatatccccactgacgaatctagtgtgatctccttcaattgcagattcagcagtgttgcatacctccagcaaatctggtggtttcaagtggatggggaagttgagttcccatttccagctgggaaatacagcgtattcttcagaatacatctggggcgagccggcaagaggtttggacgacgagtttgcaacacggagcatgttcatgggtgggacaaaaagcctgttcgtttccagctatggacttcagatggacagtatgttgcgtcccagtgttttctgaacggaccaggtaaatggatcttttaccatgcaggcgattttgttgtcgaggatggcaatgcatcaacaaaagttaaattctctatgactcagattgattgcacacatactaaaggtggtctctgtttagattctgtgctcgtatatccaagtgaattcagaaaggccgcgtcaggaggaatagagaatcgagtttttaatatggttctttaa

SEQ ID NO: 55552 - DNA, 2504 bp, Glycine max
  Peptide Sequence Number=SeqID_172330
atggcctctactatcacatcactctgctctcgccttcgaccccttcctgcccaacagaccttcctgacgccattcaagccttactcaccaaatatgaggctctgttccaagctccttggaacctaccctcacctcgcgacactgaccaccacattcacttactgcctcatgcgagcttggttaatgtcagaccgtacctgtaccctcactatcataagcacgagattgaaagccaggtggatgcaatgctacaacaaggcgttgaataccctcatggtgcgtgacaggtttccaatacccaccattgatgtactcttggatgagttgggtggtgcgcgatgcttctcgaagttggacctcttacaagggtaccaccaaattcgtatgcaccctgatgacattcctaagacagcatttcggactcaccacggtcattatgagttcaaagtcgaatacttgggtcacttggtttcgcataagagcgtggagcctttagtcgcgaaggttgccaccatccttcaatggcccaccccacaaaccactaaggcactgcggagcttcttgggccttgcgagcttttattgcagatttattagaggttatgccaccatcgcagcaccgctagtcaaggccactaccatcgatccttttcagtggactgaggaggcacaaggtgcttttgatcatctcaagcgagccttatccgtagcttcggtactggtcctactggacttccaatttccatttacggttgagacagatgcctcaggtgttgaattgtttgcgattactaccactgtgaagaagttgcgacaatacttgcttggtcaccagtttaccattgtcactgatcattgtagcctcaaggatctactcactcaggtcatccaaacccctgaacaacacatgtacctggcccgacttatggggtacgactatgagatacaatactgttctggcacccataaccaggccgcggatgccctctcccgtctgccaaaacatggtccctctgttttcatgctcctctctgttccatgtctgaccttcatggacgagctacatcgtcaattggaaactgatcctggatatgttaaacgcaggcacgaagtcatgaattctcccacgacacaccctgatttgtccatctctggcaatctaattttgcactgtggcccaaagaccttagccctcatttctgagaatttttactgggtgggactccgagacgacgtcacccaattcgtggcaaattgtgttgactgtcaatgtactaagtatgaaacaaagaagttagcagggttgctatgtcccctgccagtgccacatcgaccctgggaggatctctcactcgacttcatcgttgtactgtcgccgtttcatggcaacatagttatcttggtggtggtagactgggaccctttatttgtcagcaagttctggcaagaactcttcaaattgagtggcacccacctgagaatgagttctgcctatcacccacagagtgatggtcaaactgaggtccttaaccatgttattgagcaatatatgtgtgcctttgttcatcgccggccagggtcatggggcaaatttcttccttgggcagagtggtcccataatacttcgtggaatgcggccacgagtacaaccccttacgagctcacctttgactggaaacccttcaatttcctagagtacattgcggggtcttcttccattgatgttatggatgaaatgttaatagctcgcgaggacaccttttgggccattcgcaagaaattattcaaagcacaggcctctatgatgctgcatgaagatagcaagaaacgcgatgtaagttatgaacccgacgaatgggtcttactcaaacttcgtcctcaccgccaaacatcggcaaaaggttcccaagctatctctggcaaactggccaaaagattctatgaccctttcaaagtcatagagagaattggcagggcggcatatcgcttgcaacttccagctgaaaccaagatccacccggtttttcattgttcattgcttaaaccgtttattggaactcctgaggatgaaaaaatagccactttgccgactcagttcactgatgaccaacccatcattactttggcatggcatgggttgtctctggatgaaacctcttgggaggattgggaccaacttcgccgggactatcaccttgaggacaaggtgattctccaagggccacggggtgataaggaagcaaaacacaccacagacacacgggtgcaaacagcaacaaagtgcaaatcatccttacttgatgcttgtcgggcagtaggggacaagcataacaaatctgatcctatcattcttctctgtggttctgatctcattcattcttttggcattcctggattctggattcctgaccaggaattggttcaagaatttgaccaagaaactgctgcagttgtaatggctagatttgcttctctgaaaatggagaatgaggcatggcatgagtt

SEQ ID NO: 55553 - DNA, 387 bp, Glycine max
  Peptide Sequence Number=SeqID_172331
atggttgttccttctaagtcttccacatccgttgataagctagaagctaccctcattcgcctcactaatcaacaactttccctcaccagccagcagctatcccttagtgaatccatgaatcacatgactcaccacttggatgaacttctccaccgtgtgacccctttcttctcctcctccactccaccaatttcctcgaccctcagccccaccaccacaatacctacagtaaaccacaaaatgaagttagatgttccaaggtttgatggaacagaccctcttggttggatcttcaagatcaaccaattttttgagtatcacggcacccccaaacatgaccagttgacgatcgcttcattttatatggagggtcgtgccttggcctag

SEQ ID NO: 55554 - DNA, 294 bp, Glycine max
  Peptide Sequence Number=SeqID_172332
atgaggagtatgcaaggttgttttctccttgtattgggtccaaaacccactggctatgtaactgaagctacaagagaaactgggatagtaatcatcaacagtttagcccttgtggaaactttgatggacgcaaatcgatgggcagagatgtttccctctatgattgttagagctatcaacctcgatgttatatctaatggcatgggtagaacaagaaatggtgctctacaagtggcgtgtttcattactctgattttacagttttgcaagaagttgcacttgacttctaagtga

SEQ ID NO: 55555 - DNA, 1707 bp, Glycine max
  Peptide Sequence Number=SeqID_172333
atggcagcggcagcaacgagaagcgtgtcgctgaggcaaatattcgcggagaggagcaaggagaggctcctctcgcggaaggacttgtcggagctgaggctaaacggcaacaccaccgccaccgccaccgccgcggccgctactccccacaccctctcggatcgcgtggcgcggttcggcgagggcgtggggaggttcttccgtgagctgcgggagatggcgcggtcggatccgcggaaggtggtgttcgcggcgaaggcggggctgtcgctggcgttggtttcgttgttcatttacatcaaggaggagcagctcagcaagtactccatctgggccattctcaccgtcgttgtcgttttcgaattcagcgtagtatattatagtttacactttaaaaatcaaggggcgactttgaacaaagggttcaatcgttctttgggaacaatttccgctggagggcttgcgctgggaattgctgagttggccgttttgtctggaaagttcgaggaacttattatcgtactatgcatatttattgcaggtttttgtgcaagctatgtgaagctactgcctgcaatgaagacatatgaatatggctttcgtgtgtttttgttgacattttgtattgtattggtatctgggagaactagcagggaatttttctccacagccttttacagattaattcttattgcaattggtgctggcatatgcttgtttgtaaatattttcatataccccatctggtctggggaggatctgcataaattggtggtgaaaaatttcaatggagttgctgcatctttagaaggctgtgttaatggctacctgcaatgtgttgcatatgagagggtcccttcaaaaattcttgtttatcaagcctcggatgatccactttaccgtggctatcgagcagcagttcaatcgtcaagtcaagaagagtctttggtagattttgcattatgggagccacctcatggtccatacaaaacattcaattatccttggagaagctatgttaaagtcagtggagctttgaggcattgtgctttcatggtcatggcaatgcatggatgcatactttcagaaatacaggcacccccagaaaagaggctggttttcagcattgaacttcagaaggttggcactgaaggagctaaagtattacgccaacttggaagcaaagtggaaaatatggaaaagctaagcaatgtagacatacttttgaaagtacatgaagcagctgagcaattgcagatgaagattgaccaacaatcattcctcctagtaaattcagagagctggcaggctgcaaaaaagcctaaagaagttgaaaatcatgacaatttgttgattgatctcaaagaccctcatgaacacaaacactcattgatctcttccctcagtgaaacaggagttgattcaagacttaacataaacatagagccttcagttcctgaattgcacatttctcaaagcttgttgtccaacaaaatatcatggccacgtctctcattttatggagataacatgttacttgagcaagattccaaagtatatgaaagtgcaagctctctgtctttggcaacatttgcttcccttttaatagagtttgttgcaaggcttcaaaatcttgtggatgaattccaagatctcagtgagaaggccaatttcaaagacccctttaacccaccagtgctgaagtag

SEQ ID NO: 55556 - DNA, 1819 bp, Glycine max
  Peptide Sequence Number=SeqID_172334
atggtggtggtggttttgctcgcgccgcgtgctctcttcttcaaactcgatcactacgtgtatgtgtgtttgcgcattttcgataacgaaggttttgaaattggaacatcatcttgtcccaaatggggtgatgtccaccttctcaatgaagagagtacgagggaacttgatacttataatgtggagagtgagctacgggtccttgttgatatgggttgttacggtgatgtaacaacccttgtagataattaccgatttgtagataatagccaaggttgtccattgtcaaacgagattgtcccatgtcgagggagattgtttgaagtcgtgggtagtagcctcgacaacttgtcaagccctcgagcttggacaagtgttattcatgatgcttctgtcaaattgctctgggtggacatgcttttggttttgcaagcgagttctgacattactcttccatacaagtcgctcgtggagtgggcacgtactagagatgtggatacttgccacggtgtctctaagagcgaatccttttcctcggagaggttgagggtttctcgtcgtactggtggagacacttcttgcctccgcaggagggcgcaaccttcccatgcttccccggctggggaccttatcccgatcactatgattctcccccattttacttttgggggagtagaaaagagtggtggcggggatgtgagggacgacatcctgaaatacaagtcctccatcacctttgtggtgagcgttgctgcattgcaatgccaagcggtgttgggcaacccgcccttcttttttatgtacaagtgtctgtttgaggtcttgggtcttgtccttcccttaaccgcctttcagtgtgctcttcttgagcacttgaacgtgacaccttcacaactccacccaaacagttgggccatggtgagggcctttaagattttgtgcctcttcttcaacatccgacccatctccttgaacaacatgtccaagaagttgtttaagttctcaaatgtcttttgtcgcttcaaagactatttcttcaaggtcttggctactgacgttgtgggtcgacaaagctattttgaagtagttgccgacctctttggacgtgcgggaattatgggtgactttccttggaggccacttgtgaaacaagttggacctcttggtgggactgtgtcactgtctgctattgctattgctgctggagaaaggagtcaacttgctattgaggttggccttgttgctggtgttgctgaggatggcgacgctgggatgtcgagccgtaagaagttgagagctctttttagccttcatgccctgagacaagctgcttttgctttcgctgttgttgttgttgttactcctactcctccacctcctcttgttgtgcttgttcaggaggccactcctactactgaagttgatgcgccagctgctttggctagtcctattgtgtctccttcgttcaccgtcgctacatccttgctgagtgtcggtgtggtgaccatgagtgctcctatgatgccgcctcctttttctttaactccactgtgttggcatcggcttccacctcttttcaccccctatgctggggtcaaccatgccacgaattctgctaaggtctttcttctgcggagtttgacaatccttgaaaaaaatgggcaaaggaaccaagaggcgctaagcaaagtggcgtccttggagtgccctaaggtatctagtgctaccgtcgcctttgttgaagctgtgaagttgaaccacgaactgtcttccaaggttggcagtgttttggccaagttgttgcgcactaggttggatg

SEQ ID NO: 55557 - DNA, 309 bp, Glycine max
  Peptide Sequence Number=SeqID_172335
atgttcatctctgtgtggtggtcgacggcaagcaacaacggctcgtggtggccaccggtggtcgtgggtagtggagaagaaagtgttaggttagcaaaatttcaaggcgttacaattaccatccaacctagtgcgcaacaacttggccaaaacactgccaaccttggaagacagttcgtggttcaacttcacagcttcaacaaaggcgacggtagcactagataccttagggcactccactttccaaaccatgagagcagtaaccctacattaggcaacctctacctccaaggacgccactttgcttag

SEQ ID NO: 55558 - DNA, 399 bp, Glycine max
  Peptide Sequence Number=SeqID_172336
atgtttttgtgtgatgatgacaataataatgatggtgataacgttagcaatagtgacaaagataaagatatcagtggtggtcacgatgatagtgacaatgacaataataacattagaggtggtggcaaaagtggtattagtggtagtggtggggtgatagaggtggtattaacgttggtggtggtgatggtgataacgaagatagtattagtggtggtagtagttgttgtgacactgatgaaagtggtattgttggtagcggtgatgatgacattgatggttgtgtggtggctgtgtggtggttgcgatgacattggtggtggttgcggtagcggtgacactaatagtgatggtggtggtagtaatgccgatggtgatggtaatgttggtagtgattga

SEQ ID NO: 55559 - DNA, 273 bp, Glycine max
  Peptide Sequence Number=SeqID_172337
atgggtataacttcttggttgttatcactggacacaaggtaccaacgttccttggggttcattgcaagaagtgggaataacttcttggttgtaatcactaaatacaaaggagggaagtcctttgtggagaacaacgtagaagatgatatagaaggaggaattggagctggttgtgctccggaggctccgtggcgtcaagttccggtggccgcggtagaggttgaagccccctttcgcttctttgatgattctaccattgtaggagttttttga

SEQ ID NO: 55560 - DNA, 2019 bp, Glycine max
  Peptide Sequence Number=SeqID_172338
atgaagtggaatgttgcttcctttgtcgcgatgttaacctgctggtacagggtcacaccttcaaggtggacctccattcctttgtgcggcgccgacattgtgcttggcgttcagtggctcaaagcactcagaccagtgttgattgattataatgacttaagcatgaagttcgtttttaatggcaccttaattgaactcaaaggcaattctgacaatgcattgctcgaactcactcctcctcaactccggagactgaaccaaacccacagcgcgagtgaatattttcacattcgactttgttcttcagcgtctccttccttacccactcaccctgccatccttaccttgaaccatcaattttcctccctttttcagacaccaactgctctacccccatcctgcaccaccaaccactcaatacacctttcacctcactcatctccgatcaatgtccatccttacaggtaccctcatttccaaaaacaagaaattgagtctcaggtctcgtgcatgcttcaacatggcattatccgcccaagcaccagccctttttcatcatcggtcctcttagtcaagaagcgcaacgacacctggagattttgtgtggactacagagctctcaatgtgatcaccatcaaggatcactttccgatttcgatggtagatgagctgctcgatgaactcggcggagcacggtggcttttgaaattggatttactgcaagggagtggaacctgttcttgccaaggtcgaagctgtccttcaatggtcgccaccaacatcagtcagagtattgtgtggttttttgggccttttaggattctacagtcacttcatccaagggccctatgtaaagccccagtcttgcggctaccggatttttccctgccctttgtagtcgagactgacgcctctggaattgaccatagaagtcttaaggaactcatggcacaagcaatccaaactccagagcagcagacataccttgcacgcttaatgggttatgactatacgattcaatattgtgctagcaagtcaaacctggctgcagacgccttttctcggcgatcggagattccttccggcacccttttgatactaacagttccaaattgtatgtttttgcaggaattgaaggcagagctatcaaacaatcccaaattccagaagtaccatcaacagataattgctgagcctcataatcatcctgaatacaaagtattgtcatcgacgctcttcgggattactatgccccttgcctattccggcacagccatgggaagacctctccctcgactttattatgggattgtcgaacttttgaggtcattccaccatcctagtagtggtagaccggttttcgaaaggagttcatttgggcatgttgctagcataatactccgcttcaggcatggcaaggctattcatggacatcgtcgacaaaatccacgacatgcctcggagcttggtctccgacaaggaccccctctttgtgagctgtttctggcaggaattgttcaagttcagtggaacgtgttggaccttgtggcctcaataatcttaagagggataggcttacagtctcttaaccaatctcatcgaataagaagaatggaagaagaaatctctcttcaagagaagaatattacaatgaagatcatcgtaccacccttagaccaacggacagatagaggtcatgaaccgtgtcatcgaacaatacctcagagcctttgtccatcaacgtggggacgattcttgatatgggcagaatggtcgtataatacctcggtgcactctacaactggaatgtctccatatgagataacttttgccaagaaacctccaagtttaatccagtatctggagggaacctcgaatgtggaagtcattgatgagtggcttaagcaacgagaccaaatacttgctacttttgcaaagaagctgacaaaggcccaacaacgaatgaaagcatacgcagacaaacaacgccgtgaattgacttttgaagtaggagactag

SEQ ID NO: 55561 - DNA, 168 bp, Glycine max
  Peptide Sequence Number=SeqID_172339
atgggtgggggcttggctagtgaaggtaaaaggggtagagtgggtttaggtgtaggaacgagagcaggtaatggtggaggaaaattggtgggcgagggcgaggtcgagctcggagacgaaacagctcaggagaaaggagggtgggaatccgacgattctattggctaa

SEQ ID NO: 55562 - DNA, 483 bp, Glycine max
  Peptide Sequence Number=SeqID_172340
atgtcgcggattcaccacgaaacatgcaggacacctaatcaaaccgttggaattgcaagacgaacagctcctgaatccgccactcttctctccgaacactttgtggcttccatcgcactcgtcgcagaccacgaatctcagccctccgcacaaatcacacatcttcctcacctcgtcggcaccgccgatgtacacgccggcgacgaagacgctcggcagcggcacgctgcggcggacgaggatccgctgcagttcctcgcggaagcgctcgtcgacgctgacgtcgcgctcgtcgatcgcgacggcgaagccgcggaggatagatcggacggcgcggcagtcgtcgaaggtgcggcggacgacgcggaggctagtgtagtagacgacgacggcggtacggtcggagtccggaggcggttggacggcggaggaggcggcgcgggggctgctaaaggagcggatgagggagggagagacgattag

SEQ ID NO: 55563 - DNA, 1422 bp, Glycine max
  Peptide Sequence Number=SeqID_172341
ccaagtgcatagccaacatctccttctccatggtcctcactggtttattactctattcccggtccatgatctccatgctcttcctcggccacctcggagaactcgccctcgcaggtggctccttagccatcggcttcgccaacatcaccggctactctgttctctctggcctcgccatgggcatggaacccatctgcggccaagccttcggtgccagaagattcaaacttctcggcctcaccatgcagagaaccgttctccttcttctcgtaacctcatgcctcatctcattattcttctggctcaacatgaggaaaatattactcctttgcggccaagaagaagacatagccaacgaggcagaactctacatactctactctctccctgatcttgtactacaatcgctgttacaccctttgagaatctaccttcggagccagtcaataacgctccctctcacatgctgcgccgccgtttcgattctcctccacgtgcccatcaactacctcttcgtctcaatcctcaagctcggaatcaaaggcgtcgcgttaagcgccgtcgtcacaaacctcaacctcgtctggttgttgattgtttacgtagttgtctccggcacgcacaagaaaacgtggccgggtatttcgcgcgagtgcttccaggggtggaattcatggaaaacgctaatgaatctcgcgattccgagttgcgtttccgtttgtctggaatggtggtggtacgaaattatgattttgctctgcgggttgttagttaaccctcacgcaagtgtggcctccatgggggttctgattcaaacaacggccttgatatacatttttccgtcttccttgagcttcggagtgtccacgcgcgtggggaacgagttgggagccgggaatcctcggagggcgaaactcgcggcgatggtgggcctatgtttcagttttgtgttcgggctttccgctttggcgttcgcagtttcagtgaggaatgtttgggcttccatgttcacactcgatggacaaatcattgctttgacgtcagcggtgttgccgattattgggctttgcgagctcgggaactgtccccagacgacggtgtgcggcgtcttgagagggacagcgaggcccaaattgggggccaacataaacttgggttgcttctacctcgttggcatgcccgttgcggtgtggttgggcttctttgcagggtttgacttcaaagggttgtggctggggatgttggcggcgcaagggtcgtgtatgatgacgatgatgttcgtgttggcaaggaccaattgggagggtcaagcgctaagagctaaggagctcacagactctgattctggtgaggagaaaaatctaatggaagaagaagaacaggaggaggaagggtttttgggatcttgtgccaccaaagaag

SEQ ID NO: 55564 - DNA, 1218 bp, Glycine max
  Peptide Sequence Number=SeqID_172342
atgacttttgttttatgtcagacactaccagaaatccaatggggaaagaatatcagggttgttcttgatgctggttgtggagttgctagctttggcggctatcttctggacaaaaatgttattaccatgtcatttgcaccaaaggatgagcacgaagctcagatacagttcgctttggaacgaggaattcctgcaactctttctgtcattggaacccaaaagttgacatttgctgacaacggatttgatttgattcattgtgcaagatgcagggtgcattgggatgcagatggtggcaaaccgttgtttgagctcaataggattcttagacctggtggtttctttgcatggtctgccacaccagtttatcgcgatgatgaaagagatcagaaagtatggaatgccatggtgaccgtaacaaaagcaatgtgctggactgttgtggctaagactcttgattcatctggaattgggcttgttatataccaaaagcctacctcaactttctgttatcaggaacgcaaagagagaactcctcctttatgtgaaactagcgataggaaaagtatctcatcatggtataccaaactcagtagctgccttatacctcttccagttgatgctgagggtaatctgcagagctggccaatgccttggcccgagaggcttaccagtatacctccgagcttatccattgaatccgatgccagcgagatgttcttgaaggacaccaaacactggtcagaattagtttcagacgtttatagggatggtctttctatgaactggtcaagtgttcgaaatataatggacatgaatgctggttatgcaggatttgctgcagcactcattgatctaccagtctgggtgatgaatgtagtacccattgacatgccagatactcttactactatatttgacagagggctaataggaatgtaccatgattggtgcgagtccttaaacacatatcctcggacttatgatcttgttcatgctagctttctcttcaaacatcttatgcaaagatgtgacattgtagttgtggctgtggagatagatcgaataatgagaccagatgggtatctcctggttcaggactctatggaaataattaacaagctcggtccggtcctgcgttcacttcattggtctgtaacgttatatcaaaatcagtttcttgttggtaggaagagtttttggcgtccaaggccctag

SEQ ID NO: 55565 - DNA, 144 bp, Glycine max
  Peptide Sequence Number=SeqID_172343
atggttatgtttggtgtaggtgtgactgaggacgaagatggggtgtgggctagtttggccattgcttcctctaggcgctctaggtttgatttagaacacatggattcagccttgagagtcaatgaaagcaccaagttgttgtag

SEQ ID NO: 55566 - DNA, 285 bp, Glycine max
  Peptide Sequence Number=SeqID_172344
atgagagcaagggttaggcaacaatgtccgagagcagcatggactaagaccaacaagagacagaggttgagagtgtcatgggcttacctattggcgacatgggctagcagcggaggtgcaacaaaggcacaatggagacacgacggttgcgggcgcaagactgaggcacgagagcgtggtgttcccgtgtcctctagcatgaggttcttcatagtcatccacctattcatccgctcccccgaacacaaagttcaagatcatagtagccaaatacaatttacttag

SEQ ID NO: 55567 - DNA, 450 bp, Glycine max
  Peptide Sequence Number=SeqID_172345
atgacattggccatcccacagttttttttgaagccgttgcaggttatgtgggatgctaccgtgttcggggtgtttaatgaagacttccccttgtacataaagcatgaagatctgtctgaaatagcacatggtggtcaatgtctcaacatctttgttatacagttgtggattctgcatctgactgagacaagtatgcgtacagggaattccgatgtgtatggattcctcgagccacagtctattcagagatctgggcaatcgcaatttgaatcaaaaagatacatgaagagttggatgcagaattcaaaacgtgatgtctaccttggagcctacctgaatggcaagcctcatgatgatgaatcaactatgaatcaagtagttttgatgatgacaaaaaagcccaaaagaatgatttcaagattgagtcaacaagttcaagatcaagattaa

SEQ ID NO: 55568 - DNA, 1230 bp, Glycine max
  Peptide Sequence Number=SeqID_172346
atggatgatcaatcaatatcaatggttaattgccctccttcctttgcaacagagcttaacattctgctattaaataacaacacattgtctcttgtgtatctgtcatcactgttgaagcagtatgcattcaaagttactttgacagatgaagtatctatggctatgtccatggtttccaatcatgaaaatcaattcagacttgtcatggttaaactcaacatgcctggcctacatgaccttgcgtttgtggatttattgcatgagaaggacattccagttgttttcatctcatctggagggtctgaggatactatttggaaaacattagctaaaggaccttgttatttccttgaggaaccaatcctttttgaggatctccaatacttgtggctaattgcacatcagtcaaaacctaagtcagcaatagaagcacaacatgcaaacaaggcttgtagagaaaaggaagaaaggaagattgataatgatggtaatgaaagcaagcaaggagagaagagagaagaacttaggccagccatgatgaactttaaccgtgataaccatatacctaaggagactgagaaaagaagagaacacaaaattggatttgcgaagaaaaggaaaatcctttggactcttgagctgcgtcaaaagttcacagaagccctagaatatctaggcggcattgagagtaatattgctcgtccaaaagcgattcaaaaattaatgaaagtgtctgacctaacattaaaccagatttcaagttatatgcagagatacaaacttcagctaaagcgtaataaggtcactatcggttatggttcatatcaagcgggtacatcatcaaacattagtggcaagactacgtttccctcctcgttagggagttcaagttaccgagtagaacaacaagagcatatgcatgagtctataaaccatccaacaactgaatttgctgcaggtatccctacatcatttgctcccttaaatgcgagcccaaaacaagacctgaactctggtgaaactcaagaatcagatattcacaaactgcagagtgtcctaagcaattcatttgttgcaaatgaattggccagccaaattgatggtgctatagtgggaaactctattccaaatgcttcttcaacacttcaaaacctacctgaaaatgaatatgaagagttcttcagaagtcttgaagatattgaaactgataattttggactcatgatgtaa

SEQ ID NO: 55569 - DNA, 702 bp, Glycine max
  Peptide Sequence Number=SeqID_172347
atggatttctacaaaaggagggaatttgcactagtagctagtttagaggcaattcggttagtaacatcaatttctagcttcaaagggttgtctctccgccaattagacgtcaaatctgccttcctaaataggtcattggatgaagaggggagcttacctaattatggggaatggaattcattccaacaaataaaggaattttcatgcacaagaaaagtatgcaacaaatatctgaagagattcaacatgttagattgtaatccaacatcaactcctattgaaattggtacaaggcataaagaaggagatgaagatcttgtgaactcaacacagtatagaccagatttggtctatggagttggcttgataagcaagtttacagagaagctaagtacatctcatcaagcagctagaaaaagaatattgagatatatcaaaggaacacttgactttggcttgttatttccgaatgagttgcagtgtgaaggtgtggagattgtgcgttatattgattctgattgttgtgaagataaagataatcgaaagagtataggtggatacgttttcattcatgaaaatggatcaatctcatggagttcaaagaaatatgatgtagttgctttatcctcctgtgaagttgaatatatagttgcatcatttagagcatgccaagctgcatggttggaaactctattgaaatag

SEQ ID NO: 55570 - DNA, 438 bp, Glycine max
  Peptide Sequence Number=SeqID_172348
atgactcagaggaagaggggaagaccatctcacatatgcacagtctacaatcacaaaaaagaagaagagaggagttcccttttgcaaacaccaaagcttgaggttcctccattggtgattttacaagcatgctgggggcggggaaaacccgaccccgttcggggcaggaatagaaggttaatctacaatcctgttgggttttgggggtgggggtggggggaaatggggagttgggggcaggggtgggtggcagcagagatgaggattccagcgaagatgatggtgtggatgaaggaaaagaggaatgagaagaagaaaaataaaattaaaaatgtggtgatgccgctaaaaatcatctctgcgacaacgcacagtggagaggagttggcgcttgtactgcgaagcaaaggctttcatcctctagcaatccattgttag

SEQ ID NO: 55571 - DNA, 192 bp, Glycine max
  Peptide Sequence Number=SeqID_172349
atgagaatcctaggaccttcttcagcagctctagctcaatcctcttggagcctcttgctcatggctctagtgactagtcccttcctcgggaggattgcatcaaaaacaccttcaatgttgggcatcagtatctcagaaattgtagtagaattccctcaagctattattctcttatccaacagtgttgcttag

SEQ ID NO: 55572 - DNA, 300 bp, Glycine max
  Peptide Sequence Number=SeqID_172350
atgagcaatatttctggtggagcagttgcagatattggcggtggtagcggcaaagtaggtggcacagtcagtgttggagaggtagttcttgcattggaacgttgcatagacagggaccctcaaagctccaccatagccacaatatcgacaagggtctacgagcttgagctgcatcatattgttgtggctctcaaactagatcagtatatatctaagggttctaaagcctcaattaaaaaaagtctagttgttgacgatgcccatgcatgggtagacaatcaaattttaatcagtacataa

SEQ ID NO: 55573 - DNA, 1011 bp, Glycine max
  Peptide Sequence Number=SeqID_172351
atgactcttcctctcctcgcttcactcgctctcctctttccaatgcctctctcctctacccaatgccttctctcctcttccctaggctctcgagaagacgcgtcaagtaaaatgaaggtccgtaggcttgaagccatttttcgcaaacaaacgacgagtgacggtggtacttgttctcctcgttggactagaaaaagagcaaagaatttgcaaaatgggaatttgagccactccaaagaaatcgaggttgcagaggagacaaaagatgaggaggaagaggaaaagatagtcaccattggcaaaaagggcgtggtagttctcgaccagtggcttccggattacatgaagacaaactatcatgttctgcaactagggagtctagtaatgtttgctgatgctaaaaattggatccgtaaatcaggattacatcatggagggtttgcagtggagaacctcttcttgctccttgttcaagggcttgccctgggtgatggcctcttccgtggtgaggatgcagttgaacttcttgctgagggcgcggaggtgcttgttgataaggctcatcacatgactattgttggtagtggtgatgtcattgttgcttgcgatggctgccatttggtcatttatggtggagaaagagagaaagagagagtggggtttgagctggtcattgttggagcccaagaagaaggggttggtcggggactagatgcggtgcatatgcttctgatcctcctgggattggggcttagggagaatgaaaaagagtttgcagcgggattgtcggcacaatgcagtcacccagagagactacgaaaggatggagatgcgaagtgtcgaagagcgaggcggagtgaaaacctaagagaggatgcaatcatgcaaccgcaagacaggactaggccgagtgagcatagctgtagggagggacaaagatgcgaagtgccgttggagagtgaggcagagcaaagacctaagtgttgtgatgacggtggacaaagaggctga

SEQ ID NO: 55574 - DNA, 883 bp, Glycine max
  Peptide Sequence Number=SeqID_172352
gagaggagatgacctatcagataatgctatgatggtgacagaagatgatcctgtgacttatgaagaagctgtcaagagtaagacatggagggatgcaatgaaaaaggagatggaagccatcgagaagaacaaaacttgggaactaacaaatttgcgaacaggtatgaaaccaattggagtcaaatggatatacaaaaccaaactcaaagaaaatggagaaattgataagttcaaagcaagattagttgctaaaggtgcgtttcttcatggagaactcaaggaagaggtatatgtacaacaacccattggctttgtgaaattaggagaagaagaaaaggtttacaaattgagaaaaacattgtacgggcttaagcaagcaccaagagcatggccggatttaacgtatgaagtcagcctgattagcagatctagatttatggccaatcctacaaagacacactggtttgcagccaaacggatactaagatacttgaaaggaacaacagagcttggtatatactgcaagaaagaggagagcactaatgtagtagcatatacagatagtgactttgctggagacattgatgataggaagagtacctcagattttgtgtttctcttagggaatgaagcagcatcatggaatgttgctgaatcgaggaagaggttgaggaacagcggcaaatcgtgtaggagattgaggaaatgtgttgaatcatggatgatgttgagatgtacaaagcggcaaatcagcattaatgagccgtgtcaaagcacttgctttggttctcaccttggctctcagcaccctcaaagctccctcgtgaccacaacaccaacaaggttaaggctacgagcttgtgttgcaccattttctttgtga

SEQ ID NO: 55575 - DNA, 288 bp, Glycine max
  Peptide Sequence Number=SeqID_172353
atggcacaactccagcgagtttggcctttgaaaatggaggcaaggacactgtttgtagtggcacagacttctcgagtcgcggtagggttgttgttgcggcgtagtaatccttgtggtgtctaccctgacttatcttccttcaccggaagtggtgtccaccctaacttatcttccttcactggaagtggcatctaccctgacttatcttccctctttggaagtggcgtcatccagaactccatagcctgtatcaaacgttccgctcctaatcaggttcacatcatctga

SEQ ID NO: 55576 - DNA, 252 bp, Glycine max
  Peptide Sequence Number=SeqID_172354
atgccacaagaaggtcaagaagtactctgccaaaaaattcatgaagaagatgatgctggagattcggaaaagcttgccaactgtgcagaagaaagcatgcattctcagaaaatgcaagtacaagccatgaaggctctcgtcgatgtccttgccactagtgcttcgtcgccagctccgatcggtttgagcaaatgtaatcacaaaaatattgtgtacttcactactttatatggtcatatttatcttaattga

SEQ ID NO: 55577 - DNA, 243 bp, Glycine max
  Peptide Sequence Number=SeqID_172355
atgggggatgttcttatacatggagttctattaagatgtcagctatggttcttcaagagggactctcctttcatgttgggaagggaaatataccaatgtgcctctccagttcctgattggctcaaattggaggttgagagtttgttcttaaatgatgaggttaaaggtgtgactttttggaaggactctactcatggtgtatactctgctacctttacttatcgttggctcaacaaagcctga

SEQ ID NO: 55578 - DNA, 282 bp, Glycine max
  Peptide Sequence Number=SeqID_172356
atggttgttggaatcggttacagggctcagcttcgggggaatacagtagtgatgaaccttggttacgctcatcccgttgtttacgagataccctctgatgtgaaaattgaagttcctgcaccgaacaggatagttgtttctggcatcgataaacagagggttggacaggttgccgctgagatcagagcgttcagaccactaaatgtctacaccggaaagggaatcaggtatgttggtgaagtggtgagacagaaagaaagtaagaaagcatatagggggtag

SEQ ID NO: 55579 - DNA, 315 bp, Glycine max
  Peptide Sequence Number=SeqID_172357
atggcacataagtactgttttgaagcattggataaaacaccgaaggacattacgtgtatgtctcatgtggatagtgttccatttggtggaaaagtagtatttggaggtgactttcggaaaatcttacctatgatacctagaggcagtagatcggacatagtgcatgctactataaatgcttcctatttgagggattactatacagttttaaagcgagcatccgctaagcgcaacacacctgggctaagcgcgaggaagaatccagaagaagatgagttgtacaggttcgctaagcgcaccacttcatctctctaa

SEQ ID NO: 55580 - DNA, 285 bp, Glycine max
  Peptide Sequence Number=SeqID_172358
atgtcctacagcttctttctggatgaaactgtattcatcataattgtaaagagcgtttataaacacctttataagcggatccacactgaacaaattatcctaagagatgttaaaggagtttgtccttatattgaaccttgtgattccaaaactcagaagagcaatctggggattgctcttgttggagttggttgtgaacaaaacaaggttgatgttagggtggacaataagcttcgaaagactagtgaaatagtacttgggttgagtggagcctacatagactga

SEQ ID NO: 55581 - DNA, 1224 bp, Glycine max
  Peptide Sequence Number=SeqID_172359
atggacatgctgcaaaaggagttggatgcaatcaagactgagttgtcccaaatgcaaactcaacagtcagcccctgtacaaccggctaaccctaatgtgttgattgcacgtgttagcaccaaagaaagttgtgcagaagctgttgcaaatgttgttgctggggacccatctgcgattgaggagaataccatggggttgtatgttgtttgtggcgacagtaaacaattggtggccttaggaaaggtgtatcaagttggcggcatgatacacaatgttccttacgcagatgaagtcgtgagggtttctgtggttactgtttatgatggtgatgcaagggtcccaattcccacacctgagattgaatacgttagggaggccatgaacacattcattggctggccaactaatcttgtcaaacctttctccgctgattccaatcaagatgtaaggaatccaaatggacatgttgatcggtcaaatgtaggttttgcaaaggatccacttggagaaatcatgaaaatactttatgaagtgtatatgaatccagtggaactcccgtgggaggctagccgatttggaattccaaatatagatgccaaattttacatcacacatgctgatatggctgaaataatatcaggtcacaagtgtttaaacatttctatactgcagctatggatgatgtatttggatgagtgtgctacaagcagaggtgatggctcagtgtatggcttccttgagcctcaatcaatacacattggtaaggaggaccgtcaacaatgtcaactttatattgagacatgggtgaaggaatcacaacgatgcttgtacttaggagcatacttgcatcagtcacattggcaactatttgttctatgtcctagggaaaacatggttgtttggttttgttcgttgcgaaagaagcctgatgttaacataaaagtcgtaataaatagtgcaatgaagacaataagtagttctttggaaggcatgtctcagcaaggtccacctcggtggattgaacccaagagtcatgttcaaagtggagggtacgagtgtggatactatgtgatgcattggatgtggtgcatcgttagtggtcgtttgaaggatgactggaacaggtggttctcaaatggatcagcattagaggtggaggccatgacaataattcaaaagaattgggcaacttactttttagctattagaaataaaagatgctaa

SEQ ID NO: 55582 - DNA, 871 bp, Glycine max
  Peptide Sequence Number=SeqID_172360
atgtgggagaagaatgccaattatgcagaagttgaggataaggtggaacaagaggatgagctcttgttaatggcttcagttgatctcaaagaagaaaaagacaagtggtttttagactctgggtgcagtaatctcatgagtggtatcaaggattggttttcacacctggatgagaattttcatcacacagtaaagctaggaaatgacacctgtattgctgttatgggaaatggagtgttcgtatggtggtgtactatatatgttcttgaactcaagaataatctcttgagtattggacaacttcaagaaaagggcttgaccatcaaaattcaaaacaacatgtgtactgttgttcatccagaaaaagggtcaattatggaagttagtatgagcagcagtcggatgtttgtgctaattgctactcgagctccaactagtgcaacatgttttaaggctgaattggagcgggaatcacaattatggcataatcatttaggccatttaagctatgatggcttaaaaacacttgcttctaagcaaatagtaaatggtctgcctactattttagttacacaagaattatgtatacactgtttgactggaaaacatcatcgaaattccatgtcaaagaagagtcaatggagagcatcagagaaacttcaaatcattcatgctgatttgtgtggaccggttcaaccttcatcaaatagcaacaagaagtatttcctaagttttattgatgacttttcacgaaaaaattgggtatactttctacatgacaaggcagaaactttttctctatttaaaagtttcaaatccctagtagaaaaagaagctggaggaagcattatctgtctcaggacagacagag

SEQ ID NO: 55583 - DNA, 942 bp, Glycine max
  Peptide Sequence Number=SeqID_172361
atgggaaacgagaaagcaaattgtttctgggaagcagaattacctccaaattatgatagagttggaattgagaatttcattcgtgcaaagtatgatgaaaagagatgggttccaagagatgggaattcaaaaacaccttctggatttcgggaagagaaaagtccttcacattggcagaggcctgtggagagaagtggttatgccgctgtttctgaaaataaatttgaggaaaggaagaaaatccaaccatcaactgcaattcctgccgcaagaattaatgttcctgctcctcccagagcatctgagcaggtaactcctattaccaaacctcagcatgtagagaaagtggaatcagtagcaccacaaccacaagctccccaaccactagctgaaacatcaaagcaggctacagacacagttaaaaatacccctcctaaagttgactatgccacataccttttcaacatgttgtctatggatggccccaatgaaaatggctctgaggcagctggtacaactactgatgataatcactgggcagctgctgcagaggtgtcaacagctgagaagactagtcccctaaaagcagctgatagtactccagcttctgcatctggaattgaggatcttttcaaagatttacatcctgtgacaccaagcttgactccagaaaaaccacagagagatgtgaaaaatgatatcatgagcctctttgagaaggtcttttctgacttggagcgttcagtttgtagaatggtccatcgacaggttgccacaattgcttggttggaagctgattctgtttgtggtagccactctgttgcaatccctttggttcttgtcttgccttatcttttccgtttaaaccaatgtctccggcagtacaaagatactggagagaaaactactcttctgaatggtaagaactttgtcttgttctaa

SEQ ID NO: 55584 - DNA, 144 bp, Glycine max
  Peptide Sequence Number=SeqID_172362
atggaagcagtagcattagatgaagaaccagtggttgagctagagttcatgccttcccgagtcttcatatttgtttcaacaaacacaggcatagttagtccaaggttttcaaggtccatgtccttgtccactagctccaagtga

SEQ ID NO: 55585 - DNA, 459 bp, Glycine max
  Peptide Sequence Number=SeqID_172363
atgtcgctcaccaagggaaagataggtgtaaatgaaatggctccaaagaaactctccacgaagaggtctagaagagacgccacaggagaaggatggtcattccacagggagaggcgtgtccagctcagggaggatgagtacacaaacttccaggaggagatagctcacaggcattggacacctctagtgactcccatggccaagttcgaccctgagatagtcctagagttctacgctaatgcctggcccatagaggaaggagttcaggatatgtgctcatgggtgaggggtcagtggattcccttcgacgcagatgccctcagccagttcctgggtgacccgctgattttggaggaaggccagcagtgtgagttcagccaaaggaggagcgaggtagacgatttcgatgaggaagccatcacccagctgttgtgcataccgggtcaggattttgcctag

SEQ ID NO: 55586 - DNA, 533 bp, Glycine max
  Peptide Sequence Number=SeqID_172364
agcatgggctagtggacgctgtagtgaggaacaattcgtttgataaaactgctgttgttgcccttcctggtgggattggtactttagatgaggtgtttgagatattggcattgattcagctagaacggattggatcaaagtttcctgttcccttcctgttgatgaactatgattcattttattcaaagctgcttgaatttttaaatgattgtgagggttggggaactgtctctaaaggagaggttgcatcattgtggaaggtttgtaacagcaactcagaagctttggcatacctagaagaattctatggcatttcttctagtgacaaaagaagccttccaaattccattggtgagctccagaacttggagaccttggatataagacaaacagatatgtctgagatacgaaaggagattagcaagcttagaaaggaagctttgcctcagggggaagttaaaaaagttgccaaattggattccacgactcgaaaatcttttaaacttgtctttgatgtactccgagttaactaa

SEQ ID NO: 55587 - DNA, 3447 bp, Glycine max
  Peptide Sequence Number=SeqID_172365
atgaggcaaaagaccaacaacgcaggttctagtggtttcttgggaagtatatcttccaattttctcagatccatctcttcttcaaatcgcaaacccacctcttcttcttcttcaaaccctaaaccaccaaattctgacgctgaaaacacaccccctactacccatccaaacattcccctcaatattcaccaccaatcaaagcccaacgacccattttctcacagcgactcacatgttgtggtgagaattaggcctgaaaatagtaatggaaaagagggagattcgcaaattaagaaggtttcttcagatgccttgtgtgctggggacagaaagttcacgtttgatgaagttttagatgccaactccaatcaggaggatgtttttcagtcagtgggtgttcccttggttagaaatgctttagctggttacaacactacaattctgtcatatggccagtctggaagtggaaagacttatacaatgtggggtcccccaagtgccatggttggtgagtcctcgcgatctagtcaacagggaattgttcctcggatcttcagaatgttattttctgagcttgagagagagaggcttgtgtcagatcagaaacagttcaactatcaatgccgttgttcatttcttgagatatacaatgagcgaattgggaatttactcaatcctatccaggagaaccttgagatgaaggatgattccagcaatgcaccatatattgagaatctgattgaggaatacatcactaactatgatgatgtggcacaaattctggtcaagggtctttcaaggagaaaaaatggagcaatgagcttaaattctaatagctctagatcacatataattttcacatttgtcattgagtctttgtgtaagggaaccgcaaaaagtttaagtacctcaaagactagccgaatcagccttattgatcttgctggactggatagggatgaagttgatgatggaggtagccaatgtccaagggcaagcggacatgtagataaatcattatctcagcttgagcatttagtggatgctctaactaacaaatctcagtctggaaaaaatgaagacattccacacagcgactcctgtttaacacgcttactacatggatcacttggtggaaatgccaaactctcggtgatatgttccatctcccctgataacaagagtaatgatgcaacactgcacacactcagatttggggagcaagtaagatccattagaaatgagccagttatcaatgtactaaaggaggctgatgttgatttgagtaataatatccgacacttgaaggaagaacttattagagcaaaggctgatgttcatagctcagctgggagtaaagatggatacttccaaggacataatgtgcgggaaagcctgaatcagatgagagtcagcttaaaccgctctcttctcctatctaacatagatagtgataccaatgaacatgtaaatgtcaatgaggatgacataaggcaattacgccagcaaattgatgaattggataattcatctgaagggaatccaaaggatatatctgttgatgaagattgtgtccagttttattctgatgaggaaaattgtgatgcagacaccatcaccagtggtgatgaagttaaaaatgctgaggtatactgtggagaaacattgagcaacccctcaagggaaactgaatcttcactcagagatagtatttcagtcaattcatgcaatcattctccaacacttattggaccacagttgtctgagtctccaaaattcagcaaaactcaaaggaaaagtgtggctatttcgtcaagttatctgggaagttggaacaatgtggctgagagttcaacattcagtaacaatgtgttaagcaagccatataaacagggtgagcatgtgcaatcctcattacagtctagcaaggccaagtccttggcagcaagccttcagaagggattacagattattgactatcaccagcagaactcagcattgagcaaatcttcaacttccttctcctttgagcacttaactttgacaccatgtctagacattgacaaggctgaatcttgtgaccaaacaatgcgacagaaaccttccagtgatgaagtaactgctgctttcctttgtgcatcttgccagatgaaaatatcaaatcaggattccagtgaggtccaagcgggaaatcctgatgaagtgacagataaaattccaagacatttggagaatgtaatagcaaaaagcatcaagaaagagaaggagctggagaatgtttgcaaggagcaagcagccagaattgagcaactaaatcagttgcatgtgtcaaatctccaggtggagaaattgaaaggagaaaaagaactggactccattattatgtacaactcaatgaaagatgaagaaaagcttctaaggggaatttcctcaagtggtcatttaccatgtattatagaggaaaaatgtgaaattaaagaaatccaggaagagttagcccaaagaggtgtctcttttgattcaaatgagaaggagtcacttcttaaggaaattcagaatctaaggagcaagctgcaattatttagtgatgcacaagttaaaaagtctacagacaaactaaggtcttctttggtgtcaagatccatacaactgcaaaaaagcggtgtattttcttatgaaaatggcaatgaagacctagataatgaaagacagagatggacagaaatggaaagtgagtggatttgtcttactgatgaacttagagctgatcttgagtcctaccgccaacgtacagataggttggagatggaactgaaattagagaagtcgtcttcagtggagatggatgatgcactaaagagagctgttatgggacatgctagaatggtagaacactatgctgatctacaagaaaaatatgatgacttggttactaagcatgatgctataatggaagggatagcagaggtgaagaaggcagcagcaaaagcctcgaaaaaaggtcatgcccgctttgccaaatctctttctgctgagctttctgcattaagggtggaaagagaaagggaatcaaaattattgaaaaaggagaaccagagcttgaagattcaacttcgagatactgctgaagctgtacaggcagctggtgaattacttgttagactaagagaagctgaacatgcagcagctgttgcagaggagaactttgcaaatgtgcaacaagataatgaaaatatgaagatgcaaattgagaagctgaaaagaaaacacaagacagagattaataccatgaagcagtacattacagagagcaaattacccgaatctgcactgcaaccactgtataaggaggattctgatggggcgcacaatgcaactttctcctatacatatgatgatcaggcatggagagcagaatttggagcaatatatcaggagcatttctaa

SEQ ID NO: 55588 - DNA, 478 bp, Glycine max
  Peptide Sequence Number=SeqID_172366
atggatccggcctgccccatgcgcactgcccgcctcagccaccaccgcgcgggtcacgtcggccaggtcgcaggcactggcctgcaggcgcaggccgccgctgcggatccgcgagaagtccagcaactgctcgaccatgcgtgccatgcgcagggtgctggcctccaggtactgcagcgtctgctgcgcgccagtgttgtcttcgggaagatccagcgccagcttgtcggcacacagcaggatggccgacagcggcgtacgcaggtcgtgggtcagcaccgctgccatcgtctcgttgagcttgagcgcacgctccagcgcctcgttgcgcgccttcagcagctgccgctgctggtacagctcgatgaagacattgaccttgctcaggattacctgcggcgccaccggcttgcgcaggaaatcgaccccgccgctctcgtagcccttgaacacgcgcaggggatcatccggggaggcg

SEQ ID NO: 55589 - DNA, 760 bp, Glycine max
  Peptide Sequence Number=SeqID_172367
atggcacggatgaagtggaaggaaaaggcactgcttgcggtcgcactggccgccgccgcagcaccagcgctggcctgcacgcgtgcggtgtacctgggcgacaacggcgatgtgatcaccgcgcgctcgatggactggaaggtcgatgtggcgaccaatctctacgtgctgccgcgcggtatcgcacgcagcggccaggctggcccgaagtcgctggcgtggaccgcgcgctacggttcggtggtggccaccggctacgacgtatcgaccaccgatggcatgaacgaaaagggcctggtggccaacctgctgtggctggtcgagtcggagtatccgcagcagcgaggcaacaagccgggcctggccatctcgctgtgggcgcagtatgtgctggacaacttcgccaccgtggaagaggcggtcaccgcgttgaaacgcgagccgtacgcgatcgtcaccgacagggtgcccggcgaagatcgacaggcgacgctgcacctgtcgctgtcagatgccagcggcgacagcgccatcgtcgagtacatcggcggtcgccaggtgatccaccatgaccggcgctatcaggtgatgaccaactcgccgatcttcgagcagcagctggccctcaacagttactggcagcagatcggcggcacggtgatgctgccgggtaccaaccgctccgctgaccgcttcgcgcgcgcctcgttctacatcaacgccattcccaaggccgaggatccggtggtggcgctggcca

SEQ ID NO: 55590 - DNA, 1611 bp, Glycine max
  Peptide Sequence Number=SeqID_172368
atggcggaagtgagagggagggacacgtggacggaggagctggcgagtctgatagaggattcgggagtgcgctacggtggagattctcctccgacgtcgtttgaggtgcacgcgccgcagagcgagtcgggggagagcttgaaggagcaggccttggggttcgtgatggcgtggtgcgagatactcatggagcttgggagagggttcagggacattctgcgacagaacttgatcaacgaggattcgtatgtggtgaggaagttcggtggaccttgttccaaggtttcgaagaggttgaggtttctcaacgactttctccccgaggatcgcgatcccttccacgcttggtctgttgtgttcttcgttttcattctcgcgctcgcagctataagtgtagatcccaatcgtgaagcagtggcccctgtggtgaaggtgcgtcaacatcctcctagtgctagtcgtgtgctacttccagatggtagatacatggcttatcatgagcaagataatcttcttgggtacaatctttatgaggagcacaacttgaggctggatttcaccgtccatcttattccatcttatgaaggtttacctggagtcaaagcatcattgcttgaagagtacggcattcgtttggtcacatatgatcttcctggttttggggagagtgatcctcatcccaacagaaatctcaactcatcagctatggatgtgctgcatctagtcaatgccgtcaatgttactgataagttctggatactgtgccactctagtggatgcatccatgcttgggcttctctcagatatattcctgagaaaattgcagcgtacaacagaaacctccattcttatgctgttgttgaacaagggcctcaactgattgagggtgcagcaatgttggctcctatgattaatccatatgacccacacatgactaaggaggagatgaaaagaacttgggagaagtggctgccaaggaggaaaatgatgtattctttggctcgtagatttccaaaacttctctcttttttctatcggaaaagcttcttgcctgaacagcatgatgagattgataagctgctatctgtctcgccaggaaagaaggataaacttgtgactgaagaaccagaatttgaggaattttggcagagggatgtggaggagtcagttcgtcagggaaacatacgcccatttatagaagaagctgttctgcaggtatcaaattggggttttgacattaaggaacttcatgtgcaaaagaagtgtcaaacaagaggcatacttctttggttgaaatccatgtacagtcaggcgggctgtgaattagcaggatttcttggccttaaacacatatggcagggtctggatgatagggtggtcccaccatcaatgatggaatatatagagcgggttttgccagaggctgttatccataagcttccaaatgagggccacttctcctatttctatttatgtgatcaatgccataggcagattttcaccactctctttggaactcctcaaggtccggttgaacgacaagaggaaactgcaactgcattcgaggaagaagataaggaagaggcggctccactgctcggtggagcttga

SEQ ID NO: 55591 - DNA, 516 bp, Glycine max
  Peptide Sequence Number=SeqID_172369
atgggtattaaacattttgaagtgacaaatgaaggtcgcatgctgataaaaaatggtccccggatgaaattagggtttgacaggtcctcttccgttgaggctgctatgaagacacaggctgaaaagcaacgcaaggatgtctcttacgatgttagagattggatctatgttcatctacaattttatcgacaattatcggtttttggtactacatataccatgctcgccaaacactactatgggctatataagatcattgagcgtgttgggtgggtgctggtacaatggatgggtctatcgcctaaagatgccacttgggaaaggtgggatgagctttcacaatcttttcaccttgaggacaaggtgattttcccaagggatggcaatgatagtgcaactaaccacaccgaggctaccaacaatgacaatttaatagacgaatgggaggaggaaatcaattacaataggcccaagaggaaccaatacgtttcaaggattagaaatagagtttgttag

SEQ ID NO: 55592 - DNA, 660 bp, Glycine max
  Peptide Sequence Number=SeqID_172370
tggaagattggtctcaatatgaatgggtcgtgtgatagattcgttgtagaaaacatggtgagagatataatggagaatgaagatctcatgagatcagcaaatgatgttgctaaaaaagctcttcatggtatcaaagagaatggttcttcttatcataatttggagaatttgatcaaggacataagcttaatgaagtctgctgctggtattatgtgccaaaaagttagttttgtcattgaagacattgatttgtgtctcaagaacctcattcatgagggccattggaacataaacgaccttcacactcgagtccctcagaattttgtggagatgctggaggcaattgacactaatattcatccagacattcacgattattggatctggagtagctcctcgaatggtgattactcagctgcttctggttacaagtggctatctaactccctccccagctctacaattgaccactatgcagcttttaaatggctctggaagcttaaaaactctctgcccaccaatgcagtgggatttagacgcaacatggacaataatgttgcgtgcccaacctactccaatctcattgaggattttctccactgccttctggattgttattctctcccaatatttatccttggcttagatcacaactcatag

SEQ ID NO: 55593 - DNA, 1605 bp, Glycine max
  Peptide Sequence Number=SeqID_172371
atgaagttcaggaatctaaaggttttgaattttgacgattgtgaatttttaacagagataggtgacgtatctgatctcccaaatttggaaaaactttcatttgatcggtgtgggaatttaatgacagttcaccgctcaattggttttctaaataaacttaaaatattgagagctagattttgcagcaagcttaccacatttccacctctcaacttgacctctcttgaaatacttgaactttcacaatgttccagtcttgagaattttccagaaatattaggagagatgaaaaacttattgtaccttgaattggttaaccttggcttaaaagaattgccagtttcatttcaaaatcttgttggactcaaaactttatccctgcgtgattgtggaattcttttgttaccaagtaacattgtcatgatgcctaaattggattttttggacgcttcaagttgtaaggggctgcaatgggtgaaatcaaaagagggtgaagaaaaagaaattaggggggttccaccattcttaacatatttcacggcaagagaatgtatatccttgtcttcctcgagttcaaggatgttgtcaaatcaggaattgcatgaggctggacaaactaagttttggtttccaggagcaactattccagagtggttcaataaccaaagtaggggaccttcaagttctttctggtttcgtaatgaattccctgtcaatgttctttgtcttcttctagcacgtgtggaacgcatagatgtagatgatattttcatgcctgcggtgttcatcaatggcaaacttcataaaaatccctctcggggcactaaagtaggaaaggtgaaattggattatacatatctatttgacctaaaatcagctttggagcttaatgatatatatgaagtggctttagaaaaggaacggaaccaggtggaaattacatacgcaggtctgatagagacctcactggttaaagcaaccggaacccatgtactcagacaggatgatattcgatatgatgatccttattatgatggagctttgattactaatgccgagaggagatataggcatatttctatggactcctcttgtcggtggagacatgcctgcatgctcttcgtgattgtccaaaggtggctgcattttggagaagtactgctgcatgcggaggtatattcagagactaccgtgatagattcgtgcttgggttttcggttaattaagcctggggaatgtttgtcaattgatgaggctgaaatttggggtatttatcatggtatgaagattgcaaggaagtatgatatttggggtatttgtcatggtatgaagattgcaaggagtgggatgggctctgaggaagccattgggtttgtgttagatggatgccctacatctacatcggtgcagcattgtttcccactttgtcatgagttgaaagctctaacctctgctactaatcacttatacttctttctcacaccgcaggatgcggctgctgattccttcgccgaattcggtttatccatgaaacaacaggccgcgtcaattttttctgcttgtccctccttttgccaaccttttattaaaagaaaatacagataa

SEQ ID NO: 55594 - DNA, 813 bp, Glycine max
  Peptide Sequence Number=SeqID_172372
atggccaacaacaacgaagaggaagaggaagcagtgacgccaatggtgaagttgggttcttacggtgctgaggttcggttggtggttggtggggaggaatccgccgctgaagagaccatgctgctttggggtattcagcagcccacactttccaaacccaatgccttcgtctctcaagcttccttgcaactctccctcgactcttgtggccactctctctccattcttcaatccccttcctcattgggaacgcctggagtaactggagcagtgatgtgggacagtggagttgtactgggaaagtttctagagcatgctgttgactcagggatgcttgtccttcagggaaagaagattgttgaattgggttctggttgtggattggttggttgcattgcagcccttttgggtagtgaggtcattgtcactgatctgcgagataggctgaggctactgagaaaaaacattgagaccaacatgaaacgtgtttctctacggggttctgtaacagcaactgagctcatatggggagaagatcctgacccagaactcattgaccccacacctgattttggtaattctctccctcaactccttcaaggggcagttgtggatcttctagagacacttatgcagctctctggatctgatacaacaatatttttggccggagaactccgaaatgatgccattcttgagtacttcttagaagctgcaatggataatttcactattgggcgcgtggaacaaacgctctggcaccctgattattgcagcaatcgtgttgttctttatgttctagtgaagaaatga

SEQ ID NO: 55595 - DNA, 234 bp, Glycine max
  Peptide Sequence Number=SeqID_172373
atggggaaagggtggttacggtggcgccttccggaagatcctattagggttcttccggaacttccggaagaaggtgttccggaagatttccggaagaagggttcttccggaagtactgaaaggtcttccggaagaactggtcttttggaaagcttccggaacacctcttccagaaactctccggatgaagtagttcttccggaaactttccgaaagaagggttcttccggatga

SEQ ID NO: 55596 - DNA, 285 bp, Glycine max
  Peptide Sequence Number=SeqID_172374
atgcatgatgcaatcaaggaatatgccagagtgagttttctatgtgccccttctagtgacaattccctagcgtggttttacgtaaccttactagcttctagagatatcatcctcttagaaatagtcctcattggagtcgccaactgtcacaacctacccttggtgggagggcgacgtggggctcatgggtgcgtcttccaagggaggaaggcgcacggagtcgccactaatgtttactcgaggaaaacatcagaaaaaccgaaacgtgtggtctacgaactttga

SEQ ID NO: 55597 - DNA, 1446 bp, Glycine max
  Peptide Sequence Number=SeqID_172375
atggggaggagaggaagtagttggttttctactgtgaagaaagctctaagccctgagccaaaggagaagaacgatcaggttaagacaaaatttatatttaacctatctcagaattcaagtagatcaaagaagaaatggtttgggaagcaaaaattgcagacttcagaatcaacctcacaaacggataatgcaccacctcttcctccacctgagattattttaactcatgttgagagtgaaatcagccatgagcgtattgaagttgcaactgcagtggatgctgtggaacctgttcctgctgttcagatggcagctgctgaagttcaagccaccacaactgttcagtttaacagtaaaccaacagaagaagtggctgcaatcaggattcaaaaagcttttcggggatacttggcaagaagagaattgcgcgcgttaagggggctggtcaggttgagatcgctgatggaagggccagtggtgaaacgtcaagccattagtactctccgttctatgcagacttttgctcatttgcaaactcagattcgttctaggaggctcaggatgttagaggagaatcaagaactacaaaaacagctcttacagaagcacgcaaaagagctagagagcattcggcttggggaggaatgggatgacagcatacaatcaaaagaacaagttgaagccaagttactgagcaagtatgaagctgctatgagaagagaaagagcaatggcttattcattctctcatcagcaaaactggaagaatgcatcaagatctgtaaacccaatgttcatggatccaaccaatccagcctggggttggagttggttggaacgatggatggcagcccggccctgggagagccatagcctgatggagaaagagaagaacgacaataaatctctaagaagttctagccgtggcattaccagtgctgaaatcagcaaatcatttgctaagtttcagctcaattctgagaagcattctccaacagccagccaaaatccaggctcacctaactttgagtcccattcaaatcctcccaagccatcttctcctgcagttgctaggaaactgaagaaagcaagtcctaaggacatcttggctatagacgatggcactaagagcatggttagtgtgcagtcagagcggccacggaggcactccattgctggatcaatagtgggagatgatgaaagccttgcaagctctccatctattccaagttacatggtgccaactaaatctgcaaaagctaagtccaggatgcaaagtccatttgctgcagaaaacggaaccccagataaagggtcctctgggactgcaaagaaacgtctttctttcccagcttcgcctgctaggccaaggaggcactcaggtccaccaaaggtagagagcagcttcaatgctgaaatcactgtgggaaatggtgtggctggttga

SEQ ID NO: 55598 - DNA, 1428 bp, Glycine max
  Peptide Sequence Number=SeqID_172376
atggccgattctggcttcactagtaacaggagggatcccattaagtcctcagttgggaatgccgcggctagtaggagacgacagcatgcagtcacagtggggaaagaaaggagggaatcgctgatgcgcgcgaaaagattctgtagggtgggcattgatggcggcgatggcggtgatggcgaagtttccgttgacagtgacatgttaattgaagaagagcaatccattttggagtctcagacttcagcggcagtggaaaatttgaaatctgccattgcttttcaagggaagggtgcagtgaagaaaagagtgggggctcttcaagagttaaggcgtttgctgtcaagatctgaatttcctcctgttgagtctgctattaatgctggagctgtacccttgcttgtgcagtgtctttcatttggttctccagatgaacagttgcttgaggcagcttggtgtctcacaaatattgctgcagggaatccagaagaaacaaaagctttgttgcctgcattgcccttgcttattgctcatcttggggaaaagagctacccacctgttgctgaacagtgtgcttgggcgctgggaaatgtggctggtgaaggtgaagagttgaggaatgttctgctagttcaaggggcattactacctcttgcaagaatgatgctaccaaacagaggttcaactgttagaacagctgcctgggctttgtcaaacctaatcaagggcccagatcctaaagctgctacagaactcgttcgtattgatggagtattggatgcaatcattcgacagttgaagaaagcggatgatgaattagcaactgaagtagcatgggtggttgtttatctatcagcactttcaaatatagctaccagcatgctggtgaagagcaatgtactcgaattgcttgtacataaattagctacatcaaacagtttgcaattaatgattccggaagcatcctgggtgctgtctaatatagctgctggttctgttgagcacaagcagttgatatattctagtgaggcagtgcctgtgctattgcgccttttttctgctgctccatttgatataagaaaggaagtggcttatgtattgggcaacctttgtgtttccccaactaaaggtgatgacaagccaagtctgatcctggagcacctggtttcacttgttgaaaaaggatgcttgccaggttttattgatttagttagatcagctgacatcgaagctgcaaggctaggacttcagttcatagagcttgttctgagggggatgccaaatggtaagggtccaaagcttgtagaacaagaagatgggattgaagccatggaaagatttcagtttcatgaaaatgaagatctgagaactatggcaaatactctagttgacaagtattttggagaggactatgggcttgatgaatag

SEQ ID NO: 55599 - DNA, 885 bp, Glycine max
  Peptide Sequence Number=SeqID_172377
atggagttagaacataccaactcaatccgacttagaattcgatgccagtttccgtctctcagccctggccatatcgtactcaaacttcaacacattaggtatatgagaagtgtccttcacgtagaaccacctcccaaacgcgctctcttcaataaccggaaagtacggatacaaaacggagttcacaacccagaaccaaaccgcgccgaggaaaaccccaagcgcggtcccagcgaaaacctgagccagcgtatggtaccccaagtagacgcgggaatacatggtgagcagcgcgagggaccacgtgaggaggtggaggggggggttgtcgcgcacgtgccagaaagagaggccgcctctgagggagaggagggtgaggtaggaggcgaagaagaacatgtactggcagtggctggagggccagccgtgggagtcgcacatctcaaggagggcgcaggtggcggggcgggcctgctggacggaggtcttgatgacttcgttgatgaattgggagacgatgaggccgagggcgaagaatatgccctggagttcgcggcggaagatgaagtgagagacgaagccgcccagggagatgaagacggggacaagggatatccaggccaggaagtggccgacgcggtcgcccctctggtagcgcacgtgcgtcagcgtcacggccttcagcgccgtcggggatgtcattgttgtgggagggcaagagaagatctcagatcggggtttggtgtgaaaagtgaaacagatcttctctcccccgttgctacgttacatctggaagcattgatgatttttcaaggcctcaaaaaatttaataaactttttctattggacctacaatgtcaacctaatagaaagcttgagttgtga

SEQ ID NO: 55600 - DNA, 291 bp, Glycine max
  Peptide Sequence Number=SeqID_172378
atgatgaggcttcatgggaaaccagtgcatggagggggaggttggatggtgaagttgatttgtgggattcacaatcatgaattggccaagtccttagttggacatccatacgctgggcgattgaccaaggatgaaaagaaaattattgctgatatgacaaagttgatggtgaaaccaaaaaacatcttgctaacgttgaagaagcacaatgccaacaattgcacgacaatcaaacaaatttacaatgcaagaagtgcatatcgttcttccattagaggagctaatacttaa

SEQ ID NO: 55601 - DNA, 1180 bp, Glycine max
  Peptide Sequence Number=SeqID_172379
gcggccgcggcggcggcgcgttcctgggtgcgcttctcgcggtagagcacgtaggcgcgggcgacgtcgtgctggcccgagcgcatcagggccagttcgacctggtcctggatgtcttcgatatggaaggtgccgccaccggggcggttgcgcaccagcgcgttgacggcctgggtcgtcagttgttcaaccagctcgcgcacgcgggccgaggccgcgccctggccgccgttgacggccaggaaggccttggtcatggcgatggcgatcttgccgggttcgaacccgaccaccgagccattgcggcggatgatgttgtagctggcccattgcccgccgttggcgtcggcaggggaatcggtttgcgagggcggcacggccgagggccgggtcacagaggcgatcggggtcgcaacgcttggacggacgaatccgcatggcgtggccgacgagtatcagcggggtacatcgcgcggggcaggcgccgtatagctttgcatcaagcgggccagctccgtcctgtacttctcgacgttcgcagccttcacgtggccgaagccgcggatggtttctgcaagggcggcgattgtagccgcttgcgccaggttgtcgcggttcaaccctgcgagcaactggtctatggtctggcggtactcgcccaccagcgcgcgctccatcttgcgttcggcggtgtggccgaacggatcgaaccaggtgccgcgcaggcgcttgaagcgggtcagcagcttgagcgcggtcatggtgcgcgggcccagcgtcagcttgcgcggcacgccggtgcgcgggtccttgcgcgcgaagatcggcggtgccatgtggaagcgcaggctgtagtcgccttcgaactggcccttgagctgggcctggaaggcctcgcccgtatagaggcgggcgacttcgtattcgtccttgtaggccatcagcttgaacagtccgcgcgccaccgccatggccaggcgcggcgtcctggcgtcgggcgccagctcgcgctcgcgcgcggcgacgcgttcgaccacctcgcggtaggcctgcgcgtaggcggcgtcctggtaggcggtcaggtcttcgacgcggcgcgccacggcgcgctcgaaggtttccggcacatgcagttgcaccacctgggcgcgcgggcgcagcgcgccttccagcgcttcgg

SEQ ID NO: 55602 - DNA, 504 bp, Glycine max
  Peptide Sequence Number=SeqID_172380
atgaccggtttccttcagtttttccgacgttttccacaaataaacgttggtggcgactctacgcattttcctcctttggaagacgcacctgtaagcctcgcctcgcttgcccgcaaaagggtaggttgcgacaggtaccaccaattgcttgcccctcagtggcatatccaaggcaaggctcgaagttggctagattgtggtggggtgaaagagaggctaagttttgaattgcaaaaagtagcagttgggctaagctcagtagttgggctacgcgcatatccaccgctaagcgcagcttcaacgcgcttagcgcaaaggagaatctggcagagcatcagcatcaaagccacgcgagaaggccagggcacaaaattccacagcagccacattgcctatttagggaaaggagctctggaggtagcaagaggagcagcttttgcagagatacctaggttagatgactttagcattgggaaatgtactgttgccttagaacttgattga

SEQ ID NO: 55603 - DNA, 735 bp, Glycine max
  Peptide Sequence Number=SeqID_172381
atgggtcataaagttcatccgattggtatccgcctcggcatttccaaggactggaactccaagtggtacgccaacaaggccgagttcgctggttacctggcagccgacctgaaagtgcgcgacatgctgcgcaagaagctggctcaggccggcatcagcaagatcctgatcgagcgtccggccaagaccgctcgcgtgacgatccacaccgcccgtccgggcgtggtgatcggcaagcgcggtgaggacatcgagaagctgcgcaaggaagtgagcgaaatgatgggcgtcccggcgcacatcaacgtcaccgaagtgcgcaagccggaactggacgcgcagctcgttgccgagtcgatcgcccagcagctggagcgtcgcatcatgttccgccgtgcaatgaagcgctcggtcggcaacgcgatgcgcctgggtgccctgggcatcaaggtcaacgttggtggccgcctcaacggtgcagaaatcgcccgttcggagtggtaccgcgaaggccgcgtgccgctgcacaccctgcgtgccgacatcgactatggcttcgctgaagccaagacgacctacggcatcatcggcatcaaggtctggatctacaagggcgaggtcttcgatttctcccaggttggccaggaaaagcaggacgacaccccgtcgcgcaacgatcgtcacgatcgcggcgaccgtggtgaccgtcagcgcccggcccgtgaagcgaggtaa

SEQ ID NO: 55604 - DNA, 822 bp, Glycine max
  Peptide Sequence Number=SeqID_172382
atggaaaggcagcaatgcgaccaggccgagcgccgcgccggcaatgtgggaagcccacggcaggcgcggcgcgttgaactgtccagcgatgagcacgacaacggtgatcgcgcatgcggacagcagccaggcgttgggcacccgacgggcgtacagatcgctgatcgcgatccgcaggcacacaccgatggccagcaatcccagcagtgtcatcgcaccctcctttgtccgtcagtggacggtcagcagctgctgtccctgatcagcctgggagcggctcaggccggtgtgttgcctgacgccttgtcggcaagcttggtgagattctcaaagagcgtttcgaagaaatccttgatctgcgtgctgcccagtgcgatcaggacacccgcaatcacagccgccagcaggccgtactcgagtgcggtaacgccatcttcttccttcaggaacttgcggatcgatgcgttcatgacgtttgtctccctctacctgtctgctacaggacacctgttgggcggtggcccggctccgccgggatcgtccgtggacctccgcacgtcctggcggaggaggcacggcgggatggacccgccatgctcaagcagggtgatcgattccaggcgggacgccgttcgcgcaaccgcgaccgcacggcgcggagccgttggtcgaagtgtcgagcgatacgtgcatggtcatgctgtccccctgggtgtggtcattatcaaagaccggatcaccgtgttatcgactttgcctgaatggcggccggctgcaaccggaacctatatgcaaattcggcagaatcccttcggtccttaa

SEQ ID NO: 55605 - DNA, 321 bp, Glycine max
  Peptide Sequence Number=SeqID_172383
atgggcgccggcgatgtcaaattcttttcggtactgggattgatgctgggctggcaggcactgctgccgatctggatcgcggccagcctggcggcgggcgcacatgccgcactggtgctggtatcacgccggttgggtccagtactgcccatcggccttcaagcccatatgcatcgggcaagttcgcaatggcattcgcacccggcgctacgcggaatgcagagcgcccgccagggacgccaaggcattccctacgccgcctacctggcggtatccgccatcgcctggatcctcatcagcacgtacggaggtgtggcatga

SEQ ID NO: 55606 - DNA, 819 bp, Glycine max
  Peptide Sequence Number=SeqID_172384
atggccaaacagcaagttagggattgtgatcggttacaaaaaaaatgtgatgtgtttgcaatcacagctgctggtgattttgtagcgcatgtgttgaatgcttatactggagaggatgttgctggaaagatcttgtcatttgcccagaagggtccaagaggaatatgcattctctctgccaatggagctatctcgaatgtcaccatacgccaacctggttcttctggtggcattttgacttatgaggcatggtctcttagatctaaatgctttttgattcctgtgtcagatctaacactggaaatgggaaataagggtcggtttgagattttatctttgtctggatcattcacagttgttgacaacagtggcatgaaaagccgaactggtggattgagtgtctcacttgctggccctgatggtcgggtcataggtggtggtgttgctggacttttaactgctgctggccccattcagattgttgtaggaagcttcatgcaaaattgttgcaagacccaaaagaggaagtatcaacgtgaacaacagatagtggcggccacccctacttcagctggtccagaaatagtgacagcagcaatacctatctcacaagcaaatgctgctgatggtgagaactttctgatacctatacctatctatcagattccagaccaaaaccagagagaatctatcagtgtttcaagtgacaaacagaacctagatgctactcctgatgctgctgctacttggaatggttctgaggaatattcagaccagaggacttctccagacatcaacatatctttgccagatgaatag

SEQ ID NO: 55607 - DNA, 552 bp, Glycine max
  Peptide Sequence Number=SeqID_172385
atgtctcagatgctaagacccccgtctagaggtggccctagggatttgaaattgcttcaatcttataaggatcatgtagttgggcgtgtatggatcagtgagctcagagcagagttaaagttgatcaaccatggtagcagtgttattccttaccctacccagccgacggtgaaagagtacgtggttaggtcaaggctcttggacctatatgatgcgcagtacacaggcatgagtaatggcgtaatcaacgcctttattgagagatggcacaatgaaacctcctccttctaccttttagttggaaagaagaccatcacccttggtgatgtgtcttgtcttttacatctgcctatcataggccagctccttggtcacacaatgacaagctacaccaagaagaaaattagacgtttgttgagatcacaacttggtattatgacaaaccaggaggcaaatgttgtgatgtcagtaggcaacaaggcatgggtgtctaagcatatgcccaccattcaggggcggctcaaggacttaagaggcctaaagcaaatttaa

SEQ ID NO: 55608 - DNA, 110 bp, Glycine max
  Peptide Sequence Number=SeqID_172386
atggcactatggtcatacgctgaatctcgtctcaataattatctgcccatgacacagacttcattttacgtgtttgataaaatgcctgagttgtgtgaatcgtgtttacg

SEQ ID NO: 55609 - DNA, 1631 bp, Glycine max
  Peptide Sequence Number=SeqID_172387
tgatcaaagatcgatgcgcacggcggaaatcgtcggcgacgtgggaggcctggccctgcctgggagatggttcatgcgcggaagtgtcgacccgtcggttcgcaaaggatgttgcgatgcccgctgatctgctgatcggggtggatgccgggacctcggtgatcaaggctgtcgccttcgatttaggcggccgacaggtcggggcctcgtccgtacccaatcgttacctgcgcggggatgacggctcggcgacccagtcgctagaagcgacctgggccgactgtgtcacggcgttgcgagggctggccgagaaggttgagaatctggcggctcgaacggcagcgctcgccgtcacggcccaaggcgacggcacctggctggtgggagcgggcaatgtgccgacggccgatgcctggctatggctggacgcacgggctgcgcccacagtgcagggcctggcggcctcgccgctgaaccgggcgcgcttcgagggccacgggcacgggcctcaatacctgccagcaggggtcgcaaatggcccatatggaccgtcacgacgcgtccttgctcgacagggccgaagtggcgctgcactgcaaggactggctctatctgaatctgacgggtgtgcgcgccaccgaccccgctatgacgatacggtgattgacgcgctggggcttaaccaccggcgccacctgctgccggagattatcgacggcacgcaaatcacccatggcctcaccgctgacgccgcccggcaaaccggcctgctggctggcacgccggtgtgtctcggctatgtcgatatggcgatgaccgcgctcggtgccggggtgcacaccggtgaagccaataccgcctgttcgattgtcggctcaaccggcgtgcatctgcgcagcgtcaccattgacgaggtatggctcaacccggcgcaaaccggctacgtgatcccgctgccgtggccaggttatgtcactcaggtacaaaccaacatggcctccacgctcaatctcgactggctgctgaacgtggccagcgatctgctgagcagctttggttgtgaaaccgatcatgcgcggctggtgcagcagatcgatcgctggctcaacgacgcgcagccgggtaccctgctgttccatccttacatttcactggccggtgaacgcggaccgtttgtcaacgccgacgcgcgcgccagtttcaccggccttaactaccagcacaactttggcgacctggtgcgcggcgtgattgaaggcatcggcatggcagctcgcgactgttatcaggcgatgggcgccacgctgccgggagaaattcgccttaccggcggtgcggtgcgatcgcagccgctcaggcaaatccttgccgcctgtatcggcgcgccggtgcgcatcagccagcgcgaggaagccggcgcagcgggtgcggccatgatggcagcggtggcgattggcgcgtatccggacatggcgcagtgcgttgaacgctgggtgcgcccgctgctggacgacgccgaagcgccgtcgcctgcgctgatgcagcgctaccagcagctgttcccccagtatcagcagatccgccgcgatcttcctgccgcctggcaggcattaaacagttttaaggagtaa

SEQ ID NO: 55610 - DNA, 658 bp, Glycine max
  Peptide Sequence Number=SeqID_172388
gcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacctcacccgtcgagcagggacgaaagctgatcttcccaagagctcacatcgacgggaagggttgggctgttcgcccattaaagcggtacgtgagctgggttcagaacgtcgtgagacagttcggtccatatccggtgtgggcgttagagcattga

SEQ ID NO: 55611 - DNA, 225 bp, Glycine max
  Peptide Sequence Number=SeqID_172389
atgacgaacaccacctttagcacaaaccaaaacaccaaccaagaaatgaattttgcagcgaaaaagcctgtagaattccccccaattccggtgtcctatgctgacttgctcccatatctacttgataattcaatggtagccataaccccagccaaggttcatcaacctccatttctccaacgcaacgtgtgcttgtcatggagaagccccggggcgttccattga

SEQ ID NO: 55612 - DNA, 362 bp, Glycine max
  Peptide Sequence Number=SeqID_172390
cttgtgaggaggtgttggagtatgatcacgagcaacctcttgcaactaggtggaggccgttgagggataccaacaaggtggattcgactaaggaggtgttggagcgattgcagttgactggtgttgtttggtctccatatgcatcacaaagagacctcagacctttcaaagaccaaacatactactctggaaacataagagttgggacaaacatatcgctatatctaccagaaagggttttgagaaagttcagaaacaatatatccgacaaatcttggttcacaccacagggcaatgatttgttctggagatcggtcaacctttgcatacaacttgattggttctttagaactaaactctga

SEQ ID NO: 55613 - DNA, 523 bp, Glycine max
  Peptide Sequence Number=SeqID_172391
ctgggacataattgcagagagactgggtttcatgttggtttttggagatttagtgtggattcctttcacttttagcatacaggggtggtggctcttgatgaacagtgtggagtcaacaccagctgccattgtagctaattgctttgtcttcctgattggatacatggtatttcgaggagcaaacaagcaaaaccatgtattcaaaaagaatccaaaggctcgtatttggggtaagcctccaaaagtcattggcggaaagctacttgcttctggttattggtttttaggtagagggaaaggagagaatagagtatcacattctgaaattgatcttcattatgatgttttacaatgtcatacaaagcataaacacttcaccaattccatacttctatccagtttatcttcttattctgttaatctggagagagaagggatgaagctcgttgtgcagagaaatgagaatggcatggtcaaagctcctaggcttatcaaaagtaacagtgtcatgttcccagtttaa

SEQ ID NO: 55614 - DNA, 2658 bp, Glycine max
  Peptide Sequence Number=SeqID_172392
atgaagggtggaaaaaagaacagaaagatacccgccacgctttttaagccagttattctaaaaccagtgcctatctacacgcttggggagaaaaaccaaaagggttatcatcgtgcatgtattgatttctcacttggctctgagaaaccaatagttgctgttgacagtggcaaagcttctgatgcggttgaggctgaagcaaggaactctagtgtagggcaaaatgatagattgaagaaaccgtttgttccttcattcatcattgacaataccggcgatcctcatgaaacatacattgcttgctgtagcaagagaaattctcaggatatcccatttacgcttgacaatgctgacaaagacaaagaagaaagcagacaaataacgtcaatgcaaatcaataaggaagaaaagaacaaagaactctgtgaccctatcgtagaatttgctgctgtttcttcaacattcaaggaaaatcacaagtcggacaagggaagcagtcatggtattgatcttaataaaccatcgcaactcaagccaaggagaagaaagcatcgtcttaaggtcattgaagaagacaaaccccaaagaactgagaagcctgttacaccaaagtctgttcaatcaaaagaaaacccaactcacaagaggaagtatgagagaaggaaaggagtgaacaagacatctgctcctccaagagaagttcctggagaattgattaaagaaacaatgcctgaatctgcccaaacgtcgtgtccagggtatgtaaattttgatgaaagagcaagagttcgaagttatgcagtcgaagataatccaactgtacatctgggcagtgaaattggtgtagtcaggcaggaaatgaaagtagggcttgcctgtgatctaaatgcttccatgaagccaaagaaaaacccaactggcaagaggaagcatctgagatggaaaggagtgaacaagacttctgctcctcctacagaaatgattggaactaaaaaaaagatgcgtgaatccgcccaaacatcatgcaaggggtctgtaaaatttgatgaaagagcaagagatcaaagttatgcagtcaaagagaatccagctgtatgtccggtgcaggaaatgaatgtaggccttgcatgtgatctaattacttccttgaagctagaggaaaaccccaatgtcaagacaaagtacatgggaaggaaacaagtgaacaagacgtctgcgcctccaacagaagtgactggagaactgactaaagaaaagatgcctgaatcttcccaaatgtcatgtacagggtctgtaaattttgatgaaagaacaagagatcaaagtaatgttgtcaaaaagaatcaatccgtacttctgggcagtgaaattggtgtagtcattcaggaaatgaatgtaggctttgtctgtgatctaattacttctttgaagctagaggaaaaccctactgctaagatgaagtgcatgagaaggaaacgagtgaacaagacttctgctcctccgacagaaatcattggaactaaacaaaagatgcctgaatccgcccaaacgtcatgcacagggtctgtaaattttgatgaaagagcaagagatcaaagttatccagtcaaagtgaatccaactgctgttgcttggatgaagaaggcattaaataattccatgtcattatctgaggaaacacaacacccaagtacacctattcctccaacagaaatgactggcaagaggaataatgcgaggaaaaaaggattgaatccgtctcctaacatgtcatggagaagatccttaaattttgatatgggaactagaaatgaaagttatgtaggcagagaaattttagattttcacattgggaaggaaaatatggtgttagaggaaacaaaagtaggtctcacctataaagacacttgggtcaaagaggcactgaatgtttgcatgtcattacctgaggaaacacaacacccaagtacgtctaattcaaaatgcacttcacttggggcaaagctgaatgccaactctatggagaacaaaaatagaaaaggccagacaactgctcaggatggaaacttcaataatagccaaatttcaacaataaggttacaaatggatggttcaaagagaaaacattctcgtacctttaattgtgcagattacagcagaatgaatcggatcggggcacactacaatggactgccctcatgccagactaacttttgcattcagtttccaaacatacagaagaaaaggagaactaaaaagggggaaacttctaacacttccgttacatctgtgactacaacaaaagaagtccaacagacataccctcaggaagatgctctagcacattcatatgcatcaagctccagatgctggatttatggttctggatataatgctgctacagtcccagccgtaagtgaactgacagaaaatttaattgataatactcatacattcaacgagttcgtcttggctttgaaaaggctggcagaaagatctcaatcctctacttttgatcgtgatacgaaaaatgagggtacattaagcaaaaatggcaacagaaaggaagaaaaagaaggaattctgaagcaggcccagcccaacagtgacgctaagcgcgcatcaggcgctaagcgagcaactaactgcaggcgctaa

SEQ ID NO: 55615 - DNA, 633 bp, Glycine max
  Peptide Sequence Number=SeqID_172393
atgatgatcattttgtgcatacacgtagatggttccgatgcaacagaagatcttgatgttactataacattcgatgatccggaagaagaaaccaatgacagagaagggttcaatgggtcaatgcaaagaaaaaagggagggagaggagttcaacaagacagttgcaagcaaagtcagtcaaaagcccacggggtagaccgaaagtttcaacttctacaccaccagaagacaacaacacccaatgttagacaacaagacctgaaagatcacaagtgggtaataggaactttgtttccaactaaagatgagttcaaggaggctgtcatgacatatggtgtccaatcaggcagaaatgttaagtttgacaggaatgacaaggaaagggtaagagttgggtgtaaggaaggatgtcggtggtcaatttatttagcaaagaataaaaatgaaaaaacatggcagataaggacattgaaggatgaacatacttgtagcagggagtgtagagttacaatgatgaaatcaaaatggctaagcaagagattagtgaatggtgttagagaaaagccaaacacccacccaatcccaaccacctccaccaacaccaacccaaacccagcaaggtcaaccctttag

SEQ ID NO: 55616 - DNA, 546 bp, Glycine max
  Peptide Sequence Number=SeqID_172394
atgaggtggctagaaacggcgttttttatccggcgtggcaaccttattgagacgacgtcgtttcaatcatctgggttctcaaacaaattaaagagcgcgtttttggtgtcaacacttgcttgtttacgaagtaaaaataaaaactttgaggaactgaagcgtcgaacactcactggtgatgtaggaatggaggaagagtactttaaagtgaaagtgcaccatagtggtaagtttgtcaaagggaaaaaagttacctacgaagggaaggactatgaaaaaggatataaagatgttgaaactctttggtataaggctgcaggcagggatctgaatgatggtttgaaacaactggttgatgatgctggtgcattggagatgattcgaattgctaaatgtgaaggatgtgttcatctctatgttttgcaccctgagattgttcatcatattgttggaaatgaaaggaatgatttacctgaaaaccatattgcccaagacaatattcctcaagaaactcctatggctgaagacaatgtttctatacaatag

SEQ ID NO: 55617 - DNA, 150 bp, Glycine max
  Peptide Sequence Number=SeqID_172395
atggcctctctgaggatgctgctctgtcttctctctctgtcttttctccctctctctctgatggccttttataatgggtttttgcacccacaatggctcaagacctctataactcttgctgctgccacaaaactcttaatcaccatttaa

SEQ ID NO: 55618 - DNA, 1266 bp, Glycine max
  Peptide Sequence Number=SeqID_172396
atgggtttgatttggagccaagtgaaggagccagtgatcgtgccaatgctgagggtgtcagtgtttctgtgcttggccatgtcgttgatgatgctggtcgagagggtgtacatgggcattgtcatttgcttggtgaagctgtttggtcgaagacccgagaagcgttacaagtgggagcctatgaaggacgatgttgagttgggaaactctagttatcccatggtcttggtccaagtcccaatgtacaacgaaagagaggtttatcaactatcaattggtgcagcttgtggtctttcttggccttcagacagaatcatcatacaagttcttgatgattctactaacccaacaatcaaggagctggtgcaaatggaatgtagtagatgggcgagcaaaggggtgaacataaagtacgaggtgagggacaacagagacgggtacaaagcaggggctctgaaagaaggcatgaaacggaactacgtgaagcaatgtgactatgttgccatctttgacgcggattttcaaccggaccctgatttcctctggcgaactgtcccattccttgtcaacaaccctgaacttgctcttgttcaggcactgaatgccaatgaatgtttgatgaccaggatgcaagagatgtcactggattaccatttcactgtggaacaagaagtggggtcttgcacttatgccttctttggcttcaacggaactgctggtgtatggagaatttcggcgctgtatgagtctggagggtggaatcataggaccacagtggaagatatggacctggctgtgcgagccagtctcagaggatggaaattcttgtacctgcccaatttgaaggttaaaaacgaattaccaagtactttgaatgcctaccgtttccaacagcacaggtggtcttgtggaccagccaatcttttcatgaaaatgttcatggagattatgagaaacaggaaagtgtccttgtataagaagatatatgttatttacagcttcttctttgtccggaaggtcgtggcccacatcaacacttttatgttctattgcattgtgttacccgctacagttgtggtgcctgaggtggttgtccccaagtggggtgctgtttacatcccttccatcatcacactcctaaatgctgttggaactccaagaaatgacaatggggaagattccaaccctccacctctcctctcttctttcttccttcacccttcccgaaccattggaccaaccttatatctctcctttgctctataa

SEQ ID NO: 55619 - DNA, 195 bp, Glycine max
  Peptide Sequence Number=SeqID_172397
atgacttcagaaacaaaaggcaacgctccagcctttgtagatgagctgaggggctttagaggtggtggcagtgcgcctgttgcccactactgtgatgcctcgccctgcacctgcctgggggcgcagtacttcttgatgaaagcccagctaatagggggcctgatgaccttgttgggggtgacaggctctccgtag

SEQ ID NO: 55620 - DNA, 614 bp, Glycine max
  Peptide Sequence Number=SeqID_172398
agggactaaacgtcctcgcctttagagggctacacgtcctccccttcagaggacaacatgacctcccctttagaggactgcacgccctcgccttaacaggactgcatgttctcaccttcagaggactacacaacctcgccttccgagggctagacgcccttgccttcagaggagtacacatcctccccttgagagggctacacgccctcgccttcgtagggttacacacccttaccttcaaaggagtacacgtactcaacatcagaggactatacatcgtcgccatcagagggctacacgtcctcgccttcagagggttacacgtcctccacttcagaggactacatgcccataccttcaaaggataccttcataggactacacgcccttggcttcgtaaggcttcacgccctcaccttcagaggactacacatgctcgcctacagaggactacacgcctttgccttcgtagggctacacgccctcaccttcagaggactacacatcctcgttttctgagcgatacatgccctcgccttcagaggactacacgcctaacctttcaggggtctacacgtccttgccttcagtgggctacacgtccttgcctttag

SEQ ID NO: 55621 - DNA, 341 bp, Glycine max
  Peptide Sequence Number=SeqID_172399
atgtccaacacttcaaaggactacatgtcctccacatcagaggactacacgttctcccctttggagcactacatgtccttgccttacgagggctacacggcttcaccttttgaggactacacgccctcaccttcagaggattacacaggattacacaacctcgccttccgagggctagacgccctcgccttcagaggagtacacatcctccccttgagagggctacacgccctcgccttcgtagggttacacacccttaccttcaaaggagtacacgtactcaacatcagaggactatacatcgtcgccatcagagggctacacgtcctcgccttcagagg

SEQ ID NO: 55622 - DNA, 695 bp, Glycine max
  Peptide Sequence Number=SeqID_172400
atgggatcaagtcaaatgccttcgcttaaaaagagattctatcaagtcaaggttaagagcctagggatcaccagtctaaaggagttagggcagttgatgggtcagctccagcggcaagcttttcgcaaagcttacggtaaaatctgggacctagccatgatagaagtctctacagaggccattgcctccctcgcccagtattatgatcagccgttgaggtgcttcacctttggggacttccagctatcacccatggtggaagaatttgaagagatcctaggatgccctctaggggggaggaaaccatacctcttcacagggttctatccctcattagctagaatttccaagatagtccaaatctcagcgcaggaattagaccacaggaagcaagtcgaaaatggggtggtcggaataccgagaaaatatttggaggtaaaagcaagaatcttggcagataaaggcgagtgggtcccgttcatagataatcttgcactattgattttcgggggagtcctctttccgaacgtggatgggttggtggacctggcagcgatcgacgctttcctcgcctatcataaccacaaggaaagcccggttgtcgctatgctagccgatctatacgacaccttcgaccgaagatatgaaaagagcaatacaaggattgtttgctgtactccagctctttatgtatg

SEQ ID NO: 55623 - DNA, 191 bp, Glycine max
  Peptide Sequence Number=SeqID_172401
acacgaccattgaagttcacaaggatgtgggagatttcagtgatgatgaagatcttatgttgtctgagatcgccttctaccaggaggttattggtgaacaaatacttaagggagagatgctttcatccgacgaggaatgcgactcctcgggagatgagagtgacccttccaaagatatgacttcgccttag

SEQ ID NO: 55624 - DNA, 783 bp, Glycine max
  Peptide Sequence Number=SeqID_172402
atggaaccagaattggccatgatactttacacttatagaacagtctttgatgtgccatcaggattaccccctagcagaactcacaatcattcaatcccattggttgaaggtgctggaccagtaaaagtcaagccatatagtatattctcaaatcttgatttgagatctggttatcaccaaatactagtaaatgaggaggacaggcataaaacagctttcaggacacatcaagggcattatgaatggcttgtcatgccatttgggctcactattgcccctgctacatttcagtctctaatgaatgaggtatttcagtgctatttaaggaaatttgtactagtcctatttgatgacatacttatatacagtccaaactggtcagctcatttacaacatttggaaacagtgctgaaagtgttagaacaacataagttgtatgccaaattatccaaatgttcatttgggttacaagagatcgattacttgggccacacagtatcaggcaagggagtaacaatggatcaagaaaaggctcaagcagtcctgaattggccatatcctataaatctgaagcaattgagaggcttcctcggtctgactggatactacaggaaatttatcaaaggttatgtgtcaatcgcaactcctttatccaatctgttgaagaagaaaaaccttcattggaatgaccacacttccatggcttttgacaatttgaaagctgcaattaccaaggcaccagtactggcattgcctgatttttccaaagcctttacattttaa

SEQ ID NO: 55625 - DNA, 339 bp, Glycine max
  Peptide Sequence Number=SeqID_172403
atgggtgaagtagagaagttgcccgctaccaacgctgttgctaaggtgaacccgatgcccccatctggcctcaaccaaatgaatcatccaacctcaaatatggtaggcaaagatttgggaagtacggacgaccccatgatgtgcaaattcaaaacgagcacgccttcccatcatatggcttgcctcccaactatacaccacccaatgtggcatacactctcaatgaaaatctcaatgactccactccgatactcattgagaaccaataacctcaatctgatcaggcacatatctctcaaaccatgggggagacacatgaaattccccaccacaatctag

SEQ ID NO: 55626 - DNA, 198 bp, Glycine max
  Peptide Sequence Number=SeqID_172404
atgaggggcaccgtgcatgagcctcaagtgaacataggggccgatcaaaagttcacacccgtcgatggtggaccttgggtactagttaccctcactgttgagaggactacacgtcctcgccttgagaggactacacgccctcccccttgggtactagttaccctcaccgttgagaggactacacgtcctcccccttga

SEQ ID NO: 55627 - DNA, 234 bp, Glycine max
  Peptide Sequence Number=SeqID_172405
gtacggcctaaatcaaatttggcgtcgttgccggggagtagtgggccaaaggtgtggctgcatgagactttctatcagtacacgtgccaccggcagggccaggattccagcccatacacgtggcctactacggagcagtttgaggttgcagtagcatggccggaggattggcccgaggatcagactagactcgccggtgctcctggaggtgaggacgaggttgaggatgattag

SEQ ID NO: 55628 - DNA, 492 bp, Glycine max
  Peptide Sequence Number=SeqID_172406
atgtcgtaccggatgtcacgacatcacgcttcagaacatgcagattatatgtgtccgtatgaacagattaaacaacccctgtttacaaccttctcacctaaccactacccgtgcaatctctacctaagagccactcttagatatgagaacctccgctcactccctctcactcacactcccgtgtttacaattaagtcaaagacacaccagagatcaactctgaacaaaagagatcaactctacacactagagatcaactctacacacataggtccaacacttgatgctagggtaccatcaaggtggctcacaaaagactcaagtcccaaaaactcacaaactaactcttcaatcccggacttggtacagaactcgtgcagcctccatgattatatagccgtgtacgattctgggctgcaactccttgatgctggaggagatctatcttcttctgaaaaatctgcagttaaagagctaaaagataacttttga

SEQ ID NO: 55629 - DNA, 165 bp, Glycine max
  Peptide Sequence Number=SeqID_172407
atgtacatggtgaataacatcttcacacgatctaggcgcaaagaaaacatcaagataatgcaccataggcctagggccatcccttacaaccccctaactcaaaccaacaagcatgaaacaaagccaaaattgctccacagatttgggcacattcacacaatttaa

SEQ ID NO: 55630 - DNA, 276 bp, Glycine max
  Peptide Sequence Number=SeqID_172408
atgattattgaagaatccattcatgttgcttttgatgaaactaatgcaattttgccaagaaaggatatactagatgatatttcagaatctttagaagaaatgcatattcatggtgaagaacacaaaggcaaaggagaaggaaatgatgaagatcttcacattgatgaaataaaaataaatgctgatcttccaagagagtggagaacttctagataccatcctcttgacaacattattggtgatatatcaaaagggatttgggatggaaaatgctaa

SEQ ID NO: 55631 - DNA, 138 bp, Glycine max
  Peptide Sequence Number=SeqID_172409
gaaaatgagggaggcgtttgccacccagctcccccaggtgagctaggttgcttcctccagatggcaccgccttctggtggaacttcctggaaggcccaagtgggcccgattgctatttgtaccccccctgtttactaa

SEQ ID NO: 55632 - DNA, 234 bp, Glycine max
  Peptide Sequence Number=SeqID_172410
atgactgaccgatcgtcgtctcttcccggcgttggacaagcagaggacgtcgctgcaaggcagcccaaaatggcctcgaggaaacttgcctcaaagagatccaggaaggataaggcggccgaaggaactagttccactcctgacgcttcgaggccatcaagggatagtcatttctccgggagcgacgcatccagctcagggacgatgagtataccgatttccaggaagaaatag

SEQ ID NO: 55633 - DNA, 1159 bp, Glycine max
  Peptide Sequence Number=SeqID_172411
atggcgcgcgccacgccggcgaaatcggtgcccgcgaaatccacgcccagtgttgggcaggccgttggcgcgctgcttgatctcgatcagcgacagggattcgtcggcaaagacgaagacgatcaccggcgcccgcgcgtcgcgggccgtcgccagttcgcccagcgtcatttccaggcacgcgtcgccggtgaacacggccaccggccgttcgggctcggccagcttggcgccgatgcccagcggcagcgagcagcccatggtgcacagcgccgaggactgcatcagggtccgcggttcatggcattgccacacttgcgacaacaggatgcgatgcgcgccgctgtcgaccgaggccacggtgttcgcgggcagcaacgcccgcgccacatcgacgatcgcggccggcccccattcctcgtcggcgcggtagatggcggcgatggcgcgcttgatgtcggcaacggcgccttcggtccactgcgattgccccgccagcccggcgcccagcgcggccaggctgtgcctgatatcgccgacgaacgagatcgccgactggtgcatgtaatgggtgttgcgggtcgcggacacctcgatcacccgcgcgtcgtcggcccagacattgcgccatcccacgcgcatctcgatcgggtcgtagcccgccagcaggaccacgtcggcctcgcggacgagcggcagcacgacctggtctgccaatggcgacagccccatgccgccgatcaccatgtcgctgcgctcgtccacgatgcccttgcccttgtaggtcgtgatcagcggaatcctcaactcccgcaccagcgcctcgacctgcgcctgcgcgtgatgatgcagggcctcgaccccggcgatgatcacgggccgcctggccgccgccagccaggcgcgggcttgctggaagcgctccgtatcggccggcgccaccggcgccggcggcacgcgccgcgcgcccctggcgggcatgacttcctgcagggccaccgaaatcggcacatccacgtgcaccggccccggcgggtcgtccatggcgatggcgagcgccttgtcgatgatggcctgcgcggcgccggcggacatgcgcagcgatgccttggtgatcggccgcatcaatgccgcgtggtcgaacacctgatgcgtatag

SEQ ID NO: 55634 - DNA, 1359 bp, Glycine max
  Peptide Sequence Number=SeqID_172412
atggttactggttttgcacagtttggggattctgataaggctttgaagctgttttatgatatgcatcaatctggagagttgcctagtgagtttactcttgttggggtcatcaatgcttgtagtgatgcttgtgctattgtggaagggagacaaatgcatgggtattccttgaagctggggtatgaattgcagttgtatgttttgtcggctttggttgacatgtatgcaaaatgtggtagcatagtggatgctcggaagggttttgagtgtatacaacaacccgatgttgttctttggacttcaatcataacggggtatgtacaaaatggggattatgaaggtgctttgaatttgtatggcaaaatgcagttggggggagttatccccaatgatttaactatggcgagtgtccttaaggcttgttctaacctggcagctttagatcaaggaaagcaaatgcatgctgggattattaagtataatttcagcttggaaattccgattgggagtgctctttctgccatgtatgcaaagtgtggaagtttggatgacgggtaccgcatcttttggaggatgcctgccagagatgtaatttcgtggaatgcgatgatatctggactttctcaaaatggtcggggtaatgaaggcttggagttgtttgagaagatgtgcttggagggaacgaagcctgataatgtcacgtttgtgaatcttctctctgcttgtagtcatatgggactggtggacagagggtgggtttattttaagatgatgtttgatgaatttaacattgctccaacagtagagcattatgcttgcatggttgatatcttgagccgtgctggtaaactccacgaagcaaaagagttcattgaatcagcaacggttgaccatggtctgtgtctgtggcgcatattattagcagcctctaagaaccatcgtgactatgatcttggtgcttatgctggagagaaactaatggagttaggctcgctggaatcatctgcttatgtgttgctatcaagtatatatacagctttaggaaagtgggaagatgtggagcgagtaagggggatgatgaaagcccgaggggtgactaaagaacctggttgtagctggattgagttgaaaagtttgactcatgtatttgttgtgggagacaatatgcacccgcaaattgatgaaatacggttggggttaaaactgttaaccaagttgatgaaagatgaaggatatcaacctcttttggattcattgcctcctgaaactatcagtgatgatttgaaagatcaagaagacagccatgagatacaacttaggctgagggcattgtcacccatcaagaaacaaggtaattga

SEQ ID NO: 55635 - DNA, 3090 bp, Glycine max
  Peptide Sequence Number=SeqID_172413
atgtattcactaatgggcataaggttaaaagatgttcgcttgataggaatatggggcaggggaggcataggtaagacaaccattgctagaaaagtctatgaagcaatcaaaggggatttcgatgttagttgctttcttgaaaacattagagaggtgtctaagacaaatggcttagttcatattcaaaaggaactttctaatcttggtgttagttgctttcttgaaaagtgtaagacaaatggcttagttcccatagtagaggaagtttttcgtgatcaattaagaatcgttgattttgataatcttcatgatgggaaaatgataatagcaaactctttaagcaacaaaaaggttcttcttgttcttgatgatgtaagtgagttaagccaattggagaatttagctggaaagcaagaatggtttggtccaggaagcagagtaataatcacaactagagataagcacctgctgaagacacatggagtgcacctaacttgtaaggctagagccttagcccaaaatgaagcccttcagctcatttgtttgaaagcatttaaacgagatcaacctaaaaaagggtatttgaatttgtgcaaagaaatgattgaatgtgcaagaggccttccattggcacttgaggtgttgggttcccatcttcatggaagaaacgttgaggtttggcatagtgctttagaacaaataagaagttttccgcactccaaaatccaagataaactgaaaataagttatgacagtttacaacctccatatcagaaaatgtttctagatattgcctgtttcttcaaagggatggacatagatgaagtaaaaaatatcttaagaaattgtggtgattatcccgaaattggaattgacattttgattgaaagatgtttggtaactctggatagggtgaagaataagttggggatgcatgatttgctacaagaaatgggtaggaatattgtatttgaagaatctccaaatgatcctggcaaacgcagtagattgtggtctgaaaaagacattgactatgtattgacaaaaaacaagggaactgataaaatccaaggcatggttctgaacttagttcaaccatatgattctgaagtgctctggaacacaggagccttctccaagatgggtcagttaaggttactaaagttatgtgatatgcagctaccccttggccttaactgccttcctagtgcactacaggttcttcattggagaggatgccctttgaaagcccttccactttggcatgggacaaagcttctggaaaagctgaagtgcattgatttgagtttttcaaagaacctaaagcagtccccagactttgatgcagctccaaatcttgaatcattggttcttgaaggatgcacaagtttaactgaggttcatccatcccttgtacgccataagaagcttgctatgatgaatttagaagactgcaaaaggctcaaaactctaccaagtaacatggagatgagttccctgaaatatttaaatctttctggttgttctgaatttaaatatcttccagagtttggggaaagcatggaacaattgtcattgcttattttaaaggaaactcctataacaaaactaccctcatcacttggatgtctagttggccttgctcatttgaatttgaagaattgcaagaatcttgtttgccttccagatacctttcataaattgaaatccctcaaatttttggatgttcgtggctgctcaaaattatgtagcttgccagatggtttagaggaaatgaagtgcttggagcaaatttgtttaagtgcagatgatagtgtagagctaccttcatctgcctttaatctggaaaacctccagattacttttgaaagtcaatcccagacgagttttgtcacttatctcactggcagcaattctgttatcctgcctagttgcatttccaaaatcacaaagcttgaactccttatcctaaacttctgcaaaaagcttcaaaggaactccgtcttcccaaagcaagatttgacatggagtgaaattccatcatggtctgtccctccaaaatatgtagtcccacctgagatgcaccaacatgaagttgaatgctgcttgtttagacctaatggtaaggtgcttatcagctccaggattttacctaccatggagccattattcattggaaatagtgaggtgtgggtgtcgtttggtatttgtgacatctgtgaactattttcctctataacaaaatctgcccaggttgaacacaaacttgtcggacagaatgtgcttaaaacggatccaacaagaaacaattttgttaccctaccaagttgcatttcaaaactcacaaagcttgaacttcttatcctaaacttatgcaaaaagcttcaaaggttgcccgagcttccttcaagcatgcaacaattggacgcaagcaattgcacttcactggaaacttccaaattcaatccatccaagccacgcagtctctttgcatcacctgcaaaattgcattttccgagagaattgaaagggcatttaccgagagaattgataggcctttttgagaacatgcaggaactctgtcttcccaaaacaagatttggcatgtttatcacagggagtgaaattccatcatggtttgtccctcgaaaaagtgtttcatttgcaaaaatagcagtccctcataattgccctgtaaatgaatgggtgggatttgctctgtgtttcctattagtaagttatgctgttccacctgaggcatgccgtcatgaagttgattgctacttgtttggacctaatggtaagaagattatcagctcccggaacttgcttcccatggagccatgttgccctcacctttatagtctctatttgtccattgataaataccgtgacatgatttatgagggtggtgatggcagtgaagttgaatttgtacagaaaagttattgttgccaatcattgggaatagtgaggtgtgggtgtcgtttgaaacttctcattctccatacttgtggtttgaactcaacttttgcatgttttgttgagatgatccatgctaatgagaatcaagatattaagggaaattga

SEQ ID NO: 55636 - DNA, 473 bp, Glycine max
  Peptide Sequence Number=SeqID_172414
atgggatcttcttccaccctaacctcaggaaggttatggtccaaccatgttttcttgagtttcaggggtgatgacacacgcaaaggtttcactcacaatctttttgcttcactagagagaagggggatcaaagcatatagggatgatcatgatcttgagagggggaaagtgatatcagtggaactcatcgaagccattgaagagtccatgtttgcactcatcattctctcatcaaactatgcctcctcaacatggtgtttggatgagctccaaaagattctagagtgcaagaaagaagtttttccaatcttccttggtgttgacccctctgatgttaggcatcagagaggaagctttgccaaggctttcagagatcatgaagagaaattccgagaagaaaaaaagaaggtggaaacatggagacatgccttgagagaagttgcaagttactctggatgggactctaaggataa

SEQ ID NO: 55637 - DNA, 306 bp, Glycine max
  Peptide Sequence Number=SeqID_172415
atgattggtagtgacactgcacttggatcattgcctcattggtgtcttggtttagctaagcaaagccaaaactttgcattcgaatcaaaccgccaaatgttagatatacatgctttcttatttaatgggatcatgatcgtgttaccggctatgaaacaccaacatcgacacggacaccgcacacggtacggatacggacacgtgaacatctgtaatgttcaaaatatagaacgtagtacgggtgtcgtgtcagtgtcaaacactgacacagacgcgtgtcgaacaccggacacgacaaagaactag

SEQ ID NO: 55638 - DNA, 420 bp, Glycine max
  Peptide Sequence Number=SeqID_172416
atgggtgaagcagaggaggtgcaagagaagataaaggccgacatggaggccatgaaaaagcaaatggccacaatgatggaggccatgatgagcatgaagaagataatggaagccaatgcggttatagttgctgctactagcgctgtcgctaaggtgaacccgatgctcccatctggcctcaagcaaatgaatcatccaacctcaaatatggtaggcaaagatttgggaagtatggacgaccccatgatgtgcaaattcaaaacgagcacgccttcccatcatatggcttgcctcccaactgtacaccacccaatgtggcatacactctcaatgaaaatctcaataactccactccgatactcattgagaaccaataacctcaatctgatcagacacatatctctcaaaccatgggggtga

SEQ ID NO: 55639 - DNA, 180 bp, Glycine max
  Peptide Sequence Number=SeqID_172417
atggcagaacaagctagacaagtattttacgtgcaagacccttgtgatgaaaggtggtgcatgagagacaggtcaccaaagcaaatggcatcattaggacttcatacaactcatgtttgtcgccagtttcatcatccaccacccttaccttctcttgcttctcacgtttattgttgttaa

SEQ ID NO: 55640 - DNA, 171 bp, Glycine max
  Peptide Sequence Number=SeqID_172418
atgactctgtctttagagtatctcccatgtgatttaatgagaaaatctgtacaattccaggtcaaaagaggtcaaaatcttgaagtgctaaaaggagcagttgtgctaagcggaccttgtaggctcagggcgcatgcactactaagtgcagcttcagtgtggttagcatga

SEQ ID NO: 55641 - DNA, 326 bp, Glycine max
  Peptide Sequence Number=SeqID_172419
gatatgggctacgtgggagtacgtgagctcagttggaggtgggcaaacaagggatggtggagaggtacctagagatatgtcgcgggggtcaggagaccttggggacgtcaggcgagctcctggcagtcaacagataaaaggaacaaagaccacaaagcaaggaggcttgtggtggctggccagctgtgaattttgtgtgatatatgggttgtggtctctggtaatcgattaccaagggtgggaagctaagggagcctctggtaatcgattaccagtctgtgtaatcgattacacagaggaatgggtcactggtaatcgattaccag

SEQ ID NO: 55642 - DNA, 385 bp, Glycine max
  Peptide Sequence Number=SeqID_172420
atggacattaattttgactcgttcgacaaattcgtagaacttgtcttggatttgttttctgtttgtacccttgtaatgttggaaaaaccatctcctttgaggttcattctccggagaataaaaatctttcctaagggtatgctagaagtagtgtctattccttggaggtttatagtagggaactggttgtgtgactcagatctagttagtcctactggaattgaacgggttctaaccgaaaaagaccttctggctgacttatattcagacctagaggcttctatccttgatgaaaaagaatttctcctattgaaggttatctctacctttccggagttatcttgcttgatatgctctatggttggagcgggtcggggaatagacg

SEQ ID NO: 55643 - DNA, 925 bp, Glycine max
  Peptide Sequence Number=SeqID_172421
atggataaggcaacaccgtctattccccgacccgctccaaccatagagcatatcaagcaagataactccggaaaggtagagataaccttcaataggagaaattctttttcatcaaggatagaagcctctaggtctgaatataagtcagccagaaggtctttttcggttagaacccgttcaattccagtaggactaactagatctgagtcacacaaccagttccctactataaacctccaaggaatagacactacttctagcatacctagaacaacatacaaccaagaacaagaggacgaccaaaacattgataaggaaacccttaggaaagatttttattctccggagaatgaacctcaaaggagatggtttttccaacattacaagggtacaaacagaaaacaaatccaagacaagttctacgaatttgtcgaacgagtcaaaattaatgtccatttctttgattggtttcatgcttatgccatcagaaatgatatagattacccttggaaacaagacatcataggtgatccaacaacaaatgtcataacaaattggcaagttaaggatggtgagttaatccaatcggaattacctcccgcaacacaatatcaactaccaaatatcaaagacagtaacaataaacctgtcatggcaattccattcaagacaaaagatgtcagcgaggaagtaacctctaaagacatcaagagcctaatggaacaggcaaattataccaataaatatttacaagctttaggagaaaccataaaaactaaggtagttcctaaacaaaaatcaattgaggaaacttcgccaagtatccccattgaaaaacctttattcaaacctttcaaagttagtgagaaggctaaacgaaaaattagggaacttagaaaaactaaatccttaattgaaggcgtag

SEQ ID NO: 55644 - DNA, 489 bp, Glycine max
  Peptide Sequence Number=SeqID_172422
tctatcctaaggctcatgagaaccctagggctttctcctacatctctggcccagtcttcttggagtctcctaaccatggctttggtgatgggtcccctccttgagaggattgcatcacaaatgctccctgtcgttgcccggtatccagagtgggttgccaacatcgtgccaatcccaaaaatggatggaaaagtgcgaatgagcatggactatcgagatctaaatcaagccagtccaaaggataattttcctttattgcacattgatattctagtggataatacaacccgttttgccttattctctttcatggataggttttcaagatataatcagataaagatggcaccagaggacatagagaagatgactttcattactcgggccatggtggcattgttccatgacatgatgcataaggagattgaggactatgtagatgacatgattgcaaaatcaaaaatggaggaggagcacttagtcaattag

SEQ ID NO: 55645 - DNA, 245 bp, Glycine max
  Peptide Sequence Number=SeqID_172423
ttgagcttacctcatcagtgggctaagtgcgcatccaccgctaagcgcagcttcatcgcacttagagcgacagaagaatctggcagggcatcagcatcaaggtcgcgcgctaagcgtgagatcagtgcgctaagtgcagcagggtacaatgcccagggcacaaaattccatagacaccatagtgcctatttcaggaaaatagctctagaggcagcaagaggagcagcttttgcagagatacctag

SEQ ID NO: 55646 - DNA, 366 bp, Glycine max
  Peptide Sequence Number=SeqID_172424
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggcccccccccccccccacaaaaaaaatttgtgccaggattttgccaactttggcttgcgccccgttggctaagtctgtgcctcggtggcggatcatcatgtcataacatggcaagacacaaggtcacacgcacacacacacacacacactcacgcaggctcaagggggaggaggggctcgggcgtccgtccgcccgggcacacacctag

SEQ ID NO: 55647 - DNA, 690 bp, Glycine max
  Peptide Sequence Number=SeqID_172425
atggtattcgtcggggaaataatcgaagtgggcttgaagacagggaagttcgattacgtctcctccacatgtaccaacgctaggaggatcggagcaactggggcaaagaggaaggaaggagatacccatgccatcacttcagcgcccgcatggatcaagccgccgcggatctcccacggtacccatcagtatgcgcaacatcacccgagcttctcagctcgcgccggggacttctccaactcagcacctgtacaaactagggcacctgtgcccatccagagggaggccccccaagctctggctccaatcccgactcacctggccggcaatgcccactttggcgccggttccaacgcgataaggaactttccctcgaggccaacattcaccctgatcccaatggcgtacgaagacctcttgccatccctcgtcgccaaccaaatggctatgatatctcccggaaggatctaccagcctcctttcccaaagtggtataaccctgaagaggaaatccctaccgaggggagagggcataatagggctttgcatgtgtcagtcaaatgcatagaccacgttgtggccaaggttacgttccaagtgatggatattaacctggcttacaactatcttttgggacgcccgtggatccactcggtgggagtcgttccctctacactccaccaaaaatag

SEQ ID NO: 55648 - DNA, 591 bp, Glycine max
  Peptide Sequence Number=SeqID_172426
atgcggccgagagtagcgtactcgttccctgaggaggtgctggagcacgtgttctccttcattgagtgcgacaaggaccgcggctcgatctccctcgtctgcaagtcctggtacgagatcgagcgctggtgtcgccggagagtcttcgtcggaaactgctacgcggtctctccggccaccgtcgtcaaccgcttccccaaggttagatccatcgccatcaaggggaagccgcacttcgccgacttcaatttggtccccgagggttggggcgcttacgtgggcccctggatcaaggccatggccgctgcctacccctggcttcaggagatcaggctcaagaggatggtcatcgccgacgaatgcttggaactcatcgccaaatcgtttaagaacttccaagtcttggtcctcacctcttgcgagggcttcaccactgatggacttgcagccattgctgccaattgcaggaatttgagggagttggagttgcgggagagtgaggtggacgacatctgtgggcattggctgagccattttcctgattcgtacacatcactggtttcccttaacatttcttgcttaggcaatgag

SEQ ID NO: 55649 - DNA, 384 bp, Glycine max
  Peptide Sequence Number=SeqID_172427
atggggacgaggggttgcattaattacaatcccgtcctcgccataagacaacttggctaccccatgagaggaacaccattagaggaaggcctcacaccttttatcgcgtggttgaaagcctacgcgcaaggtctggattggcttccgaatttgagaactactaaagtggtggagggtgaagctccgaaagaagacgaacaggtacaagccctcaaaacaaagcttgagagagcccaaacaggaaaagaaaaattcaagtcagtgactgttaggattcgaaaagggaacgctgaactgagagacatcaacatagccatcaccaaggccttggagcaagagaccaagagggcccgcaaggaagaacatggccggaacaagttttga

SEQ ID NO: 55650 - DNA, 417 bp, Glycine max
  Peptide Sequence Number=SeqID_172428
atggaactccaacgtctcaaccaaaatgaagagactgacaaaaggaaaagaagaataacactcaaagcctcctcctcaaagcaagaagaagaagaagaagaagaagaatctaatgatgaagaggacttctcactctttgtgaaaaagattcataaatccgtcaaaaatacaagaatggagagaagctataacttcaacaatgggaaaagatctcaagaagtttctcctacacttaaatgctacaagtgtaatcaacccgatcacataaagaatgagaagaaaatctataaagaaagaagatccaagaaggcatatattgcttgggatgacaatgactcatccgatggttcgaagaaggagatcaaccttctatccaaggactatgaaagtgatgaaaacatctttcaagaagattaa

SEQ ID NO: 55651 - DNA, 972 bp, Glycine max
  Peptide Sequence Number=SeqID_172429
cgccatgccggctgctcagcaagatcacgcaaccgacgctgatcattcatgccaaagatgacccctttatggatcaccactcgatccccgcgcaggagtttctgcccgacaacgttcactatcagttgaccgagcatggcggccacgtcgggtttatcggtggcacgctgcgacgcccgaaaatgtggcttgagacgcgtatccctgactggctaaccccttatctggacggcaccgattatggtgaacatgaacgctcgcttgagcaaaaggtcaacgatgtaaagcgccagctgaaaagcggcgacgtggtgctgggagttgttatgtctgccagacatccgattattgccgttacggggtcgagtggtgcgggaaccaccaccaccagcctcgcctttcgcaagattttcgcccagctgaatctccgtgcggcggaggtcgaaggcgacagctttcaccgctacacgcgtccggagatggatatggccatccgtaaggcgcgcgatctgggtaaacacatcagttacttcggcccggaggccaatgacttcggcctgctggagcaaacctttattgagtacggacagagcggcaaagggcagtcccgcaagtatctgcatacctatgatgaagccgttccctggaatcaggtgccgggcacctttactccctggcagccgctgccggaacctaccgacgtcctgttttacgaaggattacacggcggcgtggtcacgccgcagcatgacgtggcgcgccacgtggatctgctggtcggcgtggtgcctattgttaacctggagtggatccagaagctgacgcgtgacatgagcgagcgcggccactcgcgcgaggcagtgatggattcggtggtgcgctccatggaagattacatcaactacctgacgccgcagtttcccgcactcatatcaacttccagcgcgtgccgacggtggacacctccaacct

SEQ ID NO: 55652 - DNA, 450 bp, Glycine max
  Peptide Sequence Number=SeqID_172430
atgaaaggaattacaggagcgtcgtaccaggcatgttgtgatgctttgacggtcacagatgtgtgttggttgccttacagtgagcatcgaggggttagggggtttgagctgatttcatcgttccagggtcagctgagatgggatcctatggtggtcacagttcgaccgaagagggtgctacgacagtttggttacattcagagcatcccttcgccgcctgttagcgctttgttgtcatatgatgatatagatgacatgtggatgcatttcgcagaccacgtactagctgtgggtgagcttttgtgtagtgcctgggtaggtgaccaacccagacatgtacctgccccagaccatgaggactacatgcagccgaccatcccacaggttccagtggcatttgacccccctcgacatgcagtggtaagattatttacacgttttaatgtttga

SEQ ID NO: 55653 - DNA, 708 bp, Glycine max
  Peptide Sequence Number=SeqID_172431
atggaatgtattcttaaggaaataggtttacctatgcagtttgtgagttggatcatgactggtgtctccacagtctcctataggtttaatgttaatggaacctattctgacattatgcaagccaagagagggattagacaaggggaccccatgtcccctatgctttttgtgataatcatggaatatatgcatagaactttggtgaagatgcagcaaaatcctgatttcaattatcactcgaaatgtggaaaaattggcctaactaatctcacttttgctgacgatgttttacttttctgcaggggggataggttaaaggtgaatccagcaaagtgtcagatgttctttggaggaatggatggttgtagcaaagaaaatctgagaaggataactgattttgcagaaggaaaactccctgtgagataccttggcgtgcccttatcttgcaaaaggctcactattcagcagtacatgccactgatagacaaaatagtggacaaagtgaagcattggactagcaaattgctaagctatgctgggagaatccagttggtgaagagcatcactagtgccattgcaatgtactggatgcagtgcttccctctgcctcagtttgttcttaggaagattaatgctatatgccggagttttgtttggacagaaattctgagaatctttgggtgctgtgggttcatacatattatctga

SEQ ID NO: 55654 - DNA, 789 bp, Glycine max
  Peptide Sequence Number=SeqID_172432
atgggaagagctccttgttgtgacgagaatggactcaagaagggtccatggacaccagaggaagaccttaaactcaccaactacattcagattcatggaccaggcaattggcgatccctccctaaaaatgctggcctacgaaggtgtggcaagagttgccgccttcgatggacaaattacctgagacccgatataaagagaggaagattctccttagaagaagaagatgttatcattcagttgcacagtatcttgggaaacaaatggtcagctatagcagctaggttgccaggaagaactgacaacgaaataaagaactattggaacacccacattaggaagaggctacttcgaatgggaattgacccagtcacacataccccacgccttgacctacttgacatgtcctctattttaaggtcaatgttgggtaacccctcccttttgaacatgcaaggcttattaggtgcacaagttttgatgaaccaagggttgttaaagctggcttccacagcctctcttctatcaacaattaacaatgatgaaaacccaaatttggcttcacagaattttgtacatagccaagttgctaccaccccaccatcattagactcaactcagtttcaatttcaaatgccaactaatcagacaaacaatgtggaagtggaaggattcttgggcaccgtgacgaacttgagctgttcaagttctccttcgggtgatgataagattaaccttgttttgcaacaaaaaaaccaagttgatttgttagggaaccatgatgttttg

SEQ ID NO: 55655 - DNA, 306 bp, Glycine max
  Peptide Sequence Number=SeqID_172433
atgaataatagtctccttctccaagccgcacttgttacaaaaagggtcaaaacaaagatgttgcttcaagcgaacatgtggaagtttgactccaaagtacaacatcgatcatcatcagtggtatcatcaagaacaacactcaacaatttattcttcaaagtcgggagggagtggagtagcaatgttcttccattgccaagtatcatgaatcaagtaattcttaactcccagatgagtatcactaatatgagcataatcaagtgcttcacatatagaaacctcttccagccatctatcataaaataa

SEQ ID NO: 55656 - DNA, 297 bp, Glycine max
  Peptide Sequence Number=SeqID_172434
atggaagcttatttgcttgtgcttgttggtgaatttggagaactaggaattcagaggcctttaacgaccaggtctagtcttagtggcaatcttggtgattatgattttggaagtatcctttgtgattcttggggtcgatggcttgtgggttactcagcttcaaactctgggtacatgcatgtcatttgtgaatcgaactccaagaatgctttgaatttgatcaacaatcaagattctgctttgcatccccatgcgtccctcatcaatcgtattcactctttcttggataagccttaa

SEQ ID NO: 55657 - DNA, 297 bp, Glycine max
  Peptide Sequence Number=SeqID_172435
atgtctaaatctcaacagttttccacctccatttgttggaaccctcctcgtaacagtcagtataaactatactgtgatggttcggtcaagcttaattcaagccaagcagttgctgatgatgggactcattttgagctatgtagcattcactatggaatgagattctcaatggtgattgatctctcctttgtcacgatcacggttgttccgagtctcatgattccagcttgttggtttttatttttgtgctggatgagatatctctcatgtcttccaatctatttggttaaaaattaa

SEQ ID NO: 55658 - DNA, 216 bp, Glycine max
  Peptide Sequence Number=SeqID_172436
atggcagcccctcaaatgaatttgcccctactagagaagaatctaacaaggctgcttcaaatgataagcatttgcttcaagaataattcaagattgcttcaacaaacaaagccttgccttaaaacaaagtgctttcaagacatgcaaggctctggtaatcgattaccaggaagtgtaatcgattaccagaagacagggttgagaaatagctattga

SEQ ID NO: 55659 - DNA, 237 bp, Glycine max
  Peptide Sequence Number=SeqID_172437
atggacggtagtttgagtcggtggcactccaagggtttcctcatttgggatccagtagtcctggagggagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 55660 - DNA, 537 bp, Glycine max
  Peptide Sequence Number=SeqID_172438
atggacttcgcagtaactctcaaagctggctgtgatatgaatcaacacggtacatacaacagccactttgaaaagtaccgaccagacacgccaacggctgtgctgctgcaggcattccccgagtcaaatccgtactacacgttcaaaacattcgactgcaccacaggaatgactcagggcccgctcagagcgaccaacctacacactgcagcacaaagacacatgacgcgaaaaagacacgacgcgcggcacgtggagttgttaccctgtaaccacctttacattctgagctacatgggcggaaacgtccaggcgcagcgacccgtgtcgactcgactcggccgaagtcagggacagactgatcgtctgcgtcacgcccggggtcccgcaggtagactagggaataccccattcgccgcccccgcgtccgctcggcggcagtatgcttgtcaggggccacctgctgatggtgctgctgccacagctgttgcacggtcacacgagtgcaaacaacccaccacggcacctcctatctag

SEQ ID NO: 55661 - DNA, 316 bp, Glycine max
  Peptide Sequence Number=SeqID_172439
atggagttctacgctaatgcctggcctaccgaggagggggtccgtgatatgcgctcttggtcagttcctggggcacccactgatgaggaggctattgcccagctactatgcataccggtgcaagacttcgcccggaccgccgcagggagatggttccttttgctatctggagacaatcaagtccaatggcacgcagatacaaacatagtcatctacttcccttgtcgaaagactcaatgtctatcgaccaaagctactagagtctcccctgctatcctgagacaagcaagtccggtagcatacggagaccatcacg

SEQ ID NO: 55662 - DNA, 1537 bp, Glycine max
  Peptide Sequence Number=SeqID_172440
tgcctgcctgctcggggatagcgtccgattcgatggcggccacaagcgttttgcctttgcaactgacgagctcgcgccatttgtgcgcttcgaacctgtctgcccggaaatggccatcggtctgccgacgccgcgcccggcgctgcggctggtcaaacagagcgacgatcagatccacctgtgtttcagcaaagacggcggggaagagctgaccgacgacatggcccgctggtctgcggagcgcgtcaaatcgctgcaccatctgtgcggctacatcctgtgtgccaaatcgccgagctgcggactggagcgcgtgcgcgtctacgagcctgacactaacaacaatcgcaaagccggcaccggcgtgttcacctcgttcctgcagaaagagctaccgtggctgccgctggaagaggatggacgcctgcacgatgacgcgatccgcgaaaactttatggggcgcgtctatgcgctgcatgagtttaacgatatgtggcgcagtgggctgacgcgccacaagctgattgccttccacagtcgctacaaactactgctgctgtcgcatgcgcaggatgagtaccgcgagatggggcggtttgtcgcggcgatggaacagtgggagtcactggatgcgtacgcctttgaataccgtaaccgtctgatgcacctgatgtcgcaccaggcgtcgcgccgtaatcacaccaatgtgctgatgcacgtacagggctattttcggccgaagctgagttcaccgcagcgtcaggagctggcgcagctgattgaccgctaccgtcgcggtgtgcagccgttgctggcccccatcaccatgctgaaacattacatggcagagttcccgcacccgtggctggcgcagcagcgttatttcgatccctacccggaagcgctgcgtctgcgctacggccacgcactggccgctgcctgccgcgacagtcaggccgaggtgctggcgctgttcatcgccacgcccggccagtggcagcaacacagcatggcccccaaacaggcggcttttatccatcaaaacctgtgcctgctgcagcagtcgctggcagaacgcggtattaagctgcactttcatcagtgcgatgacttcgctgcgtcggtcgactatctggcgaccttctgccagcagcacaaggtggatgcgctgttttacaactatcagtatgaaatcaatgagcgtcagcgcgacgctgcggttgagaagcagctcgatcagcagggcgtggtgtgccaggggttcgatgacagcctgctgttaccgccgggcagcgtacagaccggcagcaacagcatgttcaaagtgttcacgccgttcagcaaagcgtttatccggcgtctgcaacaggggctgccagagtgccatcacgcaccgaaagcgcgcgccggggcacccgtggccgctggcaaaaaaatagcagcattcgattatcctgtggaaaaattcgacgaaacctggtttcccgccggagaagaggcggcgctgaagcagctgcgccagtttgcccagcagcgg

SEQ ID NO: 55663 - DNA, 354 bp, Glycine max
  Peptide Sequence Number=SeqID_172441
atgcatcattcacatacatccatgattttcattggttgcattgctcatggcattctttccttgaaaacgaacttaatcattgttatcaaaaggaaagaacacgcttcgcgaagcccttaccggacccgtgctagagctagagtaatgggtgaagtagaggaggtacaagagcagataaaggccgacatggaggccgtaaaagagaaaatggccataatgatggaggccatgataagcatgaagaagatcatggaagtcaatgcggttgcaattgccgctaccagcgctattgcaaaggtgaacataactccccaatctggcctcaaccaaatgaatcatccaacctcaaatatg

SEQ ID NO: 55664 - DNA, 876 bp, Glycine max
  Peptide Sequence Number=SeqID_172442
ttttgccagactcgcagagacctttcttgggaggatgtgcgcaagaaggcacatgccatccagaagcagaatattgccccccacgttttgtctcgtgggggttatgattatttggagcagaagctcctgattgagaagacgaagaagaagctggaggaagctgcacagtcaggaagcgttgatggcgtcatcgaccctccatccccggtcagacgccacgtgaagtggaagatggcccgcacgaagaagacagaggagatgacgactgaggccgcaaaggaaatcgctgaaaagattgattcgtttgaggagcaggccacacagggatcgttcgtcctccatggacgtcaagatgttctcgccgctgctattggacgtccagagcaccctggacgtgtccgtgctgctggagctgcagctgacccagcagatcagggactagctagaggagtccatcacagagaaagtgacgaggcaagtcaggcatccttcaaccagcttcagtcgcagatgcaatctcaaggacttgcagtgcctcctgagcctctggttggtccctccggtcctcaagtgagcacaaaggggagttgtgtttatccctcaggaaacgatcctgagaccggtgactctgacaggtgtggcttgtacatagaagcagatcctgcccacctggttgccatggggagagtttatgagggatccactgttgtttataacactcctttgttgcttggccaagtaaaggtgagtgtggaggaggttacagatgcagatgctccagttcttgtacccactgatgaggtttccttagtggggcaggcacttcacaccttccttgcttggccgacacatctggtcaagtctttatcacagcaa

SEQ ID NO: 55665 - DNA, 738 bp, Glycine max
  Peptide Sequence Number=SeqID_172443
atggcaatttgtgcccatgttggatttcctaatctattcttgacattaacgtgtaatccagcatggccagaaatacaacgacaagttgcaaagtcaaatcttacagctcatgattgccctgatgttgtgtcacgggtattcaaaatgaaactaaaccagttgatgcatgatcttaagagtggacatgtatttggtcccattcttgcatttgtttacactattgagtggcaaaaaagaggattgcctcatgctcatatcttaatatttttgcatcctttaaataagaatccaaatccagaagacattgacaacataatttctgctgaaataccaaataaggacacagatccagaattgtatcaaattgtctccaaccacatgatgcatggtccatgtggactagctaataaaagggcaccatgtatggccaatggcaagtgtttcaggtttttcccaaaaaagtttcagccagccacaattgttgaccaagatggttttcctgtttatagaagaagagacaccagacagactgtgcaaaaacagggtgttcatctcgataatcgatttgttgtcccatataatccacatttgttactcaaatatagaacacacctaaatgtggaatggtgcaatcaaagtagctcaataaaatatttgtttaagtacatcaataaaggatctgatcggattacagcagttattgtcaatgaccaaaaccaggatggcccacaaaatcag

SEQ ID NO: 55666 - DNA, 222 bp, Glycine max
  Peptide Sequence Number=SeqID_172444
atgcggggttaccgtatggttaccagcacctttcgtcaaccaggggcaaacgagcccgttgacgtgcagagactagcatcttcttctgcaccttttgtcgtcctgacccgtaaagtcaggttttactctcgtcgttcggaaacattcaagcccggcgatgcgcgaggttcttctctgctgggcagggacgatcgagtgcaatggcgaagggaagtgtcgtag

SEQ ID NO: 55667 - DNA, 213 bp, Glycine max
  Peptide Sequence Number=SeqID_172445
atggagggcagcagagacataacagcaatgacagagggtgaactcacaaacacaggggtgcagaaggaaataatactcaaaagaaaggaatctagtgagaatttgccagctcacgcaatcttccacaatcctcctgctgatgctgcatatctgaggggaagcagccataacagaattagttatgtaatattcctaggattataccaattctag

SEQ ID NO: 55668 - DNA, 306 bp, Glycine max
  Peptide Sequence Number=SeqID_172446
atgttggtggagaagctcattgaccgtaaaacagagactgtggagtcgttattggtgaggattggtacttccaagtcaatggagatagaagcagcgcatggaaaaagaacggagaagagaggttggggtggtggtgcaatggtcgtgcatagttggttgtggtgtgctagccgcctagctgattccatcatccatggcgaagtagaggaatttgttgtgcttgtggggagagaggttgaggtcggagaccttgaggttgttggcactgtcgaggaggagggggaggttttggagcttgaggtctaa

SEQ ID NO: 55669 - DNA, 552 bp, Glycine max
  Peptide Sequence Number=SeqID_172447
atgcagaagcaaaccgccagttccattggcgagtttcccgtgtccgtactggactcgccagccccattggcgatttcgccatgcatggggagtagccagtcaaactggcgagttccaagcaggagggcgcaggctagggttttagggggttgcagtctgcacgcaggaactcgtcattcccactggcaccttgtaggggaactcgctattcccactggcgagttgcattttgaaaaaaaaaattccccttataaaacctgcacaactacattgagctgctcccttactccatctcgtgttcctccctcatcacttttgatccctctttgcagtgcattcctttcttctattcctactacgtgctttgtgttcttggtgaagttttttaccctctttgccctacattgcttggttgctcttcctactacgtgcttttggttagattttataagtttatcaatgacatcttcgtcgtcatgttcatcaaatatacaaattaagtctggtccaatagatggagacgttgtatggatgcacgctaagcatgtttaa

SEQ ID NO: 55670 - DNA, 358 bp, Glycine max
  Peptide Sequence Number=SeqID_172448
atggagatgcaaaaagtgcctgaaaccaagcaacaacagaagaagctcaaatctaaagagtttttcaacaatcttcatgcatatcttggacttcaggtcgatgttgttgaacctccactggttaaagtcacttcacaacctcaacccatcgttgaagatgaattagccatggtcagcacttccattactcctcgtgagataactccattgaccacctttgctccaacgagtccacttccgccgccaccaacctctattcctgcacttgtaaccactgtgaatcttgtgcctgtgcctccacctccatcttcaccaccaaagtcaccaccaactatccctcaacctttgtccactaaag

SEQ ID NO: 55671 - DNA, 258 bp, Glycine max
  Peptide Sequence Number=SeqID_172449
atggtggtgattttgaaaggtctggaaagctatgataatgatgatggtgaggaatgtggcatcgtttcgagttccaaagatgagtgtaaccccctcactcgttaccttagaaaccctatattcataaagcacatgatacatcacaaacaagtgacatcaacaaaaagcctaacactagtgagctacaccgatgcaagctgttggacacataagccaggaagaaagaggatagacaaaccccttcattcttccctttaa

SEQ ID NO: 55672 - DNA, 903 bp, Glycine max
  Peptide Sequence Number=SeqID_172450
atgcagaagcaaatcgccagttccattggcgagtttgttgtgtccgtactggactcgccagccctattggcgattttgccatgcatggggagtagccagtcagactggcgagttccagcacaagagggaagtagcctctgccattggcgagttaggctaaattggagtagccactggcattggagagttaggaaaatgggaatagccagcagtaaaaaagcgattcagattaaacgtgaaattagtttcaatgctttgaagaaaaaaattggagataaggtaaagttagaaaataatgaaattatttgtgctatcggttgtagattcttagtgtctggaaaatatgttgcgttacaaatttgtgatgacaaagttgttgaaatcatgctcgaaagttttcaacaacaggatcaaatgtcagttctggaattgtacatagaaaaggatgtggctggtggttctatgtttcattctgcaaattctcttacatcatttggaaataacttatctaataatgaggcgcaaccgccaagaaatgtgagcgatttacatggtgatgaagatgatgatgatgatgattatcttgtgtctaactcatacgtggaagagtctttagacgaagatgatagtattgacggtatatctgatacagatgatgaagtcaccgacatgattcaaccagtaagaattgttcacccagcaaaaggtgtacaaggaattcaaaatccattttggaatgatgctttgcattataataatatcaaccgaagtcatcctgatgaggaggacatttgtggtttggagatgccatcgagttttaatgttggccaagaattatatgttggcatggattttaatagtaaagatgcggtcaataatgcagtcaaacaatatgttatgaag

SEQ ID NO: 55673 - DNA, 642 bp, Glycine max
  Peptide Sequence Number=SeqID_172451
atgggttgtacaattacatgcattttgtggggaccttttgcaatgcaattgaaagcatggactagcgtgaaaacaaccctgaatctatggttatcttactacacctggccaaaatcaaagaacctaaaggaaagtatgcagactaccctattgccattcaaaactcaatgttcaggagttcagaaaagtttggaatcaaatgagaacattgtggtttccttcagtcagaaaattgtaacactatctcaaagttctcaattcagctcagaagtaaagcttgcccataatgttaaggtcaaaagtttaagtgagcttgatgacataaaaaagcaatgcaaccgtctcactgttgcaactactaaaaagctattggtatacaatggttggagctttaaaggttgtcctagatgcaatagaaaactgaagagacaatggagccatacacatgtccaggctgtaagaataggaatgagggaaaaatgcttaggtgatcaattaaatcaaatagcaaatgaaggtaagtttgatccaaagtctatgcctaaagccctagacaatgtgttgaagaaacaattggcattcaaaatcaagattgttccaaatagtagctgttattctgttttggaaacatctcaagattaa

SEQ ID NO: 55674 - DNA, 2565 bp, Glycine max
  Peptide Sequence Number=SeqID_172452
atgtatggggattgccaagttatgtcaagtatgggagggaacgtagtagtaaacccagacaccctcttctcttcctcgatccagaactctagcttcaacttcatccccaccatgccctttcaaccttttccttccatgaaagaagaagatgggatcttgcgagggaaggaagaggttgagagtggatcagggagtgaacaattagttgaagacaagtcagggaatgaacaagagagtcatgaacaacccacaaagaagaaacgttatcacaggcacactgctcgccagatccaagaaatggaagctttgttcaaggaatgtccacacccggatgataagcagagactgaaactgagccatgaattgggtcttaaaccgcgccaggtcaagttctggttccagaaccgtcgaacccagatgaaggcacaacaagaccgtgcagataatgtgatacttagagctgagaatgagtctcttaagagtgagaattatcggttacaagctgcactgcgtaacgtaatttgtcccaactgtggtggcccatgcataatgggtgctgatatgggcttggatgaacaccaagttcgcattgaaaatgcccgtttaagagaagagttagaacgcgtgtgttgtctcacaacaagatacactgggcgtccaatacaaacaatggcaacaggtcctactctaatggccccttcattggatttggacatgagcatatacccaaggcactttgcggataccattgctccttgcactgaaatgattcctgtgccaatgttgcctcccgaagcttcacctttttctgagggtggtatcctaatggaagaagagaagtctctgaccttggagcttgccgcttcctccatggctgaacttgtgaagatgtgtcagacaaacgagccactttggattcgaagcactgagagtgaaagggaagtgctcaattttgaagagcatgcaaggatgtttgcttggcctcagaatctcaagcatcgaagtgagctaaggactgaagctagccgtgacacttctgtggttataatgaatagtgtaactcttgttgatgctttccttgatgctcaaaaatggatggaattgtttcctacaatcgtttcaagagcaaaaactgtccaaatcatatcttctggtgcttccggtcttgcaagcgggactcttcagctgatgtacgcagaattccaagttctttctcctttggtgtccactcgtgagactcattttcttcggtattgtcaacaaaatgctgaggagggaacctgggccattgttgattttcctgttgatagctttcaccaaaattttcacccttcttatcctagatactgcaggaggtcctctggctgcgtgattcaagatatgccaaatgggtattcaagggtaacatgggttgagcatgcaaaagtagaagagaagcctgtgcatcagatattctgcaactatgtgtacagtggaatggcatttggagcacagcgttggttaggagttttgcagagacaatgtgagagggtcgcaagcctcatggccagaaacatatcagatcttggagcgataccttcgccagaagcgcgaaagaacttgatgaagctagctcaaagaatgataaaaacgtttagccttaacatgagtacctctggtggtcaatcatggacagccatatcagattcccctgaagacactgttagaatcacaactaggaaaatcacagagcctggacaacctaatggcgtgattctaagtgcagtttcaactacttggttgccctattctcacaccaaggtctttgatctcctcagggatgaacgccgcagatctcagatggatgctctttccaatgggaactcattgaatgaagtggctcatattgcaaatggctcacatccaggaaactgcatttctcttcttcgcataaatgtagcgagcaactcatcccagaacgtagagctaatgctgcaagagaattgcaccgaccaatctggaagcatagtagtgtacacaaccatcgacgtggattcgatccagctagccatgagtggtgaggacccttcttgcattgcacttcttccccaaggcttcaagatagtgccaatgtcatcaccacccaacaacgttgacacacccatcatcgatgccgcaacaaactcatcatcagagcctcctccatctctcaacaacaacaactcaggtggttgcctcctgacaatggggctgcaggttctcgcgagcacgatcccttctgcaaagctcaacctctcgagcgtcaccgctatcaacaatcacctttgcaacaccttgcaccagattgaagctgctctttcttcttctagctcccatgagaatggcaatggctctttcctttgcactgaacccaccaagcatgttagctttttgtgtggatcgatcaaggagtaccaagaagacgaagaagaactattattatgctttgtgctagaagagaagaatgaggggactgagggagtcaagagcgaaccagatagtaccctcggctttctagtgatcagagatgacctcaccagtgagtaa

SEQ ID NO: 55675 - DNA, 558 bp, Glycine max
  Peptide Sequence Number=SeqID_172453
atgggcgcaatgttgatgcaacacagacgacttatcgctttcttcagtaagcagttcactccaaagttggaacgagcttctacatacgttcgtgagctacattcggtgactatggcacctaaaggaattgatgacccaaataattcagacgtcggagcagcagtattacttggccaaacttctgggtacgagtacaccatcaagtataagagcggatccttgaatattgttgcagatgccctttcacgtatcgaacatctggcagattcttccatgtttattatatcagtccttcaattcgaattcatggaccaactccagcagcacctgcaagctagttctatgtttcaggataaatggtctgtgatctcctctaacccagccgcttacccggactacaaattgcaggatcagttgattttacacaagggtagcatttggcttaatgacgataatccttttcgcactgcccttttaacggagtttcattcgactcccctcggcgatcacctcggcgttgccaaaaccacacattgcctccaagcaaatttcacatag

SEQ ID NO: 55676 - DNA, 285 bp, Glycine max
  Peptide Sequence Number=SeqID_172454
atgagcagaggaatagaagcttcagaaaatgccttgaattcgaggtcaaggctgcggaatttagcaagcacagtatcaaaattacaaagatttgaatttgtgctccactatctatcctttgggggtaatcccttccattgcaccaggaccattgggggagtgatgaggcctatagaggtgttggatcgtggtaacggtggagcatggaacagtgaaatactggatggattcgtgatgtggttggcaggcgaagacggtaagcaacgtgtccaacacactcgataa

SEQ ID NO: 55677 - DNA, 2652 bp, Glycine max
  Peptide Sequence Number=SeqID_172455
atgtctttgttggtaaaatgttcccgactttggttccctcagaacgaacgacccattcatctacttattgactcctcaatggtggaaagaagagtgactttatcaaaggaagttagaaatgggttagaatttttgaagcgtaaaaggcttcagcgtgcaaaatctgtcactgccacccagacaagtgttgctagcatgatgaacagaagtggaggagatgctttaagagcttcagcatcatgtggcacaagatttcatggtaatgctgatgtcttttccaagcgcaaggtggataagtttgatacaaatgacctggattggactgataaaattccagaatgtcctgtgtattctccaacaaaggaggaatttgaggatcctttgatttatttgcaaaagattgctccagaagcttctaaatatggtatatgcaagattatttcccctttgagtgcttcagtacctgctggggttgttttaatgaaggagaaagcaggattcaagtttacaactagagtgcagccccttcgccttgctgaatgggatactgaagacaaagtcacattttttatgagtggaagaaattatacatttcgagattttgagaaaatggccaacaaggtatttgcacgaagatattgcagtgctggatgtcttcctgccacatacttggaaaaagagttttggcatgaaattggttgtggaaaaatggaaactgttgaatatgcatgtgatgttgatggcagtgccttttcatcatctcccactgaccagcttggtaacagcaaatggaatttgaagaaactttcgaggttgcccaaatcgattttacggctcttggaaacatcaattccgggagtaacggaacccatgctatacattggaatgctgtttagtatctttgcttggcatgtggaggatcattatttgtacagcattaactatcatcactgcggggcatcaaaaacatggtacggtattccaggtcatgcagctttggaatttgaaagggtggtgagagaacacgtgtacactaatgatattttgtcaagtgatggggaagatggagcctttgatgttctcctggggaaaacaacactatttccaccaaatattttgttggagcatgaagttcctgtctacaaggctgttcaaaagccaggggagtttataataacattccctagggcatatcacgctggcttcagtcatggtttcaactgtggagaagcagtgaattttgcaattggtgattggtttcctttaggggctgttgctagcagaagatatgcacttcttaacagggttcctttactgcctcatgaagaacttctatgcaaagaagcaatgcttcttcgtacatgcttggaacttgaagattctgattttccttcctctgacttgttttctcataatagcattaagatttcatttgttaacttgatgcgtttccaacattgtgctcgatggttcctaacgaaatcaagggcgagtataagggtctcttttcattcccatgccacgattctctgtagtctttgcaaacgtgactgttacatagcttatgttgactgcaactgtcacatgcatcctgtatgcctacgtcatgatgttgattttcttaacttcaactgtgggagcaaacacacactttatttgagggaggatattatggatatggaagctgcagccaagatgtttgagcacgaagatgggatattggatgagataaggaagcaaactaaaagtgaccaaaacatgtatgcatatcctttgtcaaatatgtttcagagagctgaagcgaatgggtacacgccttattgtgagctaaaacttgattctgttgttgaattctatgcaactccagagcactcaacaaataatcaagaatacagttcacaaaatcaatctgtcattgtacgttgctctgaaaataaaaaaccagtggtgtctgaggtttccttttcttctgccacatccactctttgctctctttcagaatctctcgagagcttttctgctcccaaaaatgctgaggagcatattaacaacaatgcaagtattattgattttgaagagtttgctgaaagaatatccaacagtgcatgtgaatcttcattatctcctgctgtgtatcatgaaagctcggttaaaccactgggtgatcttcagaagagatttgatacaaaatccattgtggacgagagtgatgattctgattcagagatatttagggtaaagcgtccttcttctctgaaagcagagaggagaaatatgaatgatgccgtgccttcaaaacatacagagcagcaggggctaaaacgactgaagaaaatccttcctgaaggaaagagtgggcaaccaatggattctagcagaagcaatgaatcaagttacaaatacagtcacgctgttaaccataaaggtcatgcagatatttcatccagggatagatttgcaaggagtaatggtattcccatttctataagatataagaagttgggcaacgaggaaataagcatgcaaggagatcaccaccaaagagataggttgcaacagacatttagggaaccaccttccatggagcttgagccaaagcgccttaaagtccgaggcccttcatttttaggcttagagagcagatcgaattga

SEQ ID NO: 55678 - DNA, 186 bp, Glycine max
  Peptide Sequence Number=SeqID_172456
atgacgggacagggtgggacggacacgtggcgctttcttgtgagcaggaggcacacgcggcatgcggataagggtgtggtttcgtggattttctgtgtcactgggggtggtggccagaacggatatagccggcggttacaacagggttctcaaggtagccccaccatagagcgaagcagacgataa

SEQ ID NO: 55679 - DNA, 222 bp, Glycine max
  Peptide Sequence Number=SeqID_172457
atgtccaacattatgaatttaatgtgcttcaacttcagtttcagcgagaatcatgcgctaagcgaggcactcagcccgcgtagcgagttgggagaatctggaggagaatctgagaagcatatgcgcgctcaatgcgtcatcagcttgctcagcgaggcgtttgtctcttcccatgctaagcacgcccagctcgctcagtggatattcactaacttgcgctaa

SEQ ID NO: 55680 - DNA, 264 bp, Glycine max
  Peptide Sequence Number=SeqID_172458
atgcaggaagagttggaagatctttatgctgctcaagaagctgggattgccttcattctagggcattctcatgtaagagcaaagcaaggctcatctgtactaaaaaagttggcacttaactatggctacaatttcttgagaaggatttgtaaaggccttgatgttgcacttaaggttcccctagtttcgctttcggaagttggcatgagatacttagccttccatcacaaggcagcacctttcagctacaagatgagggtttaa

SEQ ID NO: 55681 - DNA, 231 bp, Glycine max
  Peptide Sequence Number=SeqID_172459
atggatttatcagtccttgcactagagatttctttttcgtctttgtctggttcacttgtttcttgggcagaaacaacatgggctccagttagtgattgggaatatcaagctacactccctcacacaacttctataattgacttggctgctaagatgataagtgaaggccgaggtttagagttaatgctaatggaagcagatcctactgccccaataactgcctataggtga

SEQ ID NO: 55682 - DNA, 687 bp, Glycine max
  Peptide Sequence Number=SeqID_172460
atgcatattggtattatacacattggaagtcgtaaatacaaaactttcatttgtctctttgtctgtggaaaccataaccaacaattttcaccaactgttaactcatcctgcccaacaacatcacacaagccttgtcaccatgagtacatagtcatcaaatgcgtcgaatgtttttcgccattcatcttcatgattgtgattctgtcgggtatcatattgaccatattgatcatctccttccaatgttatgtttacttgcagaacctcattgaggtaccatcattatatcatagacaatgggctccggattacccaccttatgtgctattcgattacaatggagacaagcactgtataaagcttagaaaatattacaacagatactactttgctgacagactgaaggacttcaaaagaaccatgggcattcatgaaggtttcatgatcacattttctgcacccgagaagaattggattttccatctccacttcatgccactactgcatagacaaacatgtggaaggccacccataaccaccagaactaatgtctttactattgatgttagccaacatatgatctcatgtgcttatccattggtgctgccaccagatgctctcaattttgttgatgcatcaacaaaatatatcactatcctccatactcatggccgtcgtcacctatga

SEQ ID NO: 55683 - DNA, 138 bp, Glycine max
  Peptide Sequence Number=SeqID_172461
atggatggccctacaaaagtttctttagctattcaatcaaactggaaattggtggatttgtcatggaagtcaagctacacaagcatcaagataataatatataatgctatggttggattagcaacttggggaggttag

SEQ ID NO: 55684 - DNA, 330 bp, Glycine max
  Peptide Sequence Number=SeqID_172462
atgcctaggcaggcgcagggtgatgcacatcaggatgcgggtgcaccaccgccacctcagctggccgattcggctgggccactgggcgtggagcgtatctacagcatttggttcgccagcaggcggccaaccaccgtggatagttgcagatacacgagtgtctctaccggttcagcctcatttggggctgaggtcgcatggcctggagactggcccgatgcccaggcaggggaggagcctgcaggatcccccggtgaggcggatgaatcccgtatggatgaggatatgactgacttggtcggtttcttgggaggaagcgaagccacatga

SEQ ID NO: 55685 - DNA, 177 bp, Glycine max
  Peptide Sequence Number=SeqID_172463
atgaaagacctttttgttacaaaatttgaaagcaatgaagctcttaaggtggttggccccttgcttcttgactcaaattctccaattgatggcaccaatcctcgtttccaattccctacatggcaactcacaaacaaggaaacaaagagacaagcaataaccaaagaccaaaaatga

SEQ ID NO: 55686 - DNA, 177 bp, Glycine max
  Peptide Sequence Number=SeqID_172464
atggataaggtcaacacaactacctacaatgctaaccatattggcagaatttggctaattataagaaaattcaagccgaggcgcttcaataacgtttccatgggtgatttcgcgaagattttcaaccgttcttcgacgttcttcattcattcttcgtcgttcttcggtcttcaaccg

SEQ ID NO: 55687 - DNA, 219 bp, Glycine max
  Peptide Sequence Number=SeqID_172465
atgggtaaacctaggaaggaacactatcaagctataaaacgtatattcagttggaaggcgacacttcagctcgtagtttccttttccacttcaaaggctgcatgcatggctctggcagaagcaacaaaggaagccaaggatcaagtctatcatgaaaggattaaacatattgacatcaaaaaccaattcattcaaactgagaagaggattacagtctag

SEQ ID NO: 55688 - DNA, 960 bp, Glycine max
  Peptide Sequence Number=SeqID_172466
atggtgatgaagcctctgcgtccaaattattggtggctcattcggctagagggcagaagaagaagaagaagaaagaaaaagattagagtgcacaatgggattgttagaactttaattgaggttcttcatgttctagagcttaagaaaaatctagtctttgtgggttccatggattcaaaaggtttttcttattgggttgaaggtgaagttatgcaaatcagagggaaaggaaagtttgtggtaatgcaggggaccaaggaaggaaatatgtacatccttcaagggccagctatgataggctctatctcaactgtttcacaagttggcaaccatgcgtccaataataattctctatggcatctgcgtctgggccacatgagtgaaaaaaagactggaaattctgagcaaaggccttcaagagtttcatcattgggaggggcaaggtacttactttccatcattgatgattactctaggatgacatggaggctcatgatgaagcataaatttgaagctttcaaatgtttcaagcattggacgattcttatgaagaatcaaataggaaagacaatgaagtgtcttagcactaacaatgacttggaattctattctacaaaattcaatgaattttgtaaagatgaagacattgcaagacaacatattgtacactatactatgcaacagaatagagtagttgaaagaatgaacataaccttgttggaaaattccaaatgcatgttatccaattcagggttgaataggagtttctgggttaaggcaatcaatacaacatgttatctcgtgaattgttccccattcattgttttaggttttaggacctctattgaggtgtttggttgtccaacatactatcacgcaagtgaaggtaagctagatcccaaagccaagaagaatgtctttatggagtatgaagatggaatcaaaggattcagaatctag

SEQ ID NO: 55689 - DNA, 1791 bp, Glycine max
  Peptide Sequence Number=SeqID_172467
atggctgattccaccaagtacattcccataggtggcacaggcacaaccctcaactcacacctcaacaccctcttccccattctcaaagccagaaaaacactcactgttgcttattgcttcacctttgcctttgttgctctcactgttttccttgcgttttgcccctctccaaacacctcctctcccttcttcaccagcatattctcctccactgccaccaccgcttcctctgccagctcctacaagtcccaactctcttccattttctctttcttcttccccaacaccacaatttcatcaagtgctactcttcacaccgacaccactagatctagcaatagcacttctcaatctcctcaaacaagtaaaaagacattcaaaaccaccccttttgaaaaccaaactcaaactactcctccaaccagaagcaagataccaagtgatcatcacactgcaaaaccacctgatcatgttgtaaataaggaaccatcgagtggtaacaatcatacccaagtttctgatgaggataaagctgtaaagaagacaaatcaatcttctaatggtgttgggcatagtccgaataagaatttgagttctttggtgaatggagggggcacagagaagggtgttgggcatagtaattacacggtttcttggtcgaagaagcagaagaatgggagcaatgaaacggattcaagggtgaaggatgaattcatggagtctttgatcaagtgtgaattttttgatggggaatggatcaaggaggattcatatcctctctatgaacctggttcttgcaatattatcgatgaacaattcaattgtatccaaaatggaaggcctgataaagcctttcagaaatataagtggaagccaaaggggtgcagcctcccaaggttggatggacatcgaatgctggatatgttgagaggcaagaggcttatctttgttggtgattccatcaataggaatatgtgggaatctctaatttgcatcctgagaaacgctgtgaaagacaaaagcaaagtttatgaagcaaatggaagagtccatttcagaggagaagcctcttattcattcatattcaaagattataacttctccgtggagcttttcgtatcccctttcttagttcaggaatgggaagttcaagtcaagaatggaacaaagaaggaaacacttcgtcttgatttagttggtaaatcttcagttcaatataaaaatgcggatataatcatcttcaacactggccactggtggactcatgataaaacttctaaagggaaggactattaccaagagggtagccatgtctatgatgaactgaatgttttggaggcatttcgaagggctataacaacttggagtagatggattgatgccaacataaatcaatcgaagtctatggtattcttcagaggctattctgcttcacatttcagtgggggacaatggaattctggtggacaatgtgacagtgaaaccgtgcctatcaagaatgagaagtacttgagggaatacccccctaagatgagggtattggaaaaggttttgaagaacatgaaagcccatgtcacctacctaaatgtcactaaaatgacagatttcagaaaggatggtcatccctcgatatataggaagcaaaacctatcaccagaagagaggaaatctccattgaggtaccaagactgcagccactggtgcctccctggtgttccagatgcatggaatgagattctttatgccgaacttctgttgaaacagtatcagaatcagcagaagagaccatag

SEQ ID NO: 55690 - DNA, 255 bp, Glycine max
  Peptide Sequence Number=SeqID_172468
atgggtcaaaacacaaaaacatcaagagcacccaaatttatcaatcaattctcatcaaaacatcaattgcggtatctccaatggtttcctgagattcctcaagcttttcctctgactgctctgacagggttcccaaatgttagagagaaggagaagggattgaagccttcattccactgtctaagtgcgatgagtatttccccatccacatatgttctgtttcaaatcccaacggtaaagatgtgtggaaattaa

SEQ ID NO: 55691 - DNA, 387 bp, Glycine max
  Peptide Sequence Number=SeqID_172469
atgagggtcgagtattttcctctaaaggaagatgtgattttgcaaaatgaagcgccaacagacctttatatctttgttattggtgctgcagtaaaagaaattctcattcccgttgtgtcccttgattctctcaggtgccctgcatgcaggaattataagcctcactacgaaaaggttgcaagattatttaatgaacctgatgcagtgcatccaggaataatattaattgcaagggtagattgtggattaaagttttccatccataaatttgatgtcatgatgcactttgctgccgttgcatacgtgggagagagcacacttgaccctcttaaccaaggggacattcatgtcctttactgcatacttgatcactttggctcttggtag

SEQ ID NO: 55692 - DNA, 141 bp, Glycine max
  Peptide Sequence Number=SeqID_172470
atgaagccaccgcaaaaaggaagaagtgaggaacaagaaaattgtcagaggttgcgaattggtagaggcgaggaagaggttgcaatggttgtgtggcaaaggaacgaaatgacgaagcatggtggttgtcgagtccattaa

SEQ ID NO: 55693 - DNA, 803 bp, Glycine max
  Peptide Sequence Number=SeqID_172471
ggatcctctttccccacatagtagtatgcttggtatcaaaagattgttccacttgattaaatgggtggtggaccaaaagatctggtgtcccattcaaatttcaagggatggtctgcatatcgcacaccttgcctttgcatatgatctccttttatttgcaaaagcaaatgttgatcaagctaaagttattaagtatgtgttgaagtccttttgtgataactccggtcaaaagattgctcaagagctcgggttccaaagaatggcggaccttggtctgctcgtgatgagattgatagaagatgcagaaatttcgtgtggggggacacgaccaaaggagggtgcattggttaaattggaaggatgtttgttccccagagacattgcgaacaatgaggactgcaaatcatgctttgctaatgagaggggtcggcgactttggagtagtcctgatgacctttgggtgagagtgatgaagtctaaatataaatccggtatggcaggaagactgatcattgataaggacaggaatggctctaatttctggaaaggcttagtaagttgttggagccacattgagaagaacatcatttggcggcttggaaatgctccaacagccaggttttgggacgatgcttgggttcctcaagttggcaagcttagcgatatttgctctcaaaaggatctgccagcttgctttttcgtgaactgggaaggtcagtggaatactgacattagggatggttttcttcaggccaatgtaattgatcaaattgagaatatcaagcctcccatgggttctaatg

SEQ ID NO: 55694 - DNA, 705 bp, Glycine max
  Peptide Sequence Number=SeqID_172472
atggacatgaatgttggagccctcatctctggacagatcactcttatggcccagtccaactcctcgaggctcggatttccagccctcatcactaccttatgcatggcccaaggagtcacctcagattccttgacttttaagtcgctcagcccagccattaacctggcttacataaagaagaactgttggaacttggacaaccccacggtcagctttccagggacccgcaaggccaggactagaggatctgagggtccatcttctgttgctccccagacatctactgcaccagctcctattccttcaacatcggttcccgatacttccgatccctccgctcagagcacatacctcatgatggcgatgctacaaagcattcaccagggtcaatacctggtgatgcaaagtttacatagtttggctcagcatcagccaattatgagcatagaggagttttccttacaggtggcctggccaggagtccaaccttcttctcatggaggaggtgaggcctctgcagctcaggagcctcaaccagatctggagactacacctgctgctcaggaggatgatttagaggccactcccccagagtcatttgtaccagaaactaatccagagaaagatgtagtgattgtggaggccagtccacaggcatcaccagtatctacaccagtgttggagctgagcaccctgcaaggatga

SEQ ID NO: 55695 - DNA, 457 bp, Glycine max
  Peptide Sequence Number=SeqID_172473
ggaaagggaagaatcaaaagaattctcagactgtgtcgttttcaattctttgacaagggagaagggagacacaaaagaattcaagcggttagtccttcgttcttttggaaaagggagaagagagacacaaaaagaatccaggcggttagtccttcgttcttttggaaaagggagaagagagacacaaaaagaatccaggcggttagtccttggcgaattctttttggcaaagggagaagagaatgaaaagatgaatagcacaagttttcaaggtttagaaaaccagaatactttggaaagcttttggcacaaagaagaagaagaagttcaaagagattcaaggcttgtaaaggattgtataagattgattgaaaattgtgtcttgaaaagcaaatcaaagccttgcttttatagacccttcatgtctggcctagaggaccatttagaagagttataa

SEQ ID NO: 55696 - DNA, 111 bp, Glycine max
  Peptide Sequence Number=SeqID_172474
atgtttgcacgcgcgcatccatgctcacctcgtcaaacaggattttgtagtctaggattaggaacaactatcccaaaagctgaagcttttggatggaggcaaaactcctga

SEQ ID NO: 55697 - DNA, 1380 bp, Glycine max
  Peptide Sequence Number=SeqID_172475
atggtgcggccgcgggagctgctctatatggctattgacggtgttgcgccgagggcgaaaatgaaccagcaacggtctaggcggtttagggctgcgaaagatgcagctgatgcggctgctgaagaagcaaggttaagggaggaatttgagaaggagggaagaaaacttccttctaaaggagagtcacagacttttgattcaaatgtcattacacctggaactgaatttatggctgttttatcaattgcacttcagtactatgttcatcttaggttgaacaatgaccctggttggcaaaatattaaggttattctttctgatgcaaatgttcctggtgaaggggagcataagattatgtcctatatccgcctgcagagaaatcttaaaggttatgatccaaatacacgacattgcctatatggtttggatgccgatctgattatgttggcattggctacccatgaaattcatttttcaattcttagagagattgtatttactcctggacaagacaagtgcttcctctgtggtcagatgggtcatatggctgcaaactgtgaaggaaaggcaaaaaggaaggcaggagagtttgatgaaaaaggagaggctattgtgacgaaaaagcccttccagttcctaaatatttggactctgagagaatatctggagtatgagatgagaatatctaatcctccttccgagattgattttgattgcattgtggatgattttatcttcatgtgtttttttgtcggcaatgattttctaccacatatgcctacactagagattcgtgagggtgcaattaacttgctgatagcagtatacaagaaggaatttagggaatttggtggttatttaaccaatggaagcacgataaacttgagcagggtggagcacttcattcaggctgttggatcttatgaagataaaatattccagaaaagagctcgattgcatcagcgacaaacagaaagaataaagcgtgaaaaggcacaggcaaggaggggagatgatgctgagcctcaatttcaaccagagtctttagtcgcagtttcacgattccatggttctcgtcttgcttcagctccaactcctccaccatttcaaccttctgggcattataattctcaagcgtctgcatcagttagaaaagacaataaagaagcatttgagaggcctcttaaagtttctagggtttcttctggagcaactgttgccgctgctattgttgaagctgagaataatcttgaaatagatgctcaagataataaagacgaattgaaaacaaaattaaaggagatacttcgagagaaatctgatgtatttaactcaaaaaatgctgaagaggataagtactccctacgtccctatttataa

SEQ ID NO: 55698 - DNA, 3309 bp, Glycine max
  Peptide Sequence Number=SeqID_172476
atgggtgccaaaactatgagcaatcaacaatttggccttgccctgttgcactgtttgcttttgggggtcgtgtcttggtgtccgtacttttcaatggaccgacgctggccatggaagaaaaaatcgtcggacaagaccgtgcttgagaaagcagctggcgaattggactctgctgcgggtgctggcactcagaagccgagctacgtccaaatctctgtagagtcatattcccatctgactggtttggaggatcaagtgaagacatatgaagaaaaagttcagacactggaggaagagatcaaggaattaaatgaaaaactgtcagcagctaattcagagataaataccaaggaaagcttggtaaaacagcatgctaaagtagcagaagaggctgtttcaggctgggaaaaggctgaagcagaagctttggcattgaagaaccatctggaaactgtcactcttgcaaaacttactgctgaggaccaggcgtcacagttagatggtgctcttaaagagtgtatgcgtcagataagaaagctgaaggaagaacatgagcagaaaatacaggaagttgctctgataaaaactaagcaattggacaagattaagggtgagtttgaggctaagatagagaattttgaacaggagcttctcaggtctgctgctgacaatgccgctctgtcaaggtccttgcaagagcgctctaacatgataatcaatttaagtgaagaaaaagctcatgctgaggctgaaattgagcttctcaagggtaacattgaatcatgcgaaagagaaatcaattcactcaaatatgagcttcatgttatttccaaagagcttgagattcgcaatgaagaaaagaatatgagtatgaggtctgcagaagctgctaacaagcagcacatggagggtgttaaaaaaattgctaaattagaggcagaatgccaaagattacgtggtctagtgcggaaaaagttgcctggtcctgctgcacttgcacaaatgaagctagaagttgaaagtcttggtcgagaatatggagaaacacgattaaggaagtctcctgtcaaaccttctagttctcacatgtccacattgcctgggttctcccttgataatgcacagaaattccacaaagataatgaatttcttacagagcgtttattggcaatggaagaagagaccaagatgctgaaagaagctttggcaaaacgtaacagtgagttgcaggcttcaaggagtagttttgctaaaactttgagcaaacttcaaattttggaagcacaagttcagacaagtaatcagcagaagggatctcctcaatccatcatccatataaatcatgaaagcatttacagtcaaaatgcaagcaatgcaccaagcttcatctccttgtctgaagatggaaatgatgatgtgggaagttgtgcggagtcttggtctacagcaattatctctgagttatcccaattccctaaagaaaaaaatactgaagaattgagcaaatctgatgccactaaaaagttggaactaatggatgactttctggaggtggagaaattggctcggttatcaaatgatttcagtggagtttcagttacttcaaacaatatggcaaatgaaactgtgaccaatgatgtatcagaggtcagtactgagaaagatgttccctctaacacccaagataatagtgagccaaatccattgcctagtgaggtttcttctgctgaggaattgtcagcacctgatccccaatctgatgttccagctggcttgtcgctagcagagcttcaatcaagaatatcatcagtttttgagtccacggctaagggtgctgacatagagaagatcctgaaggatattaaacacgttcttgaagaggcatgctgcacttccatccagaactctgtatctgccattccccatgatgtcaagccttctgatactacgtgtgatgagcagggtaatactgaagatgctgctggctcaaatgcagaaaaagaaattatttcgtcccagcaacctatagaatatgtgcagatgacttcggatttagaagtcgcaacttctcaaattcatgactttgttttgtccctagccaaagaagcaatgacagctcatgatatatcttctgatggagatggaataagtgaaaagatgaaggagttctctgtcacttttaataaagttacatgcaatgaagcaagtttgctgcagttcgttcttgacctgtctaatgttctagccaaagcaagtgaattcagattcaatatccttggttataagggtacagaagctgaaactaacagtcctgattgcatagataagattgctctgccagaaaataagttagttcaagacaattcatcaggagagagatatcaaaatggtcattcacatattcttaatccctgttctgatcccgaggttcctgatgatggaaatttggccccaggctatgaatcaaatgccacgtcacagaagttctcaatggaggacttcgaagaattgaaattagagaaagagaaggcagttgctgatctgtcaaagtgtgctgaaaatcttgaaatgaccaagtctcgattactagagacagagcaatatctagctgaagttaaatcacaattggcttctgctcaaagatcaaacagcctggctgagacacaactaaaatgtatgacagaatcttacaggacaattgaagcacgcacaaaggattttgaaactgagcttaatcacctgcgaatgaagacagaaactctggagaatgaacttgaagatgaaaagaaggctcatgaagaagctttggctaagtacaaggagatagaagaacaactacaaaggaatgagagcttagctgctgataaagacattaagactaagcaggagagaaatttggcagctgctgctgaaaaattagctgagtgtcaagaaaccatatttcttcttggcaagcagttaaaatctctgcatcctcaaacagagccaatgggatctccttattcaaaggccgaaggcttcacagagtgtgaacctaatagcccaacttttcaggatcaagcggagatggacagtgctagttctgcatttgtgcaaagactgggtggagagtcccccttacatttttctaacagtttatacagtccatcagataatgaatcaaactttccagccatatcttctgtacagaatccaaaccacaggcctactaagtcaacctcttcgtcagcttcttccactcctacaccggagaaacacacccgaggtttcagtagattcttttcatctaaaggaaaaaacggtcattga

SEQ ID NO: 55699 - DNA, 369 bp, Glycine max
  Peptide Sequence Number=SeqID_172477
atgagggtgttggaatgggttattgaccaaagtcaaagtgcctttcttagggaaagacaacttttaaatagtgtcttgatagctaataaggcagtagatgaagctaagagaagaaagaggaagtactttgttttcaaggtagattttgagaaggcctacgactcactctcatctggattcctacgactcatgcttgggaggatggtattccatgaaaggtggatcctttggatcaaagggtgtttacaatccttgtgttctttggttttggtgaacgagagtcttgcacaagagttcaaatgttataaaggtttgcaccaaggtgatcctttgacaccttttcttttccttattgtagtggaaaggtaa

SEQ ID NO: 55700 - DNA, 216 bp, Glycine max
  Peptide Sequence Number=SeqID_172478
atggaacttattaatgtgcctttggtagggaagacattcacttgcttcctgactaatggaaaagcaaagagtcgaattgataaggaggcttggttgaagaaaaatgttgttggatggggagcttatttacttaaagaaaaactaaatagggttaaggaggttttgaaaaaatggtacaaggaggaatttggtgtctacaaaggagatgacaactaa

SEQ ID NO: 55701 - DNA, 378 bp, Glycine max
  Peptide Sequence Number=SeqID_172479
atgagcgtccacgtggcccaggtgattgctgacgccatctatttgtttgcaggtatgccacccaccaggcaccctctggacccggataagtctaacagggccctggggtttccggcgttgatcacgggcctctgccagtcattcgaggtcgcagacgcatcacccccacctgatcaggccgatcccgctggatcactaggcatggagcgttatctacagcacttggttcgccagcaggcggccaaccaccgggggcaggtgcagatacatgagtgtctctaccggttcagccttagtcagcaggggcagggtttcgctccttttgcatgccctactccagagaagtttggggctaatgtcacatggcccggagactag

SEQ ID NO: 55702 - DNA, 201 bp, Glycine max
  Peptide Sequence Number=SeqID_172480
atgagtgcagtgcagagagtgcaagatgctgatgatgagagaaaatgttttagtagggctcgcttagcgcaattccaaccccgagagggatttgggcttagcgggctaacccgctgggccaaattcacaataaggtccaacagtgaaggaattgcgcttagcgcacagtgggcgcttagcgagatgcaattgtgcgcttag

SEQ ID NO: 55703 - DNA, 945 bp, Glycine max
  Peptide Sequence Number=SeqID_172481
atggaccaagtaaggaaccggaaaatcgacgagtacaaatggtacctctatcacgtgagtcgcatgactatgtcaaccggtattttactcaacacgtggcaagatctagagcccgtcacgctaaaagcattgtcggagcactctttctaccgcagcataaacactccaccgctttaccctattggaccgctgattaaagaaaccgaatcgctgacggaaaacgaaccggagtgtcttgcgtggctcgataaccaacccgccggttcggttctgtttgtcacgttcgggagcgggggcgttttgagttcggagcaacaaaatgagctggcgtggggtttggaactcagtggcgtgaggttcgtgtgggtggttcgggtgccgaacgacgctagtgcatttgctgcgttttttaatgcgggtggcgatgatgatgcgacgtcgtatttgccggaagggtttgtttcaaggactcgggagaggggtttggtggtgaggtcgtgggccccgcaggtggcgattctgcggcacgcatctacgggagcgtttgtgtcgcactgcgggtggaactcgacgttggagagcgtagcaaacggggttccggtgatcgcgtggccgttgtacgcggagcagaggatgaacgggacgacggtagaggaggatgtgggagtgggtgtgagagtgagagcgaagagcactgaaaaaggtgtggtggggagggaggagatagagagggtggtgaggatggtgatggaaggggaagaagggaaggagatgaagcgaagagcaagagagttgaaagaaaccgcggtcaagtctttaagcgtcggaggaccatcctacgagatgcgtgctgcaatggctaatgtttgcttgttcgcaacaaaaaagcagtgcaccaaaaagcccgttcagagggtggatcatgaaactgaagtcaaaggttga

SEQ ID NO: 55704 - DNA, 297 bp, Glycine max
  Peptide Sequence Number=SeqID_172482
atgcccaaatatacttgtgatagtggggtccatttgatgctagtcgctcatgcagactccttaggattctatcgcaaccagaccaccggtgagggctcgaaaaggcctctcgtgtgggccaagggtgcatcgtccatcgaaagaaaatgcgtggaatcgccaccaatgtttattcgaggaaaacgtcagaaaaaccaaaaagacgatggtctgcgtattttgaaaatgagggttcgggagttgttttcacgcacggggaagggtgtttccctcgctcctacgtatcctcagttgtga

SEQ ID NO: 55705 - DNA, 1194 bp, Glycine max
  Peptide Sequence Number=SeqID_172483
atggctctgaagaagctcccggcgaagaggtctaggaagggcatcactgaagaggacactgattccgaaggtggggatgaagaccagggggatgaggacatggttgacctatttgacttccttggaggaaagacggcgagtccaataacgtgcagagaccaatatggtcatctactccctttgtcgaagaccttagtgtcgttcgacagagactacattagtctcacctttgctatcccgagacaatcgagtctgatagcatgcagagacacctcatggttatccacaccctcgtcatccggagatggcaaatccgatgacacgcaaagacaccttatggttatccgcaccgtcgtcattcggagacggcaagtccgattacaagcagagaccaatgtggtcatatgttccctttgtcggagacctcagtgtctttcgatcgagactactttagtctcaccctcgtcattcggagacggcaagtccgacgacatgcggagacacctcatggttatccgtaccctcgcccctccaaagacggcaagtccgatgacacgcaaagatcaatgtggtcatttgctccctttgttagagacctcaatgtcttttgaccgagactactttagtctcaccctcgtcattcggagatgggcaaacaccttatggttatccgcacaatcatcatctagagatggcaagcccgatgacacacagagaccaatgtggtcatccgcgacctttgtcaaccagaggcaagcaagcccgttgatcgagactactttagtctcaccttcgtcatccaaagacgacaagcaagtgagtcctttggtcgagactactttagtctcaccttcgtcatcgagagacggcaagttcaatgacatgcggagacccatcatggtcatccgctggcttcatcaaccagaggcaagcgagcccattgatcgagactactttagtctcaccttcatcatccagagacaacaagccgatgacacacggagaccaatcatggtcatctgccacctttgtcaaccagaggcaaacgagctaaggcaagtgagcccgttgatcgagactactttagtctcaccttcgtcatctagagacaacaagtccgatgacacgtggagaccaatcatggtcatccgccactgtcgtcaaccagaggcaagtgaacccgttgacacatag

SEQ ID NO: 55706 - DNA, 216 bp, Glycine max
  Peptide Sequence Number=SeqID_172484
atgtcggagaactttgcggattacctaacgatggatgttaagtacctcgaagcggtcaagcaaaggttgcatcccaccgaacagatggttcaacaaagtaaaagagaaaggaaaggaatgaggaacttacttggatctttgttagagagaagatgcgtgaagatgcagaagaaagcaaaaatgcacgaagtagggtgcgagagagaaagaaagtaa

SEQ ID NO: 55707 - DNA, 780 bp, Glycine max
  Peptide Sequence Number=SeqID_172485
atggtcatctacccttttgtcgaagactcaatgtctttcgaccgagactattacagtctcttttcctttgtcatccagacacaattgagtctgatggcacgcagaggcaaatatggtcatctgcccttttttcggagactcaatgtttttcgatcaagactattacagtctcctttgccatccatagacaatcaagtccgatggcacgcagagacaaatatggtcatctacccttttgctagagacttaatgtctttcaaccgagactattacagtctcctttttcgtctgaagacaatcaagtctgatggcacgcagagacaaatatgttcatccgcccttttgttggagactcaatgtcttttgaccgagactattacagtctactttgtcgtccagagacaatcaagtccaatggcacgcagagacaaatatggtcatctgcctctttggtcagagactcaatgtctttcgaccaagactatcacagtctcctttgccatccaaagacaatcaagttcgatggcacgtagagacaaatatggtcatctgcccttttatcagagactcaatgtctttcaaccgagactattgcagtctccctttaccatccagagacaattgagtccgatggcatgcagagaccatcatggtccttcgcttttgttgtttcccgagactattttagtctcctttaccatccagagacaatcgagtccgatggtttcgctgatcgagctagtggtcggttggctggcgcgatcgcttgaacgaaattag

SEQ ID NO: 55708 - DNA, 228 bp, Glycine max
  Peptide Sequence Number=SeqID_172486
atggagagtacactaagttccaggaggaaattgccaggagggcatccgttggtcctagaagaggggcaccattgcaaattcagtgagaggaggagtcgggcttcgggttttgatgaagagaccatcggtcaactgctgtgtgttccgaggcagaacttcacccgaagtgtgacagggagacgggtgcggatcgtgcgcactagcatgaccaccctgacacagatctag

SEQ ID NO: 55709 - DNA, 522 bp, Glycine max
  Peptide Sequence Number=SeqID_172487
atgggcccaatgctagtgacaccccctagtttaatgagtgcagccccctattttgtgtttttggctgatttatttccgaaacatcgcgaaactttacgaattacacagcgacgagtgttaagcatcttaaatcagttagccaaagtttgtgcgttgacaaataattgtcctcggaagaaattaggaattgtaatcaaaaggaaagaacgcactttatggtgcccttaccgaacacgtgccagagctagagtaatgagtgaaataaaggaggtgcaagagcatatgaaggctgacatggaggccatgaaagagaaaatgattacaatgatggaagccatgatgagtatgagaaaaatgatggaggttaacatggctacaatcgttgctgcaagtactgccactaaggtggacccgactcacccatctggcctcaatcatgtaaaccctccagtcttggatatggtagagcagggaggcgaagcgctaggatgtacgggcgacccccattttgtgcaaatttag

SEQ ID NO: 55710 - DNA, 291 bp, Glycine max
  Peptide Sequence Number=SeqID_172488
atgagaggcaccatgcataagcctcaaggaaacctaggggcagatcagaagttctcacctggtagctctcttacccctggacatgttacaagcctgtcgcaacgtgcccttttgcgggcaagcgaggcgaggctcacgggtgcgctttccaaaggaggaaagatgcgcggagtcgccaccaacgaaggtattagcacctctcacgtcgacaaaagcgaggctcttgctcctacgtaccctccatcaaagaggaaatcagacctacgtagttcttccttaagagtgaagccc

SEQ ID NO: 55711 - DNA, 453 bp, Glycine max
  Peptide Sequence Number=SeqID_172489
atgtgtaagaaggagcatgaatctttcaaagaatatgtccaaaggttgagggatctggcagctcaagtagtgcccccaatggtggaaagggagatgataacaatgatagtagagacgttaccggtgttctactatgagaagatggtgggctacacgccttcaacctttgcagatatagtgtttgctagcgaaaggatcaaagtgggtctgagaagaggcaaatttgattatcctactttgatgaataggaagcctggggcaaatggagagaataagaaggacccttctcattacccatcaccctatcagcaaagaatgcccaatcatccacaaaggccacccctaaatcagccacaaaacctgcctgttgcacatctgatgctaaacaccacccttaacatgaaccaaaacaccaaccaaggaaggaattttccagaaaagaagcatgtataa

SEQ ID NO: 55712 - DNA, 276 bp, Glycine max
  Peptide Sequence Number=SeqID_172490
atggagcttccaccaacgtgtcaacaggctcgcttgcctcaagctgacaaaaggtatctccgcatgtcatcggacttgccgtctctcgatgacaaaggtgcagatgacgatgttagtctctacgtgtcaacgggctcgcttgcctctagctgtcaaaaggtgcggataaacataaggtatctccacatgtcatcaaactcgccatctctggatgacaaaggtgcagatgacgacgttagtctctacgtgtcaacgggctcgcttgcctctagctga

SEQ ID NO: 55713 - DNA, 428 bp, Glycine max
  Peptide Sequence Number=SeqID_172491
atggtttgcaccaaccaagcggatacaaccggaaggcttcttgccggttcattggcatttgaatgtcgtatcatgcactacttaattgtgtgcatcctactccctagatcttccaaccttgcacaggcccatcttgtgagatatcacatacataaggcattgcgatcaaatgctctactcccatatccccatctgatcaccttgtttttacaacattttaatatccctcttgactctgagccctttgtcaaagtcaagagatccttctctatcggtgcgaatgtagtctcctctttcagataccacaaagagagggatgggtcttgggtgaagaaagacgctccagtacaggctgtagaagaccgctctccatcaccacctcctcagagaaatgattcttcatctcttatgcacaacatacttgacag

SEQ ID NO: 55714 - DNA, 198 bp, Glycine max
  Peptide Sequence Number=SeqID_172492
atgactgtgaaaaagaggctaagtcatgaagtgcaaaaacgcagcttcagtgtgcttagcgcgatagaagaatctggtagggcattagcatcaaggtcatgcactaagcacgagattagtgcactaagcgcaacaggtgtcttcagccaggctcaacgcacgactggcgctaagcccgaatccacttactcgcgctaa

SEQ ID NO: 55715 - DNA, 396 bp, Glycine max
  Peptide Sequence Number=SeqID_172493
atgtctggaccaaagtacaacaaaaccgaagaaagcaagaatttcccgtcacttcagacgcatgcctttgtcaagtggtggacacaatttgatgtatccaaagtagaaccagaacaggtcaagctttggttcaaagctcatctagagcacctcaaagcagttgatcctgagacttcatcattccttaaccaaaagtcccaactcgctacattccttgcaagttccagatcaagagaaagcctggcaaaaaatcttaaagaagtcttacagcttttgcaacaagaagaagatgaaggcttctcctcaaagaaggaagaaactaattcttcaaaagaagatgatccattttaccaaaacgaggatgattgttttggtatttcgttaaatgatgattaa

SEQ ID NO: 55716 - DNA, 339 bp, Glycine max
  Peptide Sequence Number=SeqID_172494
atggcattaggggacatggcagctcgcccaggcgagctggagcttcaccctgaagtaaccttggtcacccaggcaagctatagctcacctaggcaagctggttacttcacccttaagtcttttgggggcccaggcgagctagaggctagcctgggcgagccaagtgatagaaagcttgcatcttggacccaaagccctcttctttccttttttcctctcaaagtttgcttcttggtttatagaggttaccgagaggaagaaattggacctcacttaagcacacctttggcctcacttaagcacggggttactaagagggagaaactgaacctcacttaa

SEQ ID NO: 55717 - DNA, 300 bp, Glycine max
  Peptide Sequence Number=SeqID_172495
atgatgcaagttagaggatgtaccctatgcggtagagctcgtgagtcaggtatgtgcatagctcaagaagatgcatctaaagagagaagaaccccaaggaggaatgcaaggtggttctcacaaggagctagaggaaggaaagccttgaaaaagaaaagagagctaagggagaagtggaggataagcttgagatcaccattccctttggagaagccctgtgatagatgtcgatggacactaaattttttaaggacctcctcacgaagaaagggaagtacatcaacaatgagaacattatag

SEQ ID NO: 55718 - DNA, 237 bp, Glycine max
  Peptide Sequence Number=SeqID_172496
atgcctaggggactccaagaaaattgggttacagatgcaggagaaggacctagggttctcaggagccttagggcttgggtatcacacaaggtggatatagtggatctcatgttagaggatgagggagagaacttggaggaggacacatcgtatgaggaggattcgtctttggacaaggaggaccccactacggagcgtaagattgtggaggggaattcctcaaaggattcatcttag

SEQ ID NO: 55719 - DNA, 1248 bp, Glycine max
  Peptide Sequence Number=SeqID_172497
atgcctctctctgtgtgtcggaggattgggaacctgaagattgccccaacccgaatgactcttcaactactagaccgctctattacaaggtcatatggtgtggttaaagacgtcctagttaaggttcgacaattcacctttcctatggactttgtgatcatggacatagaggaggatttgaacattcccttgattttgggccgtccatttatgcttactaccaaatgttttgtggacatggggaatggtaatctagaaatgagggtgaaggaccagaaggaagtagatcttgttgtgcaacgcttcaccattcattcaccactggaaaaagccttaataaatgttgtggaatgtttgaccaatgaggaagagaaagatctcagaggttgtctggcatatttggccaggttgaaggagactccctcaagggaatatgcttttgaagaattgaaaaaagactttgcagcagagaagcctaaggttgaattaaaggtcttacctcctcacttgaagtatgattttcttgaggcaaatgatgccaagccagtagtcatcagtaatgacttatcttcaaatgaggatgcatggttagtggaggtactcaagaagtataaggtagccataggatggcacatctccgatctcaaggggattagcccgtcctactgcatgcacaaaatcatgatgaaagcagactatagactggaggaagtgcaaaaacaaatcctcaagttgcttgaagcagggcttatctattcgatctctggcagtgcttgggtgagtccaatccatgtggtgcccaagaaaggtggtgtggttgtggcctgtaatgagaagaatgatctcatccatacacagacaatcatagggtggagaatgtgtatagactaccgcaagcttaatgacgccacaaggaaggatcatttccctctacggttcatggaccaaacgttggacaacgagttttcaacaccaaatctttacaaaacaaatttagtaaataagatgatgacaaaggtgatgaacaaaaagctcaaaagatcaaagaacaactcaagtgaatcaaagaacatctcaagtgaatcaagaacaagtcaagagttcaagaatcaagaagaattcaagactcaaaaagaaagcctacaatcaagaatcaagattcaagattcaagatctcaagaatcaagatcaagattcaagactcaagattcaagaataaagaaaggactcaatcaagataagaattaa

SEQ ID NO: 55720 - DNA, 300 bp, Glycine max
  Peptide Sequence Number=SeqID_172498
atgttgcatgaaatgaaatattggaacctttcaatgttgcacaaaagataccccaccaatgatagatctaacaccaaatccaaaaatgagaaggtgcaccccaaaaacaagtgttgtgaatcctccttatcaaccccgcaaaaaacacacccaccatcctccaccataatccccctccttactagagctacacgagtaggtagcttgtctaggatcagccttcaagaaaaagtcaagaccttggacgaaacatcacacttccaaaacgatcggaaggagaaattcactacagtagggtaa

SEQ ID NO: 55721 - DNA, 231 bp, Glycine max
  Peptide Sequence Number=SeqID_172499
atgatgcaacctatgcaaggttttaccaccaagattatgcacaacattgatggagttttgaatcatgtgacactatcaatgatgttggtcgcgcgtgatggtggagcaacggtacaggcaaaataccatagtcaagggaaattagagttacaactaagagtttgggagaagaggattgttttggggttaaaattgaaagttctaggctcaaatatgtggagcatcatataa

SEQ ID NO: 55722 - DNA, 1393 bp, Glycine max
  Peptide Sequence Number=SeqID_172500
atgactggagattcacggtttgagggtcatgagcgtgtgcgatataccagagatcagcttttacagcttaaagaggctgttgaggtccctgatgatattcttaagattaaacaagatatagaagctgaactttttggtgaagatccaagttggggccgtgctgaaagcaatcttcctcatcaattacaaaatcggtattctgagccagataaccgtgattggcgtggtcgttctggacaacctcctgctagtacagatgagagatcttgggaaaacctcagagataaccgagagtttggtaatagacagcaggatgctagtcaggttaatcgccatgaccaacttaattcccagtttgcaagaacacaaatctcttctatgcaagggtacatctattctgtgattatataccgtcaagcaagccatgagaaggccggtcaaggcagagcaaaaggtccagtcacagtggagcaaggtctagttgcggctgagcaatgtctagtggcagcaaaaaagagaagatgtggcaggaagggaggacctactcctacgctagtcaaggctgaggttccgtggtcagccagaaggggaagtctatctgaaaaggatcgtgtattgaagactgtgaaaggaatactcaataagttgactcctgagaaatttgatgtcctgaagggtcagttaatcgattctggcattacatcagctgacatcttaaaggatgtcatttcacttatttttgataaggctgttctagaaccaacattttgccccatgtatgctcatctgtgttctgatctaaatgaaaagctgcctccattcccatctgaagaacctggtgggaaagaaatcacctttaagagagtgctcttgaataattgccaggaggcttttgaaggtgctgaaaatctgagggaggaactaaaaaggatgactgtccctgagcgggagatggagcgtacggacaagggaaggctgctcaagctacgtacccttggaaatatccgtttaattggtgagctattgaagcagaagatggttcctgaaaagattgtccatcacattgttcaggagcttttaggatccccagacagcaaatcttgcccagttgaggaaaatgttgaagccatatgtcagtttttcaatactattggcaagcagcttgatgaaagtcctaaatcacggcgtataaatgatatttactttagccgattgaaagaattaagctcaaacctacaacttgtaccccggcttaggttcatgattcgggatgttatagagttgcgtgctagtaactgggttcctagacgggaagaggtcaaagccaaaaccattactgaaattcattcagaggcagaaaaaaatcttggtttgcggccaggagcaactgcaa

SEQ ID NO: 55723 - DNA, 144 bp, Glycine max
  Peptide Sequence Number=SeqID_172501
atggaaagtgggagagtttatattcccgaaatagcaaaagaaataggtctcttggacaagaatttgagaccaacgagtccttcttgggtaccagaaaatggaaaacttgaagataaagcagttgttctaagacgaaaaagctga

SEQ ID NO: 55724 - DNA, 264 bp, Glycine max
  Peptide Sequence Number=SeqID_172502
atggatgaagagtacgatgtaattgtgttgggcacaggtctcaaggaatgcatcctcagtggccttctctcagttgatggcctcaaggtgttgcacatggatagaaatgactactatggaggggcttctacatctctcaatcttacacagctatggaagcgatttaggggagatgacacgccgtcagagaacttaggatccagcagagaatataatgttgatatgattcctaaggacaataggcctgtgctaattaagtgttag

SEQ ID NO: 55725 - DNA, 108 bp, Glycine max
  Peptide Sequence Number=SeqID_172503
atggtgccttcaccttcatcgacgaatagggctgctaccatgaagaggaccaacgtgaaagggtacaagggtagggttttcagagcacatcttattctagaatggtaa

SEQ ID NO: 55726 - DNA, 675 bp, Glycine max
  Peptide Sequence Number=SeqID_172504
atgaaatcgagttgcaatgggtgtcgcattctccgcaaaggctgcaatgataattgcataatcaggccttgtcttgagtggatgaactctcctgagtcccaagccaacgccaccctctttcttgcaaaattctatggtcgtactggcttgctcaacctcatcactgctgctccacagcaccttggcccagttgtgttcaggtcactgttgtatgaggcatgtgggagattggtgaatcccacttatgggtcattaggtttgttttggactggggaatgggcccaatgcgaagctgcagttgatgccgtgttgactgggtccaaaatcaatggtgtggcaccttctgatggccatacctcagggacacttgctagtgatcatattctctcaacatgtgatatacgccatatgaagaatgggacaaatgtggatgacatgagaggtagaattcagttcaagaacgtcaaacaggttatcaaaccaaaacctcgaatgggttcgatcgactcaactatgttatggaaacccaactgccagagtcagagcatggaaactatcgaggcttcattggtgagccaagatgagttgaaccgagttcgtaaaatcaagttggacttggaactcactcttggctttcgttgccaatcgaccaatggcaagaaaacacattattga

SEQ ID NO: 55727 - DNA, 424 bp, Glycine max
  Peptide Sequence Number=SeqID_172505
atgaggattaacacctatgaatcatccaagatttataagcataagataaagacgtatcatgataagaagctacagagacagaacttccaaccaggtcaacaagtcttgctcttcaattccaaactcaggctatttccaggaaagctgaagtcaaagtgttcagggtcgttcatgatcaaagaagtaagaccccatggagctgtggaattggtggaccatatggcaagcaccccggagaaaagatggatcgtcaatggacagcaattaaaaatttacaatggaggccagctagaaatattaacaaggtgcaggaagcaaaaaggtggttgggctgacaatgttatcgcgctaattgcgcatctacacgctcagtgcctagctggcgagagacgcgctaagcgagatatccttgctaagtgcgtag

SEQ ID NO: 55728 - DNA, 486 bp, Glycine max
  Peptide Sequence Number=SeqID_172506
atggccactatttctcaatggcggttttatttgtacagtgctgcagtcatgacaagggcatttcctgactatattggagaccgaagggacctctttcttcttcagagcatagcgagttatttgctacttggctgtggcgttgtttatgttgtttcaggtatcctgtgcattggttttcttaaacgtgcccgccagaagcaagagattacaagagagcaagcaaccaaggatctggagtcatattgcaacagtgctcctcttccttttcatgtccatcatcattggtggagattgggtacaaagatctatagcatgggcttgttttcaatcttaactgagaggattaagactcttatttctctcagcaacttcttatctccagctgatcttgtctacaatacatgttttttaatcaagaaaacctgctttatttacttgcttttatggacgcatccaggagttggaacgccgcagagaggagcttga

SEQ ID NO: 55729 - DNA, 948 bp, Glycine max
  Peptide Sequence Number=SeqID_172507
atgggtctgtttgagaagcgccgtgctcggaagttcttcatctatgtccaagattatgaaacaaatgatcccaaatctcacgaaggactagatctgaaccaagttacagcaaggcagttgatatcgaaatatggattggaagatgatacggttgactttattggtcatgccttagcacttcatcgtgatgatagttacttggatgaaccagccaaggattttgtagacagagttaagatttatgcagaatccctagcacgctttcaaggaggttcaccttacatatatccactatatggactgggagagttgcctcaggcatttgcacgtctgagtgctgtgtatggtggaacttacatgctgaacaagccagaatgcaaggtagaatttgacgacaatgggaaagccatcggtgtgacttcagaaggagaaacagccaaatgcaagaaagttgtgtgtgatccatcatatctgtctgataaggttcagaaggttggaaaggttgcacgtgcaatatgtattatgagtcatcctattccagacaccaatgactctcactcagcacaagtcattctgccacagaagcagcttggtcgcaagtctgatatgtatctcttctgctgctcttatgctcacaatgtagcagccaaaggaaaatatattgcttttgttacaacagaagcagagactgaccaacctgaggtggaattgaagcctggtattgaccttcttggacctgttgatgaaatattctatgacatttacgacaggtttgaaccctgcaatgatcatgaagctgatggttgtttcatctctacaagctatgatgctaccacgcactttgaaaccacagtaaaagatgtggttgagctgtacagtaagatcactggaaaggttcttgatctttcggtggacttgagtgctgcaagtgctgcaactgaagaatga

SEQ ID NO: 55730 - DNA, 624 bp, Glycine max
  Peptide Sequence Number=SeqID_172508
atggaggacgtagaacgggtgaaggccgaggcactgcaaataatgggagtattttcactgctcccaaggctcgtcgttttcgatctcgattacactctctggcctttctactgtgagtgccggtcgaagcacgacacgccttctctgtttccacattcaagagggatattgcatgcactcaaacaggagaggattgatgttgccattgcttccaagtcgccaactcccgacatcgcaacaacgtatcttgacaaactcagcatcaggtcaatgtttgctgccgaggaaatattttacacctggaaggacaaaactgagcattttcagagaattcattcaaagactggggtcccctataactctatgctcttctttgacgatgataataataacatcccaggggcctcagaacttggagtgacaagcattttggttagaaatggggtaaatcttggagcattcagagacggcctcacaaaattttctcaaaacaaggatgcatcaaagaagaacagaccgaaaaggcccaaaaccacatcgattgacgatttcaaatctgttgcctctattactcccaattcccaggaggaaaatttaagtgtacctggagcatttttaatatga

SEQ ID NO: 55731 - DNA, 588 bp, Glycine max
  Peptide Sequence Number=SeqID_172509
atgacggcgggagcaatgcggcagatgctttttagcatttggaagcctccggtcgaacacgttgggccgtcagctggaggcggatattcttttgcgtttgtccgcatcgcgcgggcaagcgccgcgtgtttttccaacccggttgacgcgggtcgcggtcagtcgatgacttccgcgcaggcatcggtcggcgcggcggcgacgccgcccaccaccggcacgatcttgatgaccgcggaggtgacgcggcagggcgcggcggcgaggccgcagcccgtacaggacaggcagagcagggaaatcagcaaccacttcatgggattcgtcggcgagggatgggcgccgcgggcgtggccgtggcgcaatgcctggattctgcgccgcgggccggtcatgaatagtggggaattgagcggcgaatgtaatgacgtttgcgcgagggcgctcaggatcgttcagccttttcagcttgcatccgccatcggcgacgccgctcacagcggcgcctggccgcgctggcggtacacgcgtgccaggctggcgaagaacgacagcgcggcgatgcagcaggccagggcgaagacgtag

SEQ ID NO: 55732 - DNA, 177 bp, Glycine max
  Peptide Sequence Number=SeqID_172510
atgcattgtattcacaatgggatgcaacccatacaagattactattttgtgttcgacaaaaatggatattttgcaggtcattgtcaaggacaggatttggatagtgctgatgatagcccaattcacatcagccaacttaaggttgatgtaatcctacccctcaagggcattgaatag

SEQ ID NO: 55733 - DNA, 476 bp, Glycine max
  Peptide Sequence Number=SeqID_172511
atgaagaagatccaaggcctacaagttctacatggagctacgtcaaagattcctggtgttgctgaggcatccatcagaaatctacctccatcgaccattggtgatgctagcatctttaatgctaaggctttattagatgctaacaagggcaatcccatggaaggaattgttgagcaaactcgtgatggcagtaccctacgtgtctatttcctcccagagtttcagtttgtccaagccccacaaatgggaaggagagttgtacctgaaagtgttgctgaaccagaggttatagctaatgcaactaatggagatgttactggggaacctcaagccctactaacatctgcccaaagacttgtagcccctgcatctgttgaaactgctactgatcctttagcacctgaagctaaatttttcactaagattagagtattgaaccaagatttaggtgttgataagtacaacaatttgattgg

SEQ ID NO: 55734 - DNA, 243 bp, Glycine max
  Peptide Sequence Number=SeqID_172512
atggtattagagtctattctagatccattgttgtaccacctgcattgccatgctctaggccccttcaggcctgtagtcatgggcttgagtgggcaacttgcaacatctgcggctggcattcctctttttgaattttttcttacaatggataaaaaaggtgaattcaagtcacagatttgctgctctaaaaattatgaacagttgggaataccaggcaaccaatttgggttattggtggcatga

SEQ ID NO: 55735 - DNA, 732 bp, Glycine max
  Peptide Sequence Number=SeqID_172513
atggcttcagaagaaaatgatgcgccaacttggataagtgacgatggtccttacgtggttgtaacagatcccctagatggttctcgaaatattgatgcatccattccaacaggcacaatttttggtatttataagcgccttgaggaacttgataatctacccacagaggagaaggctatgctaaattcactccagagtggaagtaagctgattgctgccgcgtatgttctctattcttctgcaactatactctgcatcacctttggttctggaacacaggcattcactcttgatcattcaacaggagactttattctcacaaatccaagcatcaaaattcctccccgtgctttggtttatgctcttgacagctctcttgtgtggtcagggcaaatttattcagtaaatgatgcgcggtattttgactggccggaaggtttaaggcaatatatagacactgttagacaaggaaaaggtagataccccaagaagtactctgccagaactttgctgtatggaggtgtgacaatgaatccaagggaccatcttcgtcttgtttacgaagcaaaccctcttagtttcattgtagagcaggctggtgggagagggtctgatggcaaaaataggattctttcccttcaaccagttaaacttcaccaaagacttcctctctttttgggaagcttggaagacatggaagagttagaaagttatggggatatccaacaaaaa

SEQ ID NO: 55736 - DNA, 191 bp, Glycine max
  Peptide Sequence Number=SeqID_172514
gaaagctagaagatgcctcagaagatcaaggttcttcttttggagttgttgctgcttctaagtcctgcaagaattttctaattctctctgcattacgcctcctgcaagtagcgttaatctccaaatcaatggggatcaaaccacctgcagtagatcttctttgcatacaagagaaacagaacagcaattaa

SEQ ID NO: 55737 - DNA, 135 bp, Glycine max
  Peptide Sequence Number=SeqID_172515
atggggtgggccggcgcggaaggtggtgttaggccttttggagtatcactactagttgttggatttgatgataatggaccacaattatatcagactatatgtaacaagtccagacttcagaacctcgttcattag

SEQ ID NO: 55738 - DNA, 252 bp, Glycine max
  Peptide Sequence Number=SeqID_172516
atggaggctcttcaatattttagaatgacggagaagcaacaagaatatgataatgatgaattggagaaagtgaatggtctacttacagaaaaggaaaaaaagatacaagagttggaagccgagctagaatgttatagatcaaacatggcagatgatgagcctatggctactaagaacccaatgtacctaaactacattaaggttaatggacagacccttggggctgcagattctaacaatacctttggatga

SEQ ID NO: 55739 - DNA, 246 bp, Glycine max
  Peptide Sequence Number=SeqID_172517
atgtggggggacggtgggtggtgtcttctagatattgatccctgtggaaaacttgtcttatgcttggattctacattttttgagtttgaagagttatgggatgcacattctattgaattggaagagagcctccaaaaacttggagtggagaaactcaacaaagatgatgttcaaaagctacagtgggagattttggaagccaaaattggaaactggattcatttcatgcgtatagcagtaagatga

SEQ ID NO: 55740 - DNA, 150 bp, Glycine max
  Peptide Sequence Number=SeqID_172518
atggcgctgactagtgccctgtgttcagcttttgatgagcttctagacacaatggcttgtttcttggatttccatgaaatcatagaaaggaaaatccctgctcctggggatcccttgatatacctaagaattcaaatagtagcttgttga

SEQ ID NO: 55741 - DNA, 546 bp, Glycine max
  Peptide Sequence Number=SeqID_172519
atgaaccagcagaagattggtacaattgagatggtggaaggactctacagactcaatatgattcctatcaagtctaagtacaagtctgattttgctggttctagcatttccaatttttctgccttttcatatgattactcaaggtttgtttgggtttttctcatgcagtcaaaagctgagacacaatctcatctaaagaattttgttgccaatgttgaaagaaaattttctccttcttatcacaatattgttttatccattacacaaagtcttgaacctcggtcatataatgaagcttctaaagatcctgtctgggtagaggcaatgaatgcagagattaaggctttagaacttaatgatacttggattttaactgatatgcctcaacataataatgttattggttgtaagtgggtgtataagatcaagcacaaatcagatggttcaatggagagacataaggccaggttagtggccaagggctacactcaagtggaagggcaagattacctaggcaccttttctccagtttccaagctaaccaca

SEQ ID NO: 55742 - DNA, 729 bp, Glycine max
  Peptide Sequence Number=SeqID_172520
atgggttcacatctgtgctttgggagtaacattccccctccttgtccttgcccccctctttctctctttcatatgatgcatcgtaagaatggacagtttgcatcaatgaaggaagactacaaatctcctgctgaaaattgggattcaagcaatggtactccttgcccagaatctaccgtgttgatgctaatatgttattgtcgggcggcaactctgccattgttaagtgaacgtagatgccagcattgtggaattagtgagaagtctactccagctatgcgtcgaggaccagcaggtccaagatctctgtgcaatgcctgtgggctcatgtgggcaaataagggaactctgagagatctcagcaaagcagcaaggattgcttttgaacaaaatgaactggatacttcagctgatataaagccttcaacaacagaagccgaacattcttttgctaagcaggacaaggagggaagccctgaagaaactaagcctgtgcaaatggattccagtcggtcacctgagaagacaaatgaccagtttattatcggaactgctgaatcagttactgacaacttgtccatccaagtggagaatcatgctcttagtctacatgagcaggatactcttgaggatcttgctgatgcttccgggaccgaatttgagattcctgcaggttttgatgatcaggttgacattgatgattccaacatgaggacttactggctgtga

SEQ ID NO: 55743 - DNA, 865 bp, Glycine max
  Peptide Sequence Number=SeqID_172521
atggactacataaacacttcccacccaaattttattggcggaagtaaggcaatagaagctgcagtgcaacaaaccaggtcttctagaattgctttaccagtttctagggtgaaggatgcactggaatctgataagggatcagcctctgagagaagtgggaagtctcgatctattctcgcaagacatgcaaatggagtagtggctgatcaggaaatgacagctagtaaaccacatactgaaccagtccatactgtgcagtcattctctactattcatttgagagagccccctcctgtcttgaggccattggagagcaattcagagactgaagctgttgaaatcacagtaacaaagttgcttttgaaatcatactatgacattgtcaggaaaaatgttgaggatcttgtccccaaagcaattatgcacttcttggacttgaacgaactgcctcttgaagctgaaacagttgaaaggggatacagtttgcctgaaactactactggcttacctaaaattcgtggattgcctacttcgtctatgtattctaccggcagtttgggagactattatgaagcttctcccaagaacacaaagtctagaaagtcttcacattctggggaactccaatctccatttcacgattcaaatggaaatggagggccatacacgtcaggaagatctgcccgtcctgctcctcgtgcagcacctcgtcctgctccagttcaccatgctcctcctccagcccctgctcagagcggtggcggatctatgcttggtggcattggttcaaccatagctcaaggtatggcttttggcactggaagtgcagtggcacacagggctgtggatgctgtcatgggtcctc

SEQ ID NO: 55744 - DNA, 108 bp, Glycine max
  Peptide Sequence Number=SeqID_172522
atgtgggagtgcctgaacagctatggcagtgaccttagcaagtgccagttttacatggatatgcttgcagaatgcaggaagaactctggagcctcgttgagtgtgtaa

SEQ ID NO: 55745 - DNA, 453 bp, Glycine max
  Peptide Sequence Number=SeqID_172523
atgaagaaaggaattgcttgcctaccaggcttaggctccaacaatgtggcatcaagtgcccaacttttgtgtctggtctgtgaatcaaaccttgaaaactgttggcataactttatcaattatgatagggcacaacaatgctggcagaagacacacctctggcaggccatggaggctatatctattcaggtagaaaactttgctgagtttttttcttcgtgctttcaatccctaagtgttaaggagatggaggcttgtgttagggagtatgtggaaggcaagaaacatagacttatgggaaaacaaattgttgcagtcgaccaagtggttttccaggcaacgaaagtgcttacccaatggagtggtgcacaagctatggagaagagtttggatgttcaaagagatagagagctggtggtagctcttggactccaccgcaaaatgacttcctga

SEQ ID NO: 55746 - DNA, 378 bp, Glycine max
  Peptide Sequence Number=SeqID_172524
atggcatcatcgaaatatcaaagtctttgcttctacaatctccccctttttgatgatgacaatttaattcctgaaatcaagatacaagatagaatatatgcaagatataacgttatgttcactcattccatactccccctatgttttggaattaatgatctcttgatttctaagctttctaagcttctaaactaccccgtttctctccccctttggcaaaatcaaaaagccaaagtacgtggaagttggtggaaggtcgaagcaccgatgaagataactcacatcctcttcaagctgcgtgatacgggtatccattccttcaaagcgaccatccaaagaatcaaagcattcgccaacataggtgcggaggccccgtaa

SEQ ID NO: 55747 - DNA, 135 bp, Glycine max
  Peptide Sequence Number=SeqID_172525
atgaaaactgagacagctcgcttaacgcataacacaggcttaacgatcaactcaactcaggctcaacacgaacaaggcctacgaacaagtaagcttaaaggtacacttagcatgaaagttcacgctaagcatgag

SEQ ID NO: 55748 - DNA, 338 bp, Glycine max
  Peptide Sequence Number=SeqID_172526
caaaggaaagcccgatcgttgctgttttggccgatgcctatgacacattcgaccaaagatgcgagaagagcagtgcaagaattgtctgttgcacgcccgctctttatgtatggctggtctcccacatttttcgtcatgaaagggcgtccgttaattggttcccccgatggaaggaagaaggtgtcggggttttgtgctcgtgtgaagggttcccaaatgtccccttgatggaaacaaggggttgtatcaattataatccaatgctggccataagacaactaggctaccctgtgagaggggcaccatcggaagagattatcgcgcctttcatcgcatga

SEQ ID NO: 55749 - DNA, 164 bp, Glycine max
  Peptide Sequence Number=SeqID_172527
gacaagggtgcgcagaaggcacaagattgggggacccgtattctgctcttgtagtactcaaggtggctcctcagccgatggtagacgacggaagacttgctcagggaccgatgggggtaccaaggtggcgacatctcgatagactatatcacctagctagctag

SEQ ID NO: 55750 - DNA, 506 bp, Glycine max
  Peptide Sequence Number=SeqID_172528
atggcagaagaagatatcccgaagatagcctttcgcactcaccacgatcactacgagtactgggtgatgccttttggactctgcaacgcgccgtcaacgtttcaggccgccatgaacgctttactcagcccattcttgaggaagttcgcgtcagttttctttgacgacattctgatctacagtgcaaccttcaacgatcaccttcatcatctcgaatgcgtcttcaattctcttctgcaggctcattattacctgaaacaatctaagtgcttaattggtcaacgccagcttgactatctaggccacatcatctccggcagcggcgtcagacctaacccgactaagattcaggcaatcgttgagtgggctacgccgcgatctccgaaggatcttcgtgccttccttggcctcacaggattttatagaaaattcgtgcagggatacgccgccattgcagctccactaacgaaactccactggaaaaatgcatttcagtggacctcgga

SEQ ID NO: 55751 - DNA, 258 bp, Glycine max
  Peptide Sequence Number=SeqID_172529
atgatttcattacacacgattgatgcaaatcggaggtgtttgatcacggtggcggtgagaatgcacaacggcatggacgaaggtgcaaggccaaagggttgtgcggtgttgcagcggcgtggcgatcaggagcagcgcatgtggcagttgggatgctgttgcagcaacattggagtcgctggttcatatctggattgggttgaatggggcgagaagaagctgaagggtctcacatttgtagggataaaaaacaaatag

SEQ ID NO: 55752 - DNA, 414 bp, Glycine max
  Peptide Sequence Number=SeqID_172530
atgaagcacttcatagatcagatgcgccgcgacgtcatatacgaggttgaccagttggtgtacgttaagcttcgacctcatcgacaatcttcactttgttctcagccatcaactaaattgaccaagcgttactttggtccctttcaagttttggagtgtatcggcagtgtcgcgtatcgtttgcagttgcatgagggatccaagatacatcccatgtttcactgctcactgcttcgacctcattatggccccttggatctacaacaagctcctctcccaccggatgttcttgataaccaccctataatggaacctatggccatccttgactcacgcgttgactcctcaactcagccacccacacaaatggtactagtgcaatggacgggtttggctccagaagattcgacctag

SEQ ID NO: 55753 - DNA, 450 bp, Glycine max
  Peptide Sequence Number=SeqID_172531
attatggttagaactaaagggttaggtcgtgccttagataggattataggtagagccttgggaagaaaggatcatcatcattcagatgacgttccccaacgacgaaggcctacagcatccacgcgtaggcaacgggaagttgcccctattgctaaggatgctcctaacgtgactgaagatgtgcatgcacatgttgaagaaactattgattatgctgagggatttccaggtgggccgcgtgacccatcagcgctgactaactatggtgatcatgttgcagtcatcgtatggaatggagaggaacgtcctgaattgaagctatcctcccatggaatgaaggttcagaaattcgagaggcttgctcctaaaattgaagggctagtcgttgccataggattaagtcttttgatcgcatgtcatgcaatcctaccccccaagggcattggatag

SEQ ID NO: 55754 - DNA, 309 bp, Glycine max
  Peptide Sequence Number=SeqID_172532
atggaagaaggattctctaccaaaaaactacccatattcagaggtgtaaaatatgactactggaaggaacaaatgataactcattttgaatccattcacattgacctatgggacatggtagaacatagaaatcacattccatatgatgacaagttaaacgaagtcccaaggagccagtggagggaggagcaaaaactcacatttttgttcaactccaaggctcgaaacgtgatgttatgtgccttgtcaaaagaagaatacaccaatgtacatagcttcaggagtgtcaagcaaatgtggacagtctaa

SEQ ID NO: 55755 - DNA, 153 bp, Glycine max
  Peptide Sequence Number=SeqID_172533
atggactcaggaaggttccaagttagtgtaccagttcctcatcttttgcgtatgcccccatcttccgacaatatatctttagatgtgtcataccctaatttcgtctggggacctttgcttggtgacatgcgacctttctttggtccttgggag

SEQ ID NO: 55756 - DNA, 294 bp, Glycine max
  Peptide Sequence Number=SeqID_172534
atgaggattccgctccgattaaaatgttcctctcagtgtggtggtttagcggcaaacaatggcagctcgtggtggccaccggtggtcgtgggtggtggaggaggagtttctagggtggttggacagagttttgagagagagaggcgtgaaattatctcgcttgacgagcgtgtctcgttaagatggagtccacttttggcattaagcacaacttttcacgcttaccgcaatttctctcaggttagaattgcacttagggcacttcttactctttgtaattatcttaagttgtaa

SEQ ID NO: 55757 - DNA, 867 bp, Glycine max
  Peptide Sequence Number=SeqID_172535
atggagatcaagaagaggtttggggtgttgatgtgtgcagaggattcggagtacgtgaaaaaagtgtacggagggtattctggggttttcgtgagaatgctggcggaggagggagagacatgggacgtgtacaaggtggcgcgtggggagtttcctgacgaagatgatttgggtctctatgatgggtttgtgatcactggcagctgcagtgacgcacatggcaacgacacatgggtcagtgatcttctcaacttgcttcgcaaactcgattccatcaacaccaagatcctcggcatttgctttggccaccaggtacggaatgctgctgcatctttcgattcaattcaacactatttttattctcaaaaggtgtatacagtacactttttgtcttgcatttcacatcctgactacgcgatatctcatatcgatctctgtaagatacttgggcgtgcattgggagggaaggtgactcgttctactactggatgggatcttggtgtcagaaccataacattgtcaccatctttgcgatttgctttgtcttctcttgatcttccatcaagactttccattatcgaatgccacagggatgagatccgagagctaccagccaaggcagaggttattgcttggtcggataagactggaattgaaatgttcaggtatggagatcacattatgggaatccaaggtcaccctgagtactccaaagacattcttttgcaccttattgaccgtctcattcaacgcaattacatcatagatgcttttggtaaacaagcaagggagagggctgcgttgtgggagccagatagggaggcttggaagaaactctgtgtcacttttttgaagggtagattgtga

SEQ ID NO: 55758 - DNA, 837 bp, Glycine max
  Peptide Sequence Number=SeqID_172536
atggctgaaatttttacccgcgacggtgctcagatgctccatctcatccgcgatcttcggagcatcgatatcgagatcccggtggaactggagagcgagataaacctctacaagtcggtccaagacatcgacagggccgcgcgagtcgacctccagaatgcgcagtcgagattgagcgcctgtacgccggatgaatgggatgacacggtgctagcgctgtcggcggctcttacaacgtcgtggaatctcgacaacggtctaacgtccaacctgttgcaaactacgacagaccgattggtacgaaccacctaccgctacacgtctcattggtccgcccagatcgtctccaggctcaacgcgctagtcgagtcaacagagtggaacaggcacgtccgcaacattcctgcgttcgaccagaaggtccgagcgctatcgattacccgttcgcaggcgacagccgtcgcggcgtgcctggaagccgccgacgcgttcaatccgctttggaatgtgttggtgcggcttgggaacttggacggtcacgagatcggcgtaggccgcgccgacgatttctcgcggaacgcccacctgttttacatactgtccgatggtgactggggccaagcgcaaggtgcggctatgcgcatggctggttcggcattcaaatcgactgccgccgaggagtacaccgaactcataccgttcgtcttccccggtctggttggtgctgaattggacttcgcaacgccgaaccgtgcgtcggagcggcggcgcaaccgccagaccttcggcacagtcgggcctatcgctcagtacagcggcgtttcctaccactcgtga

SEQ ID NO: 55759 - DNA, 339 bp, Glycine max
  Peptide Sequence Number=SeqID_172537
atgaaggatcgaagaaatacaagtagtggggatgtctccttcacctctagaacctcacaatcactcacaaactcatctcaagctctcaggacgacttccacttcatgctcaattctctgcagcggatggactcaagcggtgcgtttaacgggattagccctcgctcggcaaacaagaacaggtcatccttcttccaaattcttcctcgcactcagccaaaggagtgttgcgctcagcagatggctcgctaagccagaagattggcttagtgagcggatgaaaatcagcacttcacaaacttgcctaattaacctgaaattgagaggaaatggttattaa

SEQ ID NO: 55760 - DNA, 324 bp, Glycine max
  Peptide Sequence Number=SeqID_172538
atggttgagattgtggcctaccctccccctaagcttatcagaggtcaagatgtgcctatttgggccccaaccccgaatgacactttttcaattagcagcgcctatgagttgattgagaattgtgcggatcctttgaatgatcctctttggaagagtattggatgtggaaagggctgcaacgggtcaaaactttcatgtggagtgtggcctttcatgaccaatatgcaacctctcctcattgtcaaggagctgatgagtaggaattggagtgttagagtaacaagattttctttttacagttacttttgttggtacaacaattaa

SEQ ID NO: 55761 - DNA, 1114 bp, Glycine max
  Peptide Sequence Number=SeqID_172539
tgccactcctcctcctctctgcgctcccaacgctgcaataacacgctcactctctttcttcattcttctcttccctttcgcgccaactctgatcggtgttccttccctccttctgcctcctcctcccgcctcagatgcagactctccctcccttctcttgcatcagaggctccccatggattttcctcccgccctcaatctccttaccgaattcggttgcggcttcgtccttctccgctccctctcccgcatcttcaatcttctaggcctctttctgatgctcacattctgcttcaaggttatgtgcttcggttggaactccaagaacgcccttcgcttcctctgcgactccggcggcgtccccagaatccgcttctgcctcgacaaagtcgttttggaaaaagtctccaaagcgaagaccaaacctttgaaaaaaccacgccaccccacttcgagctcttccttccggaggcgccccggtgggtccggggagagagggaacgcggtttccgatgatgggtcggaggggaagggggagaacgagagagagggtggcaatgaggacgaggtgttcgacgtaatgacgcttagaagaatggtgaggatggagcggcagaaggccaatgcggcgtgcgcggatctcgagaaggagaggacggcggcctcctcgtccgcggaggaggcgatggcaatgatcctgcggctgcagagcgagaagagcgctgcggagattcaggccacgcagttccggcggatggcggagcagaagctggattacgataatgaagtgattgagtcgttgcagtggacgatcacgcagcacgagtttcagaagtgtgaggtggaggatcggatagagatgtgtagggaggaactgaggcagtttatgagggatgaggaaatagaccgaattgaagatgaagtgagtaggagttttatgtatgataatgaaaatgataatgatgatcctgatggctcaactttcaggtttgatagtgtacgtttgagtaaatttaatggagcacataatgttgctgggattgatgcttcacctgcgtgtaagaatttgattctgatgctagctgttgacaacaatgttatacgaggcatttag

SEQ ID NO: 55762 - DNA, 1098 bp, Glycine max
  Peptide Sequence Number=SeqID_172540
atggaggttgtgattgttgcaattgctgctacacttggaaatcttctgatgggatgggatagttcaactattgcagacaaaatgatgtcctcaactacagtgaggaagttgcaggtggtgtcccctgttcctgtggacatagacattgcaaactccgttgaacccgttcatatctcccagattgccaaagacctcaaccttagtcccaatcactatgacctttacggtaaatacaaggccaagctggagagtgatttggatgcacatgcacaggttttgttgtcggttcttgatgagcttcaaggatcagaagatgggtattatgttgtggtcggaggcattactccgactcctctcggggaaggcaaatctactactacagtggggctctgtcaagctttaggtgcttttcttgataaaaaggtagtcacctgccttcgtcaaccatcgcaaggacctacttttggaattaaaggaggtgcagctggtggtggctatagccaagttattcccatggatgaattcaatcttcatctaacaggagatattcatgcaataactgcagcaaacaatcttctagctgctgcaattgatacccgaattttccatgagtcaacacagtcagataaggctctttttaaccggttgtgccctccaaataaagaagggaaaaggagctttagtgatgtcatgttcaggcgtcttacgaagcttggcatttcaaagaccaatccagatgatcttacaccagaagaagtaaataaatttgctaggcttgatattgacccaaattctatcacatggaggagagtaatggacatcaatgatcgattcttgagaaaaattgctattggccagggacttgacgagaaaggaatggtgagagaaacaggctttgatatttcagttgctagtgagattgtggctgttttggcactgacaacatccttagctgatatgcgaaagaggcttgggaaaatggttattgggaatacgcgagagagccatttcacattctgttttatgttagatctcattactgaaatggctcaagaaacgacccgtgcgttacgcacgggttacatcctagcgtactaa

SEQ ID NO: 55763 - DNA, 1470 bp, Glycine max
  Peptide Sequence Number=SeqID_172541
atggttcacagcatggatgagagagggtatgatgctgatgttagttacgattctggttcaaacagattaagtgtcaccttcactggatataaggatgataaaaaaattaaacagcacttattctctgtggtcaatctgagtgatgtgttacctgaatgggttgaaattggtttctcttcagcaacaggagatttttatgaggaacatactcttagctcatggtccttcaactctagtttaggcccgaaaccgcaaaagggtggaagcaaaacagggctggtgatagggctgagtgttggacttggagcaggcgtattatttgttattttgggggtaactttcctcgtgagatggatactgaggaatagaggtgtggaggaagtctcactttttgatcatactatggacaatgatttcgaaagaatgtctctacccaagaagttttcctatgaagaacttgcaagagcaactaataactttgcgagcgaaaacaaaatcggacagggaggatttggggcagtctacaggggatttatgcgagagttgaatgcccatgttgccattaagaaggtgtctcgcggatctagacaaggggtaaaggagtatgcatctgaagtaaagatcattactcaactcaggcataaaaatttggttcgactctttgggtggtgccatgagaacaatgacctgctgctggtttatgagttcatggaaaatggaagcttggattcttatctatttaaaggaaagggtctgctgacatggaaagtgagatatgatattgctagaggtctggcctcagcattattatacctgcatgaagagtgggaagaatgtgtgcttcatagagacataaaatccagcaatgttatgttggattctaattttaatgcaaagctcggagattttgggttagccagactaatggatcatgcaataggatccaaaacaactggtttagcaggaacaattggatatttgcctcctgaagctgccacaagaggcaaggctagtagggagtctgatgtatacagctttggagttgttactttggagatagcctgtggtagaaaggttattgaacctaatctgaatgaagaacagatctatttggtggattgggtttgggaacactatggtatgggtgctctcctaaaagcatctgatgcaagcttatatggacactttgatgagaaggaaatggaaagattaatgatagttggcctttggtgcactcattctgatttccttctgaggcctacaattaggcaagctgttcaagtgcttaattttgaagctccactgcccattctcacatctttcagctctatgtcctctaggactcctgcttctgcaaataaccaacacgtgtcctcaaattcaagcagtagcttactcactgaatccttacaatcgagcacaactattgacctcatttctccagcagctgcatatttacatacgtactaa

SEQ ID NO: 55764 - DNA, 1317 bp, Glycine max
  Peptide Sequence Number=SeqID_172542
atgtccactcaacaacctaacccctggggtttgtatgatccatcagcaggaagcgacagctgtggtgtaggttttattacccgcaaggacggcgagcagacccatgaaatcctgcagatggcgcatagcgccctgtgcacggtaccgcaccgtggcgggatgtctgcagagggtgtgggcgatggtgcaggcgttaacgttgacctctccctgaacttcttccgtaagctgaccggtcaggcgctggaagcgggccgctttggcgtgggcaacttctttgtgccaaaagatgcggcgctgcgcgcgaacgcagagcgtctggttgaagagacgctggccgcttacaacttcccggtgctgctgaagcgtgatatgccgctggacaacagcgtcacgcgcccggccgcacagcagttccagctgccgatcgtgcagtgggtgtttgccgcaccgcaggacgttaccgagcagagcgacttcgagcgccacatttaccgtgcgctgctggacatcgaagcacgcgcttttaccgaaagcgaattcggcggcctttatccgctgtcgctgtcgtcgcgtactcaggtgttcaaagcccgcctgaactccaacgaagtgattccctacttcaaagatctgaccgatcccgatcatcaggtgcgcggactgtttttccatacccgcttctccaccaataccgatccgcataccacaatggcgcagccgttccgtctgatggcgcacaacggtgagctgaacacggaccgtaaaaaccgcatcgcggaagcggcactgatgctggcgcgcggcaaaaagatcgtgcggccaaaaggccagtctgacagttcacgtctcgatcagagcatccacagccgtctgatggaagataacctcgatctgatcaacgccgtggtttcaatgatgccgccggcgtgggaaaacgacacctcgctgtcggctgaagtgcgcgccatgctcgaatacttctcgctgtatgaagagaagaacgacggccccgccgcgctgatcttcggtaacggcgaagtgattggcgcacggctggaccgtcttggtctgcgtccgctgcgctccgtagaaaccgctgaatacatcggtgcgatgtcagaagccggccagatcgccttcccaccggagagcgtgctgcgccgtggccgtatcgaagctggcggcatgctctattacgatcacaaagagaaacgctcttacaccaccgtgcaggcgctggaaaagctggcggcggaaaaagattatctctccctggtgcaggcggcacgcgttgaactgcagcagctgccggaa

SEQ ID NO: 55765 - DNA, 360 bp, Glycine max
  Peptide Sequence Number=SeqID_172543
atgattaaccctgcactacatcatcctctccggggtgaagagggttcatccttgaatcagaaaccatcttactgccaaaagaagcattaccagcataaggatgaggtgcttaacattgaaaacatcagcaatatgaatatgactcagaagttgcaaacaataagcattctggttgatattctcaataatctccataggcccaattttgcgagcagcaagctttttatattcatgggtaggaaaaggatctttagtcaagatagtccagacaaaatcgctaacagaaaagtccacagatcgacacttccactatcaattgagcatgagtatgttcatgcacctgggaaagtttggagatga

SEQ ID NO: 55766 - DNA, 151 bp, Glycine max
  Peptide Sequence Number=SeqID_172544
gcatgtcccaccaggaggaatggcggtatgcacttctcactcttacccctgtcccgcaaatgccaatagcggcacccccctatcccgccattgccactggcggttcaagcttcccgccagtgtcaatggcggcacccacgtccaaaagtga

SEQ ID NO: 55767 - DNA, 1850 bp, Glycine max
  Peptide Sequence Number=SeqID_172545
atgcatgtccagttatccaatcttaatttcccccatcacctcttagtgatgctgctatccattttcttcctcttgattatcccctatgcttcctctttgtcctttaacttcactagtttcgatcctaatgacaagagcatagtatttgagggatcagcaaaccctgtagcaccaactatccaactcacacgaaaccaaatggacaagggcatgattggaagcattggtcgagccacatattaccaacctatgcagctgtgggacaaagccacagggaatctcacagatttcacaacccatttttcttttgtcatagattcacagaaccgaagtaaatatggagatgggattgcattcttccttgcccctgctggttcaaagattcctaatgccacaaaaggagcttctatgggtcttacacttgataaccaacaattgaactccacagacaattcatttgttgctgtggagtttgatatctatcagaatggctgggatccaccccatgaacatgttggaatagacatcaactctatgagatctgcttctaatgtaacatggttggctgatatcaaggaagggaaactcaacgaggcttggatcagttacaactccagttcattgaatttgagtgttgtgttcacaggttttaacaatgataccgatcataccattcagcagcaacatctatctgctatagttgatctgagacttcatttaccagaattggtttcttttggcttctcagctgccacgggaaatgcaactgctatacatagtctctattcatgggattttacctcaactttggcagcacaagaaaacataacaaagggagcagacccagttgcaaggtctccaacctccaatatagctcccagtcagaagaaaaagaacaagacaggcttggcagtgggattgagtattggtggatttgtttgtgggttgggtttgatttcaattgtcttgtggaagaagtggaagaaaggaacggaagaggaagaacatgattttgaagagtttatgggtgaggattttggaaggggggtagagaccaggaagtattcatatgctgaattagcacaggcagctaatggtttcaaagatgagcaaaaactaggtcagggaggatttggtggtgtttataggggttatcttaaagacataaagtctcatgttgccattaagagggtgtcagaagattctgatcaagggataaaggagtttgcatcagaaataagaactattaaccggttaaggcatcgaaatctagtgcacttgattggttggtgtcatgaaaggaaaaagctattgcttgtgtatgagtacatgccaaatggaagcttagatactcatctcttcaagaagcaaagtttgttgaaatgggcggtgagatataacatagctcgaggattggcctctgcattgctatacttgcacgaggaatgggaacaatgtgttgtgcatagagacataaagtcaagcaacattatgctggattcggagtttaatgccaaacttggggattttggtttagcaaggtttgtggaccatgcaaaaggtgcacaaactacagctttagctggcactatgggctacatggctcctgaatgtgctaccttgggcagggctagtaaggaatcagatgtctacagttgtggagttgttgctttagagatagcttgtggaagaaaacccatcaaccttaaggcacaagaaaatgaaataaatattgtgcagtgggtgtgggaactctttggaggagggagaattcttgatgcagcagatccaagactagaaggggattttgaggaggagcaaatcaaatgcttgatgattgttggtctttg

SEQ ID NO: 55768 - DNA, 1182 bp, Glycine max
  Peptide Sequence Number=SeqID_172546
atggatcattcacccaaggttgggagagggagcagaagcctgcgttcagatgcggcattggaagccatagccaaagcttcagaagacagagtttccaacatcattctctacaactacccttccttttctggagcattctccgctctctttgctcacctcttccacactcgccacaatctcccttcccttatattgcccttctctgcagttccctttctcgctctcagggttgaagatttgtgctttgaaggccttgagacgtgttacctacttgactttattcctccaaaggaattcctttccgacctttctcgtaaatcaaaatgcaagattattgggtttgatcatcggaaattggtacttagacatattccccctgccaatgattgccccgataatattatgattaatgtaaaccttgagaagagcagctccagtgctgtttatgagtactttgccagcaaattatctcatacaacaatgactgaaattgaaagatgcctgaatttcattaagggtgcagctccatgtttggtggaatcaaaatacaaaggccaggtgcagctgatgcttaagtatattgagaatggagatcttcgccgatggagcttgcctggcattaggaatattccaattcttggtgcaagttattgtcaatttctctatagttatcatgtctttgctgaatttgctctgttctttgaaaaatcttcatggcagttgctggaattaagtgctgaaggtttgattgctaaaggaaattcatgtgtttcagctcgccagaatgctgcaaacaaattgctggaaaaggttttcagggttcgactaggtagaggattttatggagagtgcctgggagttcgggcagatgggaactccaacttaagtgatgaaattggcaagcttcttagtgtaaaaagtgctgctactggtcttaggcccataggtgctgtgatattcatgcaacggaataatctcaaaatgtgcttgcgtagcactgatagttccactgatacctctgaagttgcaaagtgttatcataagagatccataaacagtcctgatattgatacagcacatgatgagactaggataaataaggtggagcctgaccctgagcaagatggaagcattgatcttggggtaaacacgccactgttggggtcgacttcaaggacataa

SEQ ID NO: 55769 - DNA, 3090 bp, Glycine max
  Peptide Sequence Number=SeqID_172547
atggcccgattccttgcccttccgtcttcccctaccgcctctctccgcgtgatggttgggaacgacaacaccctggagtgcgacactgtttcgcatcaggttccactgcatattcagggtaattcctttaccctacatttacttcatctccccctttgcggagcagacatcgtgctgagcgttcaatggttaaagctcctgggcccaattaccactgattatgttgcgttgaccatgacttttcagtacatgggccacccagtcactcttcatgctgatgcacccctccaccccgcttccattacggcccatcaattaaaacgtgttgcccagacccacaacatatcagccttgttccacattactcccgtcatagcccaaccagagtcaccatctccttctacaccaccccctccacccttaccacctcaaatcaccaccgtactggcccgttaccccgaaatcttctctaaacctacccacctccctccccaccgtaccatccaacaccatatccaccttctccctaacaccgaacccgtaaatgttaaaccatataggtatccacacttccaaaaaacaaaaatagaaaaacaaatcacctccatgctcgactctggtctaatccaacccagccatagcccgttttcgtccccaatccttttagttaaaaagaaagatggtacatggcgctgttgcgtggattatagagctttgaacgctctcacggttaaagaccgttttccgatgcccactatagatgaattgctcgatgatttgggtcatgcttcgtgtttttcaaaactcgatttgaggaaaggatttaatcaaattagaatggctgaatcagacgtccacaagactgctttccgtacacaccagggccattatgaatttcggttcgtcgcagtgttctttgatgatatcctggtattcagctctgacttggccactcatgttacccatttggacactgttttggcaaccctatcagctcacaacttccttctccgacactccaaatgtgaattcgccaggtctcggctcaattatttgggccatgttatctctgcccacggggtagccccagacccagagaaaatccaggccatgttagcttggccagttcccacttccccaactgctcttcgaggcttcctgggtttgaccggattttataggaagtttatcaggggttatgctactgtagcttctccactcacaacccttctgcgcaaagacaacttcaagtggtcccccacagctgaccttgctttccaaacactgaagaccatgatgacacatgcccctgttttatcaaccccggatttctccattccttttacccttgaaacagatgcattagcatcggccattggagcagtgctcttacaacagggccaccccatagcgtattacagcaagacactctgtcctcaactgcaatactcatcaacatatgttcgcgagctttatgcaatcacatcggtcgtgcgcaagtggcgtcattatctgctaggcagctccttcattatacttatagaccataagagtctcaaagaccttatgtcccaagtcattcagactccagagcaacagaattacctggtcaaacttctcgggtatgactatgaaatcaaatacaagccagggtctaccaacattgttgctgatgcattatcacgacttcctgatggtgtttgcttgtctttctcgattcctcattttgatttccttgacaagctccgtcatacccttacccaggacccccaatatgtcgaattacttcaggtgattcattcccggtcagcagagcacccttcgttctcagttcataaggagttaattttccgtcaagaccgcatttggataccttttccaactccatttacatccatcctcttggacgaatttcattcatcccccctcggagggcatgccggcgttgcaaaaactcttcatcgcatacgtcagaactttgactggccaaccttgcgtgcggatgttcgtcaattcgtctctcagtgtcccatatgtcagcaaacgaagtatgcaactaagaagcctagtgggttgctacaaccacttcctcctccggcagcggtttgggaagatttatcccttgattttatcaccggtttaccctcttcccaaggcttcaccgtcatcttggtggtagttgacaagttctcgaagggagctcatttcggcgctcttccaactcactactctgcctttaaggttgcttctctttttctggacatggtctacaaacaccatggatttccccggagtttggtctccgataggaactccatttttcttagcactttttggcgagagctttttcgattaagcgggacgaagctgcatatgagcacagcataccatccccaatccgatggtcaaacggaggtccttaacaggactttggagcaatacctccgttcattcgttcaccacaaaccctcactttggtttcgcttcctccctcttgcggaatggtcatataataccacaatccattcaagcacgggattttcccctttcgaggtgatttacgatcgtccgccgccgtctatatcccgctacattcaggggacgtcttccattgatgctgtcgatactttgctcgttgatcgcacagagcttcacgctgccttgcttcgtcgcctcggtaaagcacaggaggccatgaaagccagcgccgacacccaccgccgcgacgttcagttctccgtgattcagagtatcggtgcaattgcttacaaactccagctacctgcatattcccggattcacccggtttttcatgcttcactactaaagcctcaccacggtcctttaccgactgaatacactcatcttccgaccgatgcaattgataacagcccagtaatttcccctctgtccatcgtggattggaaatgggatgagtctgttaccccaactatcaaaaaggtgctcgttcaatgggatggtttagccccagaggacacttcttgggagtcctgggaagacttgcgcacctcttacaaccttgaggacaaggttgttttcggggtagagggtgttgatagcaatacctag

SEQ ID NO: 55770 - DNA, 1425 bp, Glycine max
  Peptide Sequence Number=SeqID_172548
atgtgcagagctttgcatgagaaagatgagcgtcgattttcgcgggcaaagttcttctttatcgcactagtctgcagtttttcatggtatgtgatccccggatacttcttctcaacactcacaaacatatcatgggtgtgctggatattctccaagtcagtcactgctcagcaactaggctcaggcatgaacggcttaggatttggtgcactcacacttgactggactgctgtagcatcattcctgttcagccctcttatctcacccttctttgccattgtcaatatctttgtggggtacacactggtagtgtatgttgtgattcctattgcatattggggcctcaatgtgtacagtgcacatatgtttcccattttctcatcaaacttgttcacttcccaaggccaagagtacaacatatctgctattgtcaatgaaaagtttgagctagatatcgccaagtatcatcaacaaggtcgaattcatctgagtgtgtttttctctttgacttacggatttggatttgccaccgtagcatccacccttacacatgttgtatgcttttatggaagggaggttatggagcggtatcgtgcttcggcaaagggcaaagaagatatccacacaaaactgatgaaaaaatacaaagacatacctacttggtggttttatgtgatgatgggcgtgacgcttgtggtttctctcgtgctatgcatctttctaaataaccaggttcagatgccgtggtggggacttatctttgcttcagccttggcctttatatttactctcccaattagcatcataactgccaccacaaaccagacaccaggactaaatattattactgagtatctctttggtataatttaccccggaagaccaatagcaaatgtatgcttcaaaacctatggttacataagcatggctcaggctgtctccttccttggtgatttcaagcttggtcactacatgaagatccctccaagatcaatgtttttagttcagttcattggtacaatgcttgctggaaccatcaacatttgtgtagcatggtggttgctgaactctatcaacaacatttgtcataaagatctccttcctgaaggcagtccctggacatgtccaagtgaccgtgttttcttcgatgcgtcagtcatctggggtctggtaggacctttgaggatctttggttctcatggagactaccaagcattgaattggaagaagtggtggcagagatacaactatgttctatcagcagcacttgatgcaggggttgcttttatggctgttctgctctacttcacacttggcctggaaaacaccagtcttaattggtggggaactgctggggagcattgccctcttgcaacttgcccaacggctaagggcattgtggttgatggttgccctgtatattga

SEQ ID NO: 55771 - DNA, 2163 bp, Glycine max
  Peptide Sequence Number=SeqID_172549
atgccggccgcggggatgcggcgcacgacgagggtgttcgggatgaagggggccgagacggcccgcgttttacggtccgggcggcgcctctggccggactccggcgaggtcaagaccaagcgatcccacgacggggaccagtggccgatggcgccgccgtcgaaagccgcgaaaatcgacgccgcggcgacgccgcgtaaggggaagcgctgcgaggaggctgctgctgctgtggttgacaggaggttcggcaagggccttgtgtatcagaggaggaggaagggtttgttgaaaaaggaaggttctagaaggaacggggaggttttgcgctgcgtgatttcggttgttgtgagtcgctgtgcagggaaaagtggaaggtttttgaggttgttagcatcggtggtgaggaagctgtcggggttctgtatgtcggaggcgattcatggggcttttgcgtcgcaagggatgcagtttgtaaagggtcctacggttgtaaacactggaatatgccagttctttggggtcacagggactgtgcccgcattttctgtggacttttctgctgtttctccttgttttgagtatctgcagtatgcgatgttcttaaaatctatgtttaggtcattttttcttgtacataatccaataaatgtgcctagtgatgaggatatcgagtcagatgatgatttgctggaataccagaatgaacagcagatttcaagtgatacctttaagagggaaccttctgagattgtaactgttacatctgatgttattgaaatcaatgataagcaatctttacattcttcagtcaaggttaccaccagggcagctggtcggaatggacaatataaaaacatgttgaactctagaggcattcagaagaggagaagttctcttaggaaaaggaaagctcgtagtccttctatggtgagtttacgcagaaatggagcagtagcttctgatttaacaggtggtaggaaaagcaattgccagttgtctgttgtgacctctagcagaaaacttaggagtatggctaatggtagccccactgggagcctgaaagaagctagttctgccatagtggattcgaaagagcgactaggttcatcttcctgttatgcaaacttgttggtatcagagatagaccaatgctgcaggttagagggagcaattgttactttagagtggtcttctccaaaagaatggcttttcactgtaaagaaagatggattaacaagatgcacattcagagcagaaaaagtgatgcggcccttttcaacaaatcgattcacccatgcagtagtgtattcattggacaatgggtggaagctggagtttaccaatcgccaagactggaatgtctttaaagacctttataagaagtgttctgatcgtaatatccctgctactgctgccaaagttatcccagttccaggtgtacgtgaggtctcttcctatgcagaaagtaactgttttccctatcacagaccagatacatacatatctgcctctggtgatgagttaactagagtaatgacaagggcaactgcaaattatgacatggattctgaagatgaggaatggctgaaaaagttcaatgagtttcaagaacatgtgtcagaggataattttgagttaattattgatgctttggagaaggtttattattataatccagatgattcatttgatgaaaaatctgcagccaatggttgtcaggaccttggtagcaaggaagtggtagaagctgtatataactattggatgagaaagcgaaagctaaaacggtctttcctgcttagggttttccagggtcatcaatcaaagagagctccacttatccctaagcccttgctgcgaaaaaggaggtcatttaagagacaacctagtcagtttagtagaggcaatcaaccaagtgtgttgaaagcatttgcagctgaacaagatgccatggaagaaaatgcaatgctcaagattgaagaagccaaggccaatgcaaacatgtccatggaattagccataaataaacgcaaaagggctcaatgtcttgctcagaatgcagatttggccacctacaaggccacaatgttaattagaatagccgaagcagctatggctgcagaatcattagatgatgcagcagcatattttcttgattga

SEQ ID NO: 55772 - DNA, 360 bp, Glycine max
  Peptide Sequence Number=SeqID_172550
atgacaacctttgcattcacttccttgctcccacttacagtctcatcaccatcttcatcttccaaattctcagcttttcatgctatcagagcctcattagattctgagtatgttgcctcccgacacacccttagaagggaattcttgaagggtgttgctttgatgcctctgccacttgttgtgatgagagaaccacccccttcacatgctagagaagttgaggttggctccttccttccaccctctccctctgacccttctttcgttctcttcaaggccactcccaaggacactccagcccttcgagcaggacaagtggtgattatgattatgattatgatattccaagaacctgaataa

SEQ ID NO: 55773 - DNA, 330 bp, Glycine max
  Peptide Sequence Number=SeqID_172551
atgggcccaaaatctaccctaatgctcatgagaacctcagcgccttctcttgcatctctggctcaatcttcttggagtcttctatccaatgcccttgggggttcattgtccaaaaacttgtgctatggagagacagggagatcgaagggtggagagccaacaaatgagcaatttgaggacttttgtgtgtatgggattcagctggaaaacgtggaagcaatgtcttccaaggttattttgatgatgccaaagaatcaagagttaagcaaagtttcaagcaaagattcaagaatcaagttccaagattcaagattcaagattcaagaataa

SEQ ID NO: 55774 - DNA, 1854 bp, Glycine max
  Peptide Sequence Number=SeqID_172552
atgagctcctccgacctctcctccctctggctccccacgccgcaatccgccgcctctactaccactcctggactggaaaccacccgagcaccgccgcctcagtcccactccctcctcaaccaggagaccctccagcagcgcctccagacacttatcgaaggcgcccgagagagctggacctacgcaatcttctggcagtcttcctacgactattcctccggcacctcccttctcggctggggagacggttattacaagggtgaggaggacaaagtcaaagccaaaggcaaaacccccaaaacgacgtcgtccgcggagcaggaccaccgcaaaaaagtcctccgcgaactcaattccttaatctctggcccctccgcttccgttgacgacgtcgacgaagaagtcaccgacaccgagtggttcttcctcgtgtcgatgactcagtccttcgtcaacggaagcggcctcccgggtcaggctttttttaactcgagcccggtctgggttgccgggccggaccggctgtccgagtcggtctgcgaacgggcccaccaggggcagatgttcgggctccagactctggtctgcataccgtccgcaaatggcgtcgttgagctcgcctccacggaggtgattttccagaaccctgatctgatgaacaaggtgcgcgatttgttcaacttcaacaacaaccctgaaactggttcctgggcgttgaattgcgttgccaccaccgatcagggggagaacgacccttcctcactctggctcaaccctgaaatcagagactcctctaccgttgcgccgccgaattcaacggttaacaagactctgcagttcgaaacccctggttccagtaccttaaccgatacccctagtgctgctgctgttcatgtacctaaatctaatggccagggtttcttctcgagggaattgaacttttcgaattcattgaagcctgaatctggtgaaattctgagctttggagagagcaagaagagctcttacaacgggagtttctttcccggtgttgttgcaattgaggagaacaacaagaagaggtctcccgtttctcggagcagcattgacgatgggatgctgtccttcacatccctgccggctgcaaatataaaatctggtagtggtggtgccggtgccggtggtggtgattcggatcactcggatctggaagcttccatggtgaaacaggcagacagcagagtgatggagccggagaaacggcctcggaagagggggcgaaagccggccaacggcagagaggagccgctgaatcacgtggaagccgagagacaaaggagagaaaagctgaatcaaagattctatgctctacgagctgtagttccaaatgtatccaagatggacaaggcatcgttgttaggtgacgccatatcgtacataaatgagctgaaattgaagctcaacgggctggattcagagaaaggggaattggagaagcaattggattcagccaagaaggaacttgagctcgcgaccaaaaaccctcctcctcctccaccaccaccacctggactacctccatctaataacgaagaagcaaagaagacaacgaccaagctcgctgatttggagatagaggtgaagataattggttgggatgcgatgataagaatccaatgcagcaagaagaaccaccctgcagcaaggttgatggcagcattgaaggacctggacttggaagtgcatcacgcaagcgtgtccgtggtgaatgatttaatgatccaacaagccacggtgaacatgggaaacaagttttacacgcaggagcagcttctgtcggcactctcgtccaaagttggcgatgaacaacgatag

SEQ ID NO: 55775 - DNA, 195 bp, Glycine max
  Peptide Sequence Number=SeqID_172553
atgcctgggaaggtggtgaagaattttagaaggctagagagtctttcttgtggggagggttggatggagaggtgggggacaaaaagcttttgtatggtggaaaggttttttttcggcggtgatggtgtggaggaggtgtgtagtagtggtggtgtagatggtggtagtgagagtgacgacgaaggtggaggttga

SEQ ID NO: 55776 - DNA, 788 bp, Glycine max
  Peptide Sequence Number=SeqID_172554
agggtacatctacttgggttgttgtgattgagaacaagagagggtacatctcttgtggatcaattctagtggagggtacatccactaggttgttcaaagaaaacaagggtgggtacatcccttgtggatctttgcttgtaaaggtttttacaaggttgaaagaaatctcaaggaccgcaggtcgcttggggactggatggaaacttaaggagtggaataaggatgtctttggtaatattcaatggcaaaattttgaaatcaagaaagcaacaaatgagattgataagaaggatgaaatgggggtgatgaatgaagaggatgttaagagtataagagatctttttgtggacttcaagaaggtgatcttagcaaaggtcttgtctagaaggattaggagagtgcttagtggggccattgatggaaggcaaggtacatttataggaggaaagaatttacttgacgaggtggtggttgcaaatgaggtgagttgtttggagtcagttagtttctctattcttcttaatggtagcccaactttggagtttaagccacaaagaggcctaagggaaggtgaacgtttttcgtcgttccttttcctcgttatagttgaagccttaagtgggcttatgaggagagttatggagaaaatatgtttgaaagctatagggtgggaacttctaagtgctgattttcaccctctcgctaagccaatcttctggcttagcgagccatccgctgtgggcaacacatctcggctgagcgcgaggaagaatctggaagaaggatga

SEQ ID NO: 55777 - DNA, 336 bp, Glycine max
  Peptide Sequence Number=SeqID_172555
atgacggaggagttgtcgtcggtccacaggttcatccggtactcggtcattcagtgcaccaacaacgagaatttggaattggatgagagtgagagtgaagtgtgggtttggtttgttttggcggcgaaagagggagtggaaaagagagagtgtgtgtatctatctgaggagagagataaggaaaggtacacgccgattaaatcgctgaatgggagaggctgtaaaaagatgccttctattcttaacctgagccaaggaaacagagaagtggtggcacattgggacacgtggcagtttctgattggattctctggaaaactgtcttcactggcgtga

SEQ ID NO: 55778 - DNA, 183 bp, Glycine max
  Peptide Sequence Number=SeqID_172556
ctgggttgcttcagctcgcctgggcgagctgggcggcaacctcctccccatttttcctataaataggctgaagggggctgttctaaggatcccggatgcccctggtgaggttttcgtaagcaaatccgtgaaggttttcctccgttattcaccgttcttcatctgttcttcgttcttcaacgg

SEQ ID NO: 55779 - DNA, 261 bp, Glycine max
  Peptide Sequence Number=SeqID_172557
atgagtcaagctcaagccttacgtataccaactcgggtcgagctcaagcctagtaaggcttggcttggctcatttccacccctactcgtacccataattttttccacttgtggacttgttgacaccgttcaagaagggtatactggattccacatgggagcattcaacgtagaaatcagtgattacttgaatgtgactattttgttggttattgtgagtgctggatatcatctcagcttggctaggtgttttgggacataa

SEQ ID NO: 55780 - DNA, 192 bp, Glycine max
  Peptide Sequence Number=SeqID_172558
atgaagcactgtcagagtgagaccgagagcaacaagtggaaccaccgtgagagtgagagtgatactaagaacgaggacggaagcaccgtaagagttagagggagaccgagaatgaggactgaagcgctgcgagagatgacgcaggctgttcatgctagactagcaagaaccattccacaacattggttttag

SEQ ID NO: 55781 - DNA, 183 bp, Glycine max
  Peptide Sequence Number=SeqID_172559
atgcttcatctcgtcgtcctcattcttttcgtcgttctcttggcatcactctcactcttggttcactcgcactgtcgatctcactctgacggacattgtcggtgttttgttggtcttgctctcagttgcaactctccatggcagcgacgagagtgtagtgtgccttgcgtaaggataatataa

SEQ ID NO: 55782 - DNA, 264 bp, Glycine max
  Peptide Sequence Number=SeqID_172560
atggcaatggattgtcacacttttgcgtgtacgggtttcattccagaatcccagcttaaaaacaaaattagtcattccttgatccacatgggctttattggacttgtaacgtggtcagggcaaaacagggcacttggtggacttgcagcttgcccaagtgagctgatgcttcactttgaagtaacattgctcgcccaggtgagctacaactcgcccaagcaagctgattacttcagccctaagccatttgggggcccaggctag

SEQ ID NO: 55783 - DNA, 204 bp, Glycine max
  Peptide Sequence Number=SeqID_172561
atgacgaccgaagaacaccaaacgaagaacgatgtagaagtcgattacagtcgcgattcgatagcacctcggcctcatttttctcttcttcttcttcttctctctaatttctctccaaattctcttaatactgaatgtccaaccctttactcagcctccctcacgcctatttatagcaaaaaagggcacttggtggacttgtag

SEQ ID NO: 55784 - DNA, 2010 bp, Glycine max
  Peptide Sequence Number=SeqID_172562
atggttgtgcagttgacgagtggcacaaagacatcatatagaaagatatgggtacttccgatctcagatttattcattgtgaaattcgatcctcgctgcagttcaaagcctgctggtaatgatgtcattggaattgatctgggtactaccaattcgtgtgtctctgttatggagggaaagaatcctaaagttattgagaattctgaaggagctcgtacaacaccatcagtggttgccttcaaccagaaagcggagcttcttgttggtacaccagccaagcgtcaggctgtgactaacccaacaaacactcttttcggaaccaagcgtttgatcggtaggcgttttgatgattctcaaactcagaaggagatgaagatggttccatacaagattgttaaggcgtccaatggagatgcttgggttgaagccaatgggcagcagtattctcccagccaagttggtgcttttgttctcaccaagatgaaggaaactgctgaatcatatcttggaaagtcagtttcaaaagctgtaattactgtaccagcttacttcaatgatgctcagaggcaggcaacaaaagatgccggtagaattgctggtcttgatgttcagagaatcatcaatgagcccactgccgctgcactttcctatgggatgaacaacaaggagggtctcattgcagtttttgatcttggaggtggaacatttgatgtgtccatcttagagatttctaatggtgtttttgaggtgaaagcaacaaatggtgacactttcttgggaggagaggattttgataatgctttattggattttctagtgaacgaattcaaaagaactgagagtattgatctttcaaaggataagcttgcattgcaaaggcttcgggaagctgctgagaaagccaaaatagaactgtcttcaacatctcaaacagaaattaatcttcctttcatcactgctgatgcatctggtgcaaagcatctgaacatcacattgactagatctaagtttgaggctttggtaaaccacttgattgaaaggacaaaggcaccgtgtaagagctgtttgaaggatgctaacatatctatcaaggaagttgatgaggttcttcttgttggaggaatgactcgtgtgcctaaagtccaggaggtggtttcagcgatctttggaaagagtcctagcaaaggagtaaatcctgatgaggcagttgccatgggagcagctattcagggtggtatcctacgtggagatgttaaagagctactactcctagatgtcactccactttctctgggtattgagactttgggtggtatctttaccaggttgattaaccgcaacaccacaattcctacaaaaaagagtcaggttatggggccagtcttcgtgttttcaacagcagctgacaatcagactcaggttggtatcaaggtgctacaaggtgagagggaaatggctgtagacaacaaatcgcttggagaatttgagcttgttggcattcctcctgccccaagaggcatgcctcagattgaagtcacatttgacatagatgccaatgggattgttactgtctctgccaaagacaagtctactgggaaagaacaacaaatcaccatccgttcatctggaggactctcagaagatgagattgataagatggtcaaagaagcagagttgcacgctcagaaagaccaggaaagaaaggctctcattgacatcagaaacagtgcagatacaagcatctacagcattgagaagagtttaggtgagtacagagataagatccccagtgaagtggccaaagagattgaagatgcagtatcggatttgagaacagcaatggcaggagacaatgctgacgaaattaaggcaaagcttgatgctgcaaacaaagctgtctccaagattggagagcacatttcaggtggttctagtggcggttcctcagccggaggttctcagggtggtgaacaggctcccgaggccgagtatgaggaagtcaagaaatga

SEQ ID NO: 55785 - DNA, 510 bp, Glycine max
  Peptide Sequence Number=SeqID_172563
atggcggaagtgaagagtgaagagccagaaaaggcaaatacaaatgtgaaagaagaagaagaagaagaagaagaagaagaagaagagtctccaatagaggaagtgaggctaacagtgaagaacaccgatgacccgacccagccgcctctcgtcatcacgcagatcaccgtgcaggtggccaccctccccctcggccatctcatggcggtggtcctccccaccgccatgttcaggatccccgggttcgggaccaagcggttctccttcaacccgggtcccttcaacatgaaggaacacgtccttattactatattcgccaatgctggtagcgccttcgggtctggctcgccctacgctctggggattgttaacattgtcaaggccttgtatagaaggaagatatccttcatttcttcatggcttctcgtgttaggatacgggtgggcggggttgctgaggaagtacgtggtggagcctgctcatatgtggtggcccagtaccctcgtccag

SEQ ID NO: 55786 - DNA, 264 bp, Glycine max
  Peptide Sequence Number=SeqID_172564
atgagggggtggtgggaaggaggagtcgtcaagggagggaggggtgtcgtcactgtgggtgtgccatcgagggagatgctgtcacgggttgagagaagggaaaagagaggtgttagggctcgtggttttacctctccattcaagtatcctagtttaccctttaactccttcaggtgtagctccgctgctggctgcacttcagccaacaatggcagcagctttgaaattcatgatggagccctaggactcttgatactaacttga

SEQ ID NO: 55787 - DNA, 780 bp, Glycine max
  Peptide Sequence Number=SeqID_172565
atggatgttgttgatggtcaggagagtttggatgttgaggttgaattagaacaagagtctcaatctatctgtaataagagaaaaaaagacataaacattagattgttagaaatatttttcgaagatgggaccggaaacattaggcaatggctgaagtacctcaatcctgatgtaattccaattagtagaaatactactaaggttgatgtcttgaaaattcatatgagggagaaggaaaaacttaaggaactaatggttagaatcccaagtaggatttctttaacttatgatttgtggactacatgtaccaccaagggttacatttgtttgactgctcactttattgacacaaattggaggttaaatagcaaaattttgaacttttgtcacatgcctccccctcacataggacatgagttgtctaagaagatacttgacttactgattgattggggaacaaagaaaaagatttgttcatgggttgtgcaagagcatttaaaaagccaacttgttttgcaaaataatgggttgttatgtgatgaagacttctttcatgttaattgttctacccatgttcttaatcttattgttaaagagagacagaaagtgtgtagtaaagccttggaaaaaattagagacagtgtgatatatgtgaggggatcggagagtagaatgaaaaaatttaaggaatgcattgagagagttggtggtgttgatacttcagctagcttgtgtctagatgttcctacaaggtttgaactcaacttatttgatgcttga

SEQ ID NO: 55788 - DNA, 222 bp, Glycine max
  Peptide Sequence Number=SeqID_172566
atgaagcctgctccaacagctggtcgaatttctatgacgattcgaaacctcccgaagtacattgagattgaagtagctaatgacatccttagagcacagaccatggaacttgtcaatcggttaaggtttatgaactccattctcgagatcactaatgcggtcggtggtggtggtgaatccttcaagattttgcaaattccataccctttcttcatgccctag

SEQ ID NO: 55789 - DNA, 2640 bp, Glycine max
  Peptide Sequence Number=SeqID_172567
atgggaaaagcccccttagtaggcaacgctgtatcgataagcgtcacgcttctcaccaactcagccttctcaaaaataaaatcaatacccaacggagacttcgacggagttgtcggagaagccgtatccaaggagatcgagggaggtgccctagtagtggcgaagggtggaggaggtgaagacgaagaagagagtaaggagggagacgaagagggtgaggtagaactagaaggagatggggttgttgttgggtttgggattcatgttatcatggatgtaaagacaatgaggagaggtgttgtggagaacggtgatggaggagaggatatggttctggctaatttaattgcaaatggggatgatgttggtcctcttgtcaggcttgcctttgaaaggggacggcctgaggggctgcttcaccggctgatatatgtcgttaagcaaaaggaatctgaaattgaggagatgtgcaagacccactacgaggaattcatccttgcagttgatgagcttcgtggagtgttagttgatgctgaggagctgaagagtgagctccaaagtgacaattttaagttgcagcaggttggcagcgcccttcttgccaagcttgaagagcttcttgagtcttattctgttaggaagaatatgactgaagctatagaaatgttgaagaactgtatacaggtgttggagctttgtgtcaagtgtaacgatcacatttctgaaggtcagttttattctgcattgaaaactttggatttagttgaggaaagttgcacacagaatattcctgcaaaggctatcaaaatggtcatagagagtagaattcctgttataaaattgcacgttgagaagaaagtatgcagtgaagttaatgaatggatggttgagataaggagttctgctaaaaatattgggcaaacggcaattggccgtgctgtgacagttcgtcaaagggacaaggaaatgctagaacagcagaggaaggccgaggagcaaagtatttcaggactaggggatctagcttatactttggaagccgaagaacttgaagaagattcagttttacagtttgatcttacaccactttatcgtgcttgtcatattcatgattgtctgggtatccaagagaagtttcgcaaatattactatactaataggttgttacaattgaattcagacctggagataacttcagcacaaccttttgttgaatcataccagacattgtttgctcaaattgctggattctttatagtggaggatagagtccttagaactacagcgggcctcctggtagctgatcaggttgaaacaatgtgggagacagctgtagctaaaatgacatcactgttggaggaacaattctctagtatggaatctgcccctcatcttctcttggtgaaggattatgtcactctgtttggatctactcttagacaatatgggcatgaaataggcacacttcttgatattcttgatagcagctgtgacaaataccacctgcttcttttggaagaatgccggcaacaaactcttgatgtctttggcaatgaccagtatgaccagatggagataaaaaaggaaagtgactatgagaatatcattctgtcatttaatcttcaaacatcagatattatgcctgcatttccatacactgccccattctcctccatggtgcccgatgcgtgtcgcattgtgagatcctttatcaaaggctctgttgattacttgtcttatggcatacatgtgaatttctttggtgttgtgagaaagtatttggacatgttcctgattgatgtactaaatgtaacactgcttgagaaaatcaatagtgaccatgtcactgtacctcaactcatgcagattgctgcaaacatagctgttcttgaaagagcttgtgattttttccttcaacacacagctcaactatgtggcatcccagtccgatcagttggaaggcctcaagctactttaactgcaaaagtgatattgaaggcatccagggaagcagttttcattgccttacagagtttggtgaacacaaaagtagacgagtttatgactcttactgaaagcgttaattggactcctgaggagacaaatgagaatggaaatgactacatacacgaagtgatcatttaccttgattctatcttgtccccagtgcaacaaattttacccttggatgctgtgtacagagttgggagtggtgcttttgagcacatctcaaattccatagtgacagctttctctagtgatagtgttaaaaggtttaatgcaaatgcagttataaatattgattatgatcttcagttcatagagaattttgcagaggaaaggttctattctgctggtttgggagaaatagacaatgaggttagttttaagatctgcatggtagaagcacgacagttagtcaatcttttgctaagtagtcaacctgagaacttcctgaatcctgatatatgggagaaaaattattatgcacttgaaattaagaaggtggctgctatccttgataaattcaaggattctccagatgggatctttggaagcctggctaataaaaatgcaaagcaaagtgctagaaagaaatcaatggatgtgctcaaaaagcgacttaaggatttcagttga

SEQ ID NO: 55790 - DNA, 246 bp, Glycine max
  Peptide Sequence Number=SeqID_172568
atggaaagcaaaaggctagtgttctacaagtctgcttttgaaaatggggaaagggcgacaattggacaattgttgcgggtgacagatgttgacttggccggggtaaatttaaaaccgaacgtggtcaacaatgaatttgtgacacgagtgaggcaggcaaccagtcctcttcctaaactgttccatcaacaaacagaagtgttttgtgactgtgctaccacactcgggtcatctgatttccaataa

SEQ ID NO: 55791 - DNA, 411 bp, Glycine max
  Peptide Sequence Number=SeqID_172569
atggcctttgacttgactctacaaacagctgttggggtatttggaggtgagggttacactgataaaacagacgtgcttcctcttatggtggcaaatgcaggaaatagctaccgtgctgcaatttcaagtctaaattccccaccagttgttgctgttgaactttgtcgtgaacatttgttagatagtgatgaggatacctggtggaaggccaatattagagagacaaaggaagaactggcagctagagggctgaagttcctgaactgctttgctaattgtgaacttcgctccatggtcattgtggatagaagtatgataggatccgaactgtcaaccactaactatccaggcaagataccttcagggctggacctccctagtgatgttgcagatgagaagtccgagaaataa

SEQ ID NO: 55792 - DNA, 855 bp, Glycine max
  Peptide Sequence Number=SeqID_172570
atgggtcccacggaactgccacttgccccggatcgacccggttcggtttctggtgtcgctgataagggcgccaagaagtggaagaagaagggtgcttggaggggtgcctattttcccaaattcaatgtaaccgtcgcttaccaccgtgctgttttgctctctagataccagtggcagccaaaacaatctgaagctggggtgaaagatggatcagaaggcttttatcgagttgatgttgatgttcctgcagatgattgggctaaaattgctggtttctatgatgttttggtgtttaatacaggtcactggtggaatagggacaaattcccgaaagagaaacctcttgtcttttataaagcaggacaaccaatagttccgccacttgggatgttggatggacttaaagttgttcttactaacatggttgcatacattcaaaaagaatttcctggaaacacacttaaattctggcgattacaatccccaaggcacttttatggtggtgactggaatcaaaatgggagctgcttgttcaacaagccccttgaggaggatgagtgtttcatgccccatgtgcttttaagcattggcttaaggaatgatatactaatacctggacagcttgacttatggtttgaacccaggaacaacggagttaacaaggaagcgagagtgttgaattttgtgattgaagaagcattacaagctgcaaacattcaattgcttgacttgactcatttaagtgagttaagagccgatgctcatccggcaatttggttaggaaggaaggatgcagttgcaatttggggtcaggattgcatgcattggtgtctgcctggtgttcctgacacatgg

SEQ ID NO: 55793 - DNA, 384 bp, Glycine max
  Peptide Sequence Number=SeqID_172571
atggattgcgttgctggttcgagtttgtttccgttgcatcgttgcaaaaccattcacctggtgaggcacgcgcaggggatccacaatgtggagggtgacaagaactacaatgcctacatcaaccccgattatttcgatgctcatctcactcccttgggatggcaacaggttgacaatttgcgtaagcatgttcgtgactctggccttatcaacaccattgatctcgtcattgcatctcctatgatgaggtggatgtttggatttcagttcaaaatgcagtgcacgaattctgaagtaaatctaatggtccacaaactcagttttgcaaggaaggctttggatgcttttgcaaacttcatattgctccaaacgtctgtttgctga

SEQ ID NO: 55794 - DNA, 708 bp, Glycine max
  Peptide Sequence Number=SeqID_172572
atgagggatgctcctcgcatcaactatgaaagcagtgaggatgtcaaacttaggaaagtagcaaccttgaccaagcattatgagaacttcaccatgaaggaaggaaagatcatagatgagatgtttggaagattccaaaccttcttgaatggtctgcaaggtctaggacatgaattcaccaaagctcagaacaacatgaagattctagaaaattttcacaagaagtgggaacccaaaacaactaccatccaagaagcacaaaacatagcaactcttatgttggatgagatgttaggagcattgcgtgttcacaatgtgatgaagtgggcgttatgtataagtagaagaagtagctcagatgaagaacaagtcaacatttgtttgatggttgatacaaatgataaggctgaggtatacttcttaagccataaacacgagtctttcaaggtctttgaaaatatcaaagaggttcataaggcccccaaggctcttcactcaatattctccaagcctcttcaggctctaccaagtgtggaagcaaagctttccaagtttattttgatgatgccaaagactcaagtcaagaatcaaagtcaagcaaatatcaagaatcaaagagtcattcaatcaaagcaagtttcaagaatcaaagagtcgttcaatcaagaatcaagattcaagcaaagaatcaagagaagactcaattaa

SEQ ID NO: 55795 - DNA, 477 bp, Glycine max
  Peptide Sequence Number=SeqID_172573
ggaactttggttgatgattgcaagcatctttattcaaatcatgatgcccgcaaaatggtttacactgaaaatgcttatatggcttctaaagaggatttgattgggcccttcaaaccggtcatcaaattgattgggctcatcttgtctgttgatgaaccctttgttaaggttaaacactcttttgctattagagctactgttgttgcctcctttgcttatcagaaggatatggatggtcagtgggtgcagaaacaagaccttccacctactgttcctgatgaacgtacaccatcaccaccaccacaaagggattccttgtcttcactgttgcatgatggtctcactaaactttgggatcttcgagcctttgtggtgatcattttgatgctatggattcacggaaaggaatccctaggtggttcagaagttgtaaaagagttttacaaagatagtgtgaatctcaagtgggttgcttga

SEQ ID NO: 55796 - DNA, 1304 bp, Glycine max
  Peptide Sequence Number=SeqID_172574
atggtttcttccaaccgttttgctgctctacctctctgttctcttctcctagctctgcttctatgtgcagttggggctagctcttcttcttcttcttccacaaatgccaccaaaattggccaaggctaccgtcttgtctccattgaagagacccctgacggtggtcttatagggatccttcaagttaagcagaaaaccaaaacctatggccctgacattccccttcttaggttctatgtcaagcatgagacagataatcgtttgagggtacacataaccgatgcacaaaagcaaaggtgggaggttccctataaccttttgccaagggagcaaccaccacctttgagtcaaagcattgggaagtccaggaagaaccctattacagtctctcagtattctggttctgagtttctgttcagctacacctcagacccttttagctttgcagtgaaaaggaagtccaatggtgagaccctttttgactcctcctctggtgattctgacccttttagttcccttgtttttaaggaccagtaccttgagatttccaccaaattgcccaaagatgcctctttgtatggtttgggagagaacacacagccacatgggatcaagttgtaccctagtgacccttacactttgtacaccactgacatttcagccattaatctcaatgctgatctgtatggatcacaccctgtgtacatggatctcagaaatgcaggtggcaaggcttctgcacatgctgttctgttgctcaatagcaatggaatggatgtcttctacactggaacttctcttacatacaagattattgggggtgttttcgacttttatttcttttctgggcctagtcctctgaatgttgttgatcagtatactaccttaattggcagaccagctccaatgccttactgggcttttggattccaccagtgcagatggggatatcacaatctatcagtggtagaagatgttgtggagaattacaagaaggctcaaatcccacttgatgtgatctggaatgatgatgatcacatggatgggaaaaaagacttcacactcaaccctgtcaactaccctcgtccaaaacttctaaacttcctggacaagatacacaacattggcatgaaatatattgtcattattgaccctggaattgctgttaacaccagttatggtgtatatcaaaggggtgtagctaatgatgtttttatcaagtatgatggtgaacccttcttggctcaagtttggcctggggcagtgaactttcctgattttctcaatccaaagacggtttcatg

SEQ ID NO: 55797 - DNA, 284 bp, Glycine max
  Peptide Sequence Number=SeqID_172575
aatttgtgaatggaggaatgaggaatgagggacttactgtcggcggaggaagctttgagcaactcgagaggggagggtttggaagcgacgacgttttggggaagggaattgttgttatcggagaagaagggacacgtggcgttgacggaaaagcgcgcgcgtgggaagaagagttgagaaggcggtgggcggagggagtggcggaatcgggcggaggagaagagggaggaggaggtggtggcggcggcggaggatccaccgacggccgccatgggagttggtga

SEQ ID NO: 55798 - DNA, 1001 bp, Glycine max
  Peptide Sequence Number=SeqID_172576
accggcataagggtggacagtgtcgggggagacctcgagtctcaggaaggttctccagtacaagatatctgtggaattgccctggtcgataaggaccgtagacaccatgaagtttgcaatgatgatggagacaaccacggggtaatcttggttgatggggataacatgcagatgatgttttcaggactagctagactgccctccataggaaaagccgcctgtgatggtgttgattacacctctgatgtgttggacaagttcttgttcttctggaggttgtcgctcacgtcgttgctgttgttgtctttgtctgcctcgtatttggttgcgtctgaccccaacctaggaggtttcgtctggggtagccggatgggtacttctaggttgaaagcttcctccaaaattgtggtgcaattggtcgttaggatcgattttggtgcttcctttgcacttttcgcgtttatgtccgccttggagcatggaatgcaatgctacctcgggattaagattttggatctggatggttgtgcacccaaatatgtccatgaattttctaagggactcgtcgtttgcttgtcacagacttgccaaggcggccaaggtcatgcggtgagacctgctggtggcatactacgcactaaattgttcgacgagggtgtcgaagctgtctatgaacctgggtgggagtccaccgtcaagaaggcatctagatgctcgtttggatttgttgtcccattgtaccgctcgaggttgactggtttccacctgaaaggtatgtctgcctccatagtacggttggcaaaaggatgccgacgaaaggtccaccctgctggatggtgtatgtgggagagacttaagtcatttgcagtgttgcctatgtgttgggggtgtgattccccttggcgtgagcctctagctgctcatggtcagcctttagctttgtcaactcctcctcatggcgtcactccatcttcacgatgcggttttggagttgttgtaga

SEQ ID NO: 55799 - DNA, 339 bp, Glycine max
  Peptide Sequence Number=SeqID_172577
atggccaaaatacatcatctagcatggccaacaaaaacatatcatccaatgaaacatacccccccacacttattccaaaaaacaattccaaagctccaaaattccttaagggtaggaaaggggaacataggctcaaaggggctatcaaaggaattaattcaaggtaggctcatttggctagaggcttataagaacaaaatgcctaaatcatctcccaacatgcatgtgaagcaagaagtatcaacaagagtcaagccaaggctattgtgcaagcaatcaatggggcaaaacacaccgaataaaatagatgatgatggctcaaattctcaccaagggtaa

SEQ ID NO: 55800 - DNA, 189 bp, Glycine max
  Peptide Sequence Number=SeqID_172578
atgcttgtttcgagggttccgaagggagcaaacaagatagcaatgcgtgggcttgccgcggcacctgaactcaatgtatggcaaatcttcgtgtggagtcagctagaacatggatgcaagagtggcaagcgcatcagccatttggttttcctctcagggaacttggtggaaggagacatcatcgaataa

SEQ ID NO: 55801 - DNA, 195 bp, Glycine max
  Peptide Sequence Number=SeqID_172579
atggataagagcttgaaggtaggagaagatgagtggagggagaaggagagaaggagcacaaaattttatgcctcaaatgagctggtgtcttcagccaggctcagcgcaagactggcactaagcccaaacccacttactcgcgctaagcacgagggtggcgctaagcgcaacgtcacgatttcagagcctatttaa

SEQ ID NO: 55802 - DNA, 330 bp, Glycine max
  Peptide Sequence Number=SeqID_172580
atgcctccttctaaaatcaaaaaccctgacaaagttcctaatgaagtcatgtatcagatgaaggatatgcaagcccacatggatcaacaatatgccttagtgtccactaaactaccccttttcttaagcaattttagcttgccaccctgcaatcctcgtccaatcaacctcgggtgggtccaaacagctaaagtattgctacaaccattcaatggtaccaatcctgatgtagctccacgtggagcttgtagaccatggatcttgttcatcaatggagtcttttgctttatgaagatcaatggcagcggaatggagaaggaagaaagatga

SEQ ID NO: 55803 - DNA, 1002 bp, Glycine max
  Peptide Sequence Number=SeqID_172581
atggcacaacaacaggaacatgaaggaaagcctgagtcttctttggaaccagacatgggcaccaactccaccatgattccgtcaacttcatggtttacaccaaagaggttactggctatattttgtgtgattaacttgttaaactatttggaccgaggagcgatagcaagcaatggggtcaatggaagtcaacgaacttgtgaaggtggaacctgcaaatctggaacaggaatacagggggattttaacttgaacaattttgaggatggagttctatcatctgcttttatggttggacttcttgtggcttctccaatatttgcttctctagcaaagaggtgtaccatatcccacttagatgccacaaggtgtaagaggagggagtgggggcacaaagaaattaatttacagcaacttgtatactcttcacctcctgtttggcatgatgtatgtgaaggtcctttggcattgtgtgtaaacccatttagacttattggagtgggattatcagtttggacccttgcaaccttatgttgtggattctctttcaatttctggtccattgcagtctgtcgcatgctagttggtgttggtgaggcttcatttataagtcttgcagcacctttcattgatgacaatgccccagtttcacagaaaacggcgtggcttgcgatattttacatgtgtataccagcaggatatgcaattggctacatctatggtggtttggttggaaatcattttggttggcgttatggattttgggtggaagctatattgatgtctccatttgctattttgggatttgttatgaagcctttgcagttaaaaggttttgcccctactgattcagaaaaggcactgacactggggacagttgcatcagaagtttcagatgtgggggcttcaaatggaaaagatgaagcattgtccttgaaggcagagttcagagacaaaagctcacatgaaccttccaggcaagaacagtacccctattcttga

SEQ ID NO: 55804 - DNA, 459 bp, Glycine max
  Peptide Sequence Number=SeqID_172582
atggcttcctcggagatcgaggtggtttcatcatcatcggtctccaaacccaacaacgaccagcctccaatcctcgacatcttcaccgcctctgctcacggcgacttcaacaaattgagaaccttcgtcgaacaagacggcgcctccgtctctcttcccgattctaacggctattacgctcttcaatgggcctcgcttaacaacttccacgacattgcgcactatctcattcagcatggggcggatgtcaatgctaaagacaacatgcaacaaacggcattgcactgggcggcggttcgtggttcaactctagctgctgatgtgctcgtggagaacggtgctcgggttgaagctgcagacgtaaatggataccgggtagtgcactctactcatgttagtcaacaattgtgtaaatggataagttgcatcatttcaggaggatttgcttattttctgtaa

SEQ ID NO: 55805 - DNA, 726 bp, Glycine max
  Peptide Sequence Number=SeqID_172583
atgacttcctcagtcatgatcaatacccagacagtgaactttataatttcttggtatatgattcagaaacaacaaaacacacaagcaataaggaagaaaaagtatgaggtttgcattctggttttgggtgctccacgtgaagacagaagtgcaatagtgaaagatgggttggaaggtgattttagggtgtttatctgtaaaaagggtagagtcacttctcttcttcacgctcacggctcatcttcactctcgtctcatctgggagcaaatcgtcgtcctccacatgggctcggcggaggaccagtccgacgcggccgcgcagctggtctccctcgccaacagcagcgaccgttacgggaagctgataatcgaagaaggcagggtgggcccacttctgaagcttctgaacgaagggaaagccgaagaagggcaggaacacgcagcacgtgccatcggggttctcgggcgtggccgcagataacggtgacgttcgttaacggcgttgaggaagtgttcgacgcgacggcgacggcggctcagagcatacgaaacttgattctggaaaactcaagacggctcagagctctcacaaatggcaccccctaccaaatgaaaacagaaaacggtgatgaaaatgtgtttggttggatttctgaaaacattttcagtgaaaatgaaaacggagaacaaccagaaaatgaaaacaataaattctcatcttcttga

SEQ ID NO: 55806 - DNA, 321 bp, Glycine max
  Peptide Sequence Number=SeqID_172584
ggggggtctgtttctaattcgatgccgccagatgcattagcgagtccggggatgccgccagtaggagaagcgattccccagtcccgccaagagcaggagcgagatgctccacgtagcagcagtcccgctaggagcaggagcgagatgctccacggttcagaggcacatgcattgggagactatatgttcacatacagtttaatgtttaatggcgtttgcaatgatactcaacgtaggaagttgtgcatgctctccttgttcatgatgagactaaacataaggtctgaaataaggttcaaagctagctgtagatgttcacag

SEQ ID NO: 55807 - DNA, 150 bp, Glycine max
  Peptide Sequence Number=SeqID_172585
atgggttggcggtcgcttactcgaaccctctccttaaggatactaggcttcctcccagctgcgcttcccgcttttccagagttgggcatgggacgacgatccatcgatcataggcctagcctctactcgcgttcgtccctaagtacctga

SEQ ID NO: 55808 - DNA, 300 bp, Glycine max
  Peptide Sequence Number=SeqID_172586
atggatcacgtggctgcaattttttttacatcaatcaacccaatacaattgactgaattgatagggagccttaaagagaagtggaagagagaagcgatcgaggagaacaaacatagagaggaaagacttctagagaacatggtgtgctcatttaaggttggtcttgaagaagttcaagatgccaatgctgacatccttcttcccacttcaaaggttcagttagtgagacaggttgtcggtttcttcattgcaaggctgagacatcttatgaaccctgttttacatgaggtatttacttaa

SEQ ID NO: 55809 - DNA, 174 bp, Glycine max
  Peptide Sequence Number=SeqID_172587
atggttgaacctattcataggtcgaatcccattgatgatctcttagttgatttggttaaggttttatatgacctttacctgaagcctgttcaggtggaatggtatggaattgcatttggggttcacaatgatgatttcctttttttcatagagttcaatgatgtttatgaatga

SEQ ID NO: 55810 - DNA, 1449 bp, Glycine max
  Peptide Sequence Number=SeqID_172588
atgggttctttgggcacaatcaacaagccacatgctgtgtgcataccgtacccagcacaaggccacataaacccaatgctaaaactagcaaaactccttcacttcaaaggctttcacataacctttgtaaacactgagtataaccacaaacgccttctcaaagcaagaggccctgattcccttaatggcctctcttcatttcgctttgagaccattcctgatggtctacctgagactgatctggatgccacacaggatattccttccctgtgtgaggccactagaagaacttgctctcctcacttcaaaaaccttcttgctaaaatcaatgattcagatgctcctccagtgagttgcatagtttctgatggtgtcatgaccttcactcttgatgctgctgaagaattgggtgtccccgaggtgctgttttggaccactagtgcatgtggatttatgtgttacgtgcaataccaacaactcattgaaaaggacctaacacctctcaaagactctagttatatcacaaatggttatttggagactaccatcgattggataccaggcattaaggaaattcgattgaaggatattcccagtttcgttaggaccacaaatccagatgagttcatgcttgatttcatacagtgggagtgtgggagggctcgaagagcttctgcaataattttgaacacgtttgatgccttagagcacgatgttttggaagcgttctcgtccattttgcctccagtttattccataggtcctttgaatttacacgtgaagcatgttgatgacaaagagttgaatgctattgggtctaatctttggaaggaggagtccaagtgcgtggagtggctcgacactaaacaacccagtagtgttgtttacgtgaattttgggagcatcgcggttatgacaagtgagcaattgattgagtttgcatggggacttgctaatagcaacaaaaactttttgtgggtcataagggcagatcttgtggcgggtgaaaatgctgttttacctccagagtttgtgaaacaaaccgaaaatagaggcctattgtctagttggtgctcccaggagcaagtgttggctcacccttcagttgggggatttttgacacacagtggttggaattcaacgttggaaagtatgtgtggaggtgttccaatgatttgttggcctttctttgcagagcaacagaccaattgtcggttttgttgcaaggattgggggattgggttggagattgaagatgttgagagggaaaaaatagagagccttgtgagggagttgatggatggggaaaagggtaaagagatgaagaaaaaagctttgcaatggaaggaattggcagaaagtgctgcttttcgctctgttggatcttcatttgctaatttggacaacatggttcgtgatgttcttttgggcaaaagtcttaaatattag

SEQ ID NO: 55811 - DNA, 237 bp, Glycine max
  Peptide Sequence Number=SeqID_172589
atgaacaaattaaagacgagttcgtttggtgatactaagccagttacacctaagtggattgaagttaagagtcacgttcaaaccgaatgttatgaatgtggatattacgtgatgcattggatgtggaacatcataagcggggagatgaagagtgattggtcccagtggtttggtgatgacacgccattgggcatagacaccatcacaacaattcagaagaaatggactagtttttaa

SEQ ID NO: 55812 - DNA, 435 bp, Glycine max
  Peptide Sequence Number=SeqID_172590
atgggcttggaaaacagcggcccagttacaaagggtgagaagcttaattctgttttcaaagtctatgttaggagaatggtccaattaaatctaggcccaaatttacgtgagaatagggctgaggtcgagccacgaaagttggactttaaggataactacatagatcatatgcctgggggtgatcttcatggttcagccacaggcactttgactcttaaacaggattggcctccttatactcctatccttccaagcagcttcaacaaagaatatatcggtgatgaggatgatgtccatagggagttagctagagacctgggtgtgtcttttgcagagaacaacatcagcatggttaacatgatgaatgaagtggataatagaaacattatattcgcaccagcagcagtgatgggaatggatcaaaatgactcatga

SEQ ID NO: 55813 - DNA, 1027 bp, Glycine max
  Peptide Sequence Number=SeqID_172591
gaccagagggagaggtagacatagagaagaggtgagaaagagagtggatcccagacagagctacgtcaaaactaggcttggacaacatcatgggtacgaccatgcaaattggagggagagagatgatatcacaactttctatttcacgaggttccccgaagatacaacggagaaggatctttgggctcaattcaaaaaatggggggatgtgagggagatcttcatctccaaacataggaacaaaggtggcaggaggtacggcttcgtgaggttcaaaggggtgtctgacaagcgcagattagaaagacagctagacaacatcattgttggaggactcaagttgtacgtgaatgttccaaaatatgggagaggaaaggagaggtatgaagagtccagagtcaaacccaggacacagcttgagatcccggcaggggagaagaaatggtacactaatgtatgggtgggctgcgtgaagaaatcgggaatatccgaaagagtcgaggacgaacccccttgggaggtgggaacaaacgtggtgccgaaatacctaggggatgatatgatactcctcctaggtctctcggataccaaagcggaaaagctcatcatcgaagaaaccagacatggctcatccccgtttcattcgttggagaaatggaatccaacgatgagatcgggacacagattgctctgggctcagtgttggggcatcccatcagaagcgtgggatattgggcaaattcataaaattgtcgcagcaataggggacttggtagaggtggatgacaacgttgaagagttgcgaatgctagatagggccagggttcttatcagaatcccatggagacctattttccaacatatggtcgaagttcacatcagcggggaggtccacaaagtgcacatcattgaagaaaactggagcgaagccggaagaaagcgcatttaccattgtcggagcgccatcggtcgtcggaagagatcgattctgacgacaacgataacggcaccccgaagtcgaagatga

SEQ ID NO: 55814 - DNA, 522 bp, Glycine max
  Peptide Sequence Number=SeqID_172592
atggttgagaataacaattaccatgtttgtatattatgcagtggaaacttgtcctttggtcttcgtaatacttcttcagctgttatccaggtggaaagtgcagaatcttattcagtttcaataaaaaatgtgggaatcaatgtttcagttgaggaccgtaagaaaattatttttgagcaatctaatgcattagcagaaagtgtaaatggccaaattcttattccaaaaggtttgcttgacgaggttgtaaatcttgttgaggcaccttttcccgtgcttggaaagtttaaggaaaccttcttagatcttccaaaagatcttttgactatggttatgcaaaagcatcaaaagtattttgctgtatgtgatgctaatggacaattattgccttattttgttgctgttgcaaatggagcaattgatgagactacagtgaggaaaggaaatgaagctgtgctcagttgttggttatacttgatggcttctggtaaggacaaactctccttgatgtttaagctataa

SEQ ID NO: 55815 - DNA, 645 bp, Glycine max
  Peptide Sequence Number=SeqID_172593
atgtctcaactaccctgggaaggggtatgtgcaacacggtgcgacagccattgtgacaagttgagggaagggaaggagcaaaaaactggagggatgcaccaaacatcctctcgcatatctcaacatcattatcttatccagcagctaggggttgcatcagtaggaatatgggaatggcagctagagtggaaaaggttatttagggaagcggagatagatatagttgcaaaatttatggaggacatcgagggtatgatagtgcaacctaatcagcacgataggtggggttggagggtggatccaagcggggtatacataatgggaaccgcatacaaagtgctaactaggcaattattaggggaaaataatgacgaagtattaaaggaattatggaagctcaaaattccaagtgtcacattttgtttggagactgattcaggagaggctaccaacaaaggattcaacggtcaaaagatgatggatgacgccattttcttctgctggatatggctcaaaaatatggaaaaaggatttgatattccttttcattcatggtctagcaatataaaggttactttttgtgtagggatgtttacactaatccagaccgatggaggcttaattcttgcaataagcttgtattag

SEQ ID NO: 55816 - DNA, 240 bp, Glycine max
  Peptide Sequence Number=SeqID_172594
atggagattacacaattcacctactttcagcaggctggaagtctccagttatcacctgtatctgtagaaattacttatggccttgagcgtatcctcatgttactgcagggggttgatcacttcaagaagatcaaatattctgatggaattacatatggagagttgttcttggagaatgagtacttgattactctgactactggttttgaattgcacttcattttatttttttggttgtga

SEQ ID NO: 55817 - DNA, 540 bp, Glycine max
  Peptide Sequence Number=SeqID_172595
atgggaatcctcgccttgcccttagtgatctccgttctcaaaccccacaccgccacgcgcctcctcccctcacactccctcctccaccgccaccgccacttcgccaccaccctctccgccgccaccactccctcttctcctcattctccttcaccttcactctcacgccactcttcttcttattcttcttcttcaagccactccaacactcgttccattaattcctcaactctcacttttcagcaagcaattcaacgccttcaggaatattgggcttccgttggatgctccataatgcaatgcagcaacacagaggttggagctgggactatgaatcctcttacatatttaagggttcttggccctgaaccatggaatgtcgcgtatgtggaacctagcatccgccctgatgatagtcgatatggagaaaacccaaataggctccaaagacacactcaatttcaggtgatattgaagcctgatcctggaaattcgcaggatctatttattcgcagcctctctgctttaggtactaactga

SEQ ID NO: 55818 - DNA, 312 bp, Glycine max
  Peptide Sequence Number=SeqID_172596
atgtcaccaaacaatttcactggacacattcctacaactttttttgggcctagtgataaaggtcccctatcgtcttatttacaattggtggctacaactcttgttgggcacgagaaaggatctattaggcctaacaaagagggtgggttggttttacctctttctctagatccaattgctatgattaatatgaagggtatggacaatcaatctatagaaggtattggctttatggaactaaccaagatttctcttatgggtgaagaaattgattctaccaaggaaggctcaattggagtcttgagaagatga

SEQ ID NO: 55819 - DNA, 255 bp, Glycine max
  Peptide Sequence Number=SeqID_172597
atgaaggaaagaggagacaattataagatttggaaggaaagagttattcttcgtttggattggatgaatattaacaatgttataaagaaggaagagtcacagctcactgagacaagaggtgtgtgtgatcacattatgcgcataaaggatatagtggctcaacttaagggcttgaagggtatgaaaaacttaaggaggccagtgggaagtgagcaatgtatctattcaggaagcatgatgagttcacacgtgtag

SEQ ID NO: 55820 - DNA, 381 bp, Glycine max
  Peptide Sequence Number=SeqID_172598
gaaattcgagacaaccaagatgacagagacagcaaagcagaagtaggccaaagcaactcaaaaagacgaagtcgaactgctgccatccacaaccagtctgagcggaaaagaagagatatgattaatcagaagatgaaagccttgcaggggttggtgcctaatgcaaataagacagataaagcttcaatgttagatgaggtgataaactacttaaagcagttgcaagcacagatccaaatgatgaacaggacaagcttgccccaaatgatggtgcctttggccatgcaacagcagtttcagatgtcaatgctagccagaatgggtgctgctgggcttggcatgggaatgggcatggtgaacatgaacatggggagatgctag

SEQ ID NO: 55821 - DNA, 2430 bp, Glycine max
  Peptide Sequence Number=SeqID_172599
atggctgtcccaaagttaccagcttacaatttggaactgactgatcgtgttttggggagacaaaaggaaaaggatcaagttgtgaaatttttactagacttgtctgataacacaaacacaaatggaaacatgtctatacttggcatcgtgggcccaggtgggattgggaagacaacacttgctcatgttgtttacgaagatcacaaagtgaggacgtcatttcaactcagaatttggataacatttcctagttaccaacttgaagctaggactttagcaaagatcatgcttagaattctacaagttagttctggccaagatgatgagttgctagatccgatgcctcacttgcaagagagcttgaatggaaagaatttgcttcttgtgttggatggttgttggtccattcatgagtgggagaaacttcaaacttgctttgaatctgctgcaagaggaagtgccatcatcttaaccacaaggacaaccaagactgcattacaaatgcttgcagatctgcatctgagtttcttatccatggagtattgttggtccttgttttctaatcattgttttggaaaccagaggcatagttgttctcctgagctggaagtgatggggaaaaggattttgagaaaatctgggggtatgcctttagctgttaaaatgcttgggggtctcctgtatgagaaagactacgaggtatttgaaaagatgcataacctaccttgctatatggacggccaaaggtctaattcagcaggtaacatggattttaccagggaaaagctaggtagcgagtattttgattttcttgtagcaagatcatttctcataagatcaaatagtggtggtaacatggattttaccatgcatgacatggtccgtgatttagccttgtttgtatccgcaaaaagtcatcctatctttgacagaaatgatgagagcattgatacttctttcttgatctcaaatctacaaaatgttgaagaaagttcatctgagctttatggccctcaaatggaagaatatatccccttgaaggataagattgacattgccaacataactcatggccttgaccaagaatctccagaaattgaagttaattatttatcttctactgcaaatgatgctgtccaaactacatttgagtattggactcatttcgatacactcagaattttggatgcatcacaactagtggaattaccatccgaactgtacagcctcagaattgaagggtgtcactctttcaagtccctgcaagatgtcttgatagacagaagcaccaacctctttgaattgtttataattgattgttcttttctcgagtacttaactgatgcatcatgccccacttcctcaaaatgtccagaacttgattcattacaggggctaccttcttgtctgaagttgctttccattgccttcggtggcaaacttatacccaaaaaggactggaatctacaagcgcttcactgtcttcttcattttgttgagattgaaagagacttgattctcgagactacggtattgtctaatcctgatgcaagtcttgggttgaaagaacttttccaaaatcatgatatgagtgataaagtcctaagagcacatttttctgaagcgttagcaattgtccaagccactacttgttcagatactgctcagatgatacctttagcagggggaatgatccaaaaatcatcatgttgggttactgtaccaatggatgaagttttgttgaaagttgtgaaaaaatatagtgataagattttgctaaaggagtcagacagaaagcccaaaagctcaaaaaagaaagggaagaagcattcactatttaatgggattagcctagaaaaacattttgagaagtctgatgagtggcgaggtaccccgccttgggatcctttggtggggggaaatgcatatccaaagttcctttgtgatgtcatggttgaaggcttggccaaacatttacggtgtgttgggatagatgctgcaattccttattcaaagaagcctgaaccaaggatgttgatagaacaagcacaaaaagagaaacgtgtgattttgacgcgggatgcaaagttgcttagacatgattatctgacaaaaaaccaaatatatagagtgaagactcttctaaaaaatgaacagctactcgaggttattgaagcttttcagataaaaattaatgaggatcagctaatgtcaaggtgcacaaaatgcaatggaacatttattcagaagccactgacaactgaagaggctattgaagctgcaaagggctttcaaagaattccaaattgcttatttaacaagaatttagagttttggcagtgcatggactgtcaccaactttattgggagggaacccaataccataatgcagttcagaagttcgttgacatttgcaagctgagtgactaa

SEQ ID NO: 55822 - DNA, 651 bp, Glycine max
  Peptide Sequence Number=SeqID_172600
atggatggcggtgatcctaccaaactactcaaagtccatctagtcacctgcaccgactcggccgagttcgcgctcctgagctcggcgctgactcggacctcggtggtgggcctggacgcggagtggaagcccgtccgaagattgttcccgagggtggcggtgctccaaatcgcgtgcggcgactcggcggtgttcttgctcgacttgctgtcccttcccctctcttccctgtgggcccccttgcgcgaattgctgctctcccctgacatcctcaaactcggattcggattcaagcaggatttggtctacttgtcatccactttcgcctcccatggcggtttcgataaggttgagccatatttggatatcaagagtgtctacaatcatctacagcataataagaaacatgtacccaagcaaagtaagagtttgtcaaccatatgtgcagaagtattggggttttcactctccaaggaactccaatgtagcgattggtcacatcgtcctcttacagaagagcagataacatatgcagctatggacgctcattgcttgctagacatatttgaggtcttccaagcaaaggttgtcaaagaagcaattcagacggtgttccaaacgtgctctaagtggttcaaatttgaaaagtag

SEQ ID NO: 55823 - DNA, 216 bp, Glycine max
  Peptide Sequence Number=SeqID_172601
atggagtttcattggtcattgtctagggtgaacaatgataggccgaaaattttggagcctttggcagtggtccagtatgtccattcctcacatggcaaagggccaaggggaactcaagttatggagattttcaggagggatgtgtggaatgtctgtgaattcctggcatcatctgcacttcttggtgaagtcgagggcatcgaccctgagccttag

SEQ ID NO: 55824 - DNA, 405 bp, Glycine max
  Peptide Sequence Number=SeqID_172602
atggagttagaaaatcaagagattcgcgatgatggtggaggtagaaggaggaggagaagagataatgatggtggtgatgctagagaagaaaaaattgaaggagtgaagctaaacgtaccccctttccaagggaaaaagactttcacaacaagcttcaaagtttcaaaagggaacaggagtgtagatgagtgttacaaagatatggaggtgcccttgattagatctagtctcaatgaacaccgggaggctattatggcacgttttttgcatgggctgaatagtgacataagagatgttgtggaattgcataattataaggaattggaggacttaatgcatcacgttgttaagttagagcaacaacttaagagaaaaagtgtcatgagaagacaaggacacaaatag

SEQ ID NO: 55825 - DNA, 408 bp, Glycine max
  Peptide Sequence Number=SeqID_172603
atgcatgggcttgctgggcttcaacctactaaccctactcaggaaaagcccatattgaatagtgcccacgacacattggagtctattgttcaacatgccacgtgcccacgttatcaaccgtcaaaattcactagggaaaaaggccatgcccctactagtaatagaaagaacaactccattggtgcacccgatggtggtgaggttcaaggtgtgccatcgtcggcaaggaaaagaacatggtccaatgctaacaacatgttggaagaatgtgatatcctcagtggttgtgctagtgctggtgccaccttttgtagggacaatgatacagccatgataacatgggcttctcttgaatctggtcggaacttgaagaccatagaggaagattcagcttgtcactgtggatcg

SEQ ID NO: 55826 - DNA, 444 bp, Glycine max
  Peptide Sequence Number=SeqID_172604
atgaacagaagactagcatccctatctaggttcctccccaagctcaccaagaaagcgaagccattctacaagttgctcaagaaaattgagtcattcctattgaacaagggcagagaaaaagccttcttggccttcaagaagaccattgccacaccaccagtcctgagtcgacccagagaaggtggtgctagcacccattactccggcttgacgtctcaggctgtgctttcagagtcaccaactagttgtcaaaacgaacaaccccatcaaataggaaagcaaggcaacatccttgaaggccctgacaatgtcattcttaagcaagccctcaagctcaacttcaaacccttaaacaatcaggctgagtatgaggcacttattgtaggtctaaaactagcaagagaggtcggggccaagaagctacgatgctacacttactcgtag

SEQ ID NO: 55827 - DNA, 1851 bp, Glycine max
  Peptide Sequence Number=SeqID_172605
atgggttacttgaggactggacgtaagcacgggaagtggccaaatcagtataaatcgagccacttgtccaacaagagcctgactgctaagggcataacgtttgtgctcctgtgccaaggccgacatggagagctgacatatgtaatggagtgccacggtgaagagtttgttgagcccccaagcatgaacgagtgttatccggtgtcgagaggggtaacctcaacaagtgttgttcgggctgcttctgccaagttggccagggtggacatgcttttggttttgcaagtgaggcgagtgaagcataggtgcagtactcttgcttatgtgtcactcatggagtggacacgtactggagacgcggatcgtgggtatcctcttttgatcatgtctttcttcctttttgagtccaccataggcatggatggtattgactccgggggttcgattcagcaacccctagtggatctagaggagaggttaagggttttgcgtcgtgctggtggaggcagttctcgtcttcatgggaggcaaggaagagtggtagtggagacgttagggtatccccttgtgtgcagcatagctatagtgatgggtcgccaccgtccccctgccgttgctggctatgagtggatgatgttaacgagcaagatcaattgggtctccttgaacaacgtatccaagaagctattcaattttgactcgaacgtgtttcgtcgctccaaggaccatttcttcaaggtcctggctattgacatcgtgtctgatcccaccaagttcaagtcttttaatgtggatcttttgacccttgtggagagggtcgaaaaagctatattggagcaactgccggtcttgttggatgcgtgggcaattttgtctcttcctttaacggatgatcctttccctaccttggatgataaaactagatctgctggtgggactgtgccactatctactatcattcctcttactagagaaaggggtcaacttgtcgttgaggtcggccctactacaggtgttgctcaggtctccctcggcgttccttcctctattttggctaagaggaagcaagatgacaacacttggggcccacctttggctccgtcggctatccaggcttctgttgttgttcttgctcctccacttcctcttgctgctcctattcaggagttcactcctactgcttcaactagtcctatcgtggctccttcgtccatcatcattgcaccctacagagtgcctcatcaccttccaccttatttcaccccagcgtttctttggatcacatctacacttcctatgatgttgattcgttgtggggcgctaagcaaggtggcgtccttggaggatgaggttgccaaatggagggctaatgcttgcatagcctggagaatggagtgtcctaaggtagttaatgccactatcgcctttgctgaagctataaagtcaaaccatcaactgtcttccaaggttggcagtgttcttgccaagttgtgcaccaggaatgagttgattgaaaatgtggagagcattatgactgagaaggatgagcttgctaagctggtggcaaacctcgaggtccagttgaaggagtcaaagtccaggctggaggagtttgagctacatgtgtccaaggagaaggaggccagcaagaagcttgaaaaggagttgttgatgtacaagagggaggtcgtggaacaacatgaaaagggctttcataacaccattaggcaggttgggttcattgccaaggaccgtgacttgagtcatttttaccttttcaaggacgtgaaggacagtgttatgcttgacgaggaagatattgttgttgagggagaggttggcgaggagtag

SEQ ID NO: 55828 - DNA, 198 bp, Glycine max
  Peptide Sequence Number=SeqID_172606
atggccaccagtgatcaccacaagccatcgttgcttgctgccggaccaccacacatagaggaatgttttaattggaggagaatcttcataattcatctcaaggattttgtagagaatgaagcccccaaccgtttgtgtcctggtttctttgaggatacaatgaccaagttggatgtccctggtggggaaatagagtga

SEQ ID NO: 55829 - DNA, 153 bp, Glycine max
  Peptide Sequence Number=SeqID_172607
atggatgttaaaaatgccttcttgaatggtgatctttcagaagaagtgtatatggttcctcccctaggtgtctctcataatctagataaagggcctgaaatggaagaagtatcttggaagcaagtttggagtactaaagctctaaaaggataa

SEQ ID NO: 55830 - DNA, 693 bp, Glycine max
  Peptide Sequence Number=SeqID_172608
atgtccacaaaagagaagataagtttttgtcaaggtttatggagtctaaaagtcccacaaggatactcttcaaatatcaagagccttgtatccgtcaatgatttgaaattggttggcttgaagtctcatgattgtcatgtgctaatgcaacaactattgcctatagcgattcacggtatcttgcctgacaaagttagggtcgcaaagtcattgaccctcgacaattggatgatttggagtatgaggctgccattgtcctttgtcaattggagatttgagcggtacttgaaggtcttaaagggttatagcaaggatcaataccaactagaagcttccattgttgaaaagtacgttgttgaagaatctattcagttttgctcccagtacattgacacagttaaatttgtctggattcctgaaactcgttatgactggacatggggagctattgggccaaatctcaatgtctctacatggagaggatgtgatatcaacaattattccttctacaccaagtcacaggatgataaaagtagcgtgcagaacagtgggatgagtgttgatgctgattcaaatcactttagtagtgtatcagaaaacaatctgattcgagcgtccatgccttactttggagttattgaagaaatctgggagcttgattatagtgaatttagagtgtctgtctttaagtga

SEQ ID NO: 55831 - DNA, 519 bp, Glycine max
  Peptide Sequence Number=SeqID_172609
atgcaaatacaagtgaacatgcataagagtgcaaagggagaagaaagagagagtgcaaaaagagatgaagaagttcagctctattcaatgaacatcatagagactttgccaattaagaaacgaaaacactcagcggaatgtgactttgtgaacaaattaggaatctgcgtgggggaaaagacaaaaggggttggtgcaaaaagagaaacacccatagagtcaagtaaccatctcaaccaaacaatctctataatagtgggtgacatggctctatactcaactttagttgaagatctagacataactgtttgcttctttctcttccaagaaataagagattcccccaaaaagatgcaaaatcttgtggggggtctccttggtttgagtgtcagaaagatgagcttgatcaaggatgttggtaatgtatttggattgatagagaagatagcctctaagagaatatgcaacttcaatgcccaaaaagtacaaagagtgcccaaatctttaatctcaaattga

SEQ ID NO: 55832 - DNA, 558 bp, Glycine max
  Peptide Sequence Number=SeqID_172610
atggaaattttgcattttgatatcaagccccacaacatcttactagatgaaaattttatcccaaaaatctctgactttggattggcaaagctatatccaatagataatagcattgtcacaatgactggagtaagagggacaattgggtacatggctccagaattattttataaaaatattggaggaatatcctataaggctgatgtttatagttttggaatgcttttgatggagatggcaagtaaaaggaaaaacctaaatccttatgcagagcgttcaagccaactatactatcctttttggatttataatcatcttgtagaagagaaagatatagaaacgaaagatgtcacagaggaggaaaataaaatagcaaagaagatgatcatagttgcactatggtgcatacaattgaaaccaaatgatcgtccatcgatgaacaaggtagtggaaatgcttgaaggagacattgagaacctagaaatacccccaaagcctactctatatccacatgaaacgacgataagggatcaaagaacaccaaacaatatcgaatga

SEQ ID NO: 55833 - DNA, 405 bp, Glycine max
  Peptide Sequence Number=SeqID_172611
atgaacgaaatcagtggagtcctgatccaaggagaaagtgtagaagcaagcttcatgatgatgaatcaaattcaaaggactaaccgcctgagaattctttgtcttaacacattggagggtacatcctttgtggtacaagtagagggtacatctacttgggttgtagaaattgagaacaagagagggtacatctcttgtggatcagttcaagtggagggtacatccacttggttgttcaaagagaacaagggagggtacatcccttgtggatctttgcttgtaaaggtttttacaaggttgaaagaaatctcaagaaccggtggttgcttggggactggatgtaggcacggtaaaaagctgattgaatctagtaacattaagaaggataagttttacttagtcaag

SEQ ID NO: 55834 - DNA, 669 bp, Glycine max
  misc_feature (131)..(131): n is a, c, g, or t
  Peptide Sequence Number=SeqID_172612
atgaacgcacaacaacgagaatcaagaacaagaacaaatctcggagaagtcgaggaggtagatgaatgctacttgaggtgtgaaggggtattttcgttgaaggaggcgccgtcgtcagaagtcattgcagntggaggaagggaagggtgtgagaaagagaaagaggaaaaaaagggaaagagaaaaaaagaagctaatacatgtcttgcttttagtgcacaaacatatgcatctgaggagcacagacccagagaagctgctgtttcacaagaaaaatttcaggattatgatatgagtaaaagaaagaggaaatactggtggaagcgctacgtgaacatcaggaaaactgaggttagagcacacaaaggcctagtctggaccatgaaatttagtccatgtggtcagtatttagcgagtggaggtgaagatggtgttgttcgcatatgtgattttcatgatcaggacagaagcaaggtaacatatttgcacgaatcttttggagaacgagccaaagccaatctccaattgcaattgcaaaagacacaaaactcgaactctgaattacttttggctaccttgaagccactgcctcaaaacttgacgttgcctggctacaatacaatatcacacgggacattatttggtttttctaaattggctgggatatga

SEQ ID NO: 55835 - DNA, 303 bp, Glycine max
  Peptide Sequence Number=SeqID_172613
atgtgtcgtggtgattgtcgtatcattccactggcgccatcaacctccaaggctcgaaccaccgtccttccactcaactgcgtagttgcactcgttggctcaagctaccaccgcagcacgtctcaaccgccgccagttaacaaggcattctgtgacatagaacctatctacacatttgaaggcacgtatgacataaacaccttggttacaggcagggaaattactggtattttatgtgctttaagccggttgctaaaaaaagtagattgtgaaagtgtaaaaatgtgttcctttatggattga

SEQ ID NO: 55836 - DNA, 897 bp, Glycine max
  Peptide Sequence Number=SeqID_172614
atggatcgtctctgttactccttcaggtcaaaagtggtttatgattcaggctcaagcgtactacaaaattgttgcaacagtggttccctggtgaattttcaagctttgagatcatatgcacgtgatgcacgcaaaggctataatctctttggccggggaagaccaggggatgaagagttcaagaaaacctgggcaaacgaaatggatgaagataacactctatggactggaagtgaggatgataacgatgaagacatgggtccaaagacggatcttgataaggagataaggaaagcaagactggaggctaaaaagcatgcagacttgattgatgctgatgacagcgatgagttaagaagtgtctggtctggcagtgacgaggagaagacactgtggactggtgatgaaatggatagtgatgatgatattcctacagaagcttacccaagtgaaagtagtgacaagtacatagataaattgtttgagtttgatgaaatgccgaaatacagaaccatctctgagatgttgaaagctgaacaagaacccgaggagttgactccaggaaagcaagctaggaagatagctgttgagaatgctttgaagaaattaaagaagggtccagatgggaggtatagcaatgtgtgggaggttatgagtgacttagatattctaattggggcatttgaaaatgttgtttcaggaccagaatatgcagaacttagacaaggagggcctaaacatctaaatattcagttttttaaggacatacaagcacgtatgagagatccaaattacaagttctcacctgagttaaaattgaaaccaaagagtaaactggtttctagaaagaaatggcaaaaagcagagtccagaagaaggaaagcacgaaagagataa

SEQ ID NO: 55837 - DNA, 762 bp, Glycine max
  Peptide Sequence Number=SeqID_172615
atggcagacgatgaactttcctcaaagtgcttggaccacctcgaggccgccatttccattctcgctataacccaagcctccatggctgccaaactagatctccttcacctgaaaatggataccctattaaccaaccaccacttctcatcttcttcctccgtgcggtcaccaccgccgtctccgctttccataccgactctgtcttcatgctccgcacccatgcaaccaagtcccgcaccgttaccggctccacttttcatgtcgcatgtgcctccatgccctgttccaatgcaacaaagcccagcacccatgcctgctcctcaccttgccgccaacagcaagcaccaagtgccccacacgctgttctccgtcttcaaccaactctgccacgtttgtgctgttgtttccctcgacaacctcttaagtgttgttgttcatgatggtcgtgcaacagctccgcatgacaagattttggaacatagagacatggcactgtttgagatgggagttgagtcttatgggtctgccattgtcgcacgcaagtgccaaccagctgcttttgcactttggacggctgctaaaccaagagagtttcgccgggacagaccttgggatccaggtattacttttggaagccatggttgcagccccaacaccttgaggacaaggaatcaagctctaaacgtgccattgagaacagtcaccaacaacctaaatgcaggagcaactcacacaagcacttggtggattagagctaattga

SEQ ID NO: 55838 - DNA, 663 bp, Glycine max
  Peptide Sequence Number=SeqID_172616
atggagtttcctagcattacaaagttttacaatatcccatttgtgtcttcttctcttgtgattttatgtattgctacaacaatactgaataaccctgtaatggccaaaaaacaatattattgtgacttccctgccatctttaactttggtgcctcaaacgctgacactggtggcttggctgcttctttttttgttgctgcaccaaaatcacccaatggagaaacctattttggtagacctgctggaaggttctctgatggccgactcattattgatttcttagctgagaagtttggactcccttatctgagtccatatcttgattcactggggaccaacttctccagtggtgcaagctttgcaacagcaggatccacgatcataccccaacaaaaccttagattcagtcctttctcccttggaattcagtactcgcaattccaacgttttaaacccactacaaagttcattagagaccaagggggagtatttgcagcactgatgccaaaagaagagtactttcaagaagctttatacacatttgatataggtcaaaatgatcttacagctggattttctggtaacatgaccctactgcaagttaatgcttcaatacctgatataatcaaaagtttcacatcaaatataaaggtagttgcataa

SEQ ID NO: 55839 - DNA, 1173 bp, Glycine max
  Peptide Sequence Number=SeqID_172617
atggagtttcctagcatcattaccttgtttcacattaaacttgtgtcttctcttgtgtttttatctatttttaccacaacactgaaccctataattgccgccaaagattgtgttttccctgccatctttagccttggtgcctcaaacgctgacaccggtggcatggctgctgctgccttctcgttaccaaattcaccaaatggagagacctattttcatagaccttctggaaggttcagcgatggccgaatcattcttgatttcatagctgagagttttggaatcccttatctcagtccatatcttgattcactggggtccaacttctcacgtggtgcaaactttgcaacatttggatccacaatcaaaccccaacaaaatatttttcttaagaatttattaagtcctttcaaccttggagtacaatacactcaattcaacggttttaaacccaaaacgcagttaattagaaatcaaggtgggacatttgcatcactgatgcccaaagaagaatactttactgaagctttatacacatttgatattggccaaaatgatcttatggctggcattttcagtaagactgtaccactaatcactgcatccatacctgatctagtcatgactttcaaattaaatatcaagaacttatacaatttgggagctagatcattttggatacacaacacaggacccattggttgtctccctttaattttgaccaattttccactcgcaataaaggatgctagtggttgtgtaaaggaatataatgaggtggctcaagattttaaccggcatttgaaggatgccttagcaaaacttcgtgaggaccttccattggctgcaatcacatatgtagatgtctatactcccaagtataatttatttagcgatccaaagaaatatggatttgagctcccacatgttacttgttgtggctatggagggaagtacaattttaacgatgttgctcgatgtggagcaaccatgaaggtcatgaacaaagatattctagtgggttcatgtaaaacaccatctactagagtggtatgggatggaatccactacactgaagcagctaacaaggttatctttgatcaaatctctagtgggaatttcacagatccacccattcccttgaaaatggcatgcaatagaaatttggcgtga

SEQ ID NO: 55840 - DNA, 735 bp, Glycine max
  Peptide Sequence Number=SeqID_172618
atggcaatttcaagatacatgttaatcccaatgaaggttattgctccttctattacttgttgggctgtgaaggctcaagtcaacaagatatggaaaacaattgacaacgttaatggaagtgcaattgggagacatactattgaatgtgttttctgtgatgaatatatcaaagttataatagacttagtgagagatgacaatgttgatgctccttacttggcaattcaacatagcagattgcaagtatgtggtgcattgactcatgtttgggccaaaatcgttggattcatggataatacgccttggtgggaaatagaaaatggccaccgattggtaggatataattacacaaggaattacgaaactgaagttagtgttccaatccagcttattggcaaacatctattatttttaatagacagagaaagtgttgaaggaagatgtgttggagatgttgttaattatccaaacaaatacatggttcatcaaatctatcatgacaagcaagtgctaatgatgtttcatgccaaggagttcttaactatggcacaagagctaggtgcaaagacagttacacaaaaatcatcaattgaaaatgctaagatgattattgcacaacctgttccacctacaatgttaattgaatggattaaaaagcaaaaaggaagacttaagatatcaaggttttgggggaggcaggagtcgtgcacctcaggctacataaaattattatga

SEQ ID NO: 55841 - DNA, 1962 bp, Glycine max
  Peptide Sequence Number=SeqID_172619
atggcaacttactatacgagttcaagtaatgaaaggaacgcagtgcctatgctgtgtcttagggaacctttgcctaattcatatcccgagacaccagttttgccgagcaatatgacattttatatgaactctggatcatattcagaagcactgtctggcaattctcagcagcaaaacaattgctttgtgattccatcaccatcagtaggggcttcacattccactcctgaacaacaagaaatctttgccaatattagtgggttccaaactgggtttcatgatttcagtgcatggagggaaggtagaagtgaaatgttagtcagacaacctatggatggacagaacttacaaggtcatggattatctctcagccttggaacccatataccctcaggaattcatagttcaagttttgattcatttttgggtactaatccttcaatttcgggtaatgaggcctaccaaaatgattcatctagagatgagggtatgagacattctgaaaatcttccacctggcttacctgaagctaatcaagatttggccaaagcggatttttcatttcatggaatgtctggtgttggaaaaacagttcctagctccaaatacctcaagacagtgcaactactacttgatgaagttgttgacatccgaaaagctattaaaagacctgctatgaaaagtcatagcacacatgagaaatctaagaaggactctaaggaggatgatgagcaactagaaaacgacaggccttctgcaaatggagtgcctaattctcaagcttcaactggtaagacctcttgtgagctttcacatgctgaaaaacaagatctgcaccacaagttaacaaagcttttgtcaatgttggacgaggttgacaataggtataaacaatattatcagcagatgcagactgtagtgtcatcatttgatgtgatagcaggatgtggagcagctaaaccatacacagcccttgctctgcaaaccatttcatgccattttcggtgtttgcgtgatgcaatcactggtcaaatcagtgcaacacaaaagaaccttggagagcaagatgcttctggaagtaacaatggagttggaatggcaagactaaactatccaaaggattctgataagatcatgctagcaagacagacaggcttgaccagaagtcaggtgtcaaattggtttataaatgctcgagtgcgtctatggaaacctatgattgaagagatgtacaagcaagataattgtattgctggcatggactcaaattcttcatctgaaaatgtgtccaaggtaacaaaaagttatgtcaagacctccaatgatgtgggtgatgattcgcagcactgtcaaagtccaattgtggccgatacaaatcacagtggtggacaagctaaggacctcagacatgatcaggctcttgatacagaaatgatggcatccattggattagctagtctcataaatggaggttatggggctgaaactgaacataggcgaaatttggatgattgtggtctcttctctaatgacacagttgttcagtctgatggagctactaataagaggtttgtgtcagttggtccaacatgccaaatgccagagtctgagaggttcaagtcaggaagtggagtgtctctaacattgggtttgcagcattgtgaaggaggtaattttttgcctggtaagacccatctcagtttggtttccatgagggaggacgacatctccaaagcgaccgcagcttcaacagttggagtagagacaacagaacttgagtgcattggtgctggaaaccaacaacaaaggaaaagagtggtgagtgctgatgttgggaccattttacagacagtgaatcatagaaggaactcagtggtccctcaaaggatgataggactgacaaaacagttgtatgatatcatgaaatttattgggaagatctatcttatggttaatgtgtag

SEQ ID NO: 55842 - DNA, 240 bp, Glycine max
  Peptide Sequence Number=SeqID_172620
atggaatgggatgtaggacattccatgtggcattcggttataatgtatcgcgtaatactcttgagtgtgctttacacatcacggaacggaagcgtggatcgttccgtaacacatggtgatgagaaacgtggcttaaggcacattattgtaagggactggagtgtcctttcatatgctaaagggaagaggaaagcaagcttcttctcaacgtacgttcaatcggttcatttgccattataa

SEQ ID NO: 55843 - DNA, 186 bp, Glycine max
  Peptide Sequence Number=SeqID_172621
atgattctgactcgtgtgatgttccatcctgcttgtatagacatgactgtggaagaagccaaaagacttgaccacttcttttgtgaaagttgctctgctgaaggtcaaaaaaagttgcaaaactctcattctgcttctagacactcagatacaaagaatttaataccatttgaattgactcgctga

SEQ ID NO: 55844 - DNA, 174 bp, Glycine max
  Peptide Sequence Number=SeqID_172622
gggatcaatggtgctgatcttcgtaatgttttcactgaagctggtttgttcgccattcgggcacaacgtgattatgtgattgatggagatttcgtgaaggaacttattcaagattctgagtacatggttttcaacttaaatgccagaaaatggtacggtaatacatgtccttag

SEQ ID NO: 55845 - DNA, 1308 bp, Glycine max
  Peptide Sequence Number=SeqID_172623
atgggtgctgcttgttgtgttgctgccagagacaaaactatacaaagtggatcaaccagtgacaatttgcatcggaatgctcgatgttctccaacatggagctttcggtgggatcatcgggggcgtgtagctggtgaagatacttctataaattggttttcagatggtattagcaggaatgatggatcagagaataaaaatgaatcagcatatgtgtcagaggatggaagtccactgcagaattatcaacagaaaagatgccaaaaaccaccaatttcagaagtaactgctgcacacaggagaaattcaacttcagaccaatctttttcaaggactgtttctacggatgtgaacatcgaacaggtgaatgggttggcagaatcatcaatagtatcttgcccatctcccacaaaaccatcactgccttcaacttcattatcagcatctcctttatcatctcaatgtcacatacctccatcaagttcgacccctttgaggtggccctgccattccccaggacaccagctatcacagcaagcttatgatagccgtatcccagcagttaagtcacccagcagcttctctttgtctgacgaaaggcctgtgttttcttcatggagcaatgaagtgggtatgcactcccatggtggatcttcagatggttggtctatacctggcttttctgagctgatgggaacaccccagagagaaagatggtcatttgatagtgagtcctatggttttaaccgagaaagattagctagacccagtagttggttttcagcttcacaagttgatttgcaatcatgtggtatttgctcaaagcttttagcagagaagtcttcttggagcatgcaaaagataattgcaagtaatgacctttctgtagttgctgtccttgtctgtggacacgtctgtcatgctgaatgtttggagattatgacacctgatatcaataagtatgatccagcttgcccagtttgcacttttggtgagaaacaaactataaagttgtctgaaaaagctctgaaagctgaaatggatttgaaggctagaaacaataaatcaaagaatcgggttgtggacagtgatattgacgatgattctgttgtgtttgatcactttaaagggagagggcttaaaggtaaaggtcctaggatagattccagttccagtgggagaagctcctttgggaaaccttttctgaggcgacatttttcctttggatcaaagggttccagatccgtgttagataatcaccctacaagaaagaagggtttcttttgggcaaaatctagcaaggaataa

SEQ ID NO: 55846 - DNA, 366 bp, Glycine max
  Peptide Sequence Number=SeqID_172624
atggcaagagcagagaaagtgagaaacagcgaaaagggcacgaatggaaaagtggaaaactcctcatttgttttttgtccagtaaccattgcagatcaatctgctgaggaggctatggtttcaatcatactagacaatttcccttctcatgccatttacggagaggaaaatgggtggaggtgtgaagaaaagaatgctgattatgtttgggtattagatcccatagatgggactaagagctttattactgggaaacctgtatttggtactctcgttgctcttctacaaaatggcacaccagtaagtatgtctcatctcttgaatgcttatatggagttggacccggtcacactagattttccttga

SEQ ID NO: 55847 - DNA, 1629 bp, Glycine max
  Peptide Sequence Number=SeqID_172625
atggaggtgagaagcatgtgggaagccctgcaactccacgggcagaaggatgcgtcgcgtaacttgtctaaggtcttcagcttcgccgctctctccccctttggcgacctcaactacgctcgtcttcttctctccaccaatccctctactacaacactctccttcgcgccttctcccaaaccccccaccccaccctataacttcactttccccttcctcctcaaatgctgcgctccttccaaactccctcctcttggtaaacagctccacgctctcctcaccaaactcggcttcgccccagatctttatatccagaacgtcctcgttcatatgtactccgagttcggcgacttggtcctcgctcgctccctgtttgatagaatgcctcacagagacgttgtttcctggacctccatgattagcggccttgttaatcatgatttgcccgttgaggccatcagtttgtttgagagaatgttgcaatgtggagtagaggtgaatgaggccacggttatttctgttttaagagcccgtgctgattctggagccttgagtatggggaggaaggtgcatgcgaatttagaggaatggggaattgaaattcactctaagtccaacgtttccactgctcttgttgatatgtatgccaagagtgggtgcatagtgaggaaggtgtttgatgatgttgtcgacagagatgttttcgtttggactgcaatgatttctggcctcgccagccacgggctttgcaaggatgccattgacatgtttgtggacatggaaagttctggggtaaaacccgatgagaggacggtgaccacggttttaacggcgtgcaggaatgcaggcttgattcgtgaaggtttcatgttgttcagtgatgtgcaaaggcgttatgggatgaaaccttcaattcagcattttggctgtttagtggaccttcttgctagagcagggcgtttgaaggaagctgaagattttgttaatgcaatgcctattgaacctgatgcagtcctttggaggaccctcatatgggcctgtaaagttcatggcgatgatgacagggccgagcggttgatgaagcaccttgagatacaagacatgagggctgatgatagtggaagttacatacttactagcaatgtttatgcgtccacgggaaagtggtgtaacaaggcagaagtgagggagttgatgaataagaagggactagtgaagccgttgggatctagtaggattgagattgatggtggtgtgcatgagtttgtgatgggagattacaatcaccctgaggcggaggaaatatttgtcgaattggctgaggtgatggataagataagaaaagaagggtatgatcccagagtttcggaggtcttgcttgagatggatgatgaggaaaaggccgttcagttgcttcaccatagtgagaagctggctcttgcttatggtctaatcaggataggtcatgggtctacaatctggattgtgaaaaacctaaggtcttgcgaggactgtcacgagtttatgaaactaatctctaagatatgcaaaagagatatcgtagtgagagacagaatacgtttccatcattttaaaaatggagagtgctcttgtaaggattattggtag

SEQ ID NO: 55848 - DNA, 129 bp, Glycine max
  Peptide Sequence Number=SeqID_172626
atggcattggtgggaacttcatcgttgtcatttgggtccgatggcattcgttgtcgatgcagaaatccggaaagtaggaggtgcaaattttgggcttgcactggtgatttgaaaaaatctataaactaa

SEQ ID NO: 55849 - DNA, 204 bp, Glycine max
  Peptide Sequence Number=SeqID_172627
gaaggacagaaggctcgtttggagaaatttgagattcctgcaaaaattaaattgctttctgatccatggactcctgaatctggcctagtcactgctgctctcaaactcaagagagaggccataaaaaagacttttgatgaagaactttctgagtttttatcatgcacagtgaggcttgttacgtgcagaaggccaacatgttga

SEQ ID NO: 55850 - DNA, 1719 bp, Glycine max
  Peptide Sequence Number=SeqID_172628
atgactgacatcatgtccgcacctgttgacctacccatgaaacttggtcatgaaattgaatattccgaggatgaaaggaagaaaaagcttggatcgttcaagaaggtggcaatcagcgcctcatctaagttcaagcattcctttgccaaaagggggaggaggcacagcagggttatgtctgtttctattgaggatgatcttgatgcagaagagttgcaagcagttgatgcttttcgccaagcactcatcttggaagagctattgcccgcaaaacatgatgatcatcatatgatgctaagattcttgagagcaaggaagtttgacattgagaaaacaaaacaaatgtgggcagatatgcttaagtggaggcaagaatttggtgctgacactatcatggaggattttgaattcaatgaactagaggaagttctaaaatactacccacaagggcatcatgggattgacaaggatggccggcctgtttacattgaaaagttgggtcaggtggactctattaagctgatgcaagtaacaacaatggaacgctatctcaagtaccatgtaagagagtttgagaggaccttcgctgttaagttgcctgcgtgttccatctcagcaaagaagcacattgaccaaagtacaactcttttggatgtgcaaggagtgggtcttaaaagtttgaacaaagctgcaagggatctcctccagaggcttcagaaaattgacggtgacaactaccctgagtcactgaaccgtatgttcatcatcaatgctggttctggatttaggctcttgtggaactccattaagtcattcctagatcccaagaccacctcaaaaatccatgtcctaggtaataaataccagaggaagttgcttgaaatcattgatgccagtgaacttccagagttcttgggtggtacttgtacttgtgcagataaaggtggttgtatgctttctgacaagggtccatggaatgacccagatatcttgaagatggttcacaatggcgagggcaaatgcaagagaaaaaccttatctgggattgaggagaaaacaatcatagaagatggtacagcacatcaaaatgtaggaaacaaagaatcatttccagagacatacgatgttgatgaacaatgtttatctccaaaaaagcaatgtgctgtgtataaatatgacgcatttgtccctgtgctgggcaagccagtcgattcatcttggaataaattaacacagaaagataaagatgctctttctaaagattgttttcctagcaagacttgtgatgggtatagcaatcactttgttggaggaatcatggccattgttatgggaattgtaacagtgatccgcttgacaaggaacatgccaaggaaaatcactgaagcaatagtgtatggcagcagctcagggtattatgatggcactatgatgaaagcacccaccatttcatgcaatgattacatggcagtgatgaagcgcatggctgaacttgaagagaaagtcactgtcctcagcatgagacctgtcattccacacgaaaaagaggaagtgctgaataatgctctgtgcagagtcaccactctcgaacaagacttggttgcaaccaaaaaggcacttgatgatgcacttgctcgacaagtagaactccaagctcaaattgacaagaagaagaacagcaacaagaagttgttccgcttccgctgtttcgctacgtga

SEQ ID NO: 55851 - DNA, 540 bp, Glycine max
  Peptide Sequence Number=SeqID_172629
atgttcaccttatggcattgcaaagatctaaaatttgatcttgagatgcaaggaaggatgaagggggagttggaaagatctggttgtcaccagtttagtttgaagaatttggctgaatcactaaaaacactaggtaacaaggcaatgcaatctaagaaatactctgatgcaattgagttgtataattgtgccattgcagtccatgaaaagagtgctgtttactactgcaacagggtaagattgatattgattataagggcagctgcttacacccagattaacaaatatacagaagcgatccaagattgtcttagatccattgagattgatccaaactacagcaaggcatatagtcgtctgggtttggtttattatgcacaaggaaattacagagatgctattcataaagggttcagaaaaggttgtggaaatcatctggagaatgttgactttattgctgttatgtactgttactttatcaaggtggccgagcgtaaattgttagaagagcaacaccgtgcatatcaaaaccagttttaa

SEQ ID NO: 55852 - DNA, 147 bp, Glycine max
  Peptide Sequence Number=SeqID_172630
atgggtctcactcgctcaaaagggactgggaatttgtcaggagcatgcatctcacacttaatagagaaagtaacgatttttaggattggaagcatggaaacagagtggagcagattccaccaatccaattttaagtgcgtacaataa

SEQ ID NO: 55853 - DNA, 372 bp, Glycine max
  Peptide Sequence Number=SeqID_172631
atgcagagtttggttgaagaggcaaagttggagtatgttaatatgccaagatatggtcctactgcaaaggaagtgaaacaattgatcgatgcagaagggtctttcactcttgagaagttggagacattcaagtcgcgttgggatgagggcttgaaggagaatggtaatggtgatttcgtattagacacaaatgtcagagccaatttcatagccaaatatgtgagagctactaccgaacctttcctgacggcacggtttggagaaggaataattgatgaattattcattagatttagaaagaaggttgcggaactattggaagaagtgatattagagcatgcttacctggtcatgtttatgacaaaaaaatga

SEQ ID NO: 55854 - DNA, 363 bp, Glycine max
  Peptide Sequence Number=SeqID_172632
atgatagaaggtttgagagaagaagaggtttgggttcagagaaattgtggtagcaaaaacttgagaaaaggtgttggagaaactgtagtgataatggtggttgataaggtgaagatgaagaggcttgtttcttgcaattccaagatacaagtgaacatcccaagagcgttcgccaagcgcaacactcatgggctaagcgtgaggaagactctggaagaaaatgagctgtacaggttcgctaagcgcaccgcttcagttcatctgctaagcgagaaaggcgcgctaagccgaaaatcactaatgtgcactaagcggtccataagtgcgctaagcgcacgagcacaaacaaggccacctatttaa

SEQ ID NO: 55855 - DNA, 681 bp, Glycine max
  Peptide Sequence Number=SeqID_172633
atggagcttcataacttgtttcaggaaatttgtccagaagaaacacagaagaagattgaaattatgtttacaaaaatagcagcattcttcccggattctcacaaagctgaagagtgtctgcataagttaaaccaaattaaagataatagcgtgtttaaattacttgaaaaattgttggaggaacaagccttcaccacgattggacaaactatgaaagataaacatctggtaatgattggagacagcaatccaaattatgagtttttacgtctgctcttctccaaatgttcatccaacattttcagctcagagcatgtcaaatgtatcttagattatctttccaataatgaaaatggaaataaggatttggaggattcttctgcaaatcttctgctggctattgttcgaaatttcccctctatgctgaaaggcttggaaaagcagttccaaaagttgttggaacagaaaagtcctgttaatgacaagctgattgaggtcatagcaaaggcaggctctcacatgtctttcaatcatagtgatatttatccattactaaagagaatttgcttggatggaactcgcagacaagccaaatttgcaggatctgcaattgctgctttaagttttgaacaatcagttttcagaaagttatatgagatgatgaggcaaggggaaacttaa

SEQ ID NO: 55856 - DNA, 348 bp, Glycine max
  Peptide Sequence Number=SeqID_172634
atggaaaattggaagtggatcaaaggtgaagttttgggaagacaggtggaaggaagatggggttccattgctggagaagtacccaagaatgtactgcgtttctcaacagcaacaacaatatatccagcagctaggggtggcaacaaatggagattgggaatggcagttccagtggaggagattatttttggagggtgtgatagacatagctgcaaaatttatggaggatatagagggtccgacagtacaagttcagcaacaagacatttggatttgggagggggatccaagtgggagctacacagtggggaatgcttagattttgctcaatcaaaatatgatagatga

SEQ ID NO: 55857 - DNA, 1236 bp, Glycine max
  Peptide Sequence Number=SeqID_172635
atggacgaatcctcgctgcaactcgtctccgaaatcggaagacacctcgctcaccgaactcgtcccaacaaagacttcttagtcaaatccctcggatttgagttaccaagacatgttggaaggagagataagaaagctgcaaatgctttggctctgataaagcagtctccacaaccacgaacagccaaagaagtacaagctgctaagaaacaagaagatgctttaaagcccctggcaaatgctgtggtttgtggcggtcttcttcaacatgcagacaaggaagttaggcttctggtagccatgtgtgtcactgacctttttagaatcatggcacctgtaccgccttttgaagacaagcatttgaggatgtatttttgttctcaggatgtatttaaacttatcattagtttgtttgaggatctagctgataccgcaagtccattcttttcaaaaagggttaaagtattggagacaatggctcaattaaagtgttgtgtgataatgctggagattgactgcatagacctggttcttgagatgttcaatattttcttctccgttgtgagattgtcattgtttcaaaatctcactccaactgaacaacaggatgcaattttcactgctgataaacttgctgcatcggtcatcaaagcttgtgcacaagaggatgagctgaactcccttgtttgtgggtttttaacaacttgcatacatgacagagatgctatgggcagcgagcttaaagaatattacaatgaaattttctctaaagttttccagtgtgcacctgagatgcttcttgatgtcatcccaagcttaattaaagaattatcggctgatgaggttgatgttcggataaaagctgtaaatttggtggggatgctttttgcacttcaacatcatgttgttcagaagtatcatgagcttttcgtggagtttttgaaaagattttctgataaatctgtggatgttaggatcagtgctctacaatgtgctaaagctttttatttagcgaatccttatgatgggacagaatcacgtgaaattatgacttctgttggagatcgattgttagactctgatgaccaagtgagaaagcaggcagttcttgttgcctgtgatatttttagttcaaacctaaaacttgtttcatccaaactgctatctcaagccactgaaagactccgggatataaaggcatgtgctattgaattttgtatgcttggtaaaggatga

SEQ ID NO: 55858 - DNA, 198 bp, Glycine max
  Peptide Sequence Number=SeqID_172636
atgaagaataatttaggagcccatcctgcactccagcccacattacaagtgtcaaagctaccgggctaccaccatgtctcttatctgcaaacaagtggtgacactggcaattgcgatgtctgcccgagagtagttaaagggctagtgcacagccatcctgaatgggtgttggggctacagagcatggtgcgatgttag

SEQ ID NO: 55859 - DNA, 240 bp, Glycine max
  Peptide Sequence Number=SeqID_172637
atggtatcagagcctatcccagatccattcaaagggtcacccaccattgttgttcatgcaccaagctcaagaagtgttaggcgtgagggggtgtattgggaaaaacacccaagatttaaattgactccattgaagagattgaagaagattctctatttgcaggcagagtgttttgacattgatggtaacttacaaggagtgaaaagattactttcaacaagaaagtgcaaaggttgttga

SEQ ID NO: 55860 - DNA, 315 bp, Glycine max
  Peptide Sequence Number=SeqID_172638
atggcagcgctatcaaaagcattgcgtggtacaaccaaactggaaaagattttagatatttgggaagctggaaagttgttttattgtctgtctacctggggacttgctttggcaggggataagagtttggacttagaagggaggcctaaggtttggagattgtatgtgaggagaaagaggggtcagaatagtaagggtgaggtggcaaaggctgtaacagaattgccaaacgtgctttaccaaagtcgtgcaattttgagagttgctgcaaagggtgttcattcaggaagtaaacttgctctcaaggctctctaa

SEQ ID NO: 55861 - DNA, 792 bp, Glycine max
  Peptide Sequence Number=SeqID_172639
atgccaaatcaaaaccctattttgcattgcaccttcctcttattactcttgcatcttctactgaatgcatctccaatgagatgcaaatcaactatagagccatgctccaactatgattcatgcaatgctcttcttggctacacactttacactgacctcaaggcctctgaggttgcttctctctttcaaatagaccctattgcacttctcactgccaatgccattgacatctcttaccctgatgtagagcaccacattctcccttccaagctcttcctcaaagtccctatcacccgttcttgtgttgatggtattagaaaatcaatgtctactcattataggactagaccttccgatactctctcttccattgcaaattcaatatatgggggtttggtgtcccctgatcagcttagggaggctaattccataggtgatgatccttcagtgcttgatgtgggtctgaaccttgtggtgccacttccatgcacttgcttcaatgagagtgataactctttgccttcaatttacctttcctatgtggttcagccaattgatacattggctgcaattgcagctagatatttcaccacttttactgatttgatgaatgtcaatgacatggggactacagctatctctgatggtgacattcttgttgttccaatacctgcttgtgcatcaaattttccaaaatatgcttctgattatggcttacttgtccctaacggaagctacaccatattactgctggtcactgtgtgcagtgtagctgtggaccacaagatttga

SEQ ID NO: 55862 - DNA, 531 bp, Glycine max
  Peptide Sequence Number=SeqID_172640
atgttcatttgggtttgtcgctctacctgcagtttatactgtatgccctcttctctagctgtctcttgctccagcatgcgatgcaaaaacagcaatcttatgcttgggaatgttactgtgcaacgaagtagttctggttgcaatgttacgtcttgcaattatgatggttttgttagtggcaccacaataacatcgttgtccccatctcttcagcctcgttgtccaggactgcagcgattccatccacttatagcaccacctacatctgttataagggaatcggaatttgcctttacaccatcactatcaccatcacagtcatcgcaatcacaagaaaccggtctaacagctcctaagtcttcggtcatgcctgcaaccagatcatttccaggattctcacctgcaaatggccctgttagtaggattgcttccggtgcttctgctactccctccttggcaaatccgatgcttgttttgagatttgcatttatgttattgcttgtaaagttgttgatccctttggctttgtaa

SEQ ID NO: 55863 - DNA, 684 bp, Glycine max
  Peptide Sequence Number=SeqID_172641
atgaaaagcgtagaggtggccaagacggtgctcgaggtcgccgacgtggcttggaccgccgtcgaacacacccaccattaccgccaccgctgcagtcatcccgtcgcccccgccgccgccgatgtctgcccctccgaccaagatttagagtctctgcgatcagaaaatcgacgcctcaggaacttgctcgacttgaatctgaacctgctccaaaacctctccaagtcaccctgcctcgataattgccctcccgatttgaatgagcgattagttgctaccatgagatctgatgaatacttgactcggctcaagttcctgcaacaggaaactgctagtggaggaaatcaatttcctttcaaggaggccactgagcttgatcaccgatcagctgacattttggtcaacatcgactctcaagaacccagttggtgggtttgggttacagatgaggtggatcctattaatgttgaggaattgagtggaattgatgatgagagttacgtggtcatcagcgaggaacatgtggttgatggtgttgccaactttatggccagatgcattttatcaaacccgaaagctctgaatttttcaccagaggaactgcagaaagtaagattttctccaatccatttatatttcatgcttggtgtgggaactgttagacatgtggcccagcctcaataa

SEQ ID NO: 55864 - DNA, 330 bp, Glycine max
  Peptide Sequence Number=SeqID_172642
atggagtccaaattaaaagacgcgtcgggtttagtgcacgccaaagagatcgttaaaagaaatggaattgacgctatcatttatattgccaatgggggttctatcctaaaggaacatttgtgttttcgaaagaggttcaaggcatacgatatttggggtgacgaggtcgaggatttgatcagtgaagcgatacgagatggggagggagcggtggaagaaggagcagagagagaagaagtgcaatgtggtgcggtgttgcggggctttaaggccttcagaagttgttggtggtgttgcaagaggacatgcgaggaagagggagtagagtga

SEQ ID NO: 55865 - DNA, 369 bp, Glycine max
  Peptide Sequence Number=SeqID_172643
atgttgattcattgtgaggtgcaacttaaaatcgaagcaaaagaactcgacagaatttgtgttagttttcgacaggaaccttatcagcaccctatggtggccaatgccatcattgcttttgctgaggctgttagagcaaaccgccaactgttttctaaagttggtggtgcactggccaagtttttgtgcacccagttagatggtgatgacatatttagacgctgcaagagtttacagggtgaaaagatggacctaggtggcaaagtggagagcatggcgggtaagaaggatgagcttgccaagaggattgctacgttggaggcccgccttaaggagtcggagtccaaattggaggagtccaagctgtga

SEQ ID NO: 55866 - DNA, 447 bp, Glycine max
  Peptide Sequence Number=SeqID_172644
atggttaaggaggagtgtaaggaggtaagtgtctcctccaagaggttagctaagaaggaaaattattttgcaataaagacaaacattaaagaaacttcccttcttaaacaacctccacatcttctcctttgtagaaggacacttgttaacactgccacacctcttaggcttgaggttattcctctaataaatgagttgttggatgagggtttcgtttgtaagagcttaaatccttgtgctttgttggtgcccaaaatagatattattaggcaccaaatccctaaaatagtgatcaaggggttcccacagatcctaagagaaatttggcccactccaccaagtgttaaggggagaagcccagagtttcaagaacctatggatttgaggtcaaatccttttcaagggggaggggatgatgcaatcctaccccctaagggcattggatag

SEQ ID NO: 55867 - DNA, 282 bp, Glycine max
  Peptide Sequence Number=SeqID_172645
atgttaaggtcttcactttttgactttgaggattgtaatggtgaagataatttggaatacaagaaagttgttgattggttcagttgcaacttgcaacacgacagaactgaaccagagcaaagagttttgcgaattctcggttttatcagagccgagaaaagacaaaagatgagccaatcacacaggactgcactcagtgactcattgggggaacgaaagagacccaaacaactctcgataggcgatagcatcaaacgctatgctagtgcacccactaattaa

SEQ ID NO: 55868 - DNA, 276 bp, Glycine max
  Peptide Sequence Number=SeqID_172646
atgagaacatcaccatggagtctcatattggagactaggaacactgttaaatcaaggttgttagcatttgagggtatgcttcagtacttggaagtaagggagaagcaatacgacaagaaggaataccttgatttttatactgaccttaccgctacatctccagccgtttctggagtgatggtatatatagcaactcccgacaagaaatctaatgtaaattatttgggccctgcatcgattgaagacattgcaaggtattatttcatctacgtatga

SEQ ID NO: 55869 - DNA, 300 bp, Glycine max
  Peptide Sequence Number=SeqID_172647
atgggtgcaaatgtttcatcattcatgaacagggtatggagggagcatcctgagctggcaatgatgtatcctgagctggagtgggccacggatcctaggtgctctgtgttgctgccatatctgcaacataatctgcatcctcagtggcatccgcaggccgatgttgagccaggtcgtgaatactctacatcaccaggcataagccatggtggaggctctacagcatcggcactaagatctctatgctctgagcggagatgctggagggtgttggaacaggagctggtggtgctggtgtag

SEQ ID NO: 55870 - DNA, 107 bp, Glycine max
  Peptide Sequence Number=SeqID_172648
atggctaatatgcacctctatgaagggggtgagtggagttatggaggtggcagagagagtgacggagccacgaaggaggagaatgaaaggttgtggagcagggagag

SEQ ID NO: 55871 - DNA, 252 bp, Glycine max
  Peptide Sequence Number=SeqID_172649
atgaaagaaaaggttgatgcaaagcatgaagaagaaggggttaatgggacttttcccttgatccctgataagaccttccaaactttcactagagaggttactagaatggagatcaagaagattatgttttccatgggtaactataaaggctataggtatagacaagttgcaagttggttttataagacccaatggcatgttgtggggaatcttttatgcaactttaacatggatatcttccatgacctttga

SEQ ID NO: 55872 - DNA, 1407 bp, Glycine max
  Peptide Sequence Number=SeqID_172650
atgggaagctggaggttcccttcctcttatacgagggctgagctaaagacttcatcggctactgagagatataggagtatgggtactcttagcctgggtcgactcaggactggcggtgtggcaatggttttcttgaaggccaagaaggcttgcttgaacatggatagggatgccagtctactatttagcttatggaattcctgggcattggtaggatggtgcatctctagtatggttatgcatcttttgaggttagcttctattccccaatatgtctccgaatacttccaggtctggcacatgttgggctatgctataggatttgaggtcaatgtcgttgatgtagacctcagaattttgcctgatatgttgtttgaagattcggtccatcaatctttgggtatgcattcttgggattgccctattaagattagtgtagtgagtgcacatttgccatttttctttcgcctttttgaacatgaaaatgttggagagccagatggtgagcttgtggcatataatgctggggtggataaccggtatttgagatggctgccacgtgaacagtacatcaactatacgtttgtgttcatgactggtgacgtcctggctgagttgcgtacatttcctgggtttgggtctgagatacaatttgatgtgttcttcaataggatttgggcctctttcagtagtgttgtcgcacagatcgacatcaaatatgtcatccaagcttgcttggtagactatcatggcttgtattggagaccctccatcgacgctcataacttgagtatcgccagtagctatggagtttggcttggtaggctccctaaactggccttgaccgaaggtggtcatgaggtctacatagcccttgtaaaggatgtcagtggagcagccctgattgatgggaaccttggacaccatgaagttcgtgattatgatgtagacaaccatggggttgtccttactaatagggttgatacccttgaagtctctatcagtgaaattgatgtcgatgtcctagatggtgtggagatgacgcttgcgggactggctggactgccctgcataggagaattcgcctgcaatgaggttgacgattgtgtctttactgtcggtgcctttgtctccctcgatcttctactctatcccttcttatgtcagcgtcatgattcctatattgatgctcttggcatcctccaggtcttgctcctactggataattgttcggcctctttacaaattgggctagatacccagcctttttatgggtacctccttgttgaaggcttcctcgaggatagttgtgtggttagccgtcaaaagtgtgtaacgttcatacctgggcccttttgggagagtttggtgcttgtctggcttgtgccttttgtccgacttgtgtga

SEQ ID NO: 55873 - DNA, 414 bp, Glycine max
  Peptide Sequence Number=SeqID_172651
atgatgcatgcacctgactcaacactcagatgcaatgtggtacgtaccaacaacaaccaaatctcaggaaatagcctaagcgtgttcacacgacactctcacttagggaactgtgctgacctccctcctataggtgatcagcctgggagcccaaaggtattccctaccagttatgatcacgaccaaaagcaagtgccaaagaccatggaccaattaaagcgcctaagcatcccctcagaaatgcttagattctctaaccacgctagttacccacgtctgggtcatccgacaaggataacgtttacaaagtctctttctctaaggtttttcaaaggaagcataagacatgcaatggcggttccaaagtcagaaaagatgcaaagacaagatgaaactaacaagaaacaagcatag

SEQ ID NO: 55874 - DNA, 126 bp, Glycine max
  Peptide Sequence Number=SeqID_172652
atggctaatcaagtttctttaggcataagcaaccaactcacctgggctagctacagctcgcctaggcgagttacattgctaggaatagagcataacgttctgattacaaatagctcgagattatga

SEQ ID NO: 55875 - DNA, 432 bp, Glycine max
  Peptide Sequence Number=SeqID_172653
atggtcatagtcaagacaaactaccccatcaaacatgttttgcgaaagcctaaattggcaaggtggatggtagcattatccatagaattttatgagttcgatctccagtatgaaactagcggccccgtgaagacacagttcatgacaaactttctggcaaaattttctaaaaatgatcaaaccaccctagactggtggaggctctatgttgacaatgcgttcaacgtgaagggaagtgggacatgtatcatcctcggaggccttggaaatgtcactcttgagcaagccctcaagcttaacttcaaagccttaaacaacaggctgaggagagtaacaccaaagcaaacctactcttcaagaagaggaggaaccaggctaaataactctttacaagaatttcctaattcaggggatgttaaccctaaatcctaa

SEQ ID NO: 55876 - DNA, 357 bp, Glycine max
  Peptide Sequence Number=SeqID_172654
atgaacactcatcctcctatagagatacctgtggctaagcgaggcagtaccttggttccattcacatcatccaccttgaaccaccgtcgttctaccgaggcagtcgaatatatttgtctctgtcacactcgcactaagtcgggcacagaaccaatgtcgtctttgcattgttgcctcccaaggcctccatcgggagaaaacccttcaagggtctatgttatgttttgggtgaaaacccactcttttaggttctataggaggtttgttttcatcgtcaacggccatcatgacaagaaatatgcattgatttttgttgaattaatatttttacctaccagcggaacacctgacatttaa

SEQ ID NO: 55877 - DNA, 217 bp, Glycine max
  Peptide Sequence Number=SeqID_172655
gccaaaagaagagaaggttcaagtagatgatatctcgctaagcaagacaaatccgcttagcgagtggcatccgctaagcgaggcataccgctcgcttagcgggttgaaagatcgtagaagaggattagtcaaagatgtgctcgtccagcgcgccccagcccagctcgcccagcgagtaggttgtctcttctcgcgcttagcgggcccaactcactaa

SEQ ID NO: 55878 - DNA, 444 bp, Glycine max
  Peptide Sequence Number=SeqID_172656
atggcctctaggaagagaaaatcaaccaccttccaacttcaagaaccatatgacacgaccagattcatttcagaggtcgcctgggaaagatatgagcagaactatgatgagttccgccgagaactcgagaggagacggtggcataaagccttgaccaggcagcctgatggtcgcattgacgtggccttggtcaaggagttttatgctaatttgtttgatccagaggacaagtccccgaggcaagttcaagtacggggcaagctgattaagtttgatggtgagaccctcaacgcattcttggagaccccagtggttttggagctaggggagcactactccgctttttccagattctgtcacatgcatccggaccctcaagagcttgcatccaagctctgcatcccagggcgaggtttcgtacttaacactgaaggagcaccttag

SEQ ID NO: 55879 - DNA, 492 bp, Glycine max
  Peptide Sequence Number=SeqID_172657
atggccgatggagatgtgtgggagggtggtgtgaagaaagatgctaggtggttcaccgccaggaaaagtggagatcaaaaatatgatattgtaagtaatggtgaaccacgtgcacaaggcatgctctcaagccctttatcatataaacctgatccaactcttgaaaatcatcattctcactttcgtactaaaaaaacattttctccatttatcatgaagaccagaagaagttgcagaattttgggtgctgtcttggccttggttgtgcttcactttcttctgttctccttgtactctctctcccatgaacagagcttttcaggagagacaagtttgtcagtgtcaagggagcttctatcttcatcctttgcttctttttcaacaagtataaataagataagtggaagcaagaaacagaaaaagaagaaagttatggagccaagtctgaggaaagcaccaccaagcataccaaatcctactcagaacaagtag

SEQ ID NO: 55880 - DNA, 213 bp, Glycine max
  Peptide Sequence Number=SeqID_172658
atggcgaatggtgagatccatagtcacaactctatagtgcaatgccatttcctttctcatttctctctcttggcttcgagctttttctctacttctatggtgcctctgaattttagccaagaggtgctaaccaactcacctaggaaagctgaactcccctcgcgggttgcttacttagtgcttaagatactcactcgcctaggcgagctgtag

SEQ ID NO: 55881 - DNA, 657 bp, Glycine max
  Peptide Sequence Number=SeqID_172659
atggatgacgatgtgattgataatcaaattaagcaacttgagagggaagcatactctggtgtcttgcgtgctttcacatgtcaatccgatgataagaatttaaggttgtgttgtttctactttggtacaatattaattaacatgatagaaaatgcaatcagggagtcgagacaaaggcaaacagggagtgccagtcaccaacatgcaacaaaaaacacatctcagccggttcatggcgatttacatagtccaactgattcaactgaaactgattcacctccctcaaaaaaacggatcagtatagccgctatgttcccacgagatgaggacacacaggagaaaggtaaagatcaagtcataccctacagaaatcaacataatagtgggcaaggcggcgatgatgttatcgcaggccgtgcaccaagaattaggattaagtatggggacacaagcaaaattccgacacctccaagtgtcaagggaaagagagttatggaagttactactttgatgaacagagatatgtatgttaacaaggtgaaaatatttgccctccaggttcattggaggagagcatccgtatttgcatgggaaattaacaagagggatggaagcacattaacaacattttggtggatgagaatgtctttttcttag

SEQ ID NO: 55882 - DNA, 762 bp, Glycine max
  Peptide Sequence Number=SeqID_172660
atggaattcatcactgaagatgccattttctgctatagggtcatgccctatggcttgaaaaatataggcgctacataccaaagattgatggaccggatcttcaaacaacatatcaggcaaaattctgaggtctacatcaacgacattgacgtcaaatcctatagcatagcccaacatgtgccagacatggaagaggacgaggcctacaagcaagccttcttggccttcaagaaaaccattgccacaccgtcggtcctgagtcaacctaggctaagagtacccatactcttatatctctcagtagccgatgaagtcattagctcagccctcgtaaaagaggaagggaacctccagcttcccatctactttaccagctgcatactccatgatactgagaagcgctaccaaatgatagagaagctggcgttagcactcattacctcagcccgacgtctcataccatactttcagagtcacatggtcatagtcaagacaaactaccccatcaaacatgttttacgaaagcctaaactggcaaggtggatggtagcattatccatagaattttctgagttcgatctccagtatgaaactagcggccccgtgaagacacagttcatgacaaactttctggcaaaattttctaaaaatgatcaaaccaccctagaatggtggaggctctatgttgacaatgcgttcaacgtgaagggaagtgggacatgtatcatcctcggaggccttggaaatgtcactcttgagtaa

SEQ ID NO: 55883 - DNA, 1008 bp, Glycine max
  Peptide Sequence Number=SeqID_172661
atgacgataaagataacgacgccgttaacgacgacgacgctgatgatcaccaaacgccgaaaggccggcgaggtattcgttcacgatgaaagggaagaaattgccagggctgactctcacaagtttaatttgatctttaatgaaatggaaaccttacatcagctagttacaaagccaagagaacaagtagccgatgcaaaggctcttttggacatcacccaatctttggtaatgtctgtgaaaaatattgccattggtggactaactccttcagactttgttacccacattcttaaaaaattcggaggacaagctggaccaagtaatagcactgaagatttcagcagaaactcagtagcttggaaggatattggagttgcagtgtcacgtgtttttagagcgggttgtgggtgttatacaatgattggcgccatggatgctaaaataaaacagaggaaggtttataatcgtcgcaagcgtgtgagacccactgaattggcccggcctaaagagcttggtggtggttcgggggaagagagaactgagactgataaacatatgataaccatgtttaacatcttaaggattaataaatttgtgaagcttgaaaatctgattttgaatcggaactcattcgcacaaacggtggagaatttatttgctttatcctttttagtcagagatgggcgggctgaaataaaagtgaacgaggctggatggctactagtttcgccaaggaatgctcctgctgctaattcagtagtttccagggatgttgcttttagccactttgtattcagatttgacttcaatgattggaagctgatggtttgctctgttggtgttggtgaggagctgatgcctcatagggatagccaattacagagtcagactgaagaatatacaagctcattatatttgattcaggtcaaatttgcatcgatacagtttcctgttttgaaaactgtcaaataccagataatggcaccagcgcataatgatatttaa

SEQ ID NO: 55884 - DNA, 648 bp, Glycine max
  Peptide Sequence Number=SeqID_172662
attttcaggaaagagatagatctcctccagcatcaaaccgttgcagcccagaaacgcagattgctatataatcatggaggctgcacgagttctgtaccaagtccgggattgaagagttgtaaacaggggttgttagaccttgaactaacactattgagagtggatttcctccctggcttggtagcccccagattcttgaatgcactctccaacaatcagaaaaaggctagaattgtcaaatacagagactcccctcacctaacatgtctgatttcccctgcaaaaccaaaaggcatgtccaccttggacaacttgatagaagcagctcgaacaacacttgtcttggttggagggcttgccaagcctcatagacctgcaactcttgcacttgtcgaggttaccactctcgacaccaaacaactattctacatgcttggggactcaatgaactcgcgaccctcctacttgtcaaggctactaccctcgacacttgataacctctttcgcccgcaaactgactcagagcttgggggcttatgtactatccaaggtccaccaaatacatatggcaagctatgtggcactctgatacatacattagccttccatctctgccccagcacagaagcacatacgtcaagcccttag

SEQ ID NO: 55885 - DNA, 1209 bp, Glycine max
  Peptide Sequence Number=SeqID_172663
atggctggaaatctatcaaaaatcattccggatatgtcgaaaatagaacctctagacgactcaaattataggagatggtttcaaaaactgttgattttgtttgaagccttagaggttgattatgtgctatttgaagatcctcccgctgatgtcaacgcttctgaatcatctactcttgaaactcctgctacccctgtcgtcacaccgcttcctgcagaaaccaagaaagctaacgaagaagcaaagaagaaatatgaaaaggacaacaaaactgctagaggtcatctgctaactcatatggcagataatctgtttgatcttttcattaatcaaaagtctgcgaaaacaatatgggacactctgctgaaacgttacggtgatgatgatgctggaagaaagaaatatgtggtaggaaattggctgcgtttccaaatgatggatgacaaaccaatcatggagcagattcatgagtatgagaatctagttggtgatatactaaatgaaggaatgaagatgtgtgagatattgcaggctaatgtgcttctagaaaaatttccaccttcgtggagtcataaagcctatgagtgcaaactgaggaagggacaacaatctaacaactcgaaacctgctgcaccacatgctcctcaagcacatctagcagaaaatgaagaagtgatagctgctgtggtagtggaagcaaacatggttgacaacaaggtggactggattctagataccggtgcttctaaacacctatgcgccaacaaagagctttttcaccagattgaggatgctgatgacggaaaatgtgttttcatgggaaattcagctacaactagagtgcttggtaaaggaaagattctccttaaacttacttctggaaaaacattatctttgagtgatgttttgtatgttccctctctgcgtaggaacctaatttctggtagttgtctaaatagagctggattaaaattggtttttgaagctgacaaagtagtaataactgaaatgatgaacgctatgttattaagttctgtatggggatgtcttgctaaggtagctctaccagatttcaagaggactaatgtaggtaccaaaacttttgattgtgtgtttattggatatgctcaaaatggtgctgcttataggttcttgcacgcacttgatggattcaacttcgtgagagtgaaggtgggccgccttctatga

SEQ ID NO: 55886 - DNA, 1020 bp, Glycine max
  Peptide Sequence Number=SeqID_172664
atggcctctaggaaatgtaagagtatcggttcaagacccacaactcaatatgatacaaggagatttcactccttagatccatggaaccggtacacggataatgtattggggagaaacatcttgccagagaagaaggtgaagctttaccacactgagtttgatgtttttaaaactgagttggagaggcataatctccataaacgcctcaccaatttggttgatgggagcatagatgtggctttggtgaaagagttctatgcaaacctatacagctctgagggtccttcaccaaagcaagccaggttcagaggccatctagtgaagattgacgctgacagcctcaacacattcctagagacacctgtggtgtggcacaaggatcctgaggaaggacttgatgactttagcccagtctctcacatggacatgaacataagagctctcatttatggccagatgacttctatagctcaaaataactcttctagatttgggtttcctgctctaatcaccgccctatgtcgagccagaggggttgtctctgatagcctcacttttgagcgcctgagcccggtggtggcacctccaggatccattccttccattgagcagtttctggagatggtaacctggcctggggcccaaccttctcttcacagggaatatgaaggtcccacagcccaagtaccacagcatgtagaggatgcgtcatctaaggtcactgttccagagccattcattgtagaggaggaggcaggtgagacacaggttagacaggaagctgctgctactcctgagaggtcacgagaggtcacatcaaatccacccacactagtggtggacctatcctcacctcagcatgcagcagacccctccactcctatactcgagataccagaggacccaaccacaccagtcctgactctgaacacttctcctctagctactccagtacttcatctgatagatgaggaggatgttcagacacgggacactcaggaccagtcacaggaattctaa

SEQ ID NO: 55887 - DNA, 648 bp, Glycine max
  Peptide Sequence Number=SeqID_172665
atggctagagatacactagggtatagtgggcagagaggttcaccagacttaggggaattagcaagtcctgactacctagcacttagtgcactcatttggcacgggaagctcacaggcctcactttgctactcccgacgggctccgagactatgatttttgagttaggagttggggagatgtacattgtgtttgactcacccttacaaccaccaatttcaggaggaggtcatagagcattcaggagggtgttcacatggattagtcgattctgctacaactatatggtggaggaagaggcacatgctgcataccctttcccattcgtgtatacccctcaacgtgatattaaccatatcatttcctactatacttactttggatttgagcggctagacaacccactgagattattgttgcaattctttgggcatgatgttaatgagtgggccactagatctaacttttgttgggatacatccattgagaacttcaaggatacaggagatttcattgacaataaggatctcacgccatccgagatcgcattctactggggggtctatggtgaagagatgattttgtttgataaggaatgcaattctttggaagacgagaatgacccttctaaggatatgatttcgccatag

SEQ ID NO: 55888 - DNA, 531 bp, Glycine max
  Peptide Sequence Number=SeqID_172666
aaggctaactgctacaaagggaaggagttgcaaattgaagatgatgatgaagttcttccaactaagtatgtaaaggctcgtcctgacagattgttcatacatgagcttgaggatcttaagcaaaaggagttctatcttgtgtttgattgcactttctcactccttgtgcatctgccccattccaaattcaatttcactccccaagtgcaacctatcattgaagaagtggattatgatgttgaagttgtacttgatcctgatgcaatggcggtttccatctatgatcctccatcttcaagggcatatgtcaaaatgatcgaggctgagcttcaaaggaggcaagaagcatttgctcaagctttgaaagatcatgctcataagatcactagatggaaacttgctagacctctaatgccttctgacactcctgccttttctattgatctctcatcagattttgattattttggtgataagtatttaaggaagcttgatgaagatattgccaaactaaatggggagaaaaagtaa

SEQ ID NO: 55889 - DNA, 222 bp, Glycine max
  Peptide Sequence Number=SeqID_172667
atggtgatagaatttcttgaacaggcaacgattgcatttagtgttccaaaaagtactacggtgaaaagcctggctgcaattgatgaaggtaacttgaacaaactaagtgagaagcttcttatgagcaaatctgggaaggttatctctgctcccaatataaagccaaaagagataatgctagaagctgtttgtctgatgagatttgatgagagactaaagtaa

SEQ ID NO: 55890 - DNA, 348 bp, Glycine max
  Peptide Sequence Number=SeqID_172668
atgtatggcaataatagatttatattactaaggaaaggaggcacgtctggaaaagagaaaagtacagaaactaatacaggtggggaaggtgtcgaacgtgggagtctaaggggggcttctttactagatgaaaattctgagggaaggaagctacagtggaaggctcatatggtcaaggaagggcaaaagggaaggaaattacacagaaagagtgggaatactataataatcaatgagaaaaaattatgggagataggcaagttgtgtggggtaacttttgaaggagaggatgttataatgaaggagaagttgaaaaagatggaagtgagagatcaacaggggctgtag

SEQ ID NO: 55891 - DNA, 369 bp, Glycine max
  Peptide Sequence Number=SeqID_172669
atggattacctcactcctaacttgggggaagccaataccaaccagcttatcgatctactaaagggaatcatgtttgacttcaagcatgagttgttacagatgttggagaacaacccatttagtggtggtgcccatcaacatcctatgcagcacctgacgaagttcatcaagttgaccaacacgaacaaaatcactacatggaaccaatgcacaagtgccttaaggaggtatttctctcccatgaagacagatcaacacatcagggacattggaaactttgtacaaagggagcaaaagggtctacttgaagcctgggaaaggttgcaagagattatcagaagctgtccacaccatggcattactcaatag

SEQ ID NO: 55892 - DNA, 1080 bp, Glycine max
  Peptide Sequence Number=SeqID_172670
atggatgagatcaatttttatggggaggacatagttcttataatcattaccccaacaattttaatcaaggatatggctttgggaagaatcaaggaatgtatagatctcaacctatgcaaaatcaaatgccttgacaagatgagagacaacccacttttcaagaaaccatgcttcaatatatggctcagaatgatcaaagaacgaagcagtgccaaagaaggaaggggatcaaaagaaggagatactgaaatctccctagggtcttactttgataagtgcctatgtgatttgggggctactataaatttgataccttattccatatttaagaagttgggcataacagacttagaacctactaacatcactcttcaccttgctgatcattcagttgtctatcctagaagggcgattgaggatgtgttggttaaggaggaaaagttcatcttttcagttgattttgttattttagatatagaggttggggatgaaagagtagtatttagtttatctaatactttgaaacaaccttcctcattagttgatgcactaatggagggggtattcccaatggaggaaatattgacgtttctccactctcaacatggtcacgaaccacccaattgtaagaggttgaaatgtggcattgttccaaagataaagcctcctgttaaggaacctcctgaagtggagttgaagccctctccttccaacttcaaatatgtttttattaacccaccatcttctcttccaactatgattgctatatgtttacatgaaactaaggaggagaaattgttgtggatttttagggacaagaagggaaattttgggtggaacattcatgacatgaagggtttgaaccctacactctgcacccataagatcaatgctaaagaggggtctccacccaaacagtcatcccaaaggaaacttattcccaacatgatggaatttgtgaaaaaaaaggatattatgtccactatcaagatgaaggcataccatgagcgattccagcaaatgcaaaccattatgcacccctccgacctcttagcaaatcatcacatgtcaaactcatga

SEQ ID NO: 55893 - DNA, 471 bp, Glycine max
  Peptide Sequence Number=SeqID_172671
atggaaaggataacaagtcggtggccagtgcttgatcaaaacttgtacaacatgggaatgaagaacacctcaacaacgtttgcatcggccaccgttaatgtcatgccagccattacttttataatggcactgatttgcagcaaagactaccaacatcaattacaagtgatttctttcactacgcatcatattacactgatagctagacatgacaatgcaaggttagagacagtgaacttgagaaaaatacccagcgtagccaaggtagttggaacagcagtaacagtctcaggagctatggttatgactttgtacaaaggcccggctcttcagttcataaagggacaagcagcaacccaccatgaaagtggcaacagcacacaaccctctgaacaaaactgggtgcttggcacagtagagctcattgcaagttgtggtggttgggctagcttctttatcttgcaagtataa

SEQ ID NO: 55894 - DNA, 189 bp, Glycine max
  Peptide Sequence Number=SeqID_172672
atggcgaagaagagagaattggagagtggtggtggtggtggttgtcgtcgtggaagcgggtggatgatgagggaggtaaacattacatgtaaaatgtgcaaagcacaaaaccatcattcacttataatggctggacattatcaaggagacgtacgagtgaaacatatatatcaatctgaaggaatataa

SEQ ID NO: 55895 - DNA, 195 bp, Glycine max
  Peptide Sequence Number=SeqID_172673
atggaaagggtggggttctttaagaagaaggaaagacgatggtgccacaaaggattatctcacgatagtgggagacaatggagacactacgagagcagaaggtgggttctttcacaagtagatgatgaaatcgtatggagggagaataggcgttgtaaaggggaagcagggttattggaaaatctctttaagtaa

SEQ ID NO: 55896 - DNA, 216 bp, Glycine max
  Peptide Sequence Number=SeqID_172674
atggtggagcaaaacaaatttatggcagatgaaaaaccaacaactaaaaacacatacacccccacaactcactcactcctttccatttctagtgcaatgaacccatggctcgacgatctaaccgacgacctccagagtcttaacttcgcctccaccgccaccgtggacatgaagtgggcaccagcttcggctccaaaaccaccactctcatattaa

SEQ ID NO: 55897 - DNA, 462 bp, Glycine max
  Peptide Sequence Number=SeqID_172675
atgatgagtctttggaatcaagaccacaatattagagttaagaagtggccactaaagccatcagggctaggagctccattaatcatagagaaactacatgttgaacttcttctagagaaggttcaaaacccttctttccaaacacttcacgtatcttcaacagatgcaaaattgatttcgaaaaagtcttgccctaaagaagtgactttccatggtctgattggtttccatagcttagagagcttgtctctgattttggttacctcgagaggagaggtccctttcgacaagattagcctattgtggagggctttgcgagttggcttacaaggaaattgtaggaacttgagagaacttttgcaaaggatcgatcgttcaaggatgccgcctcgtttggttttggatttgacgggaaagcgaacgaagatggaaggccaaggaatgcctaggggcaaacgatag

SEQ ID NO: 55898 - DNA, 276 bp, Glycine max
  Peptide Sequence Number=SeqID_172676
atggtctatacatggacaagggagctctatgttgtgtctaatctcactttcttatttgtggtgttcttgaccttctctagattcttcttcacacaccatgtggatcctttcattgaagatgtatttgatgttgaagcttcctctaattccatggttatccgagtatatgatcttccaacctctcatgcctatgtctgtttgcttgaagatgaactagctagaaccaaagaagtacttgctcaaaccatacaagaccgtgcttatgctgagaattag

SEQ ID NO: 55899 - DNA, 345 bp, Glycine max
  Peptide Sequence Number=SeqID_172677
gctataacattgagaaagtacccagcagagatgtccctagccacctgggtttgctttgtaggtgcacttcaaagcagcgcagttagttttttcatggaacgcaatagccctcatgtctggtctctagcatgggattctaggcttgtagcttatgcatactcgggaatagtaacatcagcaatccaattttacgtgcaaggcatggttattaaaaccacggggccagtgtttgtgactgcatttaatcccctgcgtatgatcatagtcacggccttggcctgcattgttctctcagagaaactccatcttggaaggtactaccaagtgaagcaacatttcaattga

SEQ ID NO: 55900 - DNA, 135 bp, Glycine max
  Peptide Sequence Number=SeqID_172678
atgaaggatattcattggtatcttgcgtaccgaaaaatgattgcgagtacaaaggtaatggagggtacagaattcatcacagcagacgcaaatgatgctgatgtgtacttcataccaaggaacgtgaagcattga

SEQ ID NO: 55901 - DNA, 264 bp, Glycine max
  Peptide Sequence Number=SeqID_172679
atggatgaagggttttatccaatgggttcaaaatcactttatgccttaaaaaaccagttcacaaaacttgaatacactagtgtagaaaatgttctcctagaattcaaccacattaacacgaacatctttaagctttatatagacttaagagtatttgaggatcaagtaattgttccattgctcttgtactacaatccaagtgctaaagcacttgccttctcggactggacgctgaagcaatatcgtccaatggctgatgcttga

SEQ ID NO: 55902 - DNA, 966 bp, Glycine max
  Peptide Sequence Number=SeqID_172680
atgaataatccaacagcgactatatttaagagttatgaaggcaaagatccattagccccatatattgattcattctcaggtagaggtccaaacaaaatcactccaaatattctaaagcctgatttagctgctccaggggttaacattctagctgcatggtctccaattgctcctatctccggagttaaaggagataagagaatttcaaaatacaatatactatatggaacttcaatggcatgtcctcatgttactgcagcagctgtttacatcaaatcatttcatcccaactggtctcctgcagtgattaaatccgcattaatgacaactgctactccaatgcgtgatatacttaatcatggaaatgctgaatttggttatggtgctgggcaaatcaatcctatgaaggcagtaaaacctggattagtttacgatgctactgaaattgattatgtcaagtttctgtgtggagatggttatagtggatttatggacaaaattacaggagataataaaaccacttgtacaccagcaaatacaggaagtgttttggaccttaatctcccatcttttgctctatccacaactcgctcaaagtatattagtgccacttttagtagaactgttactaatgttggatcagctaaatccatatataaagccacagtaactacacctccatcatcttcttccttaaacatcaaagtagtgccagatgttttggtcttctcgtctttggaggagaagatgtcgttcacccttaagattgaaggaagcattaacaatgcaaatatagtttcttcgtctttggtttgggatgatggcacttttcaagtaaggagccccgtcgttgtttatgttcctccatgcacatattgctactacttgctccatgcagctaaacagatgaatcctgtgaataaccgtgatgctgaattcgcatatgcatgctgcaggccaaattga

SEQ ID NO: 55903 - DNA, 255 bp, Glycine max
  Peptide Sequence Number=SeqID_172681
atgaccaattggatgcagtgtgcgaaaaagatattgaggaagaagacatggtggatgcaaacgcctctcaagttgagaatagaaccaaaaagacgatgggcacaccctctaccaaggttgcccatgtaccacaatgtccaatatgaagaagatgatgacaaaggtgatgacaaaaagatcaaaggtcaatcaaagaatgagttcaagatgttcaagatagaatcaagaacacttcaagattcaagaggaaagtag

SEQ ID NO: 55904 - DNA, 1077 bp, Glycine max
  misc_feature (390)..(390): n is a, c, g, or t
  Peptide Sequence Number=SeqID_172682
atgatctctgtaggcttgtggcatctcctccaaatatttacatgttttctgcttttgactcaatcattttctaaagatgatcgaaagacttacatcgtctacatgggcgattatccgaagggtgtgggattcgcagaatcacttcacactagtatggttgagagtgtcctcggcagaaattttccaccagatgctttgctgcatagctacaagagtttgaatggatttgtggcgaggctaacaaaagaagaagcaaacagaatgagaggtaattttaatacgcatgtcagtcaatatatatctcacgaatggatagtgtggtctctgttataccagacagaatccataagccacaaacaacaaggtcttgggactttcttggcttccccngaaaatgttcaaagaaacattatagcagagagcaacacaatcgttggagtgatcgatagcggaatttggcctgaatctgatagctttaatgatgctggatttggtccaccaccaaagaaatggaagggcatttgccagaacttcacttgcaataacaaaataattggagcacaatattttcgcactaagggtttttttgagaaagatgacatcaagtctccaattgatacaactggtcatgggagtcattgtgcttccactgctgcgggaaacccagttaggtccgcgagtctattagggtttggctcagggacagccagaggaggagttccatcagcacgtattgctgtgtataaagtgtgttgggcaacgggttgtgacactacagacatccttaaagcctatgatgcagccattgcagatggtgttgacatcctttccgtctcagtgggagctacacagcttacacacaacaagtattttaaagacgtacacgcaataggagctttccatgcaatgaagaaaggcatattaacatcaacatctgcggacaatttgggtcaattaggtccttactcaacctcaaagtttgcaccttggttgcttagtgtagctgcctccaccatagataaaaagtttttcactaagatccagttgggaaatggcaagatctatgaggtttattaa

SEQ ID NO: 55905 - DNA, 1722 bp, Glycine max
  Peptide Sequence Number=SeqID_172683
ctgatggattcaaaatcaaagatctcaaatctccaagagacacagatggtcatgggactcacacagcatcaacagcagctgggaacccagttagcatggcaagcatgttaggccttggacaaggcacatcaagaggaggtgccacgtcggcgcgcattgctgtctacaaagcgtgttggaatgatcactgtgatgatgtagacattcttgctgcatttgatgatgcaattgcagatggggttgatatattgtcagtgtcacttggaggatccaatgatcaaaactattttggagatgcatcttccattggagcatttcatgccatgaaaaatggaatagtgacagtatttgcagcagggaactctggtccatctcctgcatccgtagacaatttatatccttggtcaatttcagtcgctgctagtactttagacaggaagtttgttaccaaggttcaattaggagacaacagaacttatgagggaatctctataaatacatttgaccttaagggagaattacatcctctgatctttggtggagatgccccaaatactaaagcaggcaaggatgaatctgaatccaggctttgccatctctattcattggatccaaatttggtgaaagggaaaattgttctgtgcgaggacggaagtgggttaggccccctcaaagctggtgctgttggtttcctgatacaaggtcagagttcaagagattatgcattttcttttgtcttgtcaggatcttaccttgagttgaaggatggtgtcagtgtatatggctacataaagtctacagggaacccaactgcaacaatatttaagagcaatgagataaaagatactttggccccccaggtagcctctttctcatcaaggggtccaaatatagttacacctgaaattctcaagccggatttgatggctccaggagtcaacattctagctagttggtctccaatttcccctccttctgatactcatgctgacaagagagaattacagttcaatattatctcgggaacatcaatgtcttgcccgcacgtgtcaggcgcagcagggtatgtcaaatcatttcatcctacttggtctcctgctgctatacgctcagctctaatgacaacagcgagggcaaatcctggtgcagcggtaaagttgtgccttggtgacttgttggtcatgggttcgaatccggaaacagtctccttgcatatgcaagggcatatcgtgtacgacacggttaaacagatgagtcctgtgaataaccgtgacactgaattcgcatatggagcaggccaaattgatccctacaaggctgtgaaacccggtttggtttatgatgctgatgaaagtgattatgtgagatttttatgtggacaaggctatagttcaaagatgttaaaactcatcacaggggataacagcacttgtcctgagacaccttatggaacagcaagggatctaaactacccttcctttgctcttcaagccacacagtccacaccaattgtaagtggcagtttctacaggactgttacaaatgttgggtcaccaaattccacatataaagctactgtgactgctcctataggactaaaaatccaagtgaccccaagtgttttgtcgttcacttctcttggtcaaaagcgaagttttgtgcttagtattgatggagcaatatactcagctattgtgtcaggttctttggtttggcatgatg

SEQ ID NO: 55906 - DNA, 651 bp, Glycine max
  Peptide Sequence Number=SeqID_172684
atggcgtacaaagtggaccatgaatacgactacctcttcaaggtcgtattgattggggactccggggttggaaaatctaacatactttccagatttacgagaaatgagttctgcttggaatctaagtctactattggggttgaattcgcaaccagaacattgcaggtggaggggaagactgtgaaggcacaaatatgggacactgcagggcaagagaggtacagagctatcaccagtgcctactatagaggagctgttggagccttgttggtgtatgacataaccaagaggcaaacatttgacaatgtgcagaggtggcttcgcgaactaagggaccatgcggactccaacattgttatcatgatggctggaaacaaatctgacctgaatcatctgagagcagtgtctactgaagatgctcaaagtttggctgagagggaaggtttgtcctttctagagacttcagcattggaggcatacaatgttgagaaggcattccaaaccattttgtttgatatatatcacattataagtaaaaaggcactggcagcacaagaggctaattcctctactggccttccccaaggaactaccataaatgtctcgaatatgtccagtaatgctggcaatagaagttgttgctctaactaa

SEQ ID NO: 55907 - DNA, 228 bp, Glycine max
  Peptide Sequence Number=SeqID_172685
atggaaataagatgtgtagtatctgagccggaacccatagagcaatggtcatatggccccaaggagtggaacgtttataagagaaagccaaaacctaaatataccacacatatgcatcatacggcttcatataatttcaaaacttctagccttctcaacacaatcccccaaccccaaatcatcgagaggctggagtgcttcctagatttgttagagattctaccttga

SEQ ID NO: 55908 - DNA, 261 bp, Glycine max
  Peptide Sequence Number=SeqID_172686
atgccgatattggatcaatttcatctgttcattcacgatttcattaaaaacattgtagatgtcaaagctgatggtatgggtgaagattcatggttgttggtgcataaccatttgcttaaagaacttgccaaatggtctgacgagtatgtcaacctctttggtgacattggcaacaaatttaaggaattaaagaggtccctacttgttgaaggattatccatggtaactatggataagtggatatggatatcaccgacatga

SEQ ID NO: 55909 - DNA, 441 bp, Glycine max
  Peptide Sequence Number=SeqID_172687
atggcaagtagatcttctgttcttcttttgcttctcctctttagctttacttcacttgtgctgaaatgccactcaacttcaccagatgacctcaaaacttacatagtctacaccggcaatagcatgaaagatgaaacttcttcattgtccctttaccaaagcatgcttcaagaagttgctgacagcaatgctgcacctaagtctgtactgcaccactacaagcgtagtttcagcggctttgttgtgaagctaacagaggaagaagctaatagaatcgctgatttattgaacaagaaatttggtaataatgcaggacttgatggagtggtgtctgtctttcctaatggaaagaaacaactctacacgacaaagtcatgggattttattggctttccacaacacgtgcaaagatcaaacactgaaagtgacattattatagga

SEQ ID NO: 55910 - DNA, 195 bp, Glycine max
  Peptide Sequence Number=SeqID_172688
atggagtcaggtgacatgcgggggtaccgtattgttactcgcaccttttgtcaaccaggggcaaacgaacccgttgacgcgcagagactaacatcatcttctgcaccttttggccatccagggacaacgagtcaggttttttctctcgtcgtccgaacgcattcaagcccgatgacgcacgagattcttctctga

SEQ ID NO: 55911 - DNA, 327 bp, Glycine max
  Peptide Sequence Number=SeqID_172689
atggtcaacaagtcatcacttctgcacttggatcctaaatcacctgaagctcaagcttttaatcaaattggtcagaaatccaatggtggttctatcagtccttcgcccactacttctgttgaaggaagttcccagaatggtagaaagcaagggacagatgaaacggccacagctaagaagaatagaaccttgaccaatgattccatcataaatttctttactgatccttctgctccacaaaccattgactccacacatagttctgtagcattagcacttatggagggtttgtatctgaagagtttagcatatgaattcaggagatga

SEQ ID NO: 55912 - DNA, 3327 bp, Glycine max
  Peptide Sequence Number=SeqID_172690
atggaaccgccggctgctcgaccgaggggtcgaccgaggaaacgaagaagaaaggaggaggaggagaatgaggccgaagcaaaaaggcaggctatgggaacgcgagccatagctttggtagggaggtacgtgctcaaggattttcccggaaacggaatttttctcgggaaagtggtgtactatgagtgcggattgtaccgggtgagttacgaggatggcgattttgaggatctcgacagtggagaggtgcgcaccattctcgtgaaagatgatgaggagtttgataaagacttcgcccggaggagggccgcgttggagaaattggtggcgaagaagaatagtgtaaaggccaaagatgtttcggagagccgtggtgaagggagggaggagcaatcggccgttggggaggctgaattgaaaggtgggttggtgttggagaaaaatgaaggagaagggaacgaaaatgatatggaggatgattcttccagtgactcaagcttcggggaaatcgagtctgggactactgatgcagagttactgccgcctatgccgctgccgccggagttgccctcgtcgtccggcaccattggtgtaccggaggagtctgtatcccatttgtttgctgtatacggattcctcagatcattcagcacccagttatttcttatgccattcacactggacgagtttgtgggtgctgtaaattgtcgtgttccaaacacggtgttcgatgccgttcacctttccttgatgaaagtgttgcggaggcatctggaagccctctcatcggagggctcagagattgcttccaaatgtctcaggtgctatgattggagcttgctggattcattgacttggccagtttttgcaattcagtatttagtagtcagtggacacacaactgctcatgaatggcgaggattttacaaagaagtttccaccgatgaatattatttgttgcctgtgagtaggaagttgatgatattgcaaattctctgtgataatgctctggaatctgaggagattgtaatggaaatgaacattcggagggaatcagaggttgggatggattatgatggagaggatatccttccttcagaagttgggcttagaagagtccagccaagatatgccaatactccagcttctgaggataaagaagctacaaagtttgtttcagcttcaaatgctgtgaaccaacctgggagctctatttcatattccagagatacagaaggcactgaagatggtgatgttgatagaaatggagatgaatgtcgcctttgtggaatggatgggatcctgctttgttgtgatgggtgtccctctgcttatcattcaaggtgtattggtgtgttgaaaaatcatataccagaagggccatggtattgtcccgagtgcaaaatcaatatgatggggccaaccattgcaaagggaacatcacttcgaggggcggaaatatttggaaaggatttgtatgggcaactcttcatgggtacctgcgaacacttacttgtgctgaatattgggaatgatgagttttgtcatagatattacaatctgaatgacattcccaaggttctcaaagtgctttatggatccacggagcacagggctatatatcatgatatttgcatggctgtgcttcaatattgcaatattccagaaagtactttattatttcctcctttgggtgaaacccctctaagtcctgctactcaatgcaatggcaacggtagcagcaacgagtgcccttcttccaagtgctctttggtaaatggtcaaattggtaactatgaccatgcaaatgatacagtaaatctttcttcccaaaccaaagaaagcacacaagcaggttttgaaaagtgtgaacgcaatgtaaccaatgatcctgcatacatgggtttctcctataagcctttgttgtacattaatcactatgctcatggtgattttgctgcatcagcagctgctaaatttgcccttctttcctcagaggaatctagatcagagggccatgtgtcagacaatcagaggaaaactgcatctggaaacacttacttgcaagcaaaagcattctcactaacagcttcgcgtttcttttggccaagttctgaaaagaagcctgtggaagttccaagagaaaggtgtggctggtgcttttcttgtaaagcccctgcttcaagcaagagaggatgcatgttaaatcatgcagctctaagtgccacaaaaagtgctgtaaaaatgcttgctggtttttctcctataagaagtggagaggcaatacttcctagtattgcaacttacattatatacatggaggaatgtctacgtggtttagtagttgggcccttcctaagtgcaagctatagaaggcaatggcgtaagcaagtggaacaggcaccaacatttagtgctatcaaaccacttttacttaaacttgaggagaacattcgaacgattgttttttgtggggactgggttaagctgatggatgattggttggttgaattttccatggtacaaagtgcctcatctactcttggaacagcacagaaacgtgcaccaagtggtaggcgttacaagaagcggttagctaatgatgaagctacagctgatggttgccctgaaaactttgtgtggtggcgtggtggcaaattcaccaaatttatattccagaaagcagtcttgccaaaatccatggtcaggaaagcagcacgtcaaggtggttcaagaaaaatttctggcattttttatgctgatggctctgaaattcccaagagaagtagacaacttgtttggagagttgcagttcaaatgagtaggaatgcatcacagctggcacttcaggtcaggtacctagatttttatctcagatggagtgatctgattcgtcctgagcagaacatccaggatgggaaaggtcaagagactgaagcttctgctttcagaaatgcaaatatttgtgacaataaacttgtagaggggaaaagttgttatggaatagcttttgggagccaaaaacatcttccttctcgggtgatgaaaaatgttgttcaagtggagcaagatccagaaggaaaggaaaagtattggttttttgaaacacgtattccattatatttgataaaagagtatgaagaaggtaatggaaatatgccatgtaatgaggagcacttgaatactgcatctgagttgctgcacagaaggcggttgaaggctatctgcaaggacatatttttttacctaacatgcaagagagataacttggatgtggtgtcatgttctggatgctcacaagtgcaatgcatgccaaggtactcatga

SEQ ID NO: 55913 - DNA, 387 bp, Glycine max
  Peptide Sequence Number=SeqID_172691
atgaaactatcaattgctcgattgaggagctgcccaaggaagcgaagaagagaggaggatgagaatgagaatgaggtgaagcgaccaacaataggggttagttacgagggtgatgattttaaggacttagacagcgcagaggtccccaccatactcataaaggatgatggattttacaaagacttggcacaaaagagggtcggattagagaaattaaaggcaaggagtagtgtaaagaatgatggaggaaaggagaatgatggtgatatggaggatgaatcatcgagtgactcaggctcgagagatcacaagtctaggattgacttggaggcattgttgccaatagaattgttgtcatcgtttggaaccattggtattccaaagtag

SEQ ID NO: 55914 - DNA, 342 bp, Glycine max
  Peptide Sequence Number=SeqID_172692
atggcgagaaaaatcaaacgcacgtttcgtgaagtcaaaaaatgcgaaagagaaaccctaaccttctcggttttgaagcgcgttcggatgttgccgtatcctccgccgcgagggagcggagcgccgccgtctccctcttctccggcagcagaaggatccggcaacgcaattggtgttgacgagattcagattcagctccgattcataacggaaaatgtgcagagtgagagagagagagagagagggagggaaagagagagaatggagcgagtgaaaaatgagaatcaaaaactgaaaaacccgctaggcggggcggtgcggtgctggagtgacccatgctaa

SEQ ID NO: 55915 - DNA, 822 bp, Glycine max
  Peptide Sequence Number=SeqID_172693
atgtattcctatcagccatggaaggtgccattactggaatgctactgcagaattccatttcccattggaaatactggtgaaagattttgttctttgtgcttgaaggatagtggtgttctatatgaggatccttatattcagattggtgttgaagcagagtggagggctcatcatgggcatttggttcttttcttggggaacaagaatacttctcctcttatctctgttcaatctttagtgttgcctcctgctcatttgaagatggagctttcactagtaccagaaaccatacctccccggtcacaggtacaatgtccactcaaaatcattaatctccacccaagcagggatgtagctgttcttgacttctcatacaagtttgataacaatatggtcaacgccaaacttcaccttctagctgtcctaaataagtttcttgagcctatacctgtatctgctgaagaattttcccctcaatggaaaatcactttcttgaccacctttaaagcttcaagaagtggtatgtatctgctacaagtttgtgtatttaccaattcagttttgagtgagttaattcaatttgttagaggagttagaccccttccactgcttgaactggcaaacttattcaatagctaccatttaactagttgccccggacttgaccccaatccaaacaatcttgttgcaagtataacattccattcagaaagtacaagtgcgatgctctgtttaacaacagagctgcgaatgacagttgcttcgggatatgcatatacctatgcaagaacctccaatgactcaacaagccagcactcttga

SEQ ID NO: 55916 - DNA, 1599 bp, Glycine max
  Peptide Sequence Number=SeqID_172694
atgaaaacgccttatattacaggttattgtcacgagggctgttcaacaagatcaacagtctcggcaaatgaagttgagtacttgactacatgcaagcaatgctaccatgccagattacttgctcagaaagagaatactaatgaatctccaaccagtccattactcctacaaggacgagagaataactctgggacatttttgaatggatcaaggcctaaatctcatgatcaagtactgaaatcttccaggacaaaggctaataatcccaacgtgaaacaagttactcctgtgacggctttgaaaggaacaaaggctaaatattatgaacaagaaccgacttctaccaggacaaaggataataatcattttggcacgcctcaagttgcttctgaggccactttgacaggaaaaaaacctcgcaaaaattgttcttggggtattatatggcaaaagaaaaataatgaagatacagacaatgatttctggctcagaaacatacttttgaaagggggttcaaacatgccacagttaaaacctgtttgtcacttgtgtcggaagccatatatgtctgatctgacgtatatttgctgtgagacatgccgaaattggtatcacgctgaagctgttgaacttgaagaatccaaaatttctagtgtgttgggcttcaaatgttgcaagtgtcgaaggataaaatcacctgtttgtccatactctgatttgaagcctaagagacaagagggcaagaagtcacgcacaaggactaaaaagaaagagcattctggagcagactccgattctggagcaatctattatgatatgagagattgtgaagttgctactcctgtctttcatgtagaggatgatcccagtcatgtctttcctgtagagggtgatcctactcacgtctttcctgtagaggatgatcctcttcttttctctctttcgagtgttgagctgctaacagaacctaagatggaaggggatgttgagtggaacagtgtccctgggccagggcttcggaaattgccagtgagaaggaatgttaagcatgaaggggatggtgatgtttcttttggaggtatgcctgcagatgtatctccacctttagaatatgcctctgctgttgactttgacaacaagctgctgaatgactctgataatgtaaactatgatgattacatggattttgaacccaatacctatttctctctaacggaactgctgcagccagatgatggtagtcagtttgagggtgttgatgtgtctgcggacttgtcgggatatttggaaaattctagtacccttattcctgaagaacgtggagatgataaaacagaacctgcattttccttgcaagacaccggcggggacttgtcaggatatttggaaaattctattacatttattcctgaagaatgtggagatgttatgacagaacctacattttccttgcaagacactggctttagttccaatgttcgccttgggttgaaataccatctaggcttggaagttggaggtgtgggaattgccgggattggtaataggctgattttgctagttctcttggtggcggcgttgagtcctctggagaagtaa

SEQ ID NO: 55917 - DNA, 345 bp, Glycine max
  Peptide Sequence Number=SeqID_172695
atggttgagggcactcacattatcaatggcaagcaggtggagattaagcggacgataccgaggggggttgctggctggaactcaaaagacttccgaacgaagaagatttttgtgggtggaattccttcgactgtgactgaaggtttggacatggcagtttcattgttgaatggttgttggttcttcacaggtgtatactgggaagatgcatatttcataacaaatatggagcctatgaaattttgggagttcatgtcattggtagtggaaggtctaggatatgaaaggaaataccaatttgaatttcagaaaatgagtatttataatcctagaatggaccaatag

SEQ ID NO: 55918 - DNA, 198 bp, Glycine max
  Peptide Sequence Number=SeqID_172696
atgaacttggatgaagatgatgctgtgatgggtgatgctactgctagaagtgacgctacaactgtttattatgtctacctgatagtgtttgctttatatgggaccttgaaggctattgctggagaagctggtgttccatttttctatcgggcaggatcagaatttgaggagattaagtcttccttttgcattttatag

SEQ ID NO: 55919 - DNA, 309 bp, Glycine max
  Peptide Sequence Number=SeqID_172697
atggcttttcaacggtgttcattcatctcggtatcatatcgagtaactcaaggcaaaaatatcaaatacaagttaaatgagatattgatcccttatttggtcctggcatacacttctgttgcttgccttttaacacttcctattccattcattcggttaggtacccgactgatatttccaggagagcaagaattcactcatttccttgacactcacgcacccctgttcttaagggtcatatataaaagacttcctgtgaatgaggaaagcagttctcgcaggtggagagagaatactataattcagtga

SEQ ID NO: 55920 - DNA, 909 bp, Glycine max
  Peptide Sequence Number=SeqID_172698
atggtagattggccgattccaaccaccatacagtccttacaagggttcttagggctcactggcttctaccgcaagttcattaagcaatatgcctccatcgccgccccattgacaacgctacttcagaaagacaattttcattggaatgatgatgcctctgcagccttcattcgccttaaagaagcaatgatacaggcaccagtattggcattacctgatttcaccactccattcactgttgaaactgatgcttcaggtctagcaatgggagcagtactcgcccaacatggacacccactggcattttttagcaaggttttctgcccacgccttcaacgatcttcaacatatgttcgagagcttcacgccatcaccacagtcgttcgtaagtggcgacaatatctgctgggacattccttcatcattcttacagatcataggagtctcaaagatctcatgagtcaagtaattcaaacgcccgagcaacaaatttacttgtcaaaactactaggttatgattataccatcgagtacaagtctggcaagtcaaaccttgttgcagaagctctatctcgtattccgttggggactacagcctcattctttgtcctatcgacaccaaatttcaccttcctcgacgacctgcggcactccttggccgacaatcaccacttcagaaaacaatgtgaattggtcacagccagtccagacagtcatcctgacttcaaattacacaagggactattgttcttttgcgggaaaatttggcttgacccccagaactcatttcgcactgccctaatcgatgaatatcatgcaacccccctcggaggccacatgggttttgcgaagacattacaccgtgtccaaaaaaaattttattggtcatcaatgcggaacgacgtctag

SEQ ID NO: 55921 - DNA, 369 bp, Glycine max
  Peptide Sequence Number=SeqID_172699
atggatgatggggtttgggaaagccttgggaaacaagatttgactgcacgcaagggcatgctcggccaagcacgagcgtgtcagcaccccctcacccctagaaaacaatgcctgacctcatgcttatgcatggacgtgactagcctggtactacaattagaaaatgaggtcagatgcgaggcacaggttgggcgtgccagtgcgcgcggtcaaacttttgttttcgaaggctttccaaaccctcatcaacatccattatcagattctaacatgtttctagtcaaatttaagccagagaacattctaaacaagaatcacaacaattacatgttcaaataccaattcatcaatcatctcattactctttaa

SEQ ID NO: 55922 - DNA, 888 bp, Glycine max
  Peptide Sequence Number=SeqID_172700
atggagacgctaccgacgacgacgacaaagcgaggaggagcgagatcgaagcccgttcagacctcgaaatcgtctctcgttatggccttcttctcctgcgtcgcgtggctctacgtcgccggaaggttatggcaagacgcagagaatcgcaatttactcgctagtcttctgaaaaagaattcagctcagaggcctaaggttcttacagtggaagataagttaatggtgcttgggtgcagggatctggagaggaggattgtggaagctgagatggaattgacattggctaagagccaagggtacctaaaggggcaaggccagagaagcggctcttctgatcgtaggcttcttgctgttatcggagtgtatactggatttgggagtaaattgaagagaaatgttttcagggggtcttggatgcccagagaaagtgtgagaattggtttggtgagggagtgggtgggcaggataaggattaaattcatttgtgatgcagactttgagtattttcttggtgatgccttgaaaaaacttgaagaaagaggagtggtcatacgttttgttattggtcggagtgctaatcgaggtgatagcttagatcgcaatattgacgaggaaaatcgcacaacaaaggatttcctgattcttgaaggtcatgaggaagctcaagaagagttgcctaaaaaagttaaaaccttcttcagtactgcagttcagaactgggatgctgacttttatgtaaaagttgatgatggcattgatattgatctcgagggtttaattgaacttcttgaccgtcgtcgtggtcaggatggggcatatgttggatgcatgaagtcaggagaagtgatatcagaagagtactttctttatctaagtttattgtga

SEQ ID NO: 55923 - DNA, 201 bp, Glycine max
  Peptide Sequence Number=SeqID_172701
atgttgtttttcattcaagctttcattattcacaggcttgggttatactttgacttgcagtattttgaggacatggttcttgagggaagctgggatgaggaactcgttaatctgatgttggttaacgattgtcataaggctctagatatcctcttgaaggatctgaaagtctttgcacaaaggaatgaagggatgagctga

SEQ ID NO: 55924 - DNA, 696 bp, Glycine max
  Peptide Sequence Number=SeqID_172702
atggggtggagatacaaggcagggttgttcctcatacttactgtggttgtcatatgggtcacctctgctgaagtcacccaggatatttttatagattacaagcagccatttgcagtgacgtatcttggagcttctcttatggtagtttacctcccagtagcattcattaaggactggttgtataagttatttaaacactgctcttctaaaagtggaagaagtgcaaaagttggggatgatttttctgtcacgtgtacctctcctctcaagggcaatggagtgcaaaaaaccactgaagtagaattagggagcatgactcgaaaagatagtgatgcaaacctttcagtacaagaacaagtaaagccattggtggctaaatataatgatgctactgctataaaggccgagaaagaacttactacaagggaaattgctacttatggattttacattgcacctatctggtttataactgagtatctatcaaatgctgcccttgcacgaacaagcgttgcaagtacaacagtattgtcatctacttcaggactcttcactctcttcattggtgtgtttttgggccaagacaatttaaatgtatcaaaagtagttgctgtcttggtcagcatgtctggggttgtgatgacaactctggggaaaacatgggctgcagatgatgcgctatcaagtgcttcgtaa

SEQ ID NO: 55925 - DNA, 971 bp, Glycine max
  Peptide Sequence Number=SeqID_172703
agctagtttgtatctacaatgaactttgtgagattggaaaaccaccacctgttgttgatgctgcagaacttcagcaagatcctgaggctactttacgggctcttttcaatgatttggagattccttttcaacctgcaatgctcaattgggaagcaggtccaaaaccaatagatggcttatgggccccttggtggtataaaactgtacacaaatctactggctttaaggaagaaaacaagtatcctcagattaaatcccataagaaaatccgctatttggaggtggggtcgaaaatcctggctgaagaagccatcccttctaggcactcccttacctactcctctgatcttccagttcctgcaaatgagaaattgcttgcctgggttggtaatgagattgtaccacgtgagagtgcaaaggtttctgtgtttgattcagttgtccaaggaggtgactcagtttgggagggtcttcgagtgtataatggaaagatatttaagcttgaggaacatctagacaggatgtttgattcagcaaaagctttggctttcgagaatgttccaactcgagataagattaaggaagctattttcaaaaccctgattaggaatggaatgtttgacaattcccacattcgactttctctaacacgaggaaagaaggttacttctgggatgagccctgcattaaatctatatggatgcacattaattgtgcttgctgaatggaagccccctgtttatgataatgagcacggcatagttcttgtaactgctacaacacgccgtaattccccaaatgcctcttctagtgttgcggcaacctcaccaacaaccagtgctctcgctgcgtgtcgcatgcgatcacccagctcggcaacctttgcttcacttcctgcgacggcgcgttgcagcttgacagctgtttcatcaagtatgacaatgtcaccttcatcggggtcgaggaggtga

SEQ ID NO: 55926 - DNA, 363 bp, Glycine max
  Peptide Sequence Number=SeqID_172704
atgttatacagcaaacttgctttcaagaatttggattcaaagattcatcacaataacctcctcaataacatacttgcaaagcttatcacaaaaaagtctttatttctgttacagattgaaggtaataatgcaaaagcagatgatgcaatcatgcttgacaaagacggttatgtatctgaaaccaatgcaacaaacatgttcatagttaaaagggggcgtgttttgacaccacatgctgattactgtcttcctggcattactagagcaactgtaatggatcttgtggtgaaggagcagtttatcttagaagagcgaagaatcagcctgtcagaagtgcataccgcagatgaggtttacctataa

SEQ ID NO: 55927 - DNA, 960 bp, Glycine max
  Peptide Sequence Number=SeqID_172705
atggcactagaagcagtggtatttccacaatcacaagacccttttggtagtggttacggatcagtgaatactaaggacttctacaactacaccttgttggctgctacttatgaacaacaacacatcaacaaagaagaagaacaaggtggtgcttctatctctacttttcaaccagagactagtaattacccttatggagattggaccaccagttcctcctcatccatgttaccccacttgaataatgaacttcaagaaaccactactactactagtaacaccttagatagcttaaacactcgtcccaagaggcgcagagccaaaagcagaaagaacaaggaagagattgagaaccaaagaatgactcatattgttgtcgagcgcaatagaagaaagcagatgaatgagtatctttctgttcttcgctctctcatgccagactcttatatccaaaggggtgatcaagcttctataattggaggtgctgttaactttgtgaaggagcttgagcagaggttgcattttcttggtgctcagaaagaaggagaagggaaatctgatgatggtggtgcaacaaacatgcccttttctgagttcttcacctttccgcagtattcaacaggtggtggtggtggttctgataattctgcagccataggtgaagacgtgagtgaggttaagtgtggcattgctgacatagaagtgaccatggtggaaagccatgcaaatctcaaaataagatccaagaaatgccccaagcagctcttgaagctggtttctggtttgcataccgtgcgcctcacaatcttgcacctaaatgttactaccactggtgaagttgttctctactccctcagtgttaaggtggaagatgattgcaagttgggatcagttgatgatatagcagcagctgtgtatcagatgctagataggattcagcaagaggcaatgttgaattaa

SEQ ID NO: 55928 - DNA, 240 bp, Glycine max
  Peptide Sequence Number=SeqID_172706
atggaggtcattcacttatggtctgctccaaggtccctcagtaccactgtcatgtattctttcgctcagagggatgacattgaagtgcttgatgagccactctatgctaatttccttcgagtcactgctgttcatagaccctacaaggaggaactactctccaaaatggaatctgatggaaataaggttgttaaggacataatttaccgtccaggaaacagcaagtatagattctgcaag

SEQ ID NO: 55929 - DNA, 135 bp, Glycine max
  Peptide Sequence Number=SeqID_172707
atgatggtggagaggagttatgtgtgtggagcctttaaggttgaggtcgcacgtgcaagggaaggttggagccataattctggatctggttggggattgggtgagaagaagatggggggcctagggagtgggtga

SEQ ID NO: 55930 - DNA, 378 bp, Glycine max
  Peptide Sequence Number=SeqID_172708
gagtatgtggagaagcaaaggaaagtggttcaggtgcaaaggcatttcatgttgcgtcgcccgattcaacgttatgatcttttgtacatggttatgcactccttgtggcttaggaggcttaatttgagggtgcttgcttcggaggcaaattgggaaggtgtagaagttggtgtctcgctaagcgaggctaatgcgcttagcgagtatcatccgctaagcgaggcatcggctcgcttagcaagtcaaaggaatcttgaagggaatctaccacgcaagcacgcgcccagcgcgccatcagctcgcctagcgattcgtttgtttcttttggcgcttagcgtgcctagctcgctaagccaaagttcacttactcacgcttag

SEQ ID NO: 55931 - DNA, 1104 bp, Glycine max
  Peptide Sequence Number=SeqID_172709
atggattctaagaatgttgttgcttttcaagttgtaacattttgcatatgcttggctgtggcaaattcggttgagttcagttaccctgcagttttcaactttggtgattcaaactcagacacaggtgaacttgctgcagggatgggatttctagtcgtcccgccttatggaaaaaattacttcaaaaccccatctgggaggttctgcgatggccgtctcatagttgacttcttaatggatgcgatgaaattgccattcttaaatgcctacatggattcagtgggtttgccaaattttcagcatggatgcaactttgcagcagcaggttcaactatccttccagccactgcaacatccatcagcccgtttggctttggggttcaggaaaattatcacaataaagtttcaggaaagaaatttgatcagtacgtcccaacagaagactatttcgagaagggattatacatgtttgacataggccagaacgatcttgctggtgcattttattcaaaaacattggaccaaatacttgcctcaattccaacaattctattggaatttgaaactggaataaagaaactgtatgatagcggggcaaggaatttctggatacataacacgggtccactcggatgcttgcctcagattgttgccaaatttggcactaatccatcaaagcttgatgaactaggatgtgttagttcactcaaccaagcggccacagcctttaatatacagcttcaatctttttgtagtaaatttaagggccagtatccagatgcaaatgttacacatgttgatatctttaccataaaatcaaacctcattgcaaactattcaaaatatgggtttgaacaacccattatggcttgttgtggatatggaggtccaccattgaactttgacagtcgagtttcttgtgggctaacaaagatcttgaatgggaccacaataacagcaaaaggttgcaatgacagcagtgtgtatgtaaactgggacgggactcattacaccgaggctgcaaatcaatatgtggcatcacaagttctcactggaaactactccaacactcttttgggagacaaaattcccttccttctctag

SEQ ID NO: 55932 - DNA, 1035 bp, Glycine max
  Peptide Sequence Number=SeqID_172710
atggctaatataatgagctacttggagatggagaaaatattcaaggtgtacgtatacccagacggtgacctaccaatcgctcacgatggcccgtgcaaggacatatactcaatcgaagggaggttcctccatgagatggaacacggcgcggggaggtttaggactaacgaccccaatgctgctcacgtttacttcttgccattcagtgtcacttggatggtcaagtacctttatactccactctcattcaacgtcactcctttaaagcagtttgtctccgactatgtgagagtaatttctacaaggcaccccttctggaatataactcatggtgccgaccacttcatgcttgcctgtcatgattggggtcctcatgcatcacagggcaatcccttcctctacaacacctcaattcgtgtcttgtgcaacgccaacacttcagagggcttcaaccctcgaaaggacgtgtccttaccagaaatccacctctacggaggtgaagtgtcccccaaactcctctcacccccacccgacaccgccccccgccgctacctcgccttcttctccggcggtttgcatggtccaatccgccccgccctcctccgccactggaaaaacgacaacgacgatgatattcgcgtctacgagtacctccccaaagacctagactactactccttcatgctcaactccaagttctgtctctgtccaagcgggcacgaagtggccagccccagaatcgtggaggcaatttacgccgaatgcgtgcccgtgatcctgtctgagtattatgtgttgccctttagtgatgtgctgcaatgggaggcgttttcagtgcaggtggatgtttcagatattcctagactgaaagagattcttagtgcaatttctgaagataagtatcggaagctcaaggagggagtgaaggctgtgaggggacattttacactgaatcgccctgccaagagatttgatgtatttcacatgatcttgcactctatatggttaaggagactaaacatcaaactcagatag

SEQ ID NO: 55933 - DNA, 1152 bp, Glycine max
  Peptide Sequence Number=SeqID_172711
atgcaggccataggaagatcaagagcttcttcaccatcacaacaacacagcaacaacaacaacaacaattcggtgttcacaacaatgaccaactacaagacctattccaaaagacttctcccactgcttcctaaccctaatgatcaacacacggccatcgaaatgaccggtgccgaccgaccgggcctcttttcggagatctccgcagccctagctgacctccattgcaacattgtcgaagcccacgcatggagtcacaatgcgcggctcgcatgcgtggcttacatttctgatcaatccactgacactgccatcgatgacccctcgcggttagcctccatagaggaccacttaaccacggtgcttcgcgccaccaccaaccctaatggcggtggtggcgcgaaccacccggacgttaagacctcggaacttctcggaggagaaggccaaatgaccaccgtggaacgcaggctgcaccagcttatgctctcagttagggactttgagaccccctcctcccccaaagagaagaagggaagaaaaaggatggtctcagttgaaagttgtgaacaaaaggggtattcaattgtcagcattgagtgtaaggatcgtcctaggctcatgtttgataccgtttgcacgttaacggacatgcagtacgtgattttccatgcttccatcacttcccatgcaggttatgcatgtcaggagtattttatcaggcacgtagacggatgtgctttagatactgcaagcgagaaggaaagagtaatgaaatgcttagaggcagccatagaacgccgggtttgtgaggggattaggctagagttgtgtgcagacaacagagttggattgctctcagacataaccagagttctccgagagaacggcctcgtcgtcgttcgagcagacgtagaaactcacggagagaaatcggtgaacgctttctatgtgagggacatatcagggaacgaggtagacattgaatatttcagcaactcagtgaagaaggaaatgggtccaatcgccactcttcatgtcaagaatgatactaacagaagaaaaccaaactcacctaaacaggcccctctttcatttggaggcatgctaagatctcggattgaacgtttttctcatggcttcattctatga

SEQ ID NO: 55934 - DNA, 660 bp, Glycine max
  Peptide Sequence Number=SeqID_172712
atgtaccggttccctttatctttcagaatatttttgcaacattcgaagcatattagcatttcaattggcagaccacatgagaactgtccatcatttaacaacttgtatatgctagatggacaacaaatatccatatcaagtcctggatttatctatgaatcctatgaacctcgtgagaaaatcccatttgggaagagatggttcactagaagtggttggagaagaacaaaaaatgacataattcttgagcttaaaagtgcctatgctattgcaaagttaagaaaaaagggttattcaaaaaatcagttctacaatgaggctgccaatatgtacaaggagtcttccatgtgcttcattatttctgtcagccaagatagtgccacatttgcaaaactggctggcatgccaacatctttgcttctggggctcatgtttgttggtgttgcactatttcctactgacaagataaacactctaatagctaaaggtgacaaaagaacattaaggaaagcagttactgagaatatgttttctattggagttgatcggaaagacctaaataaaacatttattcagcttactcttgagattttggctaaacagaaatttgaagcatatgactcaaaaggttctgtagtagctggagataaaagcaaggag

SEQ ID NO: 55935 - DNA, 435 bp, Glycine max
  Peptide Sequence Number=SeqID_172713
atggagattccacgtaaatatcacttctctccaattctctcgctgattctactttccttaatcattgtcgtgctggtgctgcgttcacgtcagttactggaattcgcgccaatcgccaccggttcaaaacctccgtattccgttcctctggatcgtctccgaacgaagctctccggcgagaatccgctccacgccgtcggaaactccggtgaacttcgccggaacaaattccgcaaccgaactgctacgaggaaggtaggaaaactagaacaaagactcgcggcggcgagagctgcgatgcggaaggttgcgtcggaatctgaagatgagagaggcaatctcagtgtggcaaacaccgcgcgtgacggcgacggcgaccaccgctacgtccctgccggagctatctatcgtaacgcccgcttgttttatcggtaa

SEQ ID NO: 55936 - DNA, 738 bp, Glycine max
  Peptide Sequence Number=SeqID_172714
atgactaatcacaactacaagcttcatcccaattcaccccccaccattatgcatatgcatgttccggattctcctccaccgccaaatcagattggctttattgaagatgttggtgaagggattgaagggttggtgacttgcactaaaagtcttgctagtttccaaagcattgatgttagcggtgaaatcgatgataatgacaataatgatgatgaggaggatgaagataattgttggaggaaaacaagggtggcagagggtagaggaaactttcctccaccactttcgtcgttgaatgggaacggacaacctagtttcattcttgtaccagtaaggaaaaatggaaggttgcaactcaccaaagtaagaataaagagacctaaaattctctatgctacccgacaagatggacgattgagattgctccttgttccagatcaatgtgtagaagataatgcacaagaagaagagcatgaacaagaactagtagatgacacagaggaagaagacatgaggctagtagaatcaatgggggaagaggaagaggatgatgaagtcgttgaagagattattagttatgactctgaggagaaagatgttaggattggagagttgaagtttcctaacgaaaggtctaggaagtgtcatgaagttttgaatcatattcaaagccatcatcatcatggtcatgggagtcatcaccaccacctacatatgtatggatttagcattgcgtga

SEQ ID NO: 55937 - DNA, 1350 bp, Glycine max
  Peptide Sequence Number=SeqID_172715
atggccaatcataaactagattatcatttatgggacaagaagaaaaaccaagctaataaatcgaagaagaagcttacaattgcagaagctttaaattttgaatctcatatgcagcatgccaatcccaatcccaatcccaataccaataccaataccaatgccaattcgaggtccaaaagagctaccaagagacaagcctctctattttcttgttattcttctgcccatgacttgaggcatttggaattggagaaagagaaagaagactcatcatcaccaagagaagtcttggaagccttcatgaaagacttcgttgactctcatcacgaacaatcacatgaatctgaaaccactagttcaaccacgaagacacactatcactggaccaaattcttcaaactttggaagaaaaagtcttttaagcgcctaggttccatccctcctcttagtgtgccaaagctaccaaaatggaaaagcaaaagcagcagagaaaaccaagctctaaaaaatataattggaagaggtggttttgctgaggtttacaaaggctgtctccaaaatgggcaattaatagctgtgaagaaattgactaaagggaccacagatgaaaaaaccgcaggctttctatgtgagctaggtgtaattgctcatgttgaccatcctaatactgcaaagctagttggatgttgtgtagaaggagaaatgcttcttgtctttcaactatctaccctcggaagcttaggatctcttcttcatggttcagataaaaacaaattagattggagtaaaaggtataaaatttgtcttggaatagctgatggtctcctctatctgcacgagtgttgccacaggcgaatcattcatagagatattaaggcagagaatattctgctcacggagaattttgagccacagatatgtgattttggacttgccaagtggttaccagaacaatggactcaccataatgtatcaaaatttgaaggcacatttggctactttgctcctgaatatttcatgcatggaatagtagatgagaaaactgatgttttttcatttggggtcctacttttggagatcataactgggcgtccagcggtggatcatatgcagcagagtgttgtgatatgggcaaaaccattgcttgataaaaatcatatcaaggacctcgttgatccttctcttggcgatgattatgaacgaggacagttgagctgtgtagttttgactgcatcaatgtgtattgagcactctcctatcttccgcccccgcatgagtcaggcaagtacaccacgacctagattgatgcacattattagttcattcaaactgaaattaccatcatattaa

SEQ ID NO: 55938 - DNA, 2374 bp, Glycine max
  Peptide Sequence Number=SeqID_172716
atgcagcctgtccctgaaatatcagaaggctgtgaaggatttagagcatcacatcctttactcttggttgttgcatgtgataaatcaaagatccctggtaaaatgctaaatgtcagagatggccataatgaaactcaagcggaaaacattgtcagctcagctacagcagttcggttttactcactaaggtcccatacttatgttcatgctctgagatttcgttcaactgtctacatggttaggtgcagtcctcgaatagtggctgtgggtctagctactcaaatatattgttttgatgctcttactcttgagaataagttcagtgttctcacttaccctgtgcctcagttgggaggacaaggaatgattggggttaatattggctatggtccaatggctgtagggccccggtggttagcttatgcttcaaacagctcattgttgtcaaacacaggtcgcttgagtcctcagagtcttactcctcctgctgtcagcccatcaacatcacccagcagtggaaacccggtagcccgatatgccatggaatctagcaagaatttggctgcagggctgatcaatcttagtgatatgggatacaaaacattgtctaaatactatcaagatctaatacctgatggatcctgttctcctgtatcttcaaactcaagctggaaagttagtcgatttgcatcaaattctacagaaacagatccagctgggatggttgttgtcaaggattttgtttctagagctgttgtagcacaatttagggctcatactagtccaatatctgcattatgttttgacccaagtgggacactcttagttacagcctcaattcatggcaacaatattaatatatttcgaattatgccatcctgctcaaggaatggatcgggttcacaaagcagtgattggagctattcacatgtgcacctttacaagctccaccgtggcatgacatctgctgtaatacaagatatttgttttagccattacagtcagtgggttgccatcatttcctctaagggaacttgtcatatttttgttcttgccccatttggtggtgagacagttcttaagatgcacgatcaagacactgatgggcctgctctgttgccaatttttcctctgccatggtggttcactccacatttcacagtaaaccagcagcagtattgcctgacacccccacctcctgttgttctttctgtggttagccgaataaaaaatagtaatgctggatggctcaatacggttagtaatgctgcgtcttctgcggcagggaaagtctcaatcccatctggtgctgtttctgctgtctttcatagttccattccttataattcacacaatgcatactcaaaaattcatgccatggagcacttattagtttataccccttctggtcatttaattcaatataaactactgccaccattggtggcagagccaagtgaaactgcttcaagaacagccccagttccttcagcacagatacaagaagaagatttgcgtgtgaaggttgaacctgttcaatggtgggatgtctgtaggagatatgattggccagaaaaagaagtgggcatattggggaatactgttgttagactggaagctgtggaaatgatcttggatagttcagattatgaagataataatagtgtcgggaacaataattctataaaacttaataatgagcaatgccacttctcaaatgtagaggtacatataagctctgggcggataccaatttggcaggaatctgaggtgtctttctttgtgatgagtcattcggaagccggagagctgaatttatgtgaacttaatacaagtggagaaattgaaatagagaatattcccgttaacgagattgaaataaaacagaaggatctgttgcccatctttgaccatttccatagaattcaatctacttggggtgacagaggtattgttatgggaagatgctctagctcttcatctgattcacatggaactgaagagaagttgtcagaagatgctgcaattttccattcaaagttgatggtacctggcttagctgaaaagacatttgttgatggtgcaagtgcaaagttaaaatcatcaaaacatgaaaaagccggtgacagtttcaattcaagcttaagtggctgtgatttgaatatgaatgtcactcgcgaggagtcaataagtgactcaccagactttgagcaatgttttcaagaaggttattgtaaagcatcagttgactgtcgtgaatcaacagaagttattactgatgtggattgtagcagtccctgtggcagggagaaatctgatgaagatggtgataatgatgacatgctcggtgatgtatttgacttctctgaagaag

SEQ ID NO: 55939 - DNA, 387 bp, Glycine max
  Peptide Sequence Number=SeqID_172717
atgatgacatccttcgcaacatcattgaggccttgcaacagaacaaagacaccaaacctggttactcttataggggtggtgtgcttctctacaaaggaagtatttagtggtggctcttggggcttactacaacctctaaacattcccaaccagatttgggaagaattttctatggatttcattactaggctccccaaatccaaaggatacactgcaattcttgtggttgtggattgtctgttaaaatacagtaacttcatcccattaaagcatcactacatagcaaagacgctggctgagattttcactatggaggtgatctgtttacatggagttatggcatccattttgagtgacaaagatcccatctttgctagtggtttctag

SEQ ID NO: 55940 - DNA, 273 bp, Glycine max
  Peptide Sequence Number=SeqID_172718
atgggaatctcaaagctattcccagttcaggtcgcactttggcaagaaacagttggaccgggtgactttgagagagacctttgcacaaactcgcccaccggaagtggtaaaactttggcctatgctcttcccatcgttcaaaacttgtccaccgacaccgatggccgcctccgtgctttggttgtaatttccacccgcgaccttgctttgcagttgtggcatgttgtttatgttgggggagatataaggcttaagaagaaaaagttgtattaa

SEQ ID NO: 55941 - DNA, 570 bp, Glycine max
  Peptide Sequence Number=SeqID_172719
atggaggaagaaaagcagcagccaagtgtggcggttgtgccatggatgcgccaccctgtcgacatcactcgctgtcaagaactccctgtttgtagtgttcctttgatgaaacgcaggttacagtcggtactggaggagaacatgggaatctcgaagctgttcccggttcaggtcacactttggcaagaaacgattggaccgggtgactttgagcaagacctttgcataaaatcacccatcggaagtggcaaaactttggcctatgctcttcccatcgttaagctcgtcttcgacgcctttgcatcactgttgggtctccatatttgcttggctactggtcaatctttgcttcgccacgagctttctagcctcatttatctacctggagaagacgacggtccaaatcctggatttttgtctccgttgtggttccaaagcaaggtcgacatattggtagcgacccctgaaaggctagtggaccatgtcaacaagttgtcgttgaagcatctttgttatgtcgtggttgacgaagcagatcgatttaaacctgcatctactaatatactataa

SEQ ID NO: 55942 - DNA, 651 bp, Glycine max
  Peptide Sequence Number=SeqID_172720
atggaggaagaaaagcagcagccaagtgtggtggttctaccatggatgcgccaccctgtcgacatcactcgctatcaagaactccctatatgtagtgttcctttgatgaaacgcaggttacagtcggtactagagaagaacatgggaatctcgaagttgttcccggttcaggttaagcgtgtcttcgacgcccttgcatcattgttgggtctccgtatttgcttggctactgatcaatcttcgcttcgccacaagctttctagcctcatttatctacctggagaagacgatggtcaagatcctgggtttttgtcttcgttgtggttccaaagcaaggtcgacatattggtagtgacccctggaaggctagtggaccatgtcaacaagttgtcgttgaagcatcttcgttatctcatggttgacgaagcagatcgattgctacgcgaggactaccagtcctggttacctactgtgcttaaattaactcaatctaggctgacaaagatagttttatctgctacattaactcgagacccaggaaggcttgctcaacttaatttgcatcaccctttattcctgagtactgggaaaatgcgttatcgactcccagaatatttggaatgttacaaactggtatatgacactgcatag

SEQ ID NO: 55943 - DNA, 897 bp, Glycine max
  Peptide Sequence Number=SeqID_172721
atgccagagaagttgcacttggcatcaacaaccaagcctcctggcacactaagttgcatcactcctcgtcgtttttgctcagttttggggagaattattagggtggaccatgttgataagtataagaagaaggaggaggaggatgaagagacagagcgtcagaagagggaggcgcatggcgtttgccgtgctttccaaataggtgaatgcactcggggagctagctgcaagttttctcatgatgagcaagttaagcgtgtcttcgacgcccttgcatcactgttgggtctccgtattggcttggctgctggtcaatcttcgcttcgccacgagttttctagcctcatttttctacccagagaagatgacggtccaaatcctgggtttttgtcttcgttgtggttccaaagcaaggtcaacatattggtagcgacccttggaaggctagtggaccatgtcaacaagttgtcgttgaagcatcttcgttatctcgtggttgacgaagcagatcgatttctacatgaggactaccagtcctggttgcctactgtgattaaattaactcagtttgggctggcaaagatagttttatttgctatgttaactcggggcccaggaaggcttgctcaacttattttgcattaccttttattcctgagtgctgggaaaatgtgttatcggctcccagaatatttggaatgttacaaactgatatgtgaaagaaaggtcaaacccttgtatttggttgcccttttgaaatccctaggagaagaaaaatgcatagtttttacaagatttgtggaatcaacacatcatctctgcaaattgctaaatttttttggtgatcttaaaattggtatcaaggagttttctggtctaaaacatcaacagacttga

SEQ ID NO: 55944 - DNA, 1035 bp, Glycine max
  Peptide Sequence Number=SeqID_172722
atggctaccacggcaagggtatatattgtaatggaacttgtaattggtggtggaccactgcttgataaaattaacttctcacgcctaccgggacgaacatcgggaatgtcagaaaccaaagcaagacactattttcatcagcttatatgtgctgtggattgctgtcacagaagaggcgttatccatagagacctgaagcagtcaaatttgttgctggatgctgatggagtgcttagagtgtcagattttggaatgagtgcactgcctcaacaagctagacaagatgggctgcttcactcagcatgtggtgcgcttgattatatagccccagaggtgataaggaaccggggctatgagggtaaaaaggctgatatatggtcatgtggtgctattctgtttcatttagttgctggttatgtgcccttcagaaatgaatatgacgaccgcaatactaaaattagacagattctccaggctgacttcatctgtccctcatttttctcttcaagtttaataacactgattaggagaatccttgatcccaatcctactacacggattacaatgaatgagatctttgagaatgaatggttcatgcagaattatcagcctcctagatttttcaggcaaaattttagttttggtcatcgtgttgataagggggatgaagcagggtcttcagcaccaccagtgccagtcatgaatgcgtttgagattttgaatacatttctgggctacaaccttattattggaaagcttttaaaccagctggtacaacttaaaagggaaacaagattcatatcccaaaatcccgtggatgagataattgatggaatcgagcgtgttgctgggattatgggattcgatgttaagaagataaacaattttcggatgagtattgaaggaggggcaaatgctagacgcaaaggtcatctttctatattcactaagttctgcaggcatatatatgctgcgttgtcagattttatttggaaagggagagcagaacctatggatacagaaacagatggttag

SEQ ID NO: 55945 - DNA, 1686 bp, Glycine max
  Peptide Sequence Number=SeqID_172723
atgcaaaggtcacctttctatcgccattattcaggtgaagatttaattactaacgagggatgtttctactttctaagtaatgcagaacctttagatacaatcacaaatgctgatatacacttctcgcattcactttcagtttcactccttagcctggttataggagctagggtttatcgaggctttcgattcgttccttcctcgctgttacaacaatggcgaaacctgggcgaggtcgtcgctctccctccggttccgtttccggctcctcttccccctccgactccggttcctcctctcgctcgcgctccctttctcggtcccgttctccctcgcgctccatatcgtcttccccctcctcctcctcttcctcccgaagctcccgcagccgcagccctcccccgcagaggcgccgaaggtaccgctaatttagagattgatgaaacatttcattgctattttaaagattgcgccttattgaaatattttagtcccgcagagtatagagattgcgccgaagatatcgctattttagagattgcgccgaagctcccgcagctgcagccctcccccgcagagatctcattttatggtataggatcatttttgctgctattgtcacaattttatgaaggaaaccaagaggtggaagaacttctaaaattatatgcaagtgagaaatatattctcatggtgaatcagcagctggaagatttgagattttatgtttctttcaaggttggagctacaagtgtttcagtattgcgaagtgtgtggcatactttctggctaagagtttcacccggggaaggcacgggagcaacaatgtctgatgacgaagatgagcaagtaggtagtgatgccaatctgtttgatggtgctttggatggtcctgatagcatgggattcggtcctcttattcccacagagaatgagaggtccctcacggaacgtgtaagacctgaagtaaagcacgaattgaaacaggagacttgttgtgccttggtgacttgttggtcatgggttcgaatccggaaacagcctctttgcatatgcaagggtaaggctgcgtacaacatccctcccccataccttcgcatagcgaagagcctctgggcaatggggtacgaagtttttatatgtgtaatcaggagagccagagaggggtcttgtattgtggctacgaagactgagtcaaataaagttgcagggaatgccattttatatgaatgtgttcaaacaataatgagcattgaagataatggtggcttacatgtacttgccattaatatcctgggaagattcttgtcaaaccatgacaacaatatcagcacattgagtgttcacattgcaaagttccactataaaagccaaaagaaacacaaaaaattaagcactgtaagaggtctaagatgtctcctacaactagggaataatgttttgttacagtccaatgacttgatacaagaatctattgtgtttcgtgcgtttttactggctgctggaatccccaacaaggatgttctcctacggaagaaaagggctaggattctaaagccagctttcacagttatacgggataaagaatcaaaatgtttgcttgtgttcatccgtggaactcaaagcttaaaagacacactgacagaagcaatcggtgctcccgtgtccttcaatcatttcatttga

SEQ ID NO: 55946 - DNA, 657 bp, Glycine max
  Peptide Sequence Number=SeqID_172724
atgatgtccttgtcgaaaattttgatggccacgccgcgtccggtggtcacgtcacttgcaagcctcacgatggcggaggttgcgaaacccagcatgcggtataaatgcaagtttctcttcgactacgacgatccaaagctctggttccccgagcaaatacctcccaagtcggaatctcaaactccgacggctaccgccgccttggattgcgtctccgcaggtaagaaccaacatgacaagatatgcattctcgccatcgacgacggtggcatgcgcgagattctcatcggaaaagcccttacctactcggaagccacgctgaagaagaaatctaacgaccagaacgccaccatcacagactacttcgacgtggccattgagaaaggaaacaaattctaccacgcggaaggcggcgcaagcaatcgcaagttcttgaagaggttactttctggtggaggtttcggcttggtgttgtcggtgacggcgggtttggagaaagcggtgaaggaagcgttcacagcagagagtggcggtgggagttcgactctaaaggacactctaaaaccgattttgattctgtgctatgacttatcgagtatagcgccatttttgttctcacgtgcggacacgttgaaaatggatagcttcgacttttaa

SEQ ID NO: 55947 - DNA, 504 bp, Glycine max
  Peptide Sequence Number=SeqID_172725
atggcattcttgggagagacaagtagtcagacagttgtgaactccacattagatgatgctgatgttaacacaatgttaatgtgtaatcatgaattttcatttgttggtccgattgagttattatgtagcattgctagaaccccagatggtattttaaacttacttcaagctactataacccctactcatgatgccctgctatattacaatgggaggtggaacatgtcacgccaaaatgagtttgttggttactcgttcacaggaaaaaatctcaaaaagtttgacattccctccggatttaccatggatgaactgaaggatttgatcaagcaagttgcgcctactgggattcccccttatggtattgatgaaacacaaatggtgttgattgagtctagctactggaaaaagattgagccaatagaaattttagttgttttcagtaaacctgtaccgaaaatggaagagacgagttgtccttgtcgcaaaattaacatgagttaa

SEQ ID NO: 55948 - DNA, 360 bp, Glycine max
  Peptide Sequence Number=SeqID_172726
atggaaaactttgtttatgcaaattctatacgttatgaaatcagatcttcagcagcttccattcttagtggaacttcgtttttagatgtctacttcatatttaagaacttgtatctttgtgatgggtaccttaatggtagtgagatgtattcattttttaggaactgtgccaccaccaggaagctagcctttattgacccacactacattattgaacctccctcccaggccaacacacctcacactttggtcctcttcaccaatttcacgggatcctcgacaatagatttgaatctagagcttgtggaatcagactccacagcaaagacacatgaggttgtgacagcaaagaccctgtga

SEQ ID NO: 55949 - DNA, 282 bp, Glycine max
  Peptide Sequence Number=SeqID_172727
atggatcaaatacttacctttatgtcaaagggtcttctattgtgccaaaaggtcttctattgtatcgaagggtcttctctgatggttccttgccaaattctctggccgagacgtgttgtccaaaacatgtggatatatggcctagagggtacctggttggatgcatcaggtgtcctcttgatgcaatcctaccctgcaagggcattggatagaagactccaagaagattgggccagagatgcaagagaaggtcctagggtagatttcgggtccatgggctaa

SEQ ID NO: 55950 - DNA, 861 bp, Glycine max
  Peptide Sequence Number=SeqID_172728
atggagcaatcgactaaacaccacaacaaagacattcgtgtagaagaccagactgacgtgccttcagtgtgcgagaatgaccacctgcgagaagcctactggtcgtggcaacctgaggctaacccgccaaaaggaggaaaagttgagttaaccgcagttggcttacctagagctaccaatttaagcgcgacttttccttccaattggaagaacttgaccatcgagaagtatggtggtaccatagacccgaacgaacacctagacgtgcttatcacgcaggtgagcttgtacaccacggatgatgaaatcctttgtcagttcgctactagtcggcctcaccacctaacctttgtggccctcgtcaacatccaacaggaaaagagggaaccattatggaccttcatggaacatttcagaaaggccgagtacaagaaccaggtgcatgactctaacaaagcttgcaacgatggccttggccgtaaactttctagccatgccaaagagagccaacaccccaccaaaagtcgactactcaaaatgtggccgatatcaccgcaatcatggtcactcgacgaaggaatacactaccttaaaagccaaaatggaagagcttatcaagcttggccacctaaagaagcagaggaactgaagtttcttgagggagagagaggaaagacccctaaaccaattgaggcagatcataaacaccatcgttggaggtttcatgggggaaaggcaatcgacccagtgcaggatgatcccatggttattagtgttgagataactaactacatagttaagaagacccttgtagaccaaggaagctcgactaacatcttattttggaacactttcaaatag

SEQ ID NO: 55951 - DNA, 1149 bp, Glycine max
  Peptide Sequence Number=SeqID_172729
atgggaaacgcttgtgcaaaaggaaaaccagttgctcatgtctcttcctccaatttttctggaggtaagaagcatgcaagtaggccaaagcagtattcaaattcttctgaacaactatctgctccaataacttcagaattaaatgttcccaaatccttctccagtaacctaaaatccttcagcttgaatgatcttaaagaggccactaagaacttccggcaagaaaatttaattggagagggaggattcgggcgcgtcttcaaaggatggatcgatgagaacacatatggtcccaccaaaccaggcactggaattgtagtggccattaaaaacctaaagccagaaagcttccaaggccacaaggaatggcttcaagaagtgaattatcttggacagcttcagcatgaaaatttggtgaaacttattggctattgcttggaaggtaaaaacaggcttctggtttatgagttcatgcaaaaaggaagtttggagaatcatttattcaggaaaggtgttcaacctatggcttgggttacaagggtcaacattgcaattggtgtagcaagaggattaacactcttacattccctggatcaaaatgttatctttcgtgatttaaaggcttccaacatcctacttgattcggacttcaatgcaaagctttcagatttcggcttggcaagagacggtcccactggagataatactcacgtttcaactagagttttaggaactcaagggtatgctgcaccagagtatgttgctacaggtcatttgaccccaaggagtgatgtatacagctatggtgtagtcttgttagagttactaactggaaggcgcgcggtggaagacgatagacctggattttcagaggaaaccctggtggattgggcaaagccattcttgagtgataacagaagagttttgagaataatggatacaaagttggggggtcaatactccaagaaaggagcacaagctgcagctgcacttgcattgcagtgcctcaacatagacccaaaatttagaccacctatggtggaagttctagcagcattggaagcacttaattcctcaaattcatttacaaggacaccaaaacatgagagtcatgcaaccaaacaatctggtggcccttcacaaaagtaa

SEQ ID NO: 55952 - DNA, 231 bp, Glycine max
  Peptide Sequence Number=SeqID_172730
atggaaaagagggattcgtcatggatgtgcatatggattgacactgccaatggtgcttggtcccacaacatttatatggagcatggcatttttgtgggatgggttagagttgaggatgaggatactaaagaggacctaatactggaagactctaaagaagatcccgaggaagatctagaagaagatcttaagcacgaccccgaggaggatccttctaagggttccccttag

SEQ ID NO: 55953 - DNA, 684 bp, Glycine max
  Peptide Sequence Number=SeqID_172731
gttcctactattaaagctgagttacaacgactgacagaggacaacaacactctaagaatgatgcttcaagttctaagcagcaataccacctatgtttcatacaaacaacagagcgagactagatttgacttcatggaagacaaggctgacctcatcattggaaattacactgatggaaaattggtatcatccttaatggcttctagagctcgagttactcggggacacaacgtaaaaagcttgacggagagaatggctgaggaacaaaggaaagtgcctcagactgagggaatgcaggcgcgccgcgggtttacctcgtttaattttaatatttgtaatactacgagggttcctaggtcaaaagccatcgttgacttcattgtacctaattataagactgtcaccactagaatgaatgacgggtgctttttttgcacgtaccctgcatgggaagcgccagcagaactgacgacttcatgcatgtgcgacaagtggcaagttctggaggaaagcgcaaacctcattggcgatttcacgtttgaattgcaagacgccattcccgttagcgctttgactgcagcagggtcaggcagcagcagcagcgtcaggcagcagcagcagcagtgcagggctagccataggtgcagggaaacgccattgccattggcgtttcctgcctcctga

SEQ ID NO: 55954 - DNA, 1722 bp, Glycine max
  Peptide Sequence Number=SeqID_172732
atgaacccgctaacactagtgaagcgcactcagaacatcaatgccagagaagctgcacttggcatcggcgaccaagcctcctggcacaccaagtacaaggattccgcttacgtcttcgtcggtggcatccccttcaatctcaccgagggtgacctccttgccgtttttgctaaatatggagaggttgttgatgttaacctagttagggacaaaggtaccggaaaatccaagggttttgcgttccttgcgtatgaggatcagagaagcacgaatcttgctgtggataatttgaacggggcacaggttttggggagaattattagggtggaccatgttgataagtataagaagaaggaggaggaggataaagagacagagcagcagaagagggaggcgcgtggcgtttgccgtgctttccaaagaggtgaatgcactcagggagctagctgcaagttttctcatgatgagcaagcatgccttattcatacactcgcggttctgccatggatgcgtcaccctgtcgacatcactcgctgtcaagaacttcctgtctgtagtgttcctttgatgaaacgcaggttacagtcggtactggaggagaatatgggaatctcgaagctattcccggttcaggtcgcactttggcaagaaacggttggaccaggtgactttgagcgagacctttgcataaactcgcccaccggaagtggcaaaaccttggcctatgctcttcccatcgttcaaaacttgtccaccgacaccggtggccgcctccgtgctttgattgtagttcccactcgcgaccttgctttgcaggttaagtgcgtcttcgacacccttgcatcaccgctgggtctccgtattggcttggctgctggtcaatcttcacttcgccacgagctttctagcctcatttatctacctggagaagacgacggtccagatcctgggtttttgtctccgttgtggttccaaagcaaggtcgacatattggtagcgacccctggaaggctagtggaccatgtcaacaagttgtcgttgaagcatcttcgttatctcgtggttgacgaagccgatcgattgctacgcgaggactaccagtcctggttacctactgtgcttaaattaactcagtctaggctggcaaagatagttttatctgctacattaactcgggacccaggaaggcttgctcaacttaatttgcatcaccctttattcctgagtgctgggaaaatgcgttatcggctcccagaatatttggaatgttacaaactgatctgtgaaagaaaggtcaaacccttgtatttggttgcccttttgaaatccctaggagaagaaaaatgcatagttttcacaagatctgtggaatcaacacatcatctctgcaaattgctaaattgttttggtgatctgaaaattggtatcaaggagttttctggtctaaaacatcaacgggtaagaagcaagacagtgggtgaatttcggagaggggagtttcaagtgcttgtatcttctgatgcaatgactcgtggaatggatgttgaaggggtaagaaatgtcattaattatgacatgcccaaatacacaaagacgtatgttcatcgagctggtagaactgcaagagctggccagactgggcgttgcttcacattgatgtcaaaagatgagatccagccttatgcatttgagccaaagaaagaagctacaatgagtttgtaa

SEQ ID NO: 55955 - DNA, 942 bp, Glycine max
  Peptide Sequence Number=SeqID_172733
atggagtttattctaatccaaactattgagtatgatcagcatccacagccacctggaagaagcattcaagattgtcaaaatgtatcatcagttgctggtaattcatcaaatttgggaacagctaatgtaatccaagattacaatgcttacacatcataccgaagttcttctaatccatatggttatggcagcatgggatactcaggctactataacaactatcagcagcaacctaatcatacctattcacagcctgtaggagcatatcaaaacacaggtgctccttatcagcctatttcctcctttcagaataccgggtcttatgctggatccgcaagttattcaagcacttattacaattctgctgattatcagactaccggaggttaccataacagcagcggatatggaaatcaagcaactatgtggaacagtggcagttatttttctcatcccacaggaaataattccacagatgaagtttcatctactttagggactaattccacaaatgaagttccatcttcttcaattagtcctgaaccaatagcaactacttttctaccagcatatactgatcacttaccatctcaaccagtggtatgttctaatccggtgatatttactccagcacctcctactttagtgcactccaatacaaaatctcatactttactggtcagacttgataatactcatccaatctatacaagggaaaaagttggtattataaaaccaactttgtttgtcactcatgctgaacctaagaacactatgtcagctctacctaatcctacttggcatgaacctaagtacactaagtcagcactatgtcttctactcactcagtccaaatacattagatatttattggcaaagactactatggataaggctaattttgtctcttctcctatggttggtggatacaaactaacttaa

SEQ ID NO: 55956 - DNA, 240 bp, Glycine max
  Peptide Sequence Number=SeqID_172734
atggccccaaagaaactcccttctaagagagctaggaagaccgctacaggagaaggatctagtacagctccacctgtagaaatcgaatttaatggatgccgctttcgaagcctactgaggaaggaattatggataagcgctccaaagtgcggggccaatggattccttatgaggaaggacaacaatgcgaatacactgagagaagaagtcaatttacaggtttggatgaagaggctatag

SEQ ID NO: 55957 - DNA, 288 bp, Glycine max
  Peptide Sequence Number=SeqID_172735
atggctgaggcgctcagtctcctcctccaattaaataatcaactaagtctgccatgtcttcatcatcctcagctcttcctccatctccttgggcagctccttgagcatttgcagccaaatgacgcatgtatgtgtgcatttggagctccatcttctgcaagtgggctgagatggactccaaggatggtggctagtgcggaggtggtggtggtgcatctgctgcttgctgatgttgctgatcgtgtcctggttgttgtacctgtcttggcatgcaatatttttcaataa

SEQ ID NO: 55958 - DNA, 411 bp, Glycine max
  Peptide Sequence Number=SeqID_172736
atgttttgttggtctaggtataagttagttgtcaagatggaacagaatagggagaaggcgaacttccatttttgggatgttgtatgtgtcaaaatatttggtaaaactgcagatgaatgtcgtcaagagttgattgcggaacattatatacagtcagtgatatccacgctaggtctacaggatgaacaatgtataagcaacaagtcactggctgttggtgctgcatcttcatcacaacaagattgccatcctacaccttcattgtcacagtcatctgaatatgatcctggaaatgctgcctttgtaactcctgcaaaaagaacgtccgatcagcaaggaagtagtcagtttgatagtgacgacttcgcaacatatgaactatcgaccaacaagcatataaaagctgagtaa

SEQ ID NO: 55959 - DNA, 519 bp, Glycine max
  Peptide Sequence Number=SeqID_172737
atgtcaacccctaattcatcaccatgtactgcaccacatacaactacaggttgtcaacctactcagattgggatgacttctcaacatataaattcaggaagatacacaatattcaattccaaactaatagagcacatctcggatgacactgatgacaaactcaatataacacagggagacattgttacaggttacatggatattggagatcctatttggcaatgcaagcaatgtaaagcgaagatgtggtatgatgagaggattaacaaagataaacagacaaaaaacccaaagttttcattatgttgtggtgatggaaaaatacaactggcaatactacatgatgctccgcaacccttgcggcaactactctttgacagcagagactcacaagcaaagaaattccagcaaaacatacgtttatacaacctaatgtttgcattcacatctcctggtgtcaaagtagacacatcctataatactagaaaaggtcctcctacattgcgcatacatggttaa

SEQ ID NO: 55960 - DNA, 291 bp, Glycine max
  Peptide Sequence Number=SeqID_172738
atggcctcctatggtgcttttggaaaagaacaacctatgcttggatacgaatttctatcaagaagtgcaatattctattgcaaaggtagtcctttggctttaaaagttatgggtgctagtcttcaacttagaagtaaagaggcatgggaaaatcaatttgaaaaattccagaagactaaaaatatgaaaattcatcgcatattaaaatcaagttatgatgacttagaaccatctgaaaaagaaatattttttgacatcgcatgcttcttcaaaggagaagagatttcataa

SEQ ID NO: 55961 - DNA, 300 bp, Glycine max
  Peptide Sequence Number=SeqID_172739
atggcgccgcagagggaaaagacaatgatggagaatggagagttgccaacgatggagaagaaggaggaagaagaaacgagcaatggcaccgcaaatcaacttgctgggtcgcacacggtcgcaaaaaaaggaggaagaatgagtcgcgggaagaagaaaagccaattgctgggtgcaaatgtctacatgaagatcttgaagaaccaaaaagcagaaccgccagcacttgtgctcaatgaagtccatggtggttgtgaaccaacacacgagagagaagccgctttagagacttgtccatga

SEQ ID NO: 55962 - DNA, 177 bp, Glycine max
  Peptide Sequence Number=SeqID_172740
atggggatgggagtggtttttgaagaagggatagagagggttgggaagttgccttcatctatcatgggttgtggtcaaacaagagcggtccagactctagaaactagaaagctttacgcagtgtttggtcacaaagcacgcttctctgatcaactcatcagagactcaccgaactaa

SEQ ID NO: 55963 - DNA, 1034 bp, Glycine max
  Peptide Sequence Number=SeqID_172741
tcgtggatgaggaagagggcatggttacaaaaccttgttggtgttgggtcatggatgggtggttcgagttcgacttgctagagttagcaacaaaggcactattgtcgttgctgatgcaaaagaataaggtggaagataacatttatggcgtttgtgattatactatgacggatttagtggattcgggggttagaggcttgaagcttttgcttgttggccatggcaataaggagtatctccagagattctatgcacaagaggcgtgccactggtggcaagaagaaggcatggaggaagaagagaaatttcctaatgttgttgctgaaagtgaaggatgtgtttgtattagatttttggtcgttttgattggtatgatgcatatggtagatctaggtgtagctgttcttcgggttttagtttttgttttgttaggggaaggggaaaggaaagggtatgagcttggtcgccagcctgctaacactaagctgtcaagcaacaagacagtcaggaggatccgggttagaggtggaaatgtgaagtggagggcactgagattggatactggaaattactcctggggaagtgaagctgtaactcgcaagactcgtatactagatgtggtttacaatgcctcaaacaacgagcttgtgcgtactcagactcttgtaaaaagtgctattgttcaggttgatgctgctccattcaaacagtggtaccttcagcactatggtgttgagattggtaggaagaagaagacagctgccaagaaggaaactgcagaggagggtgctgctgctgttgctgtggaagaagccaaaaagagtaatcatctgcagagaaaattggagaagcgccagaaagatcgtaagcttgatgctcacattgaggagcagtttggtggtgggcgtttgcttgcttgcatttcctctcggcctggtcaatgtggcagagctgacggctacattttggaaggtaaggagttggagttttacatgaaaaaactccagaaaaagaagggaaagggtgctgcttga

SEQ ID NO: 55964 - DNA, 243 bp, Glycine max
  Peptide Sequence Number=SeqID_172742
atggataggccaaagcgtttgtctccaagggagaaaacgagcggagtcgctaccaatgtttattcgaggaaaacgttagaaaaaaccaaaaggacgaaagtctgcgtatttttgaaaatgagggttcgggagttgtttacgcacgaggaagggtgttgcccttgctcctacgtatcctcaggtgcgatgaggaattcagacctacgtagttctttaagtctgaaagtttgtgtgttacactga

SEQ ID NO: 55965 - DNA, 522 bp, Glycine max
  Peptide Sequence Number=SeqID_172743
atggctcaaaaagtttggattttaagtggtctgctgctagaactgtggaaccataatcttcatatggcaggcatggagggaaaggatgatttggcattagtacaggcaagatgggcatttgtaaacaaggatgagaacttgcttacaagattgcaaaacatcaatttgtctttccactttgaggtggaacaacaggtgaatggtatcttcatgaacttctttggttttaatggaactgctggtgtctggagaataaaggcccttgaggagagtggtggttggttggatcgaactactgttgaggacatggatattgctgttcgtgctcatctctgtggatggaagtttgtatttctcaatgatgttaagtgtctttgtgaacttccagagacctatgaggcatataagaaacaacaacaccgctggcattctggtccaatgcaattgtttcgcttgtgttttcttgatatacttcgttcaaaggtattgaattcaacacatgttttctttcaattcttttaa

SEQ ID NO: 55966 - DNA, 252 bp, Glycine max
  Peptide Sequence Number=SeqID_172744
atgggaagacaaaaatgcatcctaagaatatgtggaagtgggaagaacatatggaagattgctcaagcaagatgggccaccaatgaaaatagatggaaaaagggtcttactgaggattatatgtgccttatgtgtggtggcaggatgaataatgttcttcattgcatatgcgactgcttgcatgcgaaggagatatggaaccacatggttccaaattttgctaacctctttttttttgcagaggatttataa

SEQ ID NO: 55967 - DNA, 960 bp, Glycine max
  Peptide Sequence Number=SeqID_172745
atgccgttgttgaacagatccggttgcgtgatctccactcctccgacgaagaccttcgccaaagaggaacgaaatatcaaactactgaaaattaccttcacgacggaggaataccttcgcggcggtgttgttcgtgttccgatgaagcgtatcggaggttacggtgatgcaacggcctggactcaaggtctcgatcttagtgccgaaagcgagtttccggagataatcgatggtgaagaggccgggaacgatgtgttcgcggaggaggtttggaacggagcacgagaagcatgtgcggagagaggcgtcggagggagcgaagatagtggaaggaccggtccaggcaacggaaccagtggtagcggcgtcggagagagacggcgcggccgtcgcgagctcgtggaagccgagggagcgaagggagcttcgaatccttcgatggtggcggtgaccttggggctgcagagtatggcggcgaaggagacggcgcagaggagcgcgaatcgtcgagagaaagatgagttttccatgcgcgcgagtgagagtgagagtgagggagagggagagaacggagcggttttgagaagttcgttacgggaatattggggaagcgtgcttgttagttacgtggtcgttagagctcacaatgataataagaatccattggttggaatcggtattggggttgtgacggcttgtgtgatgggtttaactgcattggatgcggacgccacgagaatcgaatactacgcaacagtgggagagcctttctgtgagtacaactatgtaagtctggcctcggttcactatactgcgagattcgctgatgggatagtatttgatagcagctataaacgtctagacctctcaccatgcgcattggtaatcaagggactggatcaagggattttagggggtgaaggggtgggaaatgcaaactgcagattcctctgcacttag

SEQ ID NO: 55968 - DNA, 510 bp, Glycine max
  Peptide Sequence Number=SeqID_172746
atggccgaagaggaagctaaggaaaagaagagtaaagacttaacactaaaaccctccataccatctagtaatgagagtgatgaagaaaatgcaaaaggttttgagagcgagaatctaacattacttgttagaaagtttaagaaattcttgaaaaagaataattctaaaggaagattctttcaacaaatgaataattttaagaagaatgactcaacctcccctaacttcacttattttgagtgtggcaagttgaactacataaaatatgaatgctccatccacctaaagaaacaacaagggggagaaaagaagggaaggagttataacaagaagaagacgcgggagaaaaacgacacttcaagtcattctaacaatgaagaagaagaaaacctctgcctcatggccaatggagaagttgaaagcgtttttctcaatgccttcaatgagatgcatgaggaagctcagaaattatctcttgccaataacttccttaagccacatgaaggataa

SEQ ID NO: 55969 - DNA, 1335 bp, Glycine max
  Peptide Sequence Number=SeqID_172747
atggaaaactcatctttctctcgacgattcgcgctcctctgcgccgtctccttcgccgccatactctgcagccccaaggtcaccgccaccatcgaaggattcgaagctcccttcgctccctcaactcctccaccgcctccgcccgatatccacgatcactcgttcttctcccacaccgctatccttcctccgatcttgtctcacctcggcttccacgagctcgcgacggccgcgccgtctctctccgacgccgctaccactggttccgttgcctggaccggtccttccactatcttcgctccctccgacgcctctctccgcacatgcttctcgtgctccgttccaaacctcctccgcgaacacatcgttcccggcctcttcaccatcgattatctccggaaactcgctttcggcactaagatcgagaccttgagtccaggccgttgcatcaccgtaacctccgatacgcttcatcggaacacgaacaacaccgccgcgaaggtcttcgtcggaggagtggagatcacgcaaccggatctgttcaacaacggcatggtcgtagttcacggccttcaaggttacgtctctccgttatctccgttctcttgcgacgtggagaggatgaactcgctctcgtttccgttccatccagatcaccgatccggtcacgctcagcaccatctccaccactccaacagcgccacggtgcagcctgctgctatgatgcgcctgatgctccgagatgcgatgctgaggctccgcaacaacggcttcggcatcctcgccctcgcgatgaaggtgaagtacgcggagctcgtgacgctcaacaacatgaccgtgttcgccgtcgacgacctctccatcttctccggttcgcacgcgtacatcggcaacgtcagattccacatcgtgccgaaccattacctctccatcgcagatctcgagaagcttccggtcggaactgctctgccgacgctggagagaggccagtcgctgctcatcactacctccggcagaggagagaccttggcgccgatgaggattaactacgttagggttaaggtcgcggatgtgattcgcaacgtgaagatcgtggtgcatagtgtgtatttgccgtttccacatattaatcctgtggctgcggcttatgacagtatcttaggcggtggtgaaggagcgtcggaaggagcggggaatattgcagattctgcagatcagacgacgcaagggacgtgttctgtcgttgacgggcgtggaagttgcgtcttgcctacgatgcctgatcaggttcaggtcaagccaatggtggagatcgaagaccaccatggcctgtga

SEQ ID NO: 55970 - DNA, 1332 bp, Glycine max
  Peptide Sequence Number=SeqID_172748
atgtctcgcactcccaactacgagttccaggaatggtggaacaagcagcgcgaaaagaacaccaataccaacaacctcgaccccctcgacgacaaccttaaaaaactcgagtacggccactcctctccgccgccgttcacggcgctagacgtggactcctccactgccgcgaactccgccacctccgaccacgaccgctccggcaggaaagaacgctcccgaagcgcacggcagctcacatgggtctgcctgttgaaattccagcagctcgctgcgtccctcggctggctctcccacggcctccttttcctcctccgcaccgcccaccgccggatcaccgactccgcgtcgttccgcggcgacacctcgcgcctctaccgcgcgatccgtttctttctcatcacagtcctcctactcctagggttcgagctcgtcgcgtttttcaaaggctggcatttcagccctcccgatccgagcgacgttttgggcgtcatcggcgtcgtttacgccgcgtggctcgacgttcgcgccacgtatctatctcctccgctgcagagcctggcgaatctgtgcaccgtattgttcattgtgcagtcggtggacagggtcattttgatcttagggtgcttctggatcaagtttcggaggctcaagcccgtggcgagtgtggattacgatggcccggggcagagcgtggaggattttccgatggtgttggttcagattcccatgtgcaatgagagggaggccgaaattctgccttataaacacaccattgcgccatatggctccaccatggcgagacttccttcacaatttgcctatggcggttggcaacaaatccgccacgccattcccccattgcggggccatagccactatcttggagtcatgagagtatggatgtttgctgtcacatttttagcgagattggctcaggtttaccagcaatccattggagcagtttgtatcctagattggccaaaggaaagaatgcttgtacaggttcttgatgattctgatgaagtagatacccaacagcttatcaaggcagaagtgcataaatggcaacaaaggggtgttcggataatatatagacatcggcttatacgtacaggctacaaggcagggaatcttaaatcagcaatgaactgtgattatgttaaggattatgagtttgtggcaatatttgatgctgatttccagccaacaccggatttcttaaagaagacagtgccttatttcaagggtagtgcttttgactacggcagtgacttgttgcaatctttggagacagaaaacaaagttctagaaggtgattcaatgatctag

SEQ ID NO: 55971 - DNA, 318 bp, Glycine max
  Peptide Sequence Number=SeqID_172749
atggatcatattctgcacttcctctccttagagcttctcaaagagctagacatggacgctctcttcgtctcgcagtacctccacctaagcttctcccacatcactccaacccccaatttgattctccaaaccctaaacctctcccctgaagttggccgcattgacttcaaggccatgcataacgtcctctatgccgcctcccccgccgctggccctaaaacactagcctccgtgatcaattgcctcatccgcgtggttcagttcttcgagcgaatggagagagactatgggatgaagggtgatcatcataatgcgtga

SEQ ID NO: 55972 - DNA, 390 bp, Glycine max
  Peptide Sequence Number=SeqID_172750
atggtggtcaatggccataaccaagtttgctggctcgtgacctgggctgccctttatggaaacagcctccctggttgtggggataactctggattcaataaggtggaagccttgtgcacagtgcaacctttttaccaccttcgtttggcagttttatttagtgtgtttttggttaaagtttataaacttaagtttgcaaaaatatcccaagtcttctcccaaactcagttttcaggcaaaaatttactctcaaacatacttttgagagttacgacacctgaaagtgaggataaaatccagaactcttccgattctgaagatgggcttccacctcttgaaaagaacatgaatcatttgagcatagccaatagtgatgaagagagtgaatag

SEQ ID NO: 55973 - DNA, 306 bp, Glycine max
  Peptide Sequence Number=SeqID_172751
atgacgcgtggtggtaacccgggatcgttgaatcacaacatcgattttatgaccgtctttgaagggcgacttttctacatgggttgtctagctacaaccgatgtagaatgggtaggtttctacagcggttctaaggctgaaaccgatgttgaatggataggtttctacatcggttatcagtcaactgatgtagaaaatgaaaggagatctaaaacctattgcggggaggctatagggggagagcaagccaaagtggtgcaaggtgatctatgcacaaactactcacattttgagagtttggcataa

SEQ ID NO: 55974 - DNA, 894 bp, Glycine max
  Peptide Sequence Number=SeqID_172752
atggcatccattgccttcctgtatgtattttttttacgtattttacttttgcttctctctctctctctctttttctatgatttgggacctgcagtgacacccactattgatcagaacaattgccatcttgaaaaggctttatcacattggtgtatatttcaccgaagcaaagcagagctggtagtgggaacatggaataaacaatttcacaattcagagaaggttcagcgagtcccccttctgtatcttgcaaatgatatcctgcaaaacagcaaacgtaaaggaaatgaatttgtgaccgagttttggaaggttcttcccacagcacttaaggatgttcttgagaaaggtgatgatcaagaaaaacgtgcagtatttagactggttgatatatgggaggaaaggagagtgtttggatctcaggctaagagccttaaaaatgtaatacttggagaagaagcacctccgcagttggaattcaacaaaaagcggtcccgttcagttagaattgtgaaaaaggattctcgttccattaaaacgaaattgtccattggaggtacagcagaaaaaatagtctcagcctttcatacggtgcttaatgaacattccaatgaagatgcagagatgagtaaatgcaaggcagctgttcatcgtgtgaggaagatggaaaaaaatgttgatattgcatgcactgttgtaaaggaccctaagcgaaaaactttgtccaaggaactagtggaggaagaaaatattttgaaagaatgcattgaaaatctcaaattagttgaagcaagtagaacatcacttgttactcgcttaaaagaagctttgcatgagcaggcaagtcattatgtccatgaatctgagctggagaatgttcgcactcagattcag

SEQ ID NO: 55975 - DNA, 159 bp, Glycine max
  Peptide Sequence Number=SeqID_172753
atggtgctaagcgcgccttcgaggaaatttagcattgacaaatgtactgtttccttggaacttgatagagtagggctagataattgtagtgctagacaaagtgtgcaaggttctagtttttattatgttgtgcttataatgctgtttaaatcaagctaa

SEQ ID NO: 55976 - DNA, 331 bp, Glycine max
  Peptide Sequence Number=SeqID_172754
atggctccgaagaaactctccacgaagaggtctagaagagacgccgcagcggaagggttcagtgccacccccgagtttgatagtcaccatttccagagcgccgagcaccagcagcgcttcgaggccatcaaaggatggtcgttccacagagagaggcacgttcagctcatggaggatgagtatacgaactttcaggaggagatagctcgcagacgttggacgtcgctggtgactcccatggctaagtttgaccttgaaatagtcctggagttctatgctaatgcttggcccacagaggagggagtgcgagacatgcgttcgtgggtgaggg

SEQ ID NO: 55977 - DNA, 276 bp, Glycine max
  Peptide Sequence Number=SeqID_172755
atgggaaaattagggttaccagatgtcttcgggaaaaccgtatttgatgagttcctcgttctcgtacttgtcaaggcccatgaagatggtgaaatcgccggcttcggggcgcgctttgaagtagaacaccatcgtgtcgcgttgcttcgctttgacgcacacgggaagaaagagagaggtgcggttagggttccaagacctgtcctttcctcgacacaaatcaaaattaggggtgggggattgctttcgctatccgaatcgctgcgaaaatcataa

SEQ ID NO: 55978 - DNA, 1419 bp, Glycine max
  Peptide Sequence Number=SeqID_172756
atggtcgagtttggaacgagaatgggatccatatggacggtgttgttttgttttgcatcggttttcgcgatcgtttctgcagaacgaagcattgtgaaaatggaagtgccgagattcaatgtcaccagccgagagcctcaacagagtttcctcaccaaagctttgaatttcttatggcaatctggagaatcagggtaccaacacgtgtggccggatatggaatttggatgggaaattgtgttgggtacttttgttgggttttgtggtgccgcgtttggaagtgttggtggagtaggcggaggtggcatattcgtccctatgcttagcctaatcattggatttgatccaaaatcatccacagctatctcaaaatgtatgatcatgggtgcagctgtgtcaactgtttactacaaccttaagctaaggcatcctacgttgaatatgcccatcattgactatgatttggcacttctcattcaaccaatgctcatgcttggcatcagcattggagtggtctttaacgttgtatttcctgattggattgtgactatattgcttattgttctcttcttaggcacatcaacaaaagcattctttaaaggggttgaaacatggaaaaaggaaaccataatgaaaaaggaggctgctaaacgacaagaatcaaacggttctggggctgtagtggaatacaaacctcttcccagtggaccagaaaaggacaccaaggaacaagagatgagtattattgaaaatgtatattggaaggagtttggacttctggtgttcgtttgggtttcattccttgcactacagattgccaaggaaaactatacgactacttgttcaacattatattgggtactgaacttgttacaggtcccagtctcagttggagtaactgcatatgaggcagctgccttgttcagtggacgtagagtaattgcttccacgggagaacaagggaaagatttcactgttctccagttaatgatctattgtgtctttggtgttctggctggtgtagttggtggcatgttgggactaggaggaggattcgttatgggtccactttttctggagttgggagtcccacctcaggtgtcaagcgcaacagccacctttgcaatgaccttctcctcatctatgtctgtcatagaatactacctgttgaaacgttttccagttccttatgctctttacttcattcttgtggctactattgctgcctttgttggacagcacattgtgagaaaactaattatcctattcgggagagcatctcttataatcttcattctagcctctacaatatttgtcagtgccgtctcgttaggtggagttggcattgtcaatatggtacacaagatccagaatcatgaatacatgggatttgaggatctttgcaaatacgggtcatag

SEQ ID NO: 55979 - DNA, 960 bp, Glycine max
  Peptide Sequence Number=SeqID_172757
atgccttccttagttgattttagatatgtctggaacatattcaaactggagaggggaataggggaattcagtgttatctctgaaaggattaaacatgtagcacaagcacaagtagaagaggctagctacatgcggaagcgacttgatgatgaagattcttcatataaagcctcaacttcaacgacttcagttactgatgtgaatacaaaatcagaagcagcaactaagaagtcagctgcagcaattgcagctgaggttgcagataagctaacagcttctacgtcatcgcagttaatcatgacttctgttctctcaacatttgcagcggaagaggcaaaaagtgcttgtctaacttctgagaccatgtcaaaacctgagaagtcaatacctatatcagatccaaatgtttttatgacttcacaacagttaattgccacaccaaatcattcatatccttcggttttggtacctcaacccaccttgcagaatccagctgctgcatcacagggtcaatatcaaatgctttgtaattcatcctcccagcattatttgcaatcaacaggaggggtcatttcttcttatggttatggtagcatcgcaccattaccattggggccacccccaccccatatggtgggtccaatggttcctttgacacatcagacaatgcaaataactcagcagctgcctacacctataggtcagcatcaaccaataaaaatgacacaacaagccccagcacctcctaatttccgaccacttcaactgccaggaatggtgtactatgggtgtcgttcaacttcaacaaaacaacagtccttatgcctctcctgtggtgttactgggaagaaggttggcacttggaggctgtatgttgaccatagaagctccaccaagcatgccgtaagggccaggttagcatgtatgatagtgtttgactgtagaaggtccaacatttaa

SEQ ID NO: 55980 - DNA, 423 bp, Glycine max
  Peptide Sequence Number=SeqID_172758
atgaacccccgcaacaacagtcatgccaacagatccaaaacccaacagtcctttaactctttccatataaattgtggtggtgaaagggagctaagtagtgaaggtatagtatatgatccagatttagatccatcaggagcagcaacgtctaaaatcatgggttcaaattgggcatttagtaacaccggtcacttcttggatgcccaaaaacctgtatcagaaacctatatccagcaacaaaataaaaccgggctttctaaactatatcaaaccgcacgtgtatcccccatttctctgacttattatggattttgtctggaaaatggagactacacagtattgctccattttgcagagatcatgttcactgatgacaacacatatagcagcttagggaggcgtatatttgatgtttacattcag

SEQ ID NO: 55981 - DNA, 378 bp, Glycine max
  Peptide Sequence Number=SeqID_172759
atgaaggatttcaatattgcaaatgaagcaggaggagttggaaagaatattacaagatcatttcctgctcatgtgaggaataactctttaataatccgattttattgggctggaaaagggacaactgctatcccatatggccctcttatatcagctatatctgtcactcatgtatcaaatgacactaatttattactcttgtgcaatacatgtactgaaacagtctctacaactacaagtggcagcatgtctacaggggttatagttggaatagtagttgctgcaattgttcttgtcatcctaatcgtacttgggtggagaatttatattgggaaaagaaattcatttggaaaaggtggattctctagaataaaataa

SEQ ID NO: 55982 - DNA, 732 bp, Glycine max
  Peptide Sequence Number=SeqID_172760
atggcgtactttcaaatttcggtcattgcttcacttgcttatttggtttaccaaatagatggttacgagaagtattggcttcgtcttgtttggggttttggtagtgagctgagcttttactatatatgtggagcactggtgttttttgtgttgcttggcctgtctgggtgctttattacttgttctgatccaagaattcgcagtgatttgggtcagccttgtcgagaaatatgtctttgttgctgtcaacctggagtttgtgctgatcgtcatttgcatggtactccttatatgtacggtactccttatatgtcgactgattgcaatgcatgctgtgagaattgtggaactgaatgctgtggttgcacttgcatgagaggttctgaggacgaagcagggctaccattattattcataatggttttgttttttctgtgtattagtggctacaatgataggacaacggatatggcagcgtcattatcacatacttgcgaaaaggatgctaacaaagaaatttacttttgtggacttgatgaaactcaggagcccaatgcagtgactggttttaagggcacagtagtgctgcaattaagtcacggccctaagatatggaaggtatattcaagaaaaggggaaagtgggaaacgtaaagttgtagggggagaggcgattatgctgagtgaaaattgggtggggctcaaagcagtagaagatgggaggtggttatga

SEQ ID NO: 55983 - DNA, 765 bp, Glycine max
  Peptide Sequence Number=SeqID_172761
atgatgttcacattgtggttgaggcctctgatacaaacctctgtttttttatgggtagtggcatctcattctccacaaggatgtgatttttctcagggaaaatgggtcattgatgaagcctccttccaccctctctatgatgcctcaagggactgccccttcattggatttgattgcttgaaaaatggcaggcctgataaggagtacctcaagtataaatggatgccctctggttgtgaccttccaaggtttgatggtacgaagttcttggagaaaagcacaggaaaaaagataatgtttgtgggggactccattagtaacaacatgtggcagtcactcacttgtttgctccacattgcagtcccaaactcaaattacacctttacaagtcaaatacaggaactttcggtgttctcaattccggaatatagaacttcaatcatgtggttgaaaaatgggttcctagttgatttggttcatgacaaagaaaaaggaaggattttgaaattggacagcattagttctggggaccagtggaaaaatgtggatgttttgattttcaacacctaccattggtggactcacactggacagtctcaagggtgggattactttcaagtggggaatgaattaataaagaacatggatcacatggaagctttcaagattgggctgactacttgggctaaatgggttgattctaacattgatccttcaaagactaaagtcttgtttcagggaatcgccgcttcccatgttgagtaa

SEQ ID NO: 55984 - DNA, 684 bp, Glycine max
  Peptide Sequence Number=SeqID_172762
atgcgcaaggataaggttacatcgcataacttacccccccaaaaaaaatcccaagactcggtgaggtttggagctctaaaacctgggaaaacaagcagcacaagccccgaacattttggaccgttggatccagatcgtagagacacagagcaccaaaatatagaaatatcagaggagagtgagaaagagaaagagagagagagaaggaaaaacacacaggtactgagaccgaatgctcgtaatttctcggccaataatcgggcagttcgggcagcgtcacaacacgtgaaatgctgcgttacgggctgcccaatgaggcagccggtcttcaccggaaagtcaagttttaaatcttcaagcattgatgccacacgtgtgaaatgcctcacccgtgtaatcgtactctccaaccatggtaaaaaacataacagaaaatggagttccacaaaaaaatatttgaaaggacaactcaaggatgttgacgaagtcagggaatattgcttgaaaaagagagagctggaaaacacatcagcctcaaaagattgcactggaggtgcacctagattgcactggagaggaatagatctgacaaaacgtgaaaagattaaaaaagatggctggagaaggtggtggcacgtggcagctttgatggtgccaaagaaaggtgggcttggctggcgatga

SEQ ID NO: 55985 - DNA, 801 bp, Glycine max
  Peptide Sequence Number=SeqID_172763
atggattttgtaataagtagtatacttctcttgttggcatgcattactatacacgttctctcaaacacaataacgagaaaacgaaaccacaataagcttccaccaggaccttcacctcttacccttttggaaaatctagttgaacttggcaaaaagccaaaacaaacattggccaagcttgctaggcttcatggccccataatgcgtttgaagctaggtcaactaaccaccatagttatctcttcaccggacatagccaaagaagtgttccaaacccatgatttgttattctcaaaccgaacaattccacattccacatctgttcacaaccatagtcacaacagcgttgccttccttcccatttcacctctttggcgagaccttcggaaaatatgcaacaatcaattgttctcccacaagtcccttgatgcaagccaaaaccttagacgcaaaaaaacccaagaactccttggtgatgtgcatagaagtagccttagtggtgaaactgaagagtacaaggttatagtcgagaatcttgggagagcaattgcaacgccaaacttggaggattttttcccgatgttgaagatggttgatccacaaggcattagaaggcgtgcaaccacttatgtttccaagttgtttgctatttttgaccgattgattgacaaaagattggagattggagatggcacaaatagtgatgacatgttagatatcttgctcaacatttctcaggaggatggccaaaagattgaccacaaaaagattaaacatttgttccttgaccgttcactatga

SEQ ID NO: 55986 - DNA, 582 bp, Glycine max
  Peptide Sequence Number=SeqID_172764
atggatcttattgttgctggaactgatacaacttcctacacgatggaatgggcaatggctgagttaatcaacaacccggatacaatgtcaaaggccaaaagggagcttgagcaaaccattggaataggaaaccctattgaggaatcagacattgcaagactcccatatttacgtgcaattataaaagagaccttacgcatgcaccctggtgccccacttttgctacctagaaaagccaacgtagatgtggagatcaatggctacaccatcccacagggtgcacaaatcataattaatgaatgggccattggaagaaacccaagcgtatgggaaaaccctaatttattttcacccgaaagatttttggggtcagagattgatgtcaaaggtcgacattttcaactcacaccgttcggcggtgggcgacgaatatgccctggcttgccgctagctatacgaatgttgcatttaatgttgggatcattaatcaatggctttgattggaaatttcaaaatggtgtgaacccagatattgacatgggtcaacccttgcgagctgttccatttagaataaacaaataa

SEQ ID NO: 55987 - DNA, 576 bp, Glycine max
  Peptide Sequence Number=SeqID_172765
atgctgggaaaatcaactttcgggttgtccatgtggttgcttaagtggttacccatccgacttgtggatcgattcttgctaatggtgtcatggcttctgctcggtgacacttctaaattaggattggataggccgcgtttgggtcccttagaactcaaaaacctttcaggaaaaacccctgtgctagatgtgggtacccttgccaagattaaaggtggagacattaaggtacgtccaggcattaagcggcttaaacgtcaaactgtggaatttgtggatggaaggacagagaattttgatgcaatcatattggcaactggttacaaaagcaatgtaccctattggcttaaggaagaagatatgttctctaagaaagatgggtaccctaggaggccatttccaaatgggtggaaaggtagaaatgggctctatgctgttggttttaccaaaaagggtctacttggtgcatccatggatgcaaagagaatagctgaagacattgaacagagttggaaagctggggcaaatcatagaactacttttgctcgttcacacttgccgcaaccaaattcataa

SEQ ID NO: 55988 - DNA, 735 bp, Glycine max
  Peptide Sequence Number=SeqID_172766
atggtccttcttcacctcccaaggttccctctctacctcgttaccttatctccctccctcactctccgagcctactccaaaaccaccctcttacggccacccaaatccactctcaccgcctcagaacccgccgagtttgtgaaaagcagcgtgaagactgaggattgtccctccgatggacttgctgagttcgctctcgttggccgctccaacgtcggaaaatcctcgctcctcaactccctcgtgcgccgcaagaagctcgccttaacttcgaagaaacctggcaaaacgcaatgtataaaccattttcggattaataatagctggtacctggttgatttgcctggatatgggtatgcatctgcaccgcatgaacttaggatggattgggaaaaattcaccaaagactatttccttaaccgctcaacgttagtttcagtattccttctaatagatgctagcattcctgctaaacaaattgatcttgactatgccagttggttgggtcagaatcagatcccaatgacattaatcttcaccaaatgtgacaagcggaaaaagaaaaagaatggaggcaaaagaccagaagaaaatgttaatgattttcaggatttgattcgaggtttcttccaatcagtgcctccatggatcatgaccagtagtgttaccaatcagggtcgtgatgagatactcctccatatggcccagctacggaactactggctcaagcactag

SEQ ID NO: 55989 - DNA, 1494 bp, Glycine max
  Peptide Sequence Number=SeqID_172767
atgggttacatccaccatggaagaaccggtctcaggcacatactcagattcagaaccgccaccggcgtggtctcaaactccggcagatcgcaatcgcgcgctgcattcccctcccattcccctatcctcggcaacgtgctttttttctcaacaggcgataaatacctcaacgaaattaccgcagaggtggaacgcgacaggcgcagggagcgaaacgagcgtttgcgcctcggcctcgacaccgccgacatcgacacggagtcggagcaggactacatgggcgtggggcccctcatcgcgaagctcgagaaggagatgctcaaggaatcccccgagctgaaccgctacgaggagcccaccgactccgacgacgactccgacgaggaaaccaaggacgaggcggacaagaagatgagtgacttcgagaagaaaagagacaagcacacggacctgctcaagaacttcatcgaagccgaaaccctagatgacgcgtttaagtgcatgaccaaaatagacaacttcgaaaacaagcatttccgcctccggtccgagtatagggttatcggcgagctcatgaatcggcttaaggtctcgacggagctgaaggacaagtttgttttgcagaacaaacttaatagggcgttgaggttggtgcgatggaaggaggcttatgatcctgataaccctgcgaattatggtgtgattcagcgtgagcagccgacggcggatgcgaaggaagaggctgagttcgagaaggagaagcagaagcagatcgaggagggagataatgctgatgctgatgatgatgatgagcaggagtttgatgacatgaaggagaaggataatgtactgatggccaaacttgaggctattgataggaagctcgaggagaagttggcggagctcgagtatacgtttgggaggaaggggaaggcgctcgaggaagagatcaaggatcttgctgaggagagaaatgaattgactgagcagaaaagaaagcctctttaccggaagggttttgatacaagattgatagacatgaaccgaacttgtaaagtcacaaagggaggacaagttgtgaagtatactgctatggtagcttgtggcaactataatggtgttattggttttgcaaaagccaaaggccctgcagtcccagttgcccttcaaaaggcgtatgagaaatgcttccagaatttgcattatgtagagcgacatgaggagcatacaattgcacatgcagtacaaacgtcatataaaaagaccaaggtttatctctggcctgctcctactacaactggcatgaaagccggcagatcagttgaagccatacttcatttagctggtttaaagaatgtcaagtcaaaggtcattggttccagaaatcctcataatacagttaaggctgtcttcaaagcactaaatgcgattgaaacgccaagggatgtccaagagaagtttggcaggactgtggttgagaagtatctgttgtga

SEQ ID NO: 55990 - DNA, 2622 bp, Glycine max
  Peptide Sequence Number=SeqID_172768
atgccgacgatcgacgagcttttggatgatctgggtcaggcgtcttgtttctccaagctcgatctgcgccagggatttcaccaaatccacatggccgacggagatatacataaaacagcttttcgaactctcctgggccattatgagtttcgagtcatgccgttcggcctcagtaacgcgccgtcgacgttccaatcggctatgaacgacacactcaggccttttctgcgaaaatatgtcgccgtgttcttcgacgacatacttgtatatagccccaacctcgacactcacgtctctcacctggactccgttttgtccacgttatcggataagcagttccttctccggcaatccaagtgccttttcgcccaatcccaacttaactacctcggccacattatctcggctcaaggtatcgcacccgacccagagaagatttccgctatgcttgcttggcccatcccgatttctccgacggctctccgtggttttttggggttaacaggcttctatcggaagtttattaagggttatgcggccattgcatttcctcttacttccctcttacgcaaggacaagttcagttggtccccggaggcccatacggccttcacggcccttcagcaggccatgattagtgcccccgttctagccaatcctaacttctcactcccattcatcatcgaaatagacgcatcggcgacggcaatgggtgcggtgctactccaagaggaccacccaattgcattctttagtaaggtcctgtgcccacggttgcagaaggcctctgcatatatacgcgagcttcacgcgattacttcttcggtccggaagtggcgacattacctcctcggcgccccattcaccattctcaccgaccaccgcagcctaaaagacttaatgacgcaggtcattcagaccccggagcaacagttctacttatcaaagctgctgggatatgactataccatcaggtacaaaccgggggctgcaaacgtggtggccgacgccttgtctcgcatgactccaccggaggccacgtgtttggcgttgacgatgccacacccccttttcctttccgaattacgacggacactcctccaggacccaaggtatgtcactcttttgcaggacatccaatccacgccggcgaaccacccagagttctccctccaccacgatcttattctccggaagaagcgtatttggattcctttcccttgcgttattacccaatcgttattggaagagttccacgcttctccaattggaggccattccggcacggccaaaactctccaccgtcttcaacaaaattttgattggcccaccatcagggcggatgtccgtcaattcgtggcccaatgctccgtatgtcagcaaacgaagtacgaaacccgtaagcccgctgggttactccaacccttacccattccgacatccatttgggaagatcaagctttagactttatcacgggccttcccccctcgcagggatttacggtcatcatggtcgttgttgatcgtttctcaaaggccgcgcatttcgctgctctccccacacaccactcggcctataaggtcgccgtcttgttcctcgacaccgtctgcaagctgcacggttttccccgtagcctggtttcagatcgtgatcccatttttatcagccatttttggcgggacctgttcaaacttagcggcacaaagctcaggatgagcaccgcgtaccacccgcaaaccgacgggcagacggaggtgctcaaccgaacgctagaacagtaccttcgtgccttcgtccatcaccaaccctcacggtggttccgcttcttgtccctggccgaatggtcttataacaccgccattcattccgggaccggtctttcgcccttcgaagtggtctatggccgcccaccaccgacggtggtccagtatttgcagggttcgtccaccattgaagccgtggaccagctgctgatctcccgacaggacttgcatacccaacttcaaaggcgcctccgcaaggtccaagattcaatgaaggcgtccgccgacaagcatcgccgtgatttctccgttgcggtcggcgattgggtctacgttcgactccgcccctaccgtcagacctcggtggctccgtcttaccataagttgtccaaacgtttttatgggcccttcgaggtcgtggagcgcattggcgccgtggcgtaccgactgttattaccggcatcctctcgaatccatcccgttttccatatctctctcctgaaaccccacaaaggtccattaccggcgactctggcgaccctcccctcggcgtctcttgatcatcaccctcttccgacgcccctacacatccttgattggaaattggatcattcgcttgaccctcccgccactatggtgctcgtccagtgggatggtctggctcccgaggagtccacttgggaacgctgggaagagctccgtcaagctcacaaccttgaggacaaggttgctttcggggatgggtgtattgatagcaatatcggtgggtgtatagatagcagtatcgatagcagcaataacagaccaaggaggattagcagaagacccaattacctaaaggagtatgtacaagcctag

SEQ ID NO: 55991 - DNA, 1692 bp, Glycine max
  Peptide Sequence Number=SeqID_172769
atgtttgcagttgcatattattccccggcggcctcgccaccactgccgccgtttgacatcactcctccgccgtcaccttcaatgtatccgactcctccagcacccccagtcaccccgccaccatctgcagtcacgccacttcctctgacggagccgttgttgccgtctccgtcgccggtatctctgccaccgccatttccactatctccttcaactccgaccgccgcatctcagccaccaccattaccatttgccacagcgcctgcaacgacaacgtttccgccgtttgcagttgcactatcacctccaactccaaccgccacttttccacctgcattgccagaaatgccttcgagaccgccggcgacagtggcgacggtgactgttcctccaccattcatgacggaacctacgctggtaacgccgtggtttcctgcgttgcagtcctcggcgccggaagtgaatttgccgtcaacaacacgaagtggaagtttgccggtggctgtgaatgttcagaagccttcaatattccacgtgtcaagtggtctcattgttgggtttgtaattggagctatcgttttcgtctttgtttttactgttggttcagtgctacgatggaataggaagaaaaacaaacacaagaatctatccacccctcactgtaaggaatcatctccctctcttggatccaaggggtctcatgttattcgagtgccatcaaatccaaagctgccaccacgacctctcactgagggcggtggagcttcttgctcttttaattcggtgtctgtgaaagcaattccaaataatgctccaagaggtgcctttggtcccgtgaatggtattttcacgtatgatgaattgttactggccactaaatgtttctctgagtcaaaccttcttggagaaggtgggttcgggtatgtgtacaaaggagttctcccatgtggaaaggaaattgcagttaagcagctaaaatcaggaagccaacaaggagagagagagtttcaagcagaggttgcgaccattaaccgagtgcatcataaacatcttgttgaatttgttggatacagcgataccagggcagaaagattgcttgtttacgaatttgttccaaataacacattggaattccacttacatggtaatccggcaattattcaccgtgatattaaagcatctaatatccttcttgattttaagtttgaacccaaggtttctgactttggcttggcaaaaatcttccctaacaacgatagttgcattagtcacctcaccactcgagtgatgggaacctttgggtatctagctccggagtatgcatcaagtggtaagctgacagataaatcagatctatattcctatggcatcatgcttttagaactcataacaggacgcccaccaatcacaacagcaggatcaaggaatgagagcctcattgactgggctaggccattgcttgctcaagcactacaagatggtgactttgacaatcttgttgatccaaggttgtggaaaagttacgaagctgatgagatggaaagaatgattacctgtgcagctgcctgtgtgcgccattcagccaggcttcgacctcgtatgagccaaatagttggagccttagaaggagtggtttctctaaccgatcttgttggagatgttacaacggggcttaccacagacacagtatag

SEQ ID NO: 55992 - DNA, 729 bp, Glycine max
  Peptide Sequence Number=SeqID_172770
atggaatatttcttgagagaaatagaaggaaagcaagcacacgacccgttgttcatgaacaacaacaagtcatcattgtcgtcatcgtcgtcatcatctttttccaccgtgtgggttcatgggcctgtgatagtaggagccgggccttcaggactcgcagcagcagcatgtctcagggagaaaagtgtcccaagcgtgatactagagcgatccaattgcatagcatctctatggcagctcaaaacctatgatcgcctacgccttcatcttccaaagcaattctgcgagcttcccttcatggggttcccttctcacttcccaacatacccttcaaagcaacagtttgtacagtacttggagaattacgcggagaggttcgggattaggccgaggttcaatgagacggtgcagcatgcggagtttgatgcgaaactcgggttatggcgggtgaagagcgtcgacaaggcggagaagacgacggagtacgtgtgccggtggctgatcgtggccaccggagagaatgcggaggcggtggtgccggatatagaaggggtggaggaatttggcgctcctataaaacacacgagcttgtataagagtggggaagagttcagagggaagagggttttggttgtggggtgtgggaattcggggatggaagtgtgcttagatctttgcaaccataatgctactccttctcttgtggttagagacacagttcgtacataa

SEQ ID NO: 55993 - DNA, 321 bp, Glycine max
  Peptide Sequence Number=SeqID_172771
atgggagttaaagttgtgacctcaaatgttcccattaagcctcagtttgcaaccaccaagagtgtgaattatcttccgaacgttggtgcgtttgtggccatttggtttgatagtgatgggtttgttgctgaagggcctagcatgaacgtggcttttgtctccaaggagaatgagtttgtgatgcctctacgtgacaacattctaagtggctgcacggctaagagagttttaacccttgccgagtctttggttaaagagggtaagctttgtgggataagaatgaaaaatgtgaacgtggaggaagggaaaaaatgcagatga

SEQ ID NO: 55994 - DNA, 480 bp, Glycine max
  Peptide Sequence Number=SeqID_172772
atgtgggcctttcatacagggcgtcaacttgactgggcacacttagtcagatatcgcatgcataaggcattgcgattaaatgctccactaccatatccacagcttgtcactctctttttccgccattttcaaattcctcttgattctgaaccttatgttccaatcaagcgatcttttttaattggtgctgctatgattgcttcttttggttaccacaaagagcgtgatggctcttgggtcaaaaagggtgttccacctgctgatgatgaaggccacataccagttgaagataattccactcttcttcaaaggcttatggacaagtttgatgccatggaattgcaagttgacatgcggttcgatgctatggaatcaaggatcactagggttgaagaagatgtctccttcatccgaacttgctttgatccaccaccaccgcctcctcatcctcttagattatatgttattattctaacttag

SEQ ID NO: 55995 - DNA, 141 bp, Glycine max
  Peptide Sequence Number=SeqID_172773
atgtcctggaaattgaggacgattaatccaaagtttgctcaaagcccgcaggcgttgaaaatattcccccaaagcaagcagaaatcgaccagtctgacgtatgatgatcagcctgtttcacatacagtttactttagttag

SEQ ID NO: 55996 - DNA, 369 bp, Glycine max
  Peptide Sequence Number=SeqID_172774
atgaaggaggtgctgagtgaagatttgattgttgagtttctagaagccttctgtctttttgatagagatggagacggctgcataaccatggaggaattagctagtgcacttagaacactgaatcaaaataatcctaggaaggaagagttgcaaatcatgatgaatgaagtggatatggatggcagcggaaccatagaatttgggcagttcttgaatctcatggccagacaaatgaagttgttatctgtgatgagaaatattggagtgaaggtcacagaagaagagctggagcatatgatcagagtcgctgatttggatggtgatggtcgagttaattatgaagagttcatgaggatgatgactatttaa

SEQ ID NO: 55997 - DNA, 141 bp, Glycine max
  Peptide Sequence Number=SeqID_172775
atggacccttatctgatacgaagtgcttctaccaacataccccatgtcccacgaccttcaataccctgttctcacccttggaaccaattgcaggaaacttcatctagtgctatactagccatggaaaatcaagacgagtaa

SEQ ID NO: 55998 - DNA, 1435 bp, Glycine max
  Peptide Sequence Number=SeqID_172776
caagaacaaggcaaagaaattgccacctggtcccagagggttgccaattttgggaagccttcacaagttgggaccaaatcctcatcgtgacctgcaccaactagcccaaaaatatggacctgtcatgcacttgcgcttaggttttgtgcccaccattgttgtttcttctccacaagctgctgaactgttcctcaagacccatgaccttgtctttgctagtagaccacctcttgaagctgcaaaatacatctcttgggagcagagaaacttaagctttgctgaatatggctcttactggcgcaacgtgcgcaagatgtgcacgttggaattgctaagccacaccaaaattaactccttcagaagcatgagggaagaggagcttgacctgatggtcaagcttctgcgagaggcagccaaagatggagctgttgttgatctcagtgccaaagtttcaacactcagtgcagacatgtcttgcagaatggttttggggaagaagtacatggaccgcgacttggatgagaaggggttcaaggctgtgatgcaagagggaatgcacttagcagcaactcctaacatgggagattacattccttacattgctgcacttgaccttcaaggcctaaccaagcgcatgaaagtagttggcaaaatcttcgatgacttcttcgagaaaattattgatgaacacttgcaatcagagaagggtgaagacaggacaaaggattttgtggatgtcatgttggactttgtcggtactgaagaatctgaataccgcattgaacgccccaatatcaaagccatattgctggatatgttggctggttcaatggatacttctgctacagcaattgagtggacgctttcagagctcctaaagaatccaagggtgatgaagaaagtccaaatggaattagaaactgtggtgggtatgaagaggaaggtggaggaatcggacttggacaagttggtgtatttggacatggttgtaaaggaaagcatgaggctccatccggtggcaccgttgctcataccacaccagtccacggaagattgcatggttggagatttgttcatacctaaaaagtcaagggtgatagtgaatgcatgggcaattatgagagacccaagtgcttgggatgaggcagagaagttctggccagagagatttgaaggaagcagcatagatgtgagagggcgtgacttcgagctgataccatttgggtctggcagaaggggttgtccaggattgcaattgggtctaactgtggttcgtctaacagtggcacagattgtgcattgttttgattggaaactaccaaaagacattttgccagatgacttggacatgaaagaggagttcggactcacaatgcctagggccaatcatctacatgccattcccacttatcggctttccaatgaaagggattag

SEQ ID NO: 55999 - DNA, 198 bp, Glycine max
  Peptide Sequence Number=SeqID_172777
atggatttccatgacccaatctcatgggaagcaatcagtgaaggagttgtggcttctgggacttctgctactattacaggtggctgtgaaaagcagggtaaagcagggtcagtgaatgcaaggaagaaagtggtgagtcacaagaaagtgtttttgagaatgaagactacgtctataccaactccttgcctcagatga

SEQ ID NO: 56000 - DNA, 279 bp, Glycine max
  Peptide Sequence Number=SeqID_172778
atgtggctcgccaattggctacctcagctcaatcattttagggaagtaaatgagaacagaagcctccagcatgcctgccagtataaagatttagcacatgctgatatattccaagatgttagctcttactctgagctcctagtcattttgatgccccgaaggttgacttgtaaccatgacattaacatgagcagcatgtccatcctaaatctgcaatggccaacatcaaacgaaagatttaagtacatggagcaaggacccaaaacagtgtttcaataa

SEQ ID NO: 56001 - DNA, 3456 bp, Glycine max
  Peptide Sequence Number=SeqID_172779
atggatagttgcctctacctccatccaagcgagaacccaacagtggctcttgtatccccagttctagacccttctaactaccattcatggagcagatcgatgatgacagctttgagtgccaaaaataaggtgaaattcgtagatggaagcgtacctgaaccaccaaaaacagatcaaacgcatggtgcatggcatcgctgcaacaacatggtcgtatcttggatcgtgcattcggtatccacatccattagacagaatattctatggatggacaaaacggaagaaatatggcgtgatcagaaatcccgatactcgcaaggtaatctccttcgaatctatgatcttcaacaagaggcatcatcaatgaaacaaggtgatctttctattactaaatatttcaccaaattacgcattgtatgggatgaaatacaaaattttagaccagatcctgtttgttcttgtactgtgcaatgtacctgttctgctcttgccatcattgtgcaaagaaaactcgaagatagagcgatgcaatttctacgtggtttaaacgaacagtatagcaatgttcgatcacatattctgcttatggatccattgcctacgatatcgaagattttctcaactggacacacagagaatgtgtgttacaaaaagcatggccttccttccaattatgatgggagaagcaaagcaagcaatatcaaaaatggaaagacatgcactcattgtgggaaaagcggacacactgttgatgtacgttatagaaagcatggattccccctgggatacaggttttccaattcaaggaacactacaaacaacatagtgacagcagatagcaaagtcacagatgaccaaacgcagcatcacgagtctcaagaagttcatttttcacctaagcaatacggggcattacttgctttaatccaacaaccatctcatgggaactcagcgtctacttcgtctaatgtcaaacaagttgcctccgtttcttcatgttctattgatccagcatcaatcacgggtaaacctttgccttttgatacgaacactcaagcgaggattggtacagttgaagtgagaaacgggctttaccatcttaccccaaaccatatagcagcacacactgtacaatctgtcatcactcacccaaaatacatatggggaccatgttcaaagctttccttgaatggtcattgtcactttctcaccattgtagatgatcattctcgatttacctgggttcatctcatgcatacaaaagctgaagcacgtaaaaacattatagattttactgcatatgttgaaactcagtttaatagcaaaattaaaactataagaacttacaatggttttgagttttccatgcatgatttctatgccctaaaaggaataattcatcaaacaacttgtgttgaaactcctgaacaaaatggaatcgtggaacgtaaacaccaacatcttttgaatgtaacccgagctcttctatttcaggcaaatcttccacacagtttttggtgttttgctttacttcatgttgcatacttaataaactgcattcctactccttttctgcaaaacatatcaccttatgaaaagcttcatggtaacccttgtgatatttccaatcttcgtgtttttggatgcttgtgttacatcagtacactcaaagcccatagacaaaaacttgacccacgagctcacccatgcatttttcttggtttcaaacctcataccaaaggttatctggtctatgatttgcattcccacaatattaatgcatcacaccatgttgttgttttctacgaagaccattttccttctctccatgaaacacaaacttcccacacaaataattcttctccctctccagcacccttcacaaataatcataccatttttaagcctttcccttcacctgcttcttcctcactcgtacccactaaccacattgataatcatcaaccctcgaccttacgacgctcgtccaaagataaacaccctcctacctatcttcaagattatcatcgttttctcacttcaacgactgctactacctcgaccaacgttcggtatcctctcaactcaattttatcttattctcgtctttctccatcttatcgtcatttcattatgtccatttctgttactaccgaacccacttcctatgctgaagcttctcgtcatgattgttggcttaaagcaatgtcagccgagttacatgctctccaaatgaacaacacttggactcttactactctaccacctcataaagatgccatcggatgtcgatgggtatacaagattaagtacaacgccgatggcattatcgaacggtataaagcacgccttgttgccaagggctatacacaaaaggagggactggatttcttggacaccttctcacccgtggcaaagcttactactgttcgcttcctattagccctagcaaccctcaatggatggcacctacgacaactcgatgtcaacaatgcctttcttcacggcgagctcgataaggaggtatacatgcaacttcctcctggtctctctgttgataatccacacctagtttgtcgtctccagcgttccttatacggtctaaaacaagcaaacagacaatggttcactcgcctttcttctttccttctttctcatggtttccaacaagcctccgctaatcattccctcttcttaagcttcacaggtaattcaactactgcacttcttgtttatgttgacgatattgtcttaacaggaaacaacattgatactattcgtcatatcacaactcttctcgatcaagctttcaaaataaaggatctttgtactttaaagttcttccttggtcttgaagttgctcgatcccaacatggtattcacttgtgtcaacgaaaatacaccctagatatcctctccgattttggtatgcttggttctcgccccaacaccactcctatggactatgctactcgtttgcatgccacattaggtgatccgctatctgctgaagcttcatcttcctatcgtcgtttggttggccgcctcatttatctcacaaacactcgtcctgacatagcccattctgttcagcaattgagccaatacatggctcaccccactactgctcactcacaagctgcttctcgtgttcttcgataccttaagggtactcctggctctggtattttcttctccgccactggtcctctccagcccaaagccttcaacgattccgattgggcaggctgtcgtgattctcgacgctccgtcatctatctcgcccactccattatttcttggcgctcgaagaaacaatctacggtgtctcgcagctcctccgaagccgagtatcaagctttagcctcaagatacaacttgcgagctgcagtggctcacctaccttcttcaagatttccacatttcgtttgttcaatcagccattctttattgtga

SEQ ID NO: 56002 - DNA, 2502 bp, Glycine max
  Peptide Sequence Number=SeqID_172780
atggcttcctcttcttctctactcttacttgagctcaaatttcttgcgccgcaaattacccccaaacgacgccgttctctctctagattttgctctcagaactccaggtacaatgttgctctccgtacgcgaatccgcgccttcaaggaagaaggtgccgtcattgacagagtgaacgacgtgaaatggagcggaaacggagttgccgcgagcgaatacggtgctaacggctccgttaacggttacgcgaacggcgtctcgggcgttagggagagtgagaatgcgaatggaagcttggtgaagtacgtgaacgacaatggcaatggcaatggtgtagcggcggaagtggttgaagattctgcagaagcgtcaaagcggatggaagatggaagaaagaagaggttggaggagattggtaaagaggaggcctggttcaaaaagcaaactggggaagcaccaattgaggtggcagttgcacctggaggtcgctggagcaggttcaagacttactcgatgatccagaggacgttggagatttggggattcgttataacgtttatcttcaagtcttggctgaataatcgcaagttctcatataaaggaggaatgacagaggaaaagaaaacctcaaggcgaaaggcccttgccaagtggctgaaggagagcattctgagattaggtcctacatttatcaaagttggtcagcaattctccacaagagtggacattcttccacaagaatatgttgaccagttgtctgaacttcaggatcaagttcctccatttccctcagagactgctatagctattgtcgaagaagaacttggaagtcctttagcaggtgtcttcgatcattttgagtatgaaccaatagctgctgcaagtcttggtcaggttcatcgtgcaagattaaggggacaggaggttgttgttaaagtgcaaaggcctggtctcaaagctctttttgacatcgatcttaaaaacctgaggattattgctgaatatcttcaaaaaattgatcccaaatcagatggtgcaaagagggactgggttgctatttatgatgagtgtgcctctgttttatatcaggagattgattacaccaaggaagctgctaatgcagaactatttgcaagtaactttaaaaacttggattatgtgaaagtccctacaatcatctgggattataccacgccacagattctgacaatggagtatgttcctgggattaaaataaataaaatacaagctttagatcaactgggtcttgaccgcaaaaggttagggcgatatgcagttgagtcttacttggagcagattttatcacatggattcttccatgctgaccctagcattagtgattcttttggattgtctagtaactgcatctgttacccgaggtacaagaaacaatgctgcttgtgccacatagattatcatctgttgtcttgggaagcttccctagggcttattcacaagggcattagattagaacatcctggaaatattgcagttgatgatgtcaatggtggaagattgatcttttatgattttggaatgatgggaagtatcagtcaaaatatccgagaaggtttacttgaagctttttatggaatttatgagaagaatccagataaggtccttcaatcaatgattcaaatgggtgttcttgtcccaactggagatatgactgctgttaaacgaacagcacagttcttcctcaacagttttgaagagcgtttggctgcacaaaggagagagagagagatggcaacagctgaacttggattcaaacaaccattaagcaaagaggaaaaagtaatgaagaagaaagaacgtctggctgctattggtaatgcacctggtctatgcaagtttggttggatggaatggatcattcctattcccatgcttggtgaggatttattagccattgcagcagaccagccctttcggtttcctgctacattcacatttgttgtgagggccttctcagtgttggatggcattggaaagggccttgatcctcgttttgatattactgagattgccaaaccttatgctctggagttgctaagattccgtgaggcaggagttgaagttatcctaaaggcagtcacgaacttgttcctccatgacttcagaaagagatgggacagacaatctcaagcattttacaatttatttagacaggctgatagggttgaaaagcttgctgaaatcatccaaagattggagcaaggcgatctaaagctccgagtccgaactctggaatctgagagggcattccagcgtattgccactgtccagaagacaataggaaatgcaatagcttctgggagcctaataaatcttgcaacaattctgtatcttaactcaattagggtgcctgccactatagcatatgttttctgtgcaatatttggttttcaagtgctctttggcattgtgaagatcaaaaagctagatgaacgggaaaggttgattacagggactgcataa

SEQ ID NO: 56003 - DNA, 1047 bp, Glycine max
  Peptide Sequence Number=SeqID_172781
atggatgttaaagctgcacagaggttacaactttcagcggtggttcaacccgaaaggtttgggagaagaccaccattcagtacatgtcgtttgggtgtgtctcgggaaccgcagagccttcgggtttttgtttcgccaatgatgatgcggcgcagaacaaccgctttggaggtttcctcttcttacgacaacatttcagcttcaattttggaatctgggagcgttcatgctcctcttgatgaagagctgattctaaagaatagatcacaagagacccagccatatttaaatggacgctgtatttatcttgttggaatgatgggctctgggaaaacaacagtggggaagataatgtcgcaagtgcttggttattcattttgtgatagtgatgcattggtggaggaggaggttggtggaaactctgtagccgatatatttgagcaacatggtgagactttctttcgtaataaggagccactctctggtgcctttttcttggtaacaacaagcttaaagcttagtaagctttggcttgagggggaagtgttagaattatgtgcagttcatactgaggtgttgcataagctatccctgctgcatcgacttgttatttctactggtggaggtgctgttatgaggcccatcaattggaaatatatgcacaagggggttagtgtttggttggatgtaccagtggaagccttggcacagagaattgcagctgtaggaactaattctcgtccccttctaaactatgaagcaggggatccttacacacgggcttttatgcgtttgtctgctatttttgaagagagaggtgaagcatatgccaatgccaatgccagggtctcattaaaaaagatagcaataaaactgagcaaaagagatgtgtccgaattgtctccaactgatattgcaattgaggcgctagaacaaattgacaactttttgaagggtgaaggaggcgacatagacactggtgaacgaggtgttgtaatccgagttcggttgatcaatttatgtatgccttcctctaaagagggatga

SEQ ID NO: 56004 - DNA, 780 bp, Glycine max
  Peptide Sequence Number=SeqID_172782
atggcgccgaagataacacgtaaggttagcagaaaccctgaattgataaggggaatcggaaagtactcgaggtcgcagatgtaccacaagaggggcatttgggctatcaaggccaaaaacggtggcgttttacctcgccacgaccctaaacccaagcctgaagctcctgctgaaaaaccacccaaattttaccctgctgatgatatcaagaagccccttgtcaacaagcacaaaccgaaaccagctaagctcagggctagcattactcccgggacagtgttgattcttcttgccggtagatttaagggaaagagggtagtctttttgaagcagcttccttctgggttgcttcttgtgactgcactagactctgcttttctgaaatgtactctctgctccacccatttctggtctggcttatgtttctcacttgcaacgtcaggtcctttcaagattaatggagttcctttgagacgtgtcaatcagtcgtatgttattggcacatcaaccaaagtagatgtgtctgctgttaatgttgaccagtttgatgacaaatactttgcaaaggaagcccagaagaagaagaagaagggagagggcgagttctttgaggcagaaaaggaggaaaagagtgtgttgccccagcagaagaaagatgaccagaaaactgttgactctgcattgataaaagccatcgggagtgttccagatttgaagacatatctgggtgctaggttttctttaaaggctggcgtgaaacctcatgagctagttttctag

SEQ ID NO: 56005 - DNA, 852 bp, Glycine max
  Peptide Sequence Number=SeqID_172783
atggtggcgctcctagtggcaactacatccgaccctgcttccatcaacccggccaacgcgcttttgggcatgcccgggtggaaacccggtccccatttccaggatgatatgaagagctatgtgaatgaaggggtgagggtgttggtacatgggaagagcatagttgcggaagatgagttggacaagaggtgggaagaagttactggggaggttattgatgaagtgatcttcttcagcaagcacactgctgcctccaacaagcctgccctgactgttcaccctattggagttcctcatttgcgccaaggcgatgttcccccccaaggcggcagacctggatgggcagctcttccaaatcctaggatggggccttggcttcgccttttgaaaaaccttgcccaagctcataatcttgtccctgaatttgagtttgtggctgctaaactccattctcaagttacactagaagctgcaagcagtagtactgaagactattggaagagacaggatgctgctcaagttatggcacagttagtatgggaaggacttggacttggaggtgtgtcagatgtaggaaactggagcagggagaatgataacaagaaaatccttcttgggataggtggtggacattatgcacctcggcatgtggatgtagtattgaaagataatgtatgggtgggtcacctactttctggatattcgctgccaatggaagatccaaaccagtcaaaaggagaaaaaaatgtggagattggtggaacatggagacagtctataaaagctgcatatgaagccacttattctgcatttcctggtggtgaaattcttgcacatctagaccacaagtga

SEQ ID NO: 56006 - DNA, 1887 bp, Glycine max
  Peptide Sequence Number=SeqID_172784
atgcccacgttgtggtgttgggttttcaccaacatgaaccttctgagtgatgcacagaagctgttcgatgttatgtctcataggaacctagttacttggtcttccatggtttctatgtacactcaacatggttacaatgtggaagcattggtgttgttctgccggttcatgagaagttgcagtgaggaatcaaatgaatacattttagccagtgtcgttagagcttgtacacaattgggtagtctcagtcatgctctccaggtgcatgcttttgttgttaagggtgggtttgttcaagatgcgtataagttaaaaccagtcacatggaccacaattatagcagggtatgcaaaacttggaagaagtgaagtatccttgaagttgttagaccaaatgagagggggcgatgtctatccagacaggggctttgacatggatgtttcggtggtcaatggaattattgatttttatttgaaatgtcaaaaagtgaagaaaggacggacgttatttaatcagctagaagataaagatgttgtttcatggaccacaatgattgctggttgcatgcaaaattcattccacggggatgccatggacctgtttgttgaaatggttagaatgggttggaagcctgatgcatttggtttcactagtgttctcaattcatgtggttcactgcaggccctagaaaagggaagacaagtgcacgcttatgctgtcaaggtcaatattgatgatgatgattttgtgaaaaatggtttgattgacatgtatgccaaatgtgattccttgactaatgcaagaaaagtcttcgaccttgtggctgctataaatgtagtatcctacaatgcaatgatagaaggatactcaagacaagacaagctggttgaagcattggatctttttcgtgaaatgaggctaagtttatcgccaccaactctattaacatttgtaagccttcttgggctatctgcatcattatttctcctggaactaagcatccaaatccactgcctgattattaaatatggggcttctttagacaattttgctggaagtgctctaatagatgtttattcaaaatgctcatgtgttggggatgcaagactagtttttgaggagatatatgacaaagacattgtagtatggaatgcaatgttttctgcagcaagtaacatagcaagtctgcgatatggtcagcagtttcacaaccaggtgattaagataggtcttgatgatgacccctttgtaacaaattccccactggatatgtatgccaagtgtggaagcatcaaagaggctcacaaggcattcagttccacaaaccaaagagacattgcttgttggaattccatgatttcaacatatgcccagcatggagacgcagcaaaagctcttgaggtccatgctggacttctagaccttggacttcatcactttgaatcaatgtccaagtttggaattgaaccagggattgatcattatgcatgcatggtttctctcttgggccgtgctggtaaaatatatgaagctaaggaatttattgagaagatgcccataaaaccagcagcagtagtgtggaggagcttgctcagtgcatgtagagtttcaggtcatatagaactgggtacacatgctgctgagatggcaatttcgtgtgatccagcagatagcggatcatatatattactttcaaatatttttgcatcaaaagggacgtgggcaaatgtcagaagggtgagggagaaaatggacatgagcagggtagtgaaggaaccaggttggagctggattgaagtcaaggaaggcaacgctaagcttgagtttaggtggacaaagactcaactaataggcagaattgttgattatgtgttaactggtacatga

SEQ ID NO: 56007 - DNA, 255 bp, Glycine max
  Peptide Sequence Number=SeqID_172785
atgtccatagtagaaaaattgcatctttcatcactttacttccttcaaagtttcaggggtacgggatgggtagaatatgatggttccaaaggaacgttcaaagaagcagttgagaagatttttggcaaaagcaaagagacggttgaggagagtgctgaaggagcagcaaaagtagttgaagaagcaattcataagacaacagaaaaggtgaaggagagttctcactctgagcatgagtctaaagcagaactttaa

SEQ ID NO: 56008 - DNA, 888 bp, Glycine max
  Peptide Sequence Number=SeqID_172786
atggatatacctcgtctgaaacttggaacccaaggcctggaggtttccaagttgggatttggttgtgcggggcttagtggagtgtttgacggccctgttcctgacgaggttgtcatctctctaatcaagtatgcattcagtaatggaatcactttctttgatacttccgatttttacggtccctacactaatgaagttctcgtaggaaaggcactgaaggagttgccacgagatcaaattcagattgcctcaaaatttgggattgtgaaagttgagtccaatgatgccattgtaagaggtgatcctgaatatgttcggtcgtgttgtgaggcaagcctgcgccgccttggtgtggaatatattgatctctattatccgcacaggattgacacaacagtaccaattgaggaaactatgggagagcttaaaaagttggttgaagagggaaaagtaaaatacataggattgtcggaagctagcccagacacaattagaagggcgcatgctattcatccaattactgctctgcaaatggagtggtccctttggtctcgtgaaattgaagatcaactccttccactttgcagggaacttggaattggaatagtaccattcagtccccttggccgtggattttttggtggtaagggggtcatagaaagtatacctgcagacagttatctggcaatccagccaaggtttcaggggcagaagctcgacaagaacaagaccttttattttaggatggaaaagttagcagagaagcatggatgtacaacaccacaacttgctcttgcatggcttcttcatcaagggaacgatgtggtacccatccctggtgagcgatttttccattttataatgtacatgtatgttaggaaacactag

SEQ ID NO: 56009 - DNA, 489 bp, Glycine max
  Peptide Sequence Number=SeqID_172787
atgacagcaaatgcagctttgtttttgttccaacgaacggggacctctcgtttctttctcttctttcgcattctcctatctgttgtttgtttcactctcatggaccgtcgtaaagagaaaaatggtccatggttatcggtgccacaatttggggactgggatcagaagggccaagtgccggactactcacttgatttctcaaagatccgggaaactaggaagcagaacaagacaaatatatccagggctagccttggcaatgaagaagagttcatggattcgacaacctccagcagcgtcaacactggccacagcagtgagcaccctcaaccgcactaccatcaaaccaactctccaactgtaagattcttgtcttcacaagcttcgctgttctttatttttgggaagctcttcaacactattactgttgatccacacaaatattgtagttacagtttatatgtagccagcaaatcttcatcagtatga

SEQ ID NO: 56010 - DNA, 2312 bp, Glycine max
  Peptide Sequence Number=SeqID_172788
atggattcttacttggcatcgggcttgcttactcagttacaaaatgtaccacttgttggaaatccgaatcaacctattgcttccatctcttcgaggttgcagcagagtggagatgataatggtcctaggggggctgaaggggaggaagtttcacagagtagccaggagtcagctaaagctggtcacttttcgtcagccagagagatgaggagtgttgttttacaaactggagaggaatacaaaccaaatgaaaaacctagtcaagcatcctgttcagagccatattacgtgtctctggatgaagtaactgcatcccttcaagacatggctggccaagggatttgcacttctcaattcattgaacagaaatattcacacaaacctagaaactccacaaacggggactgccagcttgatttacttgacttgacccatatttcctcaatggactttgggccggaatcatcacagttgcaaaatgatagggtagttcctggtgaaagtcacgacatggtgaatattccgtttcagacttcgatggggttaggtgttgcaacgaccatgggatctatatctgttaaaccagaacacatattgatgtctgatgatgaatgttgcagaatcctaatttcagaagcaataggtgatgaatgcttttcttctggagattataataaaggtgttaacatggttaacttgtcaggatgcacctcatttctttgtcagtcattaccatctgtccaatcagtagtttcttctactggtgataggttgacgtatacggtcgaacccaatcagttggttgggtctgaggatcagcagtttgtctccagaacacaggacaacataatttatgccaatgacttgtccagttctccttgtatccataggatagacagcacagaaatgcaagagccatcagatgttgtgaaagatgattcaaaattggtccctgtaaatagttttggctgtggatcagacgctaagcaaacttcctatccaacggatgaaaagccaaatgtgcctacagaacaagaggacacaggtgctctatgttatgaacctccccgctttccaagcttggacattcctttcttaagctgtgatcttatacaatctggaggtgatatgcagcaggaattcagtcccctaggtatccgccaatttatgatgtcttctatgaacatgaacctaactccttttagattatgggactcaccttctcgtgatgatagtccagatgctctgttaaaaagtgcagctaaaaccttcacaggtacaccatctatattaaagaaacgaaaccgagaccttttatctccactatcagataaaagaattgacaagagacttgagattgaaatgacatcaaccttgataaaaaacttttcccgattggatgtcatgtttgacgacaatgaaactccggtagcagatttgcttcctgcatcttcaatgcaaaagagggactctggtacctctgttgaaggtgataaagggagttgtcgacaagatttagttaaagtggaacgagcagaggataaaaagaagtctgtaattttggacgacaaaaaatcagaagacgattcgggtggtaataattctcaggataaagttaagcagcaacctcttgatgttgattctgagataaagaatgatgctagtgctgctgctgagattgtgcaacaaccatctgaaattttggttgaacatgatatgaatgatctgttactgtattcacctgatcaggagcatgaaagactttcagttgctgttacttgtgtacagtctatcagttcatcaggctcaggggagaattcgggtgatcacactggaaacgatggtggtcttgaaacatgtaacatatttggtggaacaccttttaggaaaagcattgaatcgccttcagcatggaaatctccttggctcattaacacttttttgtccagccccaggattgatactgaaattacaatcgaggattttgggtatttcatgagcccttgtgacagaagctatgatgcaatcgggttgatgaaacagatcagtgaacaaactgctgctcaatatgccagtgctcaagagattctaggaaatgagactcccaaggcattaccaaaagaggcgtccagaaatgacagggatggagaccaggaaaatatcgatgctcatgatcagcatgggaaccattctcagttggcttcaagtgctttggtggagcgacgtgtacttgacttcagcgaatgtggaactccggtcagaggtgatagcagcagcaaatcctcagctatgagcttctcaagcccttcttc

SEQ ID NO: 56011 - DNA, 189 bp, Glycine max
  Peptide Sequence Number=SeqID_172789
atgtgtattggcctcagacctcagtggatgccgatggagcctaaatcctttatgttgaagctcagcaatgacgatttgaaggaaataacagaggcgataccaatatctgaggtggtaggggatcgaaacattgagccttttatgcggtgctcgtggaagtttgctaatactccagcaaaccatagctag

SEQ ID NO: 56012 - DNA, 974 bp, Glycine max
  Peptide Sequence Number=SeqID_172790
gctggactcatttgcactttggagacgttgcagaatgccagctcgtgttcaatcactggagaaagttactgaaaattggagccgggttgaaagttactggagaaagcggatcaggtgcaagagcagatgaaggccaacatggaggccatgaaagaccaaatggccaccatgatggaggccatgttgagcatgaagaaataatggaaaacaatgtggttgcagttgccactaccagcgccaccactgaggtagatccgactcacccatcgggcctcaatccggtaaatccaccaatctcggatatggtaggggagggaggcaaagcgttaggaagtacgggtggcccccatttggtgcaagttcaaaacaagcattccttccacccatatggcttgcctcctaactatacaccacccgatgttgcacacactcccgatgagaatgtcaataactccacttccatactcattgagagccaacaacctcaatctgatcatgcacatgtccctcagcccataggggagacacatgaagcgcctcgagaccataatctaaccaacttcggacctcacctcgaatatgccactgaggggcaagcaattggtggtgtacccctgccaaacacattggggggccctcagtatcgctcacaaccacaactcttgcattttgccctggaaatattgccacctgctatggtagaaagggaaaaattcagtcatatagaggaaagactgagggccattgaaggaggcagagattatgcttttactgacatggcaaagttgtgcctagtacccgatgtggtcattcctccaaagttcaaggtatcgaactttgataagtacaaggggactacttgccccaagaatcacttgaagatgtactacaggaaaatgggggcatgcgcaaaagatgaaaaattgttgatgcacttcttccaagaaagtcttgttggggcagttgtcacctag

SEQ ID NO: 56013 - DNA, 192 bp, Glycine max
  Peptide Sequence Number=SeqID_172791
atgtgggatcggcacaagcttaaaggagcactcaaattgggcgtatttacccccaaggctagactccaaagagtccgtcaggggctctccctcttgattcaggaaaaagaaaggattttgggagaggaagaagggaaaacgaatttgagaggaagagagagcatagagatgtatcataaatataaaaactaa

SEQ ID NO: 56014 - DNA, 261 bp, Glycine max
  Peptide Sequence Number=SeqID_172792
atgttgcagaaccttacggattacgtaatcatcccttttttgccttccggaacgttacggaactttacgaattgcgcactaacacttccttttaatttccggcatgtcacggaacttcacggattgtgctacaatgcttttcttttggcttccaccatgtctcggaacttcacaaattgcctaacgatgggtgccaaatacctcgaagtggtcaaacgagggtcgcatcccaacaacggatggtccctagacgaaattagg

SEQ ID NO: 56015 - DNA, 351 bp, Glycine max
  Peptide Sequence Number=SeqID_172793
atgggggttcaaatagcaaccaggcccacttgggccttccaggatgttcctccagaaggcggttgcttctggaggaagaaacctagctcgcctgggcgagctcgaaaatccaagccgaggcgcttccgtaacgtttctgtaacgtttttgtgggttatttcgcgaagattttcaaccgttcttcgacgttattcgtcattcttcgttcttcaaccggcaaagtctaaggatgctccaaggactaccttagtacctaccatgacctctacatgtacctggtcacgtcttgacatgatcgatgcccctatgtgttcatgggatgcatggccaggatctcccaccctaagttag

SEQ ID NO: 56016 - DNA, 678 bp, Glycine max
  Peptide Sequence Number=SeqID_172794
atggacatttcacagagaaagagaactttgcttaagatcattgttcttggtgatagtggaaaattcagccagcagtataaagctacaattggggctgattttgttaccaaggaaatacaagttgatgataaactcgtaacattgcagatttgggatacagcagggcaagaaaggttccatagtattggggctgcattttatagaggggcagattgctgtgttctggtatatgatgtaaacatacacaaaacatttgatacactaaacaattggcatgatgagtttcttaagcagggagatatgaacgatcctgaagcatttccctttgtattacttggaaacaaggttgatgtagacggtggaaacagtagaagggtcactgagaaaaaagctagagactggtgtgcttcccggggaaacataccatactttgagacctctgcgaaagagggttacaatgttgaagaggcttttttatgcgttgctaaaattgcactagaaaatgaacacgatcaagacattgctagtgctacccaaatccaattcttgttagtctctaatattgttctgttcatggcagttattttcgaggaatctctgaagcagtttcagaagcagaacaacgaagtggttgtgcatgctgaagtaggatgtaagaagattaatgtgttttactga

SEQ ID NO: 56017 - DNA, 276 bp, Glycine max
  Peptide Sequence Number=SeqID_172795
atggcagctcggtctggcgagccaagacttacacctgaagtaactggctcacctaagagagctggttcattcaggctgaagtcttttgagggcccatgcgagtcagaggctagcttgggtgatctagggtccaaaaaacttagaaaaaagacccttttgcccctcctttttggtatctttcacattcctgatcaaaacgttgaacgatctcctgcagaagatattgaagtccctaaaaatgtaaagactgaagacattgaagtcttgaaaatgtaa

SEQ ID NO: 56018 - DNA, 2520 bp, Glycine max
  Peptide Sequence Number=SeqID_172796
gatgtccatgatagatttcgaactgaatcccattccgaggctgctgggcgctttaatgaacggttcttattatcacttgcttcttgcaaggcatgtgtggtcatggatgatgaactgaatatattaccaatttcatctcacataaggtctattaccccagttcctgttaaagaggactctgacgaactctcagaagcagaacaggacctgaagaaccttaaagaacaactaaatgaagatttccctgtagggccattgattaagaagtgttgcacattggaccagggaaaagctgtcgtgacatttctggatgcaattttggacaagacacttcgtagtactgttgcattattggctgctcgtggtcgtgggaaatcagctgctcttggtttatcagttgctggagctatagctgttgggtattcaaatatctttgtgactgcacccagccctgagaatttgaaaaccttgtttgactttatatgcgaaggttttgttgctcttgactacaaggaacatattgattttgatgtggtgaaaagtgcgaatcctgagttcaagaaagctactgtaaggatcaatatttacaagcaccacagacagacaattcagtatatactgccacatgagcatgaaaagctttcacaagttgaactgttggttgttgatgaagcagctgctattccactgccagtggtgaagtctttgctgggcccatatctggtcttcctgtcttctactgttaatggttatgaaggcactggacgctctttatcactaaaacttttgcagcagttggaagagcaaagccatgtgtctgctaagagcacaaaggacactggtcgtctgtttaagaaaatagaattgagtgaatctatcagatatgcttctggggatcccgttgaaagctggcttaactctctactttgcttagatgtttcaaacgccatccctaatattagcaggttacctccacccagtgagtgcgatttatactatgttaatcgggatacgctcttctcctatcacagagatagtgaattatttttgcagcgaatgatggccttatatgttgcatctcattacaagaattctccaaatgatttgcaattgatggcggatgctccagcacaccacttatttgtactgcttggacctgttgatgaatcaaagaatcaacttcctgatattttgtgtgtcatccaggtttcccttgaggggcagatttctcgtaagtcagcaatccaaagtttgactgatggtcatcaaccttttggagatcaaattccatggaaattctgtgagcaattccgagatacagtttttccctcactttcaggtgctcgtattgtacgcatagcggcacacccaagtgccatgaggcttggatatggttcacaagcagttgaacttttaattcgaattccagcatacgctgttttctgctgtaagcccactgccttgggacctggtggccttagctactatgaaggacaaattactcgtatttctgagattaatgttgaagataaagtacaggctccacgacttagagttacagaagctgcagagaaagtttcactacttgaagaaaatataaaacctagaacagatcttcctcatttgctagtacatctgcgtgaaaggcagccagagaagctccattacattggtgtctcctttgggctaactttggaccttttacgcttttggaggaaacataaatttgctcctttctacattggccagattccaaatactgtgactggtgagcatacatgcatgatcctgaaacccctaaacaatgatgaaattgaagctgatggatcaaatcagctgggcttttttagtccattttaccaagattttagacaacgatttgctaaacttcttgcttccacttttcgtggcatggaatacaagcttgctttgagaagtattggtagaggagaagatgaagtgcaaagcagagggactccccctcaagttagtaaatggatatcagtcattcccaacttgctagtaagttcttggaatcccgttgtagggagctccttggtgaatgcatttgccaattggacccccaaagggatcataatagatcccaaaatcaatttcaagtgccaagaccctacggagacctcgtctgataaatgtctgcagtcggtcagaggttatttatccccacatgatatgaagcgattagaggcatatgttgacaacctggctgactttcatctgattttagatttggttccaacccttgcacatctgtacttccaagaaaagctcccagttacattgtcgtatgctcaagcttctgtgttactctgcattggtctgcagaatcagaacatttcatacattgagatatacaataacaaaatccttatctcactagacagtgttatcaatggcagaacatggtggaaggctgaaattctgacacataagcacaccattgcactttatggcactgctgtggagacctcttcacaaattggctatggaagttggtaa

SEQ ID NO: 56019 - DNA, 1074 bp, Glycine max
  Peptide Sequence Number=SeqID_172797
atgaccatgaaactccagagagaattactgaatgctgatatattggttattgttgctgttacaaacaaggaatctgttgagtggattaataacaacagaaaaactattgaaaatgtaatatgccttgactcttcaccggatttgaaaaacaaattaggaggctatgatgttcccagtgaagtgagaggaagtatgtttggaaacttttttggaaattctcaatctgagaaagctaaagaatcatatgaagtagtgcagactgtatctgaagcatgggatcgacataattctgatgatataaggttctgtttgctggtactaatcaatgcttatataaggcccgttccagtattgaagaacttgagagctaaaggtttttctaccctgaactgtatgttgaagaactgtggtcgtcagaaaaacaactgtcttgagttggaagcagaaatccctgacaagccatatgtgcctccaatgatcaagttccgggggaagaacttaagttatgaaatgacagaagatttgtttgttggatggttggggagtttggaatggagctggcgtgttgtagcagggcagaacccagcatatgatcagtttccatgccaataccagttgttctataggggaaaagcaaaagggtcattttggtacgaaccagtattccaggtaaaaacattggaaggccaattggtttggaggaggaggaaatatagagtcagaagaggtaaggtacctggcacattctatttcagtgtattagataatggagttgtttcaaatgagttttggacaattgtggatgtggctgataatcttagttggggtttgttccattatcgtggtgctgctagagttgcaggacaatcttatactggggcagtacttgttagtccagatggagcatttccaaatgacagagagaggacaaagatagttgctgcactagacaaatgtgaaattaaagagtgggagctatatactgttgacaattgttcatgcatagatccacccctaggaattccggagggttcaagtttacataccatagtccaaattgaagttccaaagtag

SEQ ID NO: 56020 - DNA, 216 bp, Glycine max
  Peptide Sequence Number=SeqID_172798
atgacttgttcccaagatgcggacttgagagggctggcagctccgttgccaaccacagccaccatcctcaccggcggcgcggcgatctgctccgccgtcagggcggagaagacggttgtcggagggcgaaagcgagtttgtggtggtgagggaaaagagagcgaggcatggttgcaaattcagagacatgtaaacgtgattctctctctctcttaa

SEQ ID NO: 56021 - DNA, 153 bp, Glycine max
  Peptide Sequence Number=SeqID_172799
atggaggagtttgagactcaggtagcctgccccggagaccagccctcttcttctagagggggtggggcctttgtagcccaagagcctgacactgaggagccaccagcactagcaccaacaccatggcttgtttggtatgaaatgagtgtttga

SEQ ID NO: 56022 - DNA, 471 bp, Glycine max
  Peptide Sequence Number=SeqID_172800
atggcgtcagaacaaggcataggtctatgttcatcatcattggcgacaagtcccgtgaccagtctctactgtgtgcagattgtaaatctacactacatgcttagcaaggcacagattaagtccaggccaactgtgttatggtgttacaaggacaagcttgaactaagcagtcacaagaaaaagcgtagcaaacagattaaaaaattggtgcagaggggtctctatgatccggagaaaggtgattcgtttgaattgtttgtggcaagtgggggattaacttattgtttatacaaggattcagaaagagttcttggcaatacctttggcatgtgcgtgcttcaggattttgaggcgttgacacctaatctcctagcaagaacaatagagacagtggagggaggagggctggttgttttgctgcttcgttctctatcctcgctgaccagactgtacaccatggtgatggtatga

SEQ ID NO: 56023 - DNA, 261 bp, Glycine max
  Peptide Sequence Number=SeqID_172801
atggtggaaaatgggggaggagcttgccacccaactcgcccaggcgagctaggttgcttcctccagaagcaacctccttctggaggaacatcttggaaggcccaagtgggcctgaacctcacggattgcgtaacaatgtttccttttgatttccggcatgttacggaacttcacgtatcgtgcaacgatgggtgtcaagtacctctaagcgatcaagcaaaggttgtattccatcaaacaacggtccccggacgaaattag

SEQ ID NO: 56024 - DNA, 246 bp, Glycine max
  Peptide Sequence Number=SeqID_172802
atggagataaatcacaagtttggcgatcccagccgtatggctccgcctcctccaaggaagtcaaatagatcagccatgtcttcatcctcctgggcttcgtcctcgcctctggaatcggtgtctgttgacgtctgtgtcggcttgcaggactgcactggaaccctcttcagtcgcgaggagcttcttcagagccatttcctacgaagacatgtttgcaaaggcagggtacaaggaaattccatttga

SEQ ID NO: 56025 - DNA, 627 bp, Glycine max
  Peptide Sequence Number=SeqID_172803
tgtatgatggtgttttgagggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccaactctcagtccacctgggatgtatccaccactgatgacccagaggccttcatccagcaggtttcttggccaggagtccaaccctctactgatggggggcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 56026 - DNA, 237 bp, Glycine max
  Peptide Sequence Number=SeqID_172804
atgaagaatgaacgaagaacggcaaagaatgtccctggaattgatcacgaaaacgtggttgctgcccgagctgggttgcttccacctgaagcaacatccccctccagaacattcaagatgggcccagatgctagtacacccccttgtttgatcagtgcaccaccatttttgtgtttttggcttatttccttccgaaacatcgcgaaactttacggattacgcggtgatgattgttaa

SEQ ID NO: 56027 - DNA, 4577 bp, Glycine max
  Peptide Sequence Number=SeqID_172805
gaaaatggattggggcttgagcatcttttacatcggggacgggcattggctgcttttaaccaaattcttggccatagaattcaaaatctgaagtcagaaggggaatctagtacttcagctcatggacaaactaacattcaatcagatgttcagacacttctctcaccactaggacaaagtgaagagactctactttcatctgttttgccaattgctattatgcattttgaggattccatgcttgttgcttcgtgtgcttttcttatggagctatgtggtttatcagccaacaaactgcacgctgatattgctgtgctaaaacggatatctctgttctacaaatcaagtgaaaataatgaaaatctcaggcaattatcacctaagggatctgtgtttcatgcaatatcccatgaaggtgatgtaacagaatctcttgctcgagctttagctgatgaatatttgcacaaggattctcctgtaactggtactgagactgtaagtaaacaaccttcacgagctcttatgcttgtgttgcaccatttggaaaaggctagccttcctcggttggttgatggaaaaacatatgggtcatggctattaagtggaaatggtgatggaaatgagttaagatctcaacgaaaggctgctagtcagaactggactttggtaacaaatttttgtagattgcaccagcttccattaagtactaagtaccttgctgtattagctagagacaatgactggattgaatttttgtctgaagctcagattggaggatattcatttgatacagtagtccaagtggcatcaaaggagtttagtgatctgcgtctccgacttcatatgttaacagttttgagagcaatgcagtcaaagaaaaaggcaagcactgtattgttcttggattcactggagaaaggcagtgaaacaacctttcctgatgaaaacatgggtgttccagttgaactcttccaaatattagcagagtgtgaaaagcaaaaatgttctggagaggctctcttgaggaaagcaaaagagttgtcatggtcaatattggcaatggttgcttcatgtttccttgatgtctcttcattgtcatgcctgacagtttggttggaaattactgcagcaagagaaacttcatccattaaggtgaatgatatcgcttcccagattgcagacaatgttggagcagctgtaaatgctactaatgccttgcctgtcggtgacagagtacttacatttcattacaataggcagagtcctaaacgtcgacggctaataactcctgtttcactagactcctctgcttctgcaatatctgacatctctagctcttctataagtgaaaaaatatttgattcccaaggtaaaactatggagaatgatagaaaaatagaacattttggatgcattaatgttcctagtaattccgatgaagggcctgcttctctctcaaagatggttgcagtgctttgtgaacaacaattgttcttgcccttgctaagggcattcgagatgttccttccatcatgccccttgcttccattcatccgcgctcttcaagcattttcgcaaatgcgcctctcagaggcttctgcacatttgggttccttttctgcacgaattaaggaagaaccaatctacttacaggaaaatgtaggaagagaggcgcagattggggcatcatggattagttctactgcttcaacagctgctgatgctgtgctttcaacctgcccatctccttatgaaaaaagatgcttactgcaacttcttgctgctactgacttcggtgatggtggacatactgcagcatactatcgaaggatttattggaaaattaatttagcagagcctttacttcgtaaagataatgagttgcatttaggtgatgaaatttcagatgatgcttcactcttatctgcactagagaataataggcactgggagcaagcaaggaactgggccaagcagttggaggccaatggtgcaccctggaaatctgctacgcatcatgttactgaatctcaggctgaatctatggtagctgaatggaaggagtttctttgggatgtgccagaagagagggttgctttatggagccactgccacacactattcatcagatattccttcccttctcttcaagctgggttattttttcttaaacatgccgaagctgtggagaaagatcttcctgcgagggagcttcatgaacttttattgctttctctgcaatggctgagtgggatgataagtctttccaatcctgtctgtccattgcaacttctgcgtgaaattgaaaccaaagtatggctcctggccgttgagtctgagactcaggtgaagagtgaaggagatttcaattttaccttttccaccagggagagtggtatcaagaacgactccagtattattgatcgaactgctagtataatagcaaagatggacaaccatataaatacaatgaggagtagaattgtagaaaaatacgagtccagggaaaataaccaaatcccccacaagaatcaagtgatggatgctggtctttcaactacttttgctgggaatatgaagacaaaaagaagggccaaaggatacatggcatcaaggcgcccacctcttgaatccacagataaaaatgctgatactgatgatggctctagtactattggtttaaagaatgagttgcagctgcaagaggaaaacataaaagtggaaatgtctttttctaggtgggaagaaagggtcggaacagcagagctagaaagggctgtactttccttattggaatttggacaaattgtggccgccaagcaactacagtataaattctctcctgggcaaataccatctgagtttagacttgttgatgcagccttgaagcttgctgctatttcaacacctcctagcaatgtatcagtgccaatgcttgatgaggaagtgcgttcagttatgcagtcatacggtataatgaatgataagcactatgttgacccgctgcaggggttcaacaagcaaccaattgaactactacagctgctttcgcttaaagcacaagattcctttgaggaggccaactttctggttcagactcatccaatgccagcggcaagtattgctcaaatacttgcagaatcttttctaaagggtgtgttggctgcacatcgtggaggatatatggattcacagaaggaggaagggcctgctccattgctgtggagattttcggacttcttgaagtgggcagagctttgtccctctgaaccagaaattggacatgctttaatgcgtttggtgattactggacaagaaataccacatgcgtgtgaggccacccaccatattatccacgaacccagtccaaaagtgttgggtgtgagggggtgtattgggaaaaacccaaatcccacatcggctaaagatagtgccaagatagagtatataagtggaggacaactctcaccttatgaactagcttttggggttgagcttcttattctgtctcaccacttctacaaatcatcttcttgccttgatggagttgatgttcttgtggcccttgctgcaactagggttgatgcttatgtcttggagggtgattttccatgtttggctcgcttgataactggagttggaaatttttatgctctcaatttcattcttggcattcttatagaaaacggtcagttggatcttcttcttcagaagtattctgctgctgcagacacaaacactggcactgctgaggctgtcagaggatttcgaatggctgttcttacatccttgaagcatttcaaccccaatgaccttgatgcatttgccatggtctacaatcattttgatatgaaacatgagacggcagctcttttagagtcacgtgcagagcagtcatgtgagcagtggtttcaccgctacaacaaagaccagaatgaagacttgttggattccatgcgctacttcattgaagctgctgaagttcactcttcaatcgatgctggcaacaaaacacgtaaggattgtgctcaggcttcccttctgtcccttcaaatacgaatgccagacttccaatggctttatagatcagaaaccaatgctagacgagcgttagttgagcagtctcgatttcaagaagctctgattgtagctgaagcttataacctgaaccagccaagtgagtgggctttagtactctggaatcagatgcttaaacctgaagtaatggaggagtttgtggctgaatttgtggcagttttacctcttcagccttcaatgctgattgatttagctaggttctatagagctgaagttgccgccagaggggaccaatcccatttctctgtctggctcacagggggaggattgccagctgaatgggctaaatatttaggaagatcattcaggtgcttactgaagcgaacaagggatttgaagttgcggatgcagttggctacagtggcaactggatttggggatgtcattgatgcatgtacagaagaaatggataaggtcgctgacaatgcagcaccactagttctgaggaagggtcatggtggagcttacctccctttaat

SEQ ID NO: 56028 - DNA, 2793 bp, Glycine max
  Peptide Sequence Number=SeqID_172806
atggaggaggatggaaaagatatgaataatggaggaggaagagcaatttctttagcaagaaagtgttatgctcgatcggtcatgactgtgtcgttccaacctcctcggtctacgcccgacattatattcgttgatgtagactttaaaggagtctcaccacacgacaatgatgttgttgtcatttttgtagcgatgatgggattcaatattcaacatatcttagtagatcaagatagctcggctaatgtgatgtattgggatgccttcatcggcttgaaggtcccaaaagatttgttaagcccttatttaggggcactagttagatttgtgatggaagaaatcgaagttcaaggctatgctggcctagaaataacttttggtaatgaaggggtcaagacattgacgattcaatatttgattgtaaatgaatcgccatcctacaatgtttttctcggtcggccgttgttgaataagttagaagcaattggcaagaagagggctttatggaccaataagacaacacgagtttcatgtgttagaattggacccttggcaagattttatcgattgggtccgagtctgatagtggagttgaaagaagtggagatcgtagaggcaaaaaagatgaagatcagtacgaccttgactcctcagcttcaggctgatctattggagttgacaacaccgtttactgataaaatccaaggtgaggaggccatcattccaatcagtgttaaggccagacaacggagtccgcgagggttttacgcgtccgagtaccgccagcagcgtgacggagggctggggagaggccggagaggcggcggcgacattttcgttgaggcagggcggcttgcggcggagtatttggtctcccaggggctgctgccgcccaacgcgctgccgccgccgcccaagtggcagcagaaccataagagtccggcggagggcggcgggcggcagtcggccctgacgcggctcgggagtgttgatgggaggaggaaattgggtgggtttgatgagtttgggcagaagggaggagggaggaggagggggagtttcaacaggagcaatgggatggattgggggaaggagcataggaggaacgggtcttggtctgatcgggttcgtgccggtggtggtgaggatgatgattatgagagtggtggatttactgttagacaccagggtgaggaggatcagcaccagtatcagtaccagtaccagcagcagcatcagaatagtgttgatgatgcttcggtgaaatcgaattcgaatttgaatgaattcgtgccaaggagtgaggatggtggtgatttgaatgataaggatagggataaggagagggtgaatgctgaagtgttggaggtgaagccgagtggtgtagggaaagatgcgagtgatgtggatatggaggttggtgttggtaatgatttggagagtgtgagtgttgggcttaaggaggtgaaagatggtggcagcagcgacgatgatagtgagagattgaggaatgtgtctgctcagttgagtgatcaggagaatagtagctctggtggggttgttgctaatttggtttcgctgtgcaagtctgttaaggtgcccaccaggaggcgatcttcggttacgcgcaagaatttgaaggccgagaacaacccagatgggagtgggactgcacaagatgtcggggatcttcaagtagctgaggaagtggtgcctgaaaatgagtctgttaaaggatcctcatcgggtgatttgctaggtgagaaaagttatgatatagtacatgttgacgcggacgttgccgaggtggaacctgttcatgctgctgaggatgtgaaagaattagatgctgtgtgtaaagccggggaagttcagtatgtaacatgtcaatctggtcaggatagcggttttatgcaggataacaaccaagagtctggtgctacactaccagagtatggaggttgcagttccttggctgaggaacgtggtgaaaagcgtgttgccgaagatgatgatgatgtgagggaggacaacaagaagctgagagaatgggtgccttcccttgttcctaagactggaggtgggggatactttctgcatagtaacccaattgaagtgaaagagagctcagtagaagatgaaatttcacatattgacaaagtgaccatggcttctgatcaggggagcctgatgagtagtggttctcagttcacagaaggtggagatagaccctttcttcaatgttcagaggaaaagccttctttgctgagttcgtttagaacctgtgatctgaatctcattgaagcatctgaagtgcatgaaaatcatgttgatcatccagttctgatttacccccctgcagtttctgaaacaaagaaagctgtgccaattgacatagatctgaccatgagtcatgctagcgtatcagggaaattcaatactcatgcaacaaatggcaaagagattgaagtaattgatttagaaaatgatgattccattcaagaagagaagtcaatcgacaatatggatagaaagacagagactatgtttcctggccttgaaggtttttctagccatgctcaaaatgctgctgacatgcatgatgttcaggatggatatgggcttatgatatcagagttgcttgggccagatttccctaactgttcttcagtacctggtgacataaactctgtgcacaatgaaatgggccttcaaagtggaacggggacacttgctgaggatgattccatatatatgtcgcttggagaattaagtatgacagatttttattaa

SEQ ID NO: 56029 - DNA, 2198 bp, Glycine max
  Peptide Sequence Number=SeqID_172807
atgtcggagagcgatcagcgtcgtcttctcggggcttccgaggatgacgtggagtctggagggtcggaattggctttggcggtcgtcaatggcagcagtggcaacaacaacaacaacaacaaaggttttagggatttgttaaggttgtcgggtcaccgacacagtttgaagcgcattgagaaagaagaagatagagatagagacagggataggggtatagatagagatagaagagatcaaaatcggcatctccacgatgtggatcttgattcttctgttgatgtgcttggggacagtgcacctcctgaatgggcgttgcttcttattggttgcctcattggactcaccactgggctatttgtggcacttttcaataaagggacaaatgtggctgcaactgcagttgctaagagtccgaaaaccttgacgttgtggtcaaaatctcggttgagaaaccttgatattgaaggtgctgcctggcttcgtattcagagattggctgatacatggcatcgaatccttttaatacctgtcactggaggagtcattgttggcatgatgtgtggaatctttccaacaataaaggctatccaggctgcagttactttaggtactgggtgttcattgggtcctgaaggtcctagtgttgatattgggaagtcatgtgccaatggattctcactaatgatggaacacgacagagaaaggaaaatagcacttgttgcggctggtgcagcagctggcttcaatgctccagttgctggttgtttctttgctattgaaactgtgctgaggcctcttcgtgcagagaactcacccccatttacaactgccatgattatattggcttctgttatctcgtcaactgtatctaatgttttacaggggacccaatcagcttttacaatacccgagtatgatttgaaatctgctgctgagctacctttatacctgatattgggaatgctatgtggtgttataagtgtggccctgactcgtttggttgcttggttcaccaaattatttaagattattcaagataagtttggcattcctaccgtggtctgccctgctttaggtggctttggagctgggatcattgctcttaaatatcctggaatattgtattggggtttcacaaatgtggaagaaattctacgtactggaaagagtgcttcagctcctggaatatggcttctggctcaattggtagctgctaaggttattgcaacggctctttgcaagggatctgggctagtaggtggtctttatgcaccgagtttaatgataggtgccgcagctggtgctgtatttggaggcttttctgctgaagttattaattcagcaattcctggaaatactgctgttgctcagcccccagcatatgctctggttggaatggctgctacactagcatctgcttgttctgttcctttgacatcggttctacttctttttgagctgacaaaagattataggatactgcttccactcatgggagctgttggattggcaatatgggtaccctcagtgacaaaccgggtgaaggagagtgagacacctgattcaagtaaatcagcaagaggatactctccaatttcacatgccggatatgataatgaagataactggagacaagccaatgatgggaatgatttagaactccgtattgttgatggcactaatcttgaaccaattgataaggaactgcttctggacaatcttcaggttgagaaaagatttttcgcatttccttctgatgactgtcatttccatcttctgatgttaactctgcagcataccatgtcaaaacaatatctgaaggttttgtcatctgcaaccctgaacgatgcaataaaatgcatgcatgacagccagcagaattgtgtgctggtggttgataaagaagattttctagaaggaatattgacagatggtgacgttaaaaggtgtctgtcccagaagtctaatgacacttcgaatggcgattcagggattgtggatcaaaccgccattggcaatggcgagtttgctgagcatctcccacgtggcaaggaaaacgctagtaccattggcgatttggtagcaggtgcaagtcgccagtactcctggcgagtctggtcacagattcagtttagcttttcagagagagacacgttgttccagctttttcagataaaagaaggcacgtttttcag

SEQ ID NO: 56030 - DNA, 1912 bp, Glycine max
  Peptide Sequence Number=SeqID_172808
gcttcttgcactggccacttgctttgcaacaaagatgctccataaatatgggttgctacaacataaaaaggatacatgcatagcagagggctttaacaagacgggattactatctcttccaccaattgaaccagttaaactaaaaactgaggtggattttgctcagaaactttgtgagatagctcatttcttggagatcatccgaaatctgcaatgtagacataggtcaatatttctaagggccagtcaaggattggtcgacagtggagaagagtcatctttaataagtacagacatgttgcaggaagaatcccaactttcaattcttccatcagatttagagtcattggatgtgttgaaccaacatgagctttcttttcctctaccaggcggcaacaataatgaaaatcttgtgctggtgcctgttgattctgagtctcatttggtctcagatgaatttggcagcatatctcatttaaccccattagaaggaattttaggaaagaaagttttgcctgtggaaaatccaagagagatgatggcacgttggaagctaaataatctggaccttaagactgtggttagggatgctttgctctctggccgtcttcctttggcagttctgcatcttcatcaaatgaatgatttcgttgctgataaagagcctcatgatacttttactgaagttcgtgacattggcagagctgttgcttatgaattatttttgaagggtgaaactgaacttgctgttgctacacttcaaagacttggagagaacattgaatcttatcttaaacaacttctgtttggcactgtaaggagatccttgcgaatccagattgctgaggaaatgaaaagatatggttatctaggaccatatgagtggaagatattggatgatatgtcactgattgagtgcagtttaactactgggaggaaaaatttccatgagctgagacttgtaatcttatttgtccctgtgcatgtatatgagaagagtctctatcctagcagtagcttctggaaaacatataatcgccgactgaaagaaatcagcattgcaccggactctgttttaccagtggaaaataaattaaggctcttgcataaccattcatttcatagtcatgtcattgaatgtggtgagattgatggaattgtctttgatgcatggattgatattagtgaaagttcctctgctctggaagttgatgaagatgatgctcatgttggatattgggccgcagctgctgtctggtttgatgcctgggaccaaagaactgttgatcgtatgatattgaatcaatctgttcattcggacaatcctatattgtgggagtcacaacttgaatatcatgtttgccgtaaccactggaaggaagtctttagactgctggacttgatgcctgcatatgtcctatcggctggaagccttcaactcaatttggatcttttacagcctgcctcatctttaggatgcaatatgaatatgaagtcttctaattatggaaatttcttgtgctcttttgaagaattggattctgtatttatggaagttccagatgtccaaatgtataggttttcacctgatatatgttctgggtggatgaggatgcttgtggaggaaaagcttgcaaaaagatttatatttttgaaggaatattgggaggggacattggagatgataactctcttggctcgttcaggtttcatatctggcagagataagatctgcttggaggatgatcttactaagatgtcatctgtcagagatggagctgtacaagctttgcataaaatatttgtacatcactgtgcacaatataacttgccaaatcttttggacctttaccttgatcatcatcgtttggccctcgaaaatgattcactttatgcattacaggaaactgct

SEQ ID NO: 56031 - DNA, 1682 bp, Glycine max
  Peptide Sequence Number=SeqID_172809
gagaattggcaggaaccagctgattcagtaagagatgcttctgaccactctagcttgagctcttgtggagcagatactaagcttgattgtttttccagtgtttttggtgttgtgattaatgggttctacaaatgtcgcagagtgttctcgagtgcttcgaattgcctgttagataattggggtatttggtgggtttcaatggtgaagcttgatgaaagaataaacatagttcagtcagttgagtggatggatttccaattttctgataatcttcttgtctgtcttaattcttctggcttgattgttctctattctgcaatgtccggtgaatacatgacacatttaaatgttttacaggagacttgtggccttaacccccattttaatttgcaagggttagaaaagttatattcacacgataatatatatgctaaacaagagtgtagcattaaggataacatgtctgaccagcagagtgattcttttaggagatcattcaagaggttagttgttgcttcacacacctcccttttagctgtggttgatgaatgtggtgtgatctatgtgatctctttgagggaatatatacctgacaaaagttattcatctgagaagttgcttccacattgtcagcaatttgggctgggaatgttggttggctggggagttggtggttctgatatagatcgccaagcagtatactccaatttatctggacattttcaatcaaatgatttaaacataaaacatggaagtgttgcttccttagacaaagctgtggcaggtaatgcacttcagaaaactaatggctgcacattcaaagaaaaggggaatttggttggctcctattctagtggtttttctgctacttctaaagtaaataatggtcacaaatttcttggttatgatgtgcaatcacctgttatgagaaagatattacttcccaattttagagtctctgaggatgattctatttgtttttctcctttgggaattactattttctctaaaaagaagtgtgtaaagaatcagaagggttctcagcttatccattttaatctgcaagtgaagttagaagtccgtgatgacaacttcttagacagtgtatatgatgtataccactttgatggaaaagatgttattggagaagcaattggttgcacattccaaggttgtttttatattgtgagagatggtggtctatcagtatatattccctccatttcaattttatcaaattttcttcctgttgagtacattggttatcgtcaatcaagtaaggatatggggatttcagttctacttaaagacaatctaaaaataaaagaaccaaccaaaaggttttctccttggaaagttgaaattttggacagagttcttctgtatgaaggcactgaaatggcagatcaattgtgtttgaaaaatggatgggacatcaaagtttctcgtattcgtcaattacaaatagcattggactacttgaaattttatgaaatagaaaggggcaatatcaatgttattaaacttggaccagttatcaacttagttgagggtgttagatctttggaaatgcttgtggatgttgatctagcagaagagggaattttgagattgctttttgctgctgtgtatcttatacttaataaaggtggcaatgatagtgaaacttctgctgcttctag

SEQ ID NO: 56032 - DNA, 390 bp, Glycine max
  Peptide Sequence Number=SeqID_172810
atggattttcccttgagtagtgaggatccagctatacttcagctgcacaactgggacctgtctgagacccgaattgggctttcggactttcgtgaagcttttctttctcctaccagagagatactgcttttgcattcttatgagagggaggctcttttgcttcctctgagtaaaggtggagtgttgcattctggtggtgctgaaggtggctatgattatgagaatcacaacccaggttcagcagatgtttccccggaggcatccactaggcccagtgaatcggttttggtgaatgattcaccttgcacttcagggtcagatactgatattgatactgatcttgctggaattaaatgttcaaaatccaatagttgcccatacattagtgat

SEQ ID NO: 56033 - DNA, 237 bp, Glycine max
  Peptide Sequence Number=SeqID_172811
atggcggcatgtaataatcatggtggtagcagggacgacaatcattgcaatggatgcgatgatggtcattacagtggatgcaatagtggtcatggcagcagtgttggcaacagtcatgatggtgatggagaatttgtggcatatgcttctatcttagttgataagaagttcaaagaatgcttgttaacccaacttgatggcaattctaaaaacattgaaaatataatgttcacctga

SEQ ID NO: 56034 - DNA, 1632 bp, Glycine max
  Peptide Sequence Number=SeqID_172812
atggatttgggaagcgaatccgtggaagagaatgaagtgaatcatgatgggaatggaaacggtggttcttatgatgatgacgagataattgggtttggtttggagggaaattcggatgtcaatggttcggatcaaaagggaacggttggtgaagttgaagtgggtagtagtggggaaggtgtgaattccaaagggacaccaacaaaggggtttgggttgaagaaatggaagagaattaggaggaatgttgttaaggatccgagttcgagcgttgattccggtaaagtcttgaagagggggttgtctggcaatgccaatttgagtgaaagccagtcttttctgcgcgatgttaaggagaagagcgatggatcttcgaatatgtttgggaatgtagtgttttcagatggcaatgtgatccacggttcgagtttggattctagatatgcacttggatctggttttgttgttgggactgattctgagaatagcgaggatcggagtagcaagtcttctacagcggctagcgagcccaagttgaggcaagcgaaaagccgtagtaagaatgtgaattcaaagcatttagcaaactcagctcaacgagttcaacagggaaagggacggactgaaggcagtaacaaaccaggaggaggtggaacagtcaaaattgagaaggaaaattctttttctagtttggaatctgattcaagaagctccaacttcaagcaaggtgtttttttggttactagtaatggaaaacatagtggtaagccaaatgtttacgatggagttaatagtggtgaagcacacactagtgagcatttcactgagggagttgaaggtggttatggcaacgaaaatgttgttgaggatgaagatcttttacaagagaatttgggtacaaatttgtcttgggatgttgcagaagaaaaaagtgtgaacaacccatcttcagccattgaagatcccttaattgaatcagttagttgccttcaggctgtccaggaggcacttcaagaagaactccagaaattcagggagattgggattgaagccgtttcactagatgatgactcagccaagtgtagcagtgcgtctgctggtactactattgatcttggacttaataaatcaagccaatctggtcagtctggtgcagaagaaattaaacaaactgcttcaagttcctcagatcctcagggtgtgcttgctctgagggactccaggattgctgaacttgaaacatcctcgagtagtgttaagatttctagggaagagtctgctagaaccgtagattcgtcggatgaaaaatgtaaagtggttgagtcggagcttgaggacctttttaggctaaggattgaagctgaggttgaatgcctagccatctcaaaggtaatgcagaacttgaaggatggggcagttttccatcagacattattggaagaacaagagaaactgtccaaaagtcaagtgcaggttctcaacaagcttgtagatgcagagagtaaggcttcagtgctgaagaacaaagcagaagagttggaaaaatattgtggtgatagtgtagtagttgaggagtcttttgtgctgcagagaagattatcgcaaaattctgggatggttgtacccacgtag

SEQ ID NO: 56035 - DNA, 579 bp, Glycine max
  Peptide Sequence Number=SeqID_172813
atggaatttcgtaattttgacccaagatacactggggagttattgaagcacatggatagtcagaatgaggtccttatggaagcatatagatccatgttccatgaattgcggaaacttcaggtcgaagaagagatgcttatgcgcaagatgcatgaagttatgtcagctcatggtcccactaaaagtttgatgtcaaggtttataattccagtcctaaaggctgttaattatgggtggttatctaatgggaaccgtttcctatggttcttggacagcctacaagtagatgaagaagaatcagtagcacctgaagcagtactagcaactagagaaggggagcgaaatggcaagacaatttctgaagctcaactggtagaggaggcaacttgggaggcatcagagacagagacagagacgatcaaagagaagttcccttctctctgctttgaggaaaatgctgaaattagagagggtgatattgatgggaacccagttcctatggttcttggacagactacaagtgagaaagctcttaaggtctacaccaagaggcccaaggccaaagtgcctaaaagctag

SEQ ID NO: 56036 - DNA, 144 bp, Glycine max
  Peptide Sequence Number=SeqID_172814
atggagggaagagttgggattgttgccgccagccatcctgcggtgaggggattgggcagtgtcgggtggggcaaggcagtgttgttgcaggttagggaaggaggtgcattcactagggaagcaaagaaggatgtgaggaagtaa

SEQ ID NO: 56037 - DNA, 492 bp, Glycine max
  Peptide Sequence Number=SeqID_172815
atggagttttcagcttcatcggccattgcatgctgctggtcacttgttacaacttggaattggagtttgattttgaggtccataatggattgtatgaatgcattaggagatgattggtggcgaatgtttggtcaccaaactccaaatttgcagagtttgatgattcattcaaaaaagcgaaataggcttgaccataagaagttgcataatatggtttatgtcaaatacaaccaaaaactcaaagaaagacataatgctagagatgaaattgatccaattaggctcaatgatattgctgaatgtgcagcctcaaaagggagacaaaaagtggttgaagaagatgatgaggaagtggaatttaaggagaatgatgaggagtccaaagaagagaagttagttaattttgaggaatccaaaggagaagagggggaaggatatgcttcacttgattacaaagaagatgattatgttgagcttgaggaagaggattaa

SEQ ID NO: 56038 - DNA, 519 bp, Glycine max
  Peptide Sequence Number=SeqID_172816
atgtcatcttccgtgcagacaatttctgtcatactgattctacgccctttatcatttaggaacaacaagttgggtggtaaatgcgcagagacagattctacgccctttatcattcaagcacaacaacctgagtgggtaaacacgcagagacagattcttcgccctttatcattcaggaacaacaagttgggtggtaaacgcgcagagacagattatgcgccctttatcattcaagcacagcaacctgagagggtaaatacgcagagacagattttgtgccctttatcatttaggaacaacaagttgcgtggtaaacacgcagagacagattctgcgccctttatcattcaagcacagcaacctgagtgggtaaacgcgcagagacagattctccgccctttatcattcaggaacaacaagttgggtggtaaacgcgcagagacaaattatggtcattccgtgcacttttttgccatccagaggcgatcgtgtccggtggcacgcagagacaaattatag

SEQ ID NO: 56039 - DNA, 233 bp, Glycine max
  Peptide Sequence Number=SeqID_172817
atgaatttagggcacttggagaagtggctgattgcttcagcagtaaaagaagtggaattgatgatcatcatctcggaaatttcagccacgaagatgaagaaaatcaaggcaagaaggaaggtgagagagcctaggttttgcttcaagaccatgagcgatatggatgaattggacgatggctacaagtggaggaagtatggacagaaagttgtgaagggcacgcatcaccctag

SEQ ID NO: 56040 - DNA, 318 bp, Glycine max
  Peptide Sequence Number=SeqID_172818
atgtcaacaacttcccattccattgttcaccacagcttattcgaggagcaggatcagatgcctacacagataggtttctttccctttccaacaaaccttactttccctcctttgggttgccatcaatcctctctgaaagccttcagctccctagcaccttcttcatcacttgttatatctcaacaagattctgtatcaaatctaacagcagaaaccctattctcaaccactgctcaaaagtcaagggaagacctcacttctagctttcgaggagctcaattcctatccttgcatagattaagtgtaaatccatggtga

SEQ ID NO: 56041 - DNA, 648 bp, Glycine max
  Peptide Sequence Number=SeqID_172819
atgcagaactatcaacatgcaaagagatctgattctgcaaaagccaggatcaacagaaaactgattgcgtctgattcatcaaaaagtgaagattctgaatccacacaagtgattgtttctgattcatcagaaagtgaaaattctgaatccacacaaggttcaggctctaattttatgactcccttcgaggattgtcaatctccaactaatcagcctgtaatcaacactgaaggatattctgatcttggtgatcaactcatccaatgtagatattgtaatgcacaaatgtggtatgatgaaagaatagcaaaaaataagaattgtcagaatccaaggttcagtttatgttggggagatggcaaagttgaattgccattattacaaaatccaccccaatatctgcaacaacttctatttcatgatgatacaattgatagtaaaaattatcaacataatttgcgagcatacaacataatgtttgcctttacttctgctggaattaagctagataaaacaattaataattcaagaggacctcctacgatcagaatacaggggcaaccatgccatagaataggcagtctattaccaatgcctgggaacaaacccaaatttgcacagctatatatctttgacacagaacatgaa

SEQ ID NO: 56042 - DNA, 546 bp, Glycine max
  Peptide Sequence Number=SeqID_172820
atgcctcggaagatcaaggttcttcttctggagttgttgttgcttctaaatactgcaaaaaaaattttgattctctctgaattacgccttctacaagttgcattaatctccaaatcattgggaatcaaatcacctgcagtagatcttctttgcatacaagaaaacagaacaacaattatccagttcagaagaacaatgaatgtacgttctaaggcaatagtacatttcccaattctaaagccacctaacagaaggttcaggctaggatataagcctacatatgccaacgtgaggggaagtgcccaagaaaggaggggtagaagcatgggccagccacaaggaccgcaagtgaaggggattcccttatgtcacatcaacaaaagctttgtcagcacaagttggatgtgtgaagggcgggtcgccatgatccacgatgaagtcccccaagagcagccaaattgggtgcggtcgtgccctcccaaattcgaattagggaactggcaagttgtcgagcaacccagaatttccatggcgaacataatgtaa

SEQ ID NO: 56043 - DNA, 498 bp, Glycine max
  Peptide Sequence Number=SeqID_172821
atggctgaagagctaagaagagtaaccgtggaggattattcaagttctactgtgccacaatttttcaccagaaacaatctgaagtcatgggatgaagtagtagaaaagttcttaaagaagtacttccttgaatcgaagactacaaaaggcaaagctgccatatcttttttccaccagttaccagatgaatcattgagtgatgcacttgaaagattcagagatgggttgagaccacaatctaagcagctcttggatgcttcagctgagggtaagatcataatgaagaccccagacgaagcaatggacttaattgaaagcatggctgctagtgacattggcattttgagagaccgagcccacattcctaccaagaagagcttattggagctaacctcacaggacgctatgttggcacaaaacaagttgctatccaagcaactagaaacaataacagaaacactcagttgtaggatgtacaatttttggtggagctcatga

SEQ ID NO: 56044 - DNA, 594 bp, Glycine max
  Peptide Sequence Number=SeqID_172822
atgggtgatcggcaagtagttgaccaacaacacatgggtgatccacaactgccatcttctcctccctcaaaggatgatatggtttcatgtgttatggctttggaggctgctttgcttccctgtttgccagccagagaacttcaagcaatagaccgttctccccacccctcacatcaaagtggttggaactttttcatatgtaacacgtatcacaagaaccatagtgctgaagttaagctattgaagttaatagaaaatgatcagcgagaagggaaatgtcttctttgctcaagtcctgtgttggaaactatatttgcaaaatggttttctcatctagcaatgcacgttgatgtggataggtatgcaagagacttcatggaggctgccaagaagcttcagctttattttatcagcctgcaacgtgaggataagccaacaaaagttgaaatgcttagaaaggagatcgctctgatggaagaggaacttaacataaagaatgagctgataaaaaaacaagaaaatttaattcaggagtggaaaaaagagttgaaagatcagttggacaaacacaagattgagttggatagggtttag

SEQ ID NO: 56045 - DNA, 1959 bp, Glycine max
  Peptide Sequence Number=SeqID_172823
atgtccctgggtacttccaaagtagtttttcaggttctgtccagggctgtgcctcaaactgggtataatgattctcttgtgaactcttcagaattagcattacattcccgttttagagtaaaatgtatgaagaaaagatcctcaaggcatagggatttcattgagtgttctagcatgcttcaaagtaggttaagaactcaacaatttcagtggatgggtgtcagtttccacgactataagacctatagtcgtccgtggtggcacacatgcaaatgccaacaggctgaaagtgtgagtggcgtaactacaggagatggaaatggatcaagacttgtgaatgatgttgaaacaacaaatacgttaagcaatggaatgagagcaaagcatatcctagagtttgaagatgtccaagcccaacagttgaaacgggaaaaggaggttttggcatctaatcttacgaatggatctattaaaggcagctttaacacaattgacctcaactccattgaggaagaagcatgggatctactaagggagtctgtagtttattattgtggcaatcccattggaactattgctgcaaaggacccaaccagttccaatgttttgaattatgaccaggtctttattcgtgatttcattccttctggaattgccttcctattgaagggggagtatgatattgttcggaattttatcctttatacacttcagttgcagagctgggagaaaactatggattgtcatagtccaggacaaggtttgatgcctgctagttttaaggttaggacagttcctttggatggtgatgattctgcaacagaagaggttttggatcctgactttggagaggcagccattgggcgtgttgctccagttgattcaggattgtggtggattattttattacgggcatatggaaaatgctctggtgatctatcagttcaggagagagttgatgtgcaaacaggaattaagatgatattgaggttgtgtcttgctgatggctttgacatgttcccaaccttattagtaactgatggttcttgcatgatagatcggaggatgggaattcatgggcatcctttggagattcaggcactgttttattctgccttactttgtgcacgtgggatgcttactccagaggatggatcagctgatcttatacaggcactgaacaatcgtctggtagctctatcatttcatattagagaatactattggattgatttgaaaaaattaaatgagatttaccgttacaagacagaggagtactcatatgatgcagttaataagttcaacatatacccagaccagatttctccttggttagtggaatggatgccaaacaaaggaggctatttaattggcaacctacaaccagctcacatggatttccgatttttttcactgggaaacttgtggtctgtcgtaaacagcttggccacagaggagcaatcacatgccatattggatcttattgaggccaaatggtcagatttggtggcagagatgccattcaagatttgttatcctgcacttgatggtcaggagtggcagataatcacaggcagtgatcctaagaacacgccatggtcctaccataatgcaggctcctggccaacactgctctggcagctcaccgctgcatgcataaagatgaagagaacacatattgctgcaaaagcagttgagattgctgagagacgcatatcaagagacaggtggccagaatattacgacacgaagagatcccgattcattggaaaacaatctcaactatatcagacttggtcaatcgcaggataccttgttgcaaagctgctgcttgcagacccaagtaaagcaaacatactgatcaccgaagaggattctgagcttgtgaatgccttgattagtgccaaccctagaggaaagcgagggcgcaaaaatttgaggcagacttacattgtatga

SEQ ID NO: 56046 - DNA, 450 bp, Glycine max
  Peptide Sequence Number=SeqID_172824
atggagttcttcaaagtgcagctctcggacaccttcaagtccatgaagcaacagggtttggtggatgatcagttcacttttgtctactcgttgaaaaagaatgtcgaagataatttctacatcgaagtgataccggaattttgctgtgaagttcgagatggcttgaaatttttgacacaaacaatgaatgatcaaactttgaactacaaacttatgaaagaatatgtttataaagttaagggaagttcttcaagttttggggcatgtagattggcaaaagcacttactgactttgaacgcactattgatgcagcctctaaagaagagtgttcgaaggcactgaaacaagttcaacgtgaattttctgctctagaagaaaaacttcatatttgccttaagcttgaaagaagtttagttctcaaagctattgagggaatggccaatatgtga

SEQ ID NO: 56047 - DNA, 345 bp, Glycine max
  Peptide Sequence Number=SeqID_172825
atggaacattttcttgagcaagtagcctggcctgaagctcaacttccattggtgagacccaacgaggctgctccgcctgagcccacacctgtgcaggtcaattcagagccagctaaccgacaatctccagtggtgaatccaccttcttcgcttgagcttgaagcagttcccccatctcctcctctgattgtcatttatgacgcatcatcagacgaagcagctgctcctcctaattcaccagctgcagaaatagctaacccccatgtttccctaattggaggaattgatgatctttctaattcatcatctggagaagttgttgctctcaccaattccccagtttaa

SEQ ID NO: 56048 - DNA, 267 bp, Glycine max
  Peptide Sequence Number=SeqID_172826
atgggtgacaacgcatcacattttgatggtggaggcacgattgccaaccgttgtgcaagtggttataaaggacaagttgtgtggtgggtttgggttatggcggaggcatttggaggagaacacattggagttaaggagagggggagtatgaaagtgatttgctattggcgtgatatttggcaattactagttcggcatattggagcttcctggttcgatatcgatcgtccaagacatgatagagcagtgaccaggagagatcaatag

SEQ ID NO: 56049 - DNA, 1281 bp, Glycine max
  Peptide Sequence Number=SeqID_172827
atgttggttttcgataaacttgggtgtaagaatgaggtttcttggaatgctttgatagccggttatgctaggaagggggaaggagaggagcttttggctttgtttgtgaggatgcaaagggaaggttataggccgactgagtttacttattcggcgcttttgagttcttgttccagtatgggctgtttggagcaagggaaatggcttcatgcgcatttgatgaaatcgagtcagaagttggttggttacgtggggaacacgctacttcacatgtatgcaaagtcgggcagcatccgggatgcggagaaggtttttgacaagttggtgaaagtcgatgttgtttcttgcaattcgatgctgatagggtatgcccaacatgggcttgggaaggaagctgcacagcaatttgacgaaatgataagatttgggattgaacccaatgatataacattcctctctgttcttactgcttgtagccatgctagacttttggatgagggtaaacattattttggattgatgagaaagtacaatattgaaccaaaagtgtcacattatgcgacaattgttgatcttcttggccgagctggtcttcttgaccaagcaaagagtttcatagaagaaatgccaattgagcccactgtggctatctggggtgctttgcttggtgcttccaagatgcataagaacaccgaaatgggtgcttatgctgctcagcgggtttttgagcttgatccttcatacccagggacacatacattgcttgccaatatttatgcctcagctgggaggtgggaggatgttgcaaaagtcagaaagataatgaaagatagtggagtgaagaaggagccagcatgtagctgggttgaggttgaaaattctgtccatgtgtttgtggcaaatgacgttgctcatcctcagaaagaaaagatccataaaatgtgggagaagcttaatcagaaaattaaggagattggctatgttcctgacactagccatgtgcttctgttcgtagaccaacaagagaaggaactaaatttacagtatcatagtgagaagctggctctttcatttgcccttctgaatactcctcctggatccactatacgcattatgaagaatattaggacaccaatcggtttcatcatttttgtgatggcttctgctcgtgtggggattactggtagtgccaattattatcaatatcatctaatcattgagaggtatcatgggatagtttttgttccaaatatcatacccaattgctctgcttctacttga

SEQ ID NO: 56050 - DNA, 930 bp, Glycine max
  Peptide Sequence Number=SeqID_172828
atgaagttcaaggcagcagaaatagagactcacaactcaggagctctaatatcatgttgggagggaaatttattaatgttatttgatagttgtgctgaagacaagacaaataatgaaggtgtgcaaacggagaaaggaagttgtgtcgaaggccaggtttctcttaaagcaaaggtgttgagcccaacaatctaccttggattgaacataaacaatttaatcatgtggggaaggaccgccatgaagggactaagcttgttacgttctcccaacaattcatgccaactcatttccaacagaaaaaatcaatttatcgtaaagtcatccacggcaagaaaaacgttaaatgaagtcatcaacaacaagatcaacttatttccggcagagatcacgctgcatagaatcaatcaacgaccaaatgaacccaaacaatacaacaacctacacaagcatgatccatcacgcaaatcaaaccaaactcacgagcatggaattaatcaaatccatcatgatccaccaaaaaccctccaccacatttcccattttcatcaaaccggtactaccatcaaaagatctgttctccggtcaagtacagtcaagcggcagatcagaccacaaaaaccaaccatcgaagcaatcaagcacgaaaatccaaccatacaacaaaaatcaatgattgaaatatacttgtccgggtcggagaggggagtggagcgaagagcaccggagaggtgcggcgacggaggcgcggagggcgagggtggaaaagccatgtacctggcggcgccggaagatgacatcatgtctctcacaagaaccagtactctgggcgatcgagagagagagagagagagagaattgagaggtaatgtaaagaagatagagagtaatggagaggtgggtcccacccagggtaatcacagttcatga

SEQ ID NO: 56051 - DNA, 2280 bp, Glycine max
  Peptide Sequence Number=SeqID_172829
atggggaatgcatcagttttaggtcaaagtgggcttgaacatgctagccccctggctaccggtggaatattttcaaatggaggtgccgatgtgaacggatgggcatcacgatttcaatcagaatcctcttcaacacaaagctggctgagtccacaaggtagctcatctggtattattgttaaaaagacggtcagagtagatattcctgtggacgcatatcctaattttaactttgttggtcgcctcctaggccctagaggaaattctctaaagcgtgtagaagcaagtaccgagtgtcgtgtcttgatcaggggccgaggtagcattaaggatccagctagggaggaaatgatgagagggaaacctgggtatgaacatctgaatgaacctctccacattctagttgaggcagaattacctgttgaaatagtagatgctcgtttgatgcaagcacgtgacatacttgaagatttgctcaaaccggtggatgaatctcaggatttctacaagaagcagcaacttcgggagttagcaatgctgaatggcactcttcgcgaggagggttctcccatgtctggttctgtttcacccttccacaacagccttggtgatgctgtcaacgaatgccctgatctgcgatcggggcactggcatcatagtgccagttctaacttgttctatgtgcagtgtgtttacattgagtttgggggaggtttaaagatggtagcacgtagtaaaggtccaattgagtttgggcaatgtagtaatgatgagattagagagaggaggtccgatgttgagaactcagaagacgagaggcggccgtcgagaattgggaacttgaagaagaaggcgatgaatgcgtcatctagattcactcattctcttaagaaaagagggaaaaggaaaatcgattatcgggttccgtccatgtccattgaggatgtaagagatgcgcgggaggagactgccgtccacgaattgcgccagaaacttgttgagaggggatctttacctcctaggcatgatgactatcatacattgttaaggtttcttaaagctagggacttaaacattgagaagacagttcagatgtgggaagaaatgcttacttggcgaaaggaatatggaactgataccatccttgaggattttgaatttggagagctggaagaagtattgcagtattatcctcaagggtaccatggagttgataaggaaggtaggccagtctacattgagagacttgggaaagcccatccaagccgcctaatgcacgccaccacaatagatcgatatttgaaataccacgtccaggagttcgagaggaccctgcaggagaaatttccagcatgctccatagcagcaaagagacggatttcttcaacaacaacaatattggatgtacagggcttgggaatgaaaaatttctcacgtactgctgcaaatctcttgtctgctgtgacaaaaatagatagcagttactatcctgagacattacatcacatgtatgttgtcaatgctggttctggctttaagaagatgctttggcctgctgcacagaagtttcttgattccaaaaccattgcgaagatacagattcttgattctaagtctttatataaattactggaagtcatcgactctagtcagttgccagactttctgggtggttcttgtacatgtgctgcagaaggtggatgtcttcggtctaacaagggtccatggaatgatcctgacatcatgaaggaacgaagcagtgatacatcaacagccgaatcagggtctgatatgaatgattactcctctcccaacagacacaggagctgtccttgtcctcatttagccccagttcatgaagaagttaaagcaccagatctcaatggctactacagttgtgatgatagtgctctagcagttgagaaagtgattgaaagtgatcactttcaccttaatcgagagcagccattgcaaactaatgatatagggaatgttgcttgtagaacagattcaggagcaactgttgaaacagcttctgaaagagattatgttcttccatgtgtacaacgtcttcagagactagaaaaagtctttgaggaacttaacaacaagcctgacggtatgcctcaggaaaaggagcaaatgcttatggattccatggatagaattaaatctgttgagtttgaccttgagaagaccaagagggtgctacatgctgcagtgatgaagcagcttgagattgttgaattgctggagaacttgaagaaatcaaactgccga

SEQ ID NO: 56052 - DNA, 306 bp, Glycine max
  Peptide Sequence Number=SeqID_172830
atggatatctctgaagatactaacatccctgtaatattgggaaagccattcatgttgaccgcaagctgcataattgatatcgggaagaggaagctggagctaggttttgaagatcagaaaattgattttgatttgtttgttgaagacaagcctgctccagaacacaatgtttgcttacatgtaatggaaggaggtcaagaggttctgaaacgcaagcctcgcgctaagcgcatctctgttcatgtgctaagctgtgagtctcaagcgcttaacgctcaacccttgcatctgaggctgataagctga

SEQ ID NO: 56053 - DNA, 665 bp, Glycine max
  Peptide Sequence Number=SeqID_172831
atgatgatccaatgtgaaaggtcttcatcggttttgaaatcattgctccaaatcgtatctccatgtaaacgagatttgggtagctttcgcagactttggcaacattctgagtccactttctgtgttatagacgacaggaaccttctgaggccgagtctcaactccaaaaccggtcttcacgttctggacctcattgactgcggttcgctcgaaccggatcgaaccctgtacaacacgctcttaaagaggtgcacccaattggggaagctcaaagaaggaaaactagtgcacttccacgttctcaactccaacttcaaacatgaccttgttattcagaactcccttctcttcatgtacgcccgctgtggcagtttggaaggcgcgcgccgcctgttcgacgaaatgccgcacagggacatggtctcttggacctccatgatcaccggctatgctcaaaacgaccgcgccagtgacgccctcctgttgtttcctcggatgcttagtgatggcgcggagccgaacgagttcacgttgtcgagcttggtgaagtgttgtgggtatatggcgagttataattgtgggaggcagattcatgcgtgttgttggaagtatggatgtcactctaatgtgtttgtggggagttcccttgtggatatgtatgctag

SEQ ID NO: 56054 - DNA, 2496 bp, Glycine max
  Peptide Sequence Number=SeqID_172832
atggatacctctggtaatacatgtgagatagtggaatcaagggaagagataatttccgagttcaaaatggatgaaaagcctgagagtagttgtgctcacaaatcaggaaagaagtattcaattgaggatgatattaatcagcttttccaggctattgaaattaaaagctcatctagaagtcgtagttcatcaagtttacaaaagagtgctcttaaaaggccaataaaagtcacttcatctcaggcatcaggaattggcatctcagagcctgtaagtttaaagcaggcacttagagggttgtgcatctctcaggcctcagaaatggctgctttgaagagactgactaagccatgcagttcatctagagtatcagaggcgggcaccatcaaaaggttgtacacagcagtggtagatgaggggaaagggaacttggttgaaatctctctagtaccagagatatctgcaccttctgataaattgtctggtgtaactatatcaagttcaattgataatcattctagtcctttggttgatgcaacaaaaccaaaagaaataataactgggttttcatcccaagatcggattgtttctccaccattagaggttgagggtgagaaaccaatcatggggattggaaaaccaatacttgcaaatttgtcaccagttgcctctgcaagtgaagaagtgccagaggtcagaatggatcctgcttcctcaagcaaagcttctcttggttcttcaatgtcagataaggggcatgaagcaaattttccttctggatcttgtccacctagctctagcactggaaatggagcagacaaatacacaagcagtaatacatgtttgtcaaagccaatatttaataacttgaacttccttaagaaaaaagtaaagcaagatttaagttctgccgcgagttgctctactccatgtacaagtaatttggacaaggagggtggcaattctgattttaagcatgaaatgaaagataatgcgaaacagtctccttgcagttcaaatcatagcattgaagttaactcaattaatggtggcacagattcaagcaaatctggtttcagcttgaattgcaataagagaactaagtttttggtgacaaaagttgatgagaaatcaagatcaaaggaaaagggtgagtactctcaaagctcaaaaagtagcattggtgaatatagtagtagcacaagcatcagcgaggaaagcagtctaagtagttccagtcgcggtggccacaggcctcacatgtcaaaacacttgagatgggaagctgttcgtgctgttcagcagcaacatggtaatttaaatttgaagcactttaagcttctaaggaggcttggtagtggggacattggaactgtttatcttgcagaactaattggtacaagctgcctttttgcactcaaagtgatggacaatgaatttttggcaagtcggaagaaaatgttcaggtcccaaactgaaagagagatccttcagatgctggaccatccatttcttcctacgctgtattcccatattgcatcagataagctctcttgcttggttatggagtattgtccaggcggagatctgcacgtgctgcgacagaggcaatcatacaagagtttctcggaacaagcggctaggttttatgttgctgaggttcttcttgccctggagtatttgcacatgctgggagttgtatatcgtgacctaaagccagaaaatatcctggtacgagaagatggacacattatgctgacagattttgacttgtcactcaggtgttctgtcaatccaatgttagtcaagtcatcttcacctgacacagatgctacaaagaagacgtccagtccctgttctgaggctagttgcatacaccctttctgtctccaaccggattggcaagtttcctgctttactcccattctgttatctgccggagcaaaatctcggaagatgaaggctgacatagcttctcaggctggtcctctgccacagcttgtagtggagcctaccagtgcacggtctaactcctttgttggaacctatgaatatcttgctccggagatcatcaaaggtgagggtcatgggagtgcagtagattggtggacttttggtatatttttgtttgagcttttatatggtaagactcctttcaagggccaatcaaatgaggacacattagccaatgtggtttcacaaagccttaagttcccgggtactccaatagtcagttttcatgcaagagatttgatcagaggattgttgataaaggatcctgaaaaccgattaggttctgtaaaaggtgctgctgaaataaagcagcaccctttctttgaaggcctgaactgggctctaatacggtgtgcagcaccaccagagctccccaagtttctggattttggaagtagtgctccatctgtggctgcaaataaggagaatgcaaatgatttagaggatatagaagattgtgaagagggtgggaatttgaattga

SEQ ID NO: 56055 - DNA, 240 bp, Glycine max
  Peptide Sequence Number=SeqID_172833
atggggcttgcacttgggcttgagcacagcaagggcagactgtcattgatgttgctcccaagattgacattggcaatgacacaagcctcaacagatatgcgatgctacaaggtggtggaagaaagagaaggaaggtctctaatggcaaatagaagaagcagaggggaaacaaatgggagtgagaagagggggaacaacatgtcacatatgcactcaatgctaacagaaccattggactaa

SEQ ID NO: 56056 - DNA, 669 bp, Glycine max
  Peptide Sequence Number=SeqID_172834
atgcaattcctttcagctaaaagtaagaaaacttggtccagacagaatgaaaaatataagaaccctgagaacaatagttgttggagacgtccacctgtagaggaggttctggcaaaactaacgactaatttcaacaaagtacactccaggcagtgtgcagatgaggctgaactggctgaacatgttgtcggtttgacatgtagcctagcatcttgtcagtttagaaagaagttatcccgattgtctgtaaatgcaaatggagcccttattccaaaggactacgttgaccggaatttgataaagaaatctttgtgtgtacttcatatctgttttgtcttttcaacttgtgttcctcaccatgacttccacgactataggttaaaagctttggttgctatgcccaaggtacagccacgatttgctattgctattgggaagaaatacccaaccatgaagtccctgttaagtgtttatatggatccaagtaaatcggagcatgagaaggaatttttacttcaagacttgatgaccgaaggtttgcttggtggtgacagaaggctaggtgaggtgtgttcaaagagagtatatagaattctaatggcgcaaagcggatgcattagaacagatgatgtcgagaatggtgctgatttctttgaacgtcaatcatga

SEQ ID NO: 56057 - DNA, 927 bp, Glycine max
  Peptide Sequence Number=SeqID_172835
atggtcatattccccctttgtcgaagactcaaatgtctttcaaccgagactattgcagtctccctctgtcatccagagacagtcgagtccgatgacacacatagacaaattatggtcatccgcacccttttagctatccagagacaatcagacaatcaagtccgatggcatgcgaagaccatcatggtcatccgcacccgttttgctattcagagacaatcaaatccgatggcatgcgaagaccatcatgacgacgatgtcttcagtcattgcatgctttcaaaaggcgacaatgaccctcatttacattttgaagacaacaatgtctttagtcattgcatgctttcaaaaggcgacaatgaccttcatttacatttcgaagatgacgatgtcttcagtcattgcatgctttcaaaaggcgacaatgaccctcatttacatttcgaagacgacaatgtcttcaatcattgcatgctttcaaaaggcgacaatgaccctcatttacatttcaaagacgacaatgtcttcagtcattgcatgctttcaaaaggcaacaatgaccttcatttacatttcaaagacgacaatgtcttcggtcattacatgctttcaaaaggcgacaatgaccctcatttatatttcgaagacgacaatgtctttagtcattgcatgccttcaaaaggcgacaatgccctcatttacattttgaagatgacaatgtcttcagtcattgcatgctttcaaaaggcaacaatgaccttcatttacatttcgaagacgacaatgtcttcgaaagaagaagaaagaagagaaaggaagaagaaagatgagaaaacaaagccgaaacgcttccgaatcgcatctgtgatcgattcctacatcgttcttcgtccattcttcatcgttcttcgttcttcatccggttag

SEQ ID NO: 56058 - DNA, 210 bp, Glycine max
  Peptide Sequence Number=SeqID_172836
atggctggtgcatatcaatatgtctttgctataattattgaaaaggaaaattggactataaaagttaaagtaatcaggctttggtattttccaagcttcagtggatctaaagctcctttttcattggaaatggttctcatggatgaagagggaggaaaagttcgtgcttctgttggaaagactttgacctataatttgaaggtcttttaa

SEQ ID NO: 56059 - DNA, 153 bp, Glycine max
  Peptide Sequence Number=SeqID_172837
atggcgtttggttgtctccgtcttcgaattagcgcgggatcattctcggcgggctacagttgtgagagccaattagatctcccaccatgggaaagcattaagtttatcattattcactataacatcacaaacattgacgaggaaggggagtag

SEQ ID NO: 56060 - DNA, 318 bp, Glycine max
  Peptide Sequence Number=SeqID_172838
atggcaacaaagtttatgttgcatcgtcaaacaccttcacaggtggccaaagatcaactaactatgaaagataagagggataaggaagaaaaactagaaaaacaaaagaaaatgaaagatagtaagaccttgtcttcaaaggccaaggggaaggaaaaagaggaaaaggattcctccaagaagattgttaagaaggaaaaccattttgcaacaaaaggtgatatcaaaagagcactccttcttaaacaaggtgatatcaaaatacagaaaaatgtgttgagagaagaagcccagagcttcgagaacctctggatttga

SEQ ID NO: 56061 - DNA, 255 bp, Glycine max
  Peptide Sequence Number=SeqID_172839
atggctttttctataaatagacatgcaggggaagaggaaaagagatccagtagtctgaaaccagagagaaaaacgcagaagaacaaagagaagaggaaaagaggagctgaggcactgcagagttgtgaccatggatcatggatcacttccttcgtcatttctctttgtgttcttttctcctttatgcgaggtaaaaagctagcggatacaacgccatttgatccggaaattaccaaggctgaaaggaagaattga

SEQ ID NO: 56062 - DNA, 1671 bp, Glycine max
  Peptide Sequence Number=SeqID_172840
atgaggtttgacgagaacgctatgaattggattggcgctaccgttggtgacctcgtgggcacagtgggtgcaatattatcactaaaagataccaaagtggcgattccgtttaccttcgctgcagacaatagtagcttcgagaaatcgctctttgttccgggtttgcaaaacctccaaaacaattgtttcctcaacgttgttttgcaggctctagccagctgtttttgctttcagagttttcttcacggtgtgatcggagagtgcgggagtaaggacctggatgaaaacatgcctcttgcacttgctttggctactttgctagaagagctgagttcagttagtgcagaaagggttacattgagtcctcgaaagatgatgcttgccatgtccaataacattccaaattttaatctaactagccagcaggatgcagctgaagcatttctccatctgttatgcttattgagagaagaatttggaggttgttatgctccaaagatgagttctttagcagacatttttgcttctaataatagaattcttactccaatacagagggactgccaaagtgagcaggagagatggcagcaactcttccttggaccttttgatgggattcttggcagccgcttgacctgtcaaagttgttcatccctgatctcgattaacttcgaacattttgattgtttgcctctttcacctgtgcttagtgatacttcctcaatgagagttggttgtaccctggtggattgcctgaagcagttcattgttgctgaacatgttgaaaattatcgctgcagccactgttggcataatgctgcaatcaagtatctttctataatggaaggaaatgaggtagaactcaaaatgataaggagatgctctgacccagaaatctgcaattgccgaaaaatgtataatcttgataaactaccctggtcaaacaggttttcacatactctgaagcagctaagtattgcaaggtgcccaaggattttatgcatccagttgaaaagagtttatatgaatgtctttggagagctagtcaaactgcagggccatatttcttttccattgattttggatgtgttgtcattcatgacaactagactgggagtaaagacacaggacatagatgtacaaagtttgccattaaatttgaagtataacagaagaaattttttcccaaatcattctgatctgcaatctgagataagtacattgaaatttagtggcctttatggagcaacaagagagcagatcaattcagatggtgttattgatgatggatttgtctcctctacaaatggacaggcacttcatagtgacactgtatttccctgctctggttcttcagaaagcattcactcagatacacatatgcaatcaattgaccaggtagatgtttcttgtaatttagttcctcaagaaacatgtttgtatcaacttgtttctgttgtggaacactttggaaaagctggaagtgggcattacactgtttacagatctgtaagagtggagtcttcagaagacgtctctgatgattacctcaatcaaactccaatgcgttggttttgtatttcagattctcaagtgcatgctgtttcagtggaaggtgttctttccagtgaggccagcttgcttttctatgagagaattccaaggaactga

SEQ ID NO: 56063 - DNA, 131 bp, Glycine max
  Peptide Sequence Number=SeqID_172841
atgaggcttcactatcatcaagcgagtcggagactcagcaagaccacagatcgacctctactccttatggctcacatagacccgggtatagggcctaacatctcaaagtgtgtgcgatgtgcaggtgtcat

SEQ ID NO: 56064 - DNA, 225 bp, Glycine max
  Peptide Sequence Number=SeqID_172842
atggggacgaggggttgcatcagctacagtcccgttcttgctataagacaacttggctaccctatgagaggggcaccactagaggatgagctcgcgactatcatttcacgaggcttcaataagtccaacgtggagacacttcagaaggtcggcaaggcatgggaggtgttgcaaaagaggacaaggaactcaggggcagtaacaatgggcccatcggtggctatc

SEQ ID NO: 56065 - DNA, 876 bp, Glycine max
  Peptide Sequence Number=SeqID_172843
atgtggctgaaaggggtgaagacccctgtggttttgtctggaaatcgtgatgaatgcgctaagcacgcctatgcgcttagcctattcatcacaactgtcaaaattttggatttccagatgaacacgctaagcacgttcatccctgctgatgaacagctaagcttgaccggtcaagctaagcaccactttgcttctataagttttcctttgaataaggctaagtgcatctgtgcgctaagcccttgttgtgctaagtgcaccctattcgctaagtcggagtgtcattttgttgaggctgagctaagcgcgccatgctatgctaagctccaaccctctttgatggcatctaagaagaggaaagctccttctacacctacccaagccagatttgatagatccaggttcatatcccaagaggctttggagaggtatatcgacattgtggtacctaggaagattttgcctgaaaggaatgtcattctccatcacactgagttcgatgaatttactgaagaacttgagtatagaaactggcacaaggagttgacaaactttgtggatggtagtattgatgttgccatcataaaggagttttatgcaaacctctatgaccccgaggataaaccacctaagcaggtgagggtgagaggtcgtttggtgaaattcgatgcagacaccttgaactcattcctgaagaccccagtgatacttgaggagggggaggatgagctcacccctcctgagcctttttattttggtgcagatgcacacatggctcaggaggaggggacttcaacatatccgatacctgagccatctcctgcacctattcctgaggagacccaaccatctacactagtcacagagccagagtag

SEQ ID NO: 56066 - DNA, 495 bp, Glycine max
  Peptide Sequence Number=SeqID_172844
atggaagagaacaaagacaaaagaagtctaaagacagaaaatagagtggaggggtggtgtggtggattgtgctctctgtggaaggttgggatggaatggtgggtaaggccatgggatcaaacagatgaggaaagagacgttgaggaggaagggtccaatgaagggtggccatgtggcaaggttaagtggcttgatggggaagtggaagagatggacggtggagattggttgaatgttggctggctggttaaagggttgagggttctagaacgtgaaaagtgtcacgagcaaggtgggatttttcaagtgaaggtaagggacaagggaacactcgaggagaggtaccatcataccggcaaagttgagagatatgaaccactgagtagatgtgagacccttctgaaagcagtaatttgtaagcaacaactccaatcttacagaggacttggaaggggccaaagtaacatttcacaagctttgatgagtgcaacataa

SEQ ID NO: 56067 - DNA, 1369 bp, Glycine max
  Peptide Sequence Number=SeqID_172845
atggctcccaccaaagctaacaaggaagttgatgaggctctccaagccattactgcacaactagaggttttgcaaacacagttggagaacaagcaacaactgcaagatagtcgtcgcttgcacctccaacagtctatggactctaggcaagaagctctccaaacatttttggcaaatttgaaagaacaacttactgttcaacaaccttcaccccctccttttatgttgggtatgagtcttcccccttttacatcatctatcccaactagttttagccccatttatgtgacaacccctatatcaaccccttcttccttttcctttttcacaatcaacaacgctgaacaatattttcagtactaccaagtgccttttgagcaacgtttgtctttagcttccttttatatgaaatgtgatgctcttagttggttcaaatggatgtcccggaactgccagttctcagattggccttcatttacatgctttttggaattgtgttttggacaatcatcttacactaatcatagggcagaactattcaaactccgccaaacatgttttgtatttgattatccaacatcttttgagaagctttgtaatagagttattggtctaaagcctgaatctacccttaactgttttatttctggtctccaaccagaaatcagacatgagttagctgtttttcacccttcatctatttctcatgccattagccttgcaaaacttatagaggataaacttaaggataatcactctaaaccctatcgatctaccaacttccattcttccaccgctagtagggaaaccccccatgttaccatcacccaacccttaagcaccattcctattaaaagtgttccttctacctatattcaggaatgttgggcacaagggttgtgctattactgtgatgagaagtttgtggctggctttaaatgtgataatggtcgtttcctattgctcattgaggataatgaagacattctcattcactcatataatatttcttttacatttgtagccgaggaggcatctgaaccttttcaccttcaactttcatcccatgcattgttaggccaaccatcccccaaatcccttaagttccagggatgtattggtggacttgcagttatggccaaagaagagaaggttcaagtaactgatgactcgctcagtgaggctgatctgctcagcgagtggcatttgctaagcgaggcatatagctcgcttagtggcgtgcaaccagcccgcccagcaaggtcgttgtttcttctcaagcttagcgcacccagtctccctaagccaaaattcacttactcttgcttagcgagccagtctcgcaaagcgagccttcgaaagctgaaag

SEQ ID NO: 56068 - DNA, 297 bp, Glycine max
  Peptide Sequence Number=SeqID_172846
atgggtctagaggtcatgagtttacaagaattaggggagttgatagggcagctccagcggcaagccttccgcaaagcctacggtaagatctgggagttggctatgatagaagtctctacaaaggcgatcgcttccatcacccagtattattaccaacccctgggatgtttcaccttcgaagatttccagctagtgccgactatagaagagttcaaagaaattcttggatgccctctggaagggaggaagccttatctcttttccggattctacccttccatgtctagaatcacctga

SEQ ID NO: 56069 - DNA, 351 bp, Glycine max
  Peptide Sequence Number=SeqID_172847
atgttaagcatgaaaagactgatagaaagtaacgcagccacagctaccgccgccaacgccgccattgaggcagatcctactcatccgtctgccacgaatcaagcacatcatcctgccccagacatggtgggacgaggaggagaggtgttggggagcattggtggcccgcacttggggtataatagaaatgcttacccctacgatttaccccccaattatatgccgcccaccatgcccgagattgttgatcatgccattcccattgccttcgaaggtcagcaaccccagcctatagggggtgttaaacaagtggcctcggatatcttaagaaggggggagggggttaattaa

SEQ ID NO: 56070 - DNA, 564 bp, Glycine max
  Peptide Sequence Number=SeqID_172848
atggcattcgcaaaaccagtttgtactcctttgataacgtccattcatctcactaaacttaatgccattcggttagattcaaaaagggaacacatgtctcatgttccttatgcaagtgttataggtagtctcatgtatgcaatggtgtgcacaagacttgacctagcacaagcagtcaacatggtgagtaccttaagggtacaactgatattggattggtctatcaaggtgacacatcttgttccctttgttggatattcagattctaactacgctatagatttggatgcaagacgatctatgacagggtatgcattcacaattgacaattctcttgtcagttggaaggtacacttcatcccacagtttccttgtccattgtattggttgaatacatgggtctggcaaaaccaacaaaagaagccaaggatcaagtccatcatgaaaggactaacacatattaacattagataccacttcatccatattgagaagaggattgcaatccaaaaagttgatacgaagaagaatctagttgatatgttcacaaagcatattccttga

SEQ ID NO: 56071 - DNA, 150 bp, Glycine max
  Peptide Sequence Number=SeqID_172849
atggcacaatcaacacaagacaaagatgaaactggagtgttgttgttccaagttgccgccgccgcgttcatcctaggccagaatgaggcggttgcgttgcgttgttgttcctcctcggaagcgtgccacatcatcgtcgacctcttctga

SEQ ID NO: 56072 - DNA, 633 bp, Glycine max
  Peptide Sequence Number=SeqID_172850
atgattttggaaaacagtatgatacgtgaagggctcaggacccacgtcacggcgagcttcgcggctggattcgtggcggcgaacccggtggccatgatcaagacgagggtaccatggcactttataagtggtttccgattgagttatgcgaactcaaaatcgtccccagatgttcttgtacaaaaattggttggactctactgcaattgggtttggtgtagagatcctgtgctaaattttgatcttgttttgctgtatcattgcaatatgaaccaacaagtggtgtcatttgtggggacacacgcaaaggttaacaagatcattcaagaaatgacaacgaagtttgacattgagaagttcactggctccaatgacttcgggctatggaagatcaagatggaagcaatcttgattcaacaaggatgtgatgaagcattgaaaggggagtcgaacatgccttcaaccttaacgcaagcaaagaagaagagcatgattgataaggccagaagtgcaatcatattgtgtcttggtgataaggcaccgagggaggttgcaaaggagaaaactgtagctggaatatgggcaaagctggaatcgctgtacatgaccaagtctttggcccataagttgtga

SEQ ID NO: 56073 - DNA, 585 bp, Glycine max
  Peptide Sequence Number=SeqID_172851
atggccaaaatacaaggctcaaaagaaggaaaaacctattctaatatttacaaagaagagaggacccaaccttggtccatgggctcagaaatctatcctggggttctcatgaaccccaagaccttctttagcagctctagcccaatcctcttggagtcttctatccaatacccttggggggtaggattgcatcaaactctatgtccaaagttgctacaagagccaataaaacaccccacaccatcttactatcgctttgtcgtgcctatgccaaagattgttattcctttcgatccgcattcaccacctacagacaatgtgatgtcctctactagatctaactcttcatatgaagatattgaggtcatttcccttactttgatgtctccccaatcagtattacatgagtctcgggtaccacccaaggcaaccttggcaggtctcaagtcaaaggacgaagaagaggatttgaaggaggacatgtctttagaggaggatccatcaatggatgaggaggacctcatcatagagccaaagtttatggagggggattctttgcaggattcctccaaggagtctatctaa

SEQ ID NO: 56074 - DNA, 588 bp, Glycine max
  Peptide Sequence Number=SeqID_172852
atggggaaatctcacagcgtgaaatttgggacatgtaagcatacttcaaccagagcctttgagtatgctcatgcagatctatggggaccatcgaggatccaaacacatggggatggatcctatttcttgagcattatcgatgactattcaagaagaaagttcaaggaatggcatactcaaattgaaaatcagcaaggaaccaagttgaaggtcttaaggacagacaatggacttgaatttgtctcagatcaattcaatactttctacacacatcatggaatcaagaggcacaaaacagttgctggtactcctcaacaaaatagccttgcagaaatgatgaatagaaccattctggaaatagtgagatgcatgcttcttggagcaggtttgcccaagagtccctcatctgcccttgaatataaaacactaatggaggtttggagtggaagtccagcaaattactctaacctaagggtgtttggagccttgacatttgcacatgtcaagaaggacaagttgaaagctcgagctataaaatgtctattcctcgggaatgctaaaggagtcaaggggtacagggctgtggag

SEQ ID NO: 56075 - DNA, 219 bp, Glycine max
  Peptide Sequence Number=SeqID_172853
atgaggggggtgaaggtgatgatgtgtgaaggagattttcctgaatttctccttgagaatgagacaagatgcatggttttggcatatatcgttttgcgaattgccatcgttatgaaggagcctggcatgaaggcagaaggcaaggacttggaatgtatacatttagaaatggtgaaacccaatctggtcactggcaaaatggagtccttgacattctaa

SEQ ID NO: 56076 - DNA, 273 bp, Glycine max
  Peptide Sequence Number=SeqID_172854
atgccagacaaaagtgaacccaccaacgagaacccgatgaagaactcttggggggatccttctacactcaaagatgttaacccacgagcggagatttgtcttgatgctcatcattcaaacctaaaagtgttggtcctcctaggccttcatggtctgacacaacatgtggatgatgattgggtggacacaccacatgccggtataggacatggcgttctcaccaaccatggatacagctctgctctaatcaagaatgccaagtgtggcctgtga

SEQ ID NO: 56077 - DNA, 549 bp, Glycine max
  Peptide Sequence Number=SeqID_172855
atggcaacaaactctgtttcttcttcttccgcttccgcttttctgagttcaatttcacagaagcttgatgattcgaatatctcattatggcaacagcaaattgaggcattgagcctgtcatcaaatctcacaaacttcaaaggtttgttgggaatccacaagtcccgttatgattccttactgaagcagatcgcaaggcaggaatggagaatcctgcatatgagacgtgggaacagcaggaccgggttcttctcacctggttgcaatcgactctgtctatacatcaattctgtctcaaatcattggttgtgttcattcatgaggtctgggaacgaatccatgattattttcacaaacagacgtgagccaaagcaaggcagattcaaactgaattgcatgcaacgatgcttgaagataagtcgacgtgcgagttcctgcttaggatcaaagcaatttccgattcgcttgcctctttcaaaagtccaatttctcttcaggaacacattgaagctatacttgaaggacttctacaagactatcattcagtaa

SEQ ID NO: 56078 - DNA, 762 bp, Glycine max
  Peptide Sequence Number=SeqID_172856
atgaaggatcttatgaacatgtgggaagacctggatgacacctcatccgatgaagacaatgaagaagccaacatatgtctgatggaagatatcgcttctgagggttctgaatcaaatcaggaagatgaggagttggaaaacaaattgaaagatcttcaaaaagagcttaatgaacttcataatcaccaaaaagaagaaagatatggtctttggagagaatgtgcacaagtgcacaaagattatgaagacttcaaaatgagtaaacataatatttgggtggaatgtgaagaacacaagaaatctgtgagtttcttgaataatgagcttctaaagaatcaagaatttaagggtcaacctcaagatgttgtcaaacttcatgaggaaataagaaccttaaagattacattatccaaaattttcaatgaaacaaatactcttaacaaactattaggatactatagaagttctttagcaaatctggaaatagctatgatgggaagggatcgtcctaagaagggtttacccaatcccttcatgactaacacaaaaggacccaaaaaggtttgggtacctatgaaatggatttttcttatcccagatgtccttgattacaagaaacaaactcctatcatggtacctggacggtggttactcacgacacatgatcggagaaaagtctatgtcctaataactgactccctttcatggtggaacaatcactttcagagggaatcaaaaaggcagaatagttggggtaggtaa

SEQ ID NO: 56079 - DNA, 3213 bp, Glycine max
  Peptide Sequence Number=SeqID_172857
attaagtctgtccgagagctgagtggacagatatgtcagatttgtggggatgagatagagattactgtggatggggagccatttgttgcctgcaatgagtgtgctttcccggtttgccggccttgctatgagtatgaaaggcgcgaggggaaccaggcttgtcctcagtgcaagaccagatacaaacgtatcaaaggtagtcccagggttgaaggcgatgaagaggaagatgacactgatgacttggacaatgagtttgattatggggatgttgatgctctgggcccacaaccaatgtcggaatccttgtattctggacgccctaatactgggcgaggtgctaataacggatctggcatggcgacaaacttggaacatggctcagctcctcaaaattctgacataccgctcctgacttatggggaggaggatcctgagatatcttcgaatagccacgcgctaattgttccgtctcatatgaatcatggaaacagagtccatccaatgccttataatgatccatctattccattgcaacccagacccatggcccccaagaaagacattgctgtgtatgggtatggaagtgtggcttggaaagaccgcatggaggaatggaagaaaagacagagtgacaaacttcaggtggtgaagcatgaagggagcaatgatggaaattttggtgatgattttgaggactctgatttacctatgatggatgaaggcagacagccactttctcggaagctaccaatcccttcaagcaagataaatccttacagaatgattatagtactccgccttgttgtccttgggctctttttccattacagaattctccacccagttaatgatgcatatggcttgtggttgacatcagtcatctgtgaaatatggtttgctgtatcatggataatggatcagtttccaaaatggtacccaatacagcgagaaacataccttgatcgtctgtcgctcaggtatgaaaaagaagggaagccatctgagttgtccagtgtagacgtctttgtcagtactgtcgatcccatgaaagaacctccgctgattacagcaaacactgttctgtctatccttgctgttgattatccagttgataaagttgcatgctatgtctcagatgatggtgctgctatgcttacttttgaagcactgtctgagacatctgaatttgctaggagatgggttccattctgtaagaaatacaatattgagccccgggcaccagaatggtactttggtcagaagatggactatctgaaaaataaagtacacccagcatttgtcagggaaaggagagcaatgaagagggattatgaagaatttaaggtgaggattaacagtttggtggcaacagcacaaaaggttcctgaggatggatggaccatgcaagatgggactccttggcctggaaataatgtgagggatcatcctggcatgattcaggtcttccgtgggcaggatggtgtgcgtgatgttgaaggaaatgagctaccccgcttggtctatgtttctagagaaaagaggccagggtttgatcaccacaaaaaggctggtgcaatgaatgctctggtgcgggcatcagcaattatcacaaatgcaccgtatcttctgaatgttgattgtgatcactacattaacaatagcaaggcacttagagaagctatgtgttttatgatggaccctcaacttgggaaaaaggtttgctatgtgcaatttcctcagagatttgatggaattgatagacatgatagatattcaaacagaaatgtggtatttttcgatattaacatgaaaggattggatgggatacaaggtccaatatatgtcggaacgggatgtgttttcagaaggtacgcactttatggatatgatgcacctgccaagaagaaaccaccgagcaaaacttgtaactgttggccaaagtggtgctgcctatgttgtggctctagaaagaaaaagaatgccaacactaagaaggagaaaaagaggaaggtgaagcacagtgaagcatcaaagcagatacatgcacttgaaaatattgaggcagggaatgaaggaaccaacaatgagaagacatccaatctgactcaaacaaagttggagaagaggtttggacagtctccagtatttgtggcctccacactcttggataatggtggagttccacagggcgtgagtcctgcatcacttttaaaagaagccatccaagtcatcagttgtggttatgaagacaaaactgaatggggaaaagaagttgggtggatatatggttctgtgacagaggatatcttgactggatttaaaatgcattgccatggttggcggtctgtgtattgcattcctaagcggcctgcattcaaggggtctgcgcctatcaacctttcagatcgtctgcatcaagttcttcggtgggctcttgggtctgttgagatttttttcagcagacattgtccaatctggtatggttatggtggtgggttgaaatggttggaacgattttcctacattaactcagttgtatatccctggacttccctcccactgcttgtctactgtactttaccagccatatgccttctgactggaaaatttattgtacctgagattagcaactatgccagtattgtgttcatggccctcttcatatccattgcagcaactggcatccttgagatgcaatggggcggtgttagcatagacgactggtggaggaacgaacagttttgggtgatcggaggtgtatcttctcatctttttgccctatttcagggtttactgaaggtcttggctggtgtgaacacaaacttcactgtgacgtcaaaagcagcagatgatggagaattctcagaactctacatcttcaagtggacatcactcttgatccctccaatgaccctactaatcatgaatattgttggggtggttgttggggtctcagatgccatcaacaatggttatgattcatggggacctctctttggtagattgttctttgcattgtgggtgatcctccatctctaccccttcttgaaggggttgcttggaaaacaagatagaatgccaaccattatattggtttggtcaatccttctggcctccatcttgactctcatgtgggtcagaattaacccgtttgtgtcaagagacggccccgtgttagaaatttgtggattgaattgtgacgagtcttga

SEQ ID NO: 56080 - DNA, 312 bp, Glycine max
  Peptide Sequence Number=SeqID_172858
atggtgaaccttcttactagagaactatccagactaagattgaagcatggaaatggagctgttgagaaaccgactgaggcaaaagttgcaaatgacaacatacttgatcctctagttattagaactaagggtgcaagtcgcacaatgagttctaggagtgctacaagtatatgggagcataagtgtaaaaaatatggtcgcacgggtcataataaacgaaagtgtactgcttccatattcaacaatggagtggtctcacaagtaggagaagcgggctcaataatgaacatagaaacatggagagcctcataa

SEQ ID NO: 56081 - DNA, 2394 bp, Glycine max
  Peptide Sequence Number=SeqID_172859
atgaaacaaggttcactttcagtcacggagtacttcactcgtctatgtgtgatctgggacgagattgagaatttcagacctgattcagtctgctcgtgcaacatcaggtgctcatgcactgctttcaccatcatcgcacaacgtaagcttgaagatagagccatgcaattcctacgaggtttgaacgaacaatacactaacattcgttctcacgtgcttctcatggatcctatacctgccatatccaaaatcttttcttatgtagctcagcaagaaagacaattgctagggcacgcaggaccaaacatcaacttcgaacctaaggacatctccataaacgcgacgaagaccacttgcgatttctgtggatgcattggtcatgtagaaagtgtttgttataagaagcatggggtgcctgcaagttatgatggaagaaacaagaataacaatggaagaaagacgtgtacctactgcggcaagattgggcacacagtagatgtttgttaccggaaacatggatacccgccgggatacaaaccctatggtggaagaaccaccgtaaacaacatgatgacaatggaagataaagctacaaatgatcaagctcagcaacacgagtcacaagaggttgttcacttctcacctgagcagtacaaggcattacttgccttaatccagcagccgccggcaggaagcacggcgcagtccaaacaagttgcatcagtctcctcgtgcactgtcaacacaccattgaacccagattaccacagagatcttgcttcatctacaccaaaagcttcggtgattgttcgctatccactaagctcagtgctttcgtactcacgtctctcacctgtccataggaaattcgtgatgaccatctcatcagccgcagaaccttcatcatatgccgaagcctctcgccatgactgctggattaaggcaatgaaggccgagttacaagctttgcagacgaacaacacttggagactcacacttcttcctcctcacaagacagctatcggatgcagatggatttacaagattaaataccgggctgatggttccatagaaaggtataaagcatgcttggtcgccaagggttacactcaaatggaagggttagactacctcgacacattctctccggtggcaaaactcactaccgttcgtgttcttcttgcattggctgcgcaaaatcaatggcacttgcgaaaattggatgtcaacaatgcgttcctccatggagagcttgaagaggaagtgtatatgcaaattccacctggacttgcagttgagaacccgaaacttgtttgtcgtcttcaacggtccctctatgggcttaaacaagccaaccgacaatggttcacaaagctatctagtttcttagtctctcatgggtttcaacaatctaactcagaccactctctcttcttaaaactcactaggtctgtcactaccatactcttggtgtacgtagatgatatcatactcacggggaacagcatactggaaatacaagatatcaccaccctcctggatcaagaattcaaaataaaagaccttggtgacttgaagttctttctgggactcgagattgcctgcaccactgatggaattcatctatgtcaacgaaaatatgccttagacattttatctgattcaggtatgctgggttgcaagccacactcgacacccatggattattccatgaagttacagatgaattcaggcaactctctttctgacgagtcctcatcctcctatcgaagactaataggaaaactcatatacctcaccaacactcgcccagatattgtgtacgctgttcaacaacttagccaatacctcaagggttcaccaggatccgggctcttcttcgcagcaaccgggactccccaacttcgagctttcagtgattcagattgggcggggtgtaaagattctcaaaaatccactacagggttccttgtctatctgggttcttcactcatttcgtggcagtcaaagaagcagtccaccgtctcccgcagctcctccgaagtcgagtatcaagctctcgcatctactacctgtgagctgcaatggctaacatatattctccaagacattggtgtagcattcattcagccagccaccttgtattgtgacaaccagtctgcaattcagatagcaacaaatcccgttttccatgaacgcactaagcatatcgagatcgattgccatattatccgccacaaagtcaccgcgggtctcgtaaagctccttcctgtctcatcctccatgcaactcgtggacatattcaccaaagctttaccaccagccacctttcagcacctttgtaacaagctggtaatgatgaatatccattcccagcttgaggggggctcttag

SEQ ID NO: 56082 - DNA, 390 bp, Glycine max
  Peptide Sequence Number=SeqID_172860
atggctcaggactttgttttctctgcaagtggtatgggtggtggcggcttcagaaaagagccaccagatggcgggggtgtcgataaacgtgttctattcaaagataaggtcgtcgggaataagaagccaatggttcacatagccgactctatttttgaaggtttgtgtgcaccatgggaggttgctttggtcgtcaagcttcttggaaagagtattggttacaatgtaatgaaaggcaggttaacacggttgtggagattaacggtagggtttgatatcatggatatcagcaataatttctatatggtgaaatttgatacggggatggacaaaactaaggtcatggaggaagggccatggatgatatttgatcattatctcacggtataa

SEQ ID NO: 56083 - DNA, 681 bp, Glycine max
  Peptide Sequence Number=SeqID_172861
atggctgaaacttccaaatttcattcatccttagctatcaccaatgtgaaaactctcatccccatcacattggacttggaatcaggacaataccactcctgggtggcgttattcaaggttcatgtaaaggttcataacgtacttgaacatatcatcccacctactgatgcaaaggagaacgttgtatatgacaaggccaaagtcgatgatctccctctcttgaaacggctcaatgcggcagtcttgcagtggatttatgccacggtctcctccgacatcctcacctccattctcattgatgatgacttggctgaacatgcttggcacagtgttgtggatctctttcatgataataaaaactcaagggccctaaaaaaaacaagaattctggcggtcgaaactccgaaaaacgtggccagaacaccggtggtggctcaaaccgtggctccgtgggcttcgtgggcttgcccaccttctccatatccttcctacaaaaattgggctagacccactttcagtcctagaccaccacagcctggcttcttggaccgaagcctcagcaggcaacttacaatgcaaatgcacccaacgcaactgatattgaagcagctcttcatactctcagccttgcttaacctgatccgtcatggtacatggacactagggcgacatctcacatga

SEQ ID NO: 56084 - DNA, 516 bp, Glycine max
  Peptide Sequence Number=SeqID_172862
atggatgatcatatgcatgctctcaagcgcatcttgcgctatgttcaagattggggtgattgcccagatactagaaaatctacttccggttattgtgtgtttcttggtgataacttgctctcatggtcttctaaatgccaacccacactatctcgctccagtgttgaggccgaatatcaaggtgttgccaacgtggtttctgagtcatgttggttacgcaatcttcttttgaagttacactgtcctgtccatacaactacattggtctattgtgataatgttagtgcgatatatcttgccggaaatccagttcaacatcaacgcactaaacacattaaaatggatattcactttgttggtgagaaagtttcccgtggacaagtatgcatcctacatgtcccctcgcgttatcaaattgccgatattttcacaaaagggcttcctttggtattatttcaagattttagagacaatctcagtgtacgacaacctcccgcttcaactgttggggtgtga

SEQ ID NO: 56085 - DNA, 729 bp, Glycine max
  Peptide Sequence Number=SeqID_172863
atgcgttggaaatggcaacatatcttctcaacattttaccatgaaaatgaatttcccttctcaaagttgcacacttatttttcctccacctatgattttcttgacaatggcttatcaccttatgtgataaaccatttacaaaatcaatccactcctcacattcaagtgtcgaaccacccttctttggccccagcccaatcacctggtcaaccccgctcccctaatcatgcaactccctcttctccgcaaccgtcccaaccaacttcctcacccccacagtcggcccagtccacctctaccaacacagagtcatcatcctccactttgggccagtcagatctcaacccacatttagatcatacacaacatctccctcttcctcccattttccagcctatttcgagttccaaaaacaaacccattacaaggagccaacatggtatttttagaccaaataaaaaatatcaacatggcttccttactaatgtcaccaagcctcctctccctcataaccccgtgtctgcactccaagacccgaactggaaaatggctatggatgatgaatatattgctctcattaagaataagacgtgggatttagttcccggtccacctgatgttaatgttattcagtctatgtggatttttagacataaagaaaaatctgatggttcttttgagaggcataaggcccgacttgtaggtaatggtgcaggacaacagatatga

SEQ ID NO: 56086 - DNA, 126 bp, Glycine max
  Peptide Sequence Number=SeqID_172864
atggaagacgcacccgtgagcttcgactcgcctgcccgcaaaagggtgcatgttgtgtatgttcgtggggggcggagtgcactgaccttgtcggatggcccattcatgggggacaagcatggttaa

SEQ ID NO: 56087 - DNA, 942 bp, Glycine max
  Peptide Sequence Number=SeqID_172865
atggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaaattctttggcacttaatcgagatattcaggaggaacagactgttccagcccgataccgtcaagaatttcttacgattgcatgggaacagcttttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctg

SEQ ID NO: 56088 - DNA, 538 bp, Glycine max
  Peptide Sequence Number=SeqID_172866
atgtttcgacacgttaagaaactgcagtacacggtgcgcgtcagtgcgccgaatccgggcctggccaatctgctgttagagcagtttggcggtccgcagggcgaactggctgcggccatgcgctattttacccaaggcctcggcgatgaggatttaggacgccgcgacctgctgatggatatcgctaccgaggagctcagccatcttgagattatcggctcgctggttggcatgctcaataaaggcgccaaaggcaagctggccgaaggcactgaagaggaaggcgaactgtatcgctcaatcacgggtgccggtaacgatagccatctgacttcaattctttatggcggtggtccgccgctgaccaactccggcggtgtgccgtggaccgcggcttacgtggatactatcggggaagtgacggcggatctgcgttctaacattgccgccgaagcgcgcgccaaaatcatctatgaacgtctgatcaacgtcactgacgatgtcggcgtgaaggatgcgttaggcttcctgatgacgc

SEQ ID NO: 56089 - DNA, 441 bp, Glycine max
  Peptide Sequence Number=SeqID_172867
atgtgtatattctacccttcatatgacatgagactttcaatggaagaggttcaagtttgtgcatatgttcacaacatcatcaagccaccagaggaggttgaatttgtaatgggcaagcatcttgcaacaaggggtgactttaaggatcttcatccaaatagcatctttgacacaaagtgggacttgatgcatgtatataatttcgaagatgtcttcaacaaatatactagtgagtggattccttcctttgaccaactatcagagatttattctcatattcatgatgaggacaacctctattacttgatggttatttgtttcaaaacccaaaaggtgtatgacatggattcatttcttatagaggaagttcttcctaaacgaaaaacaaacatccatcaagtggtaacactttactttgataaaataagactgtttgtctaa

SEQ ID NO: 56090 - DNA, 468 bp, Glycine max
  Peptide Sequence Number=SeqID_172868
atgggtgctttgtatcagatagttcttctgaacattgctatgtattttgcatcagtcatgcacaccacatcaaggagcatgccactcatgccagtggacttaacactcggtttcactgaactctcactcaacatctccaattttaaaaatcacaagccttataatttacccgtaagagaacgctataggtttaaaaacggagtacacaagctgtgggtgcacgtcacagacaaacctctatccccacatagcaataccaaccctcgttcagaaatccgcacagagggctacgattattcacgaggggtatggcaatttgaagggcaaggttttgtgcctaaggatacttctgggtttatgaagccccgggtcatggaggaagttcccattattccaaatttggtgtctacacgcaacatgatccttcttgctatatggagtcaaggtggaaaaatattagaggtctaa

SEQ ID NO: 56091 - DNA, 333 bp, Glycine max
  Peptide Sequence Number=SeqID_172869
atggatcgagctgaagccttggtgagggagatggaagaacaagggatagatgctcccattgatatctatcataccatgatggatggttatacaatgattggtaatgaagagaaatgcttgattgtatttgacagacttaagcatgaagttcttcatagtcatccacctaatcatctacttccacgaacacaagattcgagatcatcacaggatccaaacataaatagcacacggggacaagcgttatgcaacagttatgctaagactcaagcctatatgcaatatggtaccatgtcagtgaaaaatcaccctggggcgtttaggagtacataa

SEQ ID NO: 56092 - DNA, 285 bp, Glycine max
  Peptide Sequence Number=SeqID_172870
atggaggagagctcaggttacttgttttttcactgcaacaaaattcttccagtatggtgggaatcgttgtcttgggtgaatatggtgggtgctttcccgcataacccaaaacaacatttcctccaacacatatatggagtgaccgagggcataagggctaacgggtggaagtggtggtggctattttcttactatggacatggctcagaaatttggagaaggattttggcactcactacaatcactggtctagcaatcttagtacagggtttattaagtagctga

SEQ ID NO: 56093 - DNA, 411 bp, Glycine max
  Peptide Sequence Number=SeqID_172871
atgcctgtcatcttggaattgtcaccacaaaagcatcaatttcattttatggctctcaaacatggattattcttgttggcccttgcatgctttgttgcatatggcacagcaacaagggacttggcgatgaagagcccaaaacagaatcacgtggagtgctggagcaacctcattgtgctaaaatcatgttacaatgagattatgcatttcttcatcaatggtcaagctgatattggccccaactgttgctgtgccattacggtaataacccatgattgctggcccgaaatactcacttccttgggctacactcaccttgaagctctcaatatacgtggctattgtgatgctgctgcttcaagcccagctttggcccctgctgctgatggacctgccaacccaatctattaa

SEQ ID NO: 56094 - DNA, 257 bp, Glycine max
  Peptide Sequence Number=SeqID_172872
ggctacgattattcacgtggggtgtggcaatttgaagggcatggttttgtgcccaatggtacttctggggtgtgcattatgcaagtgttcggggcacgccctaaacgtgccaccactcttatgcttgatgtctctaatgtgaagatttatgttgatggggttcaggtttatgaagccaatggccagggaggaagtttccattttttcaaatttggtgtctacacacaagatgatccatctagctatatggaatcaag

SEQ ID NO: 56095 - DNA, 498 bp, Glycine max
  Peptide Sequence Number=SeqID_172873
atgaccaaggctgtagcaatattggatgaaatgaatgtggcaggtgttggaccaaatgaacacacatatacaactcttatgcaaggttatgcttcactgggtgacactgaaaaggcctttcagtactttacagtgttgaggaatgagggcctggagattgatgtttatacttacgaagcgttattgaagtcatgttgcaaatcaggcagaatgcagagtgcccttgcagtcacaaaagaaatgagtgcaaaaaatattccaagaaacacttttgtctataacatactaattgatggttgggctcggagaggtgatgtttgggaggctgcagacttgatgcaacaaatgagaaaagaaggacttctaccagacatccatacctacacatcttttataaatgcttgttgtaaagctggggatatgcagtggactaaaaataagggtataaatgtctcatttgggtcatcttcatcgtcatttagtatagcaatgaattga

SEQ ID NO: 56096 - DNA, 852 bp, Glycine max
  Peptide Sequence Number=SeqID_172874
atggacgcactcacctataaaggactacacgtcctcgccttcagagggctacacgttttttccttcagagggttgcacaccctcgacttcagaggacttcacgcccttaccttcagaggactgcacatcctcaccttcagagggctacacgccttcgcctttagaggactacacgtcctcgccttcagaggactacacgtccttaccttcagagggctacacatcctcgccttgagaggactacagtcctcgtcttcagaggatatcaaaggactgcacgtcctcgtctacagagggctacacgccctcgccttcagaaggctccacgccctcgacttcaaaggactacacgtcctcgccttcagagtgctgcacgcccttgccttcagagggatacatgtcctgaccttcagagaggactgcgccttcagaggactacacgtcctcgccttcagagggctacaggtcctgaccttcagaggactacaagtcctcgccgtcagagggctccatgtcctcgccttcagaggactacacgtcctcgccttcagaggactgcatgtccttatcttgggaggacaacatgtcctcaccttcagaggactacacgtcctaaccttcagaggactacacgtcctcgcctttagtggactacatgtcctcgcctttagaggaatgcacgtccttgccttcagaggactacacatcctcgccttcataggactacacgtcctcgccttcagagggcgacacacccacacctttagaggaccacacatcctcaccttcagaggactacacgctcaccaacatgaccattcatacacagatatggatgacattgctacttag

SEQ ID NO: 56097 - DNA, 396 bp, Glycine max
  Peptide Sequence Number=SeqID_172875
atgatcatttccactgcattggcacttggcagaggaaaccgaggctttcctgttttaaatggactgaacctacgaaatcgaggaaggggtccgccgcaccatgcaccaccagccaccgcctcaaacttgatctccagccacacctctgctaacaccgacctccgtcctaaatctgcgtttcttggttccagatctacgttttcaatcacactctttctcgcgaaatcaggaaccaagctcggtgaggattatggagctgtgtgtgagaaggagaacgcagagcacctaggcatgaaaaagaagagtctgttgcggtcaatttctttttctgaaaatctgagaaaacagagagaacatgaagaaggagcaagctcatttctggttccaagaaattaa

SEQ ID NO: 56098 - DNA, 132 bp, Glycine max
  Peptide Sequence Number=SeqID_172876
atggcggtccttactctcactataaaatccaaaacaaattggcgggaaaagaagccatcgaagaagttcagagtcagagcaagctccgatcagagttcctgcaagtcctgcgtactaggcgacctgctcaag

SEQ ID NO: 56099 - DNA, 321 bp, Glycine max
  Peptide Sequence Number=SeqID_172877
atgttaggatttacacgcgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattggattatcaagtagatatgggagcaaggattgcctttgtggataactgggcggtgggtaaggagaaggaatggcagtcacagcatgggcttctccctcattctcaccctcttcatttgccctag

SEQ ID NO: 56100 - DNA, 803 bp, Glycine max
  Peptide Sequence Number=SeqID_172878
tctcggccagctggccgttggtggacaccacggtcacatcgggcggcaggaagggctgccgagatggcgacggccgcgtccagcaggccgcccgggtcgttgcgcaggtccagaaccaggcccttcatgttgggttcctgcttgtacagctcttcgaccttgcgcacgaagtcgtccaccgtgcgttcctggaactggctcaggcggatccagccgtagccgggctcgatgaccttgcccttgacggattgcgtcttgatttcctcgcgcgtgatggtcacggggaagctgcggctttcatccttgcgcaggatggtcaactgcaccttggtgttgggctcgccgcgcatgcgcttgacggcgtcgttgagcgacaggcccttgacggccgtgtcgtcgatcttggtgatcaggtcgccggtcttcaggcccgcgcggaaggcgggggagccttcgatgggcgagacaaccttgatcaggccgtcttcctgcgtgatctcgatgcctacgccgacgaagcggcccgaggtgccttcgcggaattccttgtaggacttcttgtcgaagtactgcgaatgcggatcgaggctggacaccatgccggagatggcatcggtgatcagcttcttgtcatcgaccgactcgacatagtcggtcttgatcaggccgaagacggcggacagctgctggatctcttccagcggcagcggggtcatggcaccgcgggccacggtctgcaaggaaaccgtggcaagcgcccgcgtggttccctaaaaacggcgcagcaagcgcaatttccgtag

SEQ ID NO: 56101 - DNA, 354 bp, Glycine max
  Peptide Sequence Number=SeqID_172879
atgggcacctcactatcccccatctgtccttttcgcatacaatggatgcagttatcaaatcaaggtcatgaaatgccgaaacaagtactcccgctctctgctctaccctatgttgatgcctccgctcaacatatgaccatccttacagatcatggccatcctcttcaatggaacgttaccgtcaacaatcctagcattggtcaacaatgcattgcccacccttggtatgaatttttggcaaataatgacttcagccctggagatgaaatatcgttttactttaggacttatcataaagtatgggaattgagtatcataaaacaacaacaatgggatgatacagactctgattag

SEQ ID NO: 56102 - DNA, 1557 bp, Glycine max
  Peptide Sequence Number=SeqID_172880
atgcaacttagggttgcaggctacgtaggggaagggtgcagctatgacgatgatgcagtaggactcgccatccaagctggcgaaacagtattaatgacatcatcttcatcaaatataaaaattaaatctggtccggttgacgaagacgtgttatggatacaagatatgcatgtttcacaacatatttggaatgaggaagaagatagaaaattacacattagactacacgagttgtctccacgtctctgtatggatgggtcaccattaattggtccaacaaaccttaaatgggctgatttatgtggagaattgttaggggttagaccagaagaagaagttaataaccatgacggcaacttacaacaagtagaaatgtttacacgtgcatggatcctaagattcattggaggtgtcttatttgttgacaaaggtagtagcaaagtttcgctaaggtggctgcgacggggaaatcaacatatcgccaatgatgatttgatacttttttgtcacaaattagatattatgaaacgacatgagtttgtgtgggagccttacacaacaaatgttatgtcagtgttgcctccaatttgtttagttggaagtgtagcgtggtgcgcgatggtatcactaatttgtttccaagttattgaatgccaccaacctgatatagtgttgagacaatttggaatgcaacaaccaattccatggtgtccttcgcaacccttgaatattcatggcataacattgaaagaaaaacatgatgaaaatttggggcaactgttaggcctaatgatcaatcaatggaacaatcgagctgattttaggatcgatggttatcctcgacaagaaggtctactgagctttaactccgactatatggtctggtataggcgaaaaacgaagatgtttgttgaccctaaaaatgcaaacacaactacattggctgaagttgcagagacattacagtacatggtgtctccacaagggagaaatacatggacagtggatgatctagtgtcgtatgtggagaaaataaccattttatctgaagagcaagagagaatcactgaacctgtgtcacatggtccagcaatagaacatcaatttgcaacacaagagtttcatattctcccgtcaagtgttgaaactcaaggcatagccagacgaagggaggttgttgaagcagaatcatatttgtacccacagatggtagagcgtggtcatggaatgtattacacaccaccaacattttctcagtatccattcgaaggtcatcaaagtgatacttctgcaagcgaacattcattaggtggtgttgcgaaaatatatccaaatttttcatggcctactatgaccccttcacaacaacatgatgctccaattccaacacctaatgccccattagatggttcaagtcaatccatctcattccttatccttgttgattttggccgacctttggcacgaattgtagttggatctgggataaatgtccatgagtcatcaaaaggaggaattgccgcttcattcccaagaggtcaccattgtgcggagtaa

SEQ ID NO: 56103 - DNA, 1113 bp, Glycine max
  Peptide Sequence Number=SeqID_172881
atggcaaaagtgctatctagaagacttaagaaggtgctgccttatatcatagacaaatgccaatatgcttttatggagggcaggcagttactgcatagcgcagttatagctaatgaagttgtggaagaagaaaagagatgcaataaaagctacctagtgttcaaagtagactatgaaaaggcatatgactctgtgtgttgggattttctttcctatatgatgaatcggatggggttctgcaccaaatggattaagtggattgagggctgcttaaagtcaacctcaatatcaatactggtaaatggaatccccacagatgagttttttcctcaaggaggtctcagggaaggagacccactggctccattcttgttcaacattgtagctgagtggttaattggattgatgaaagaagctcaggaaaagaagctatttgaagggattaaagtagggagggatgggttggatattagcttactacagtatgctgctgacacgattttctttggaaaagcatcgctggagaatgtaaaagcaatcaagggttccaaagaaggtggccgacaagctggtgacgttgcagtgatggttcttgggggggaagttcagaccaacagaagattgcctgggctttacttggaaaatggaaatggaacctattccaccatcagggagaattgtagtcatgtctacaatgcatttaaggaaaagagttggtgcacaagtggtatagaatggaaaattggatgtgggtcaaaggtgaagttttggaaagatagatggctggctgtatgggaatggcaactagaatggaaaaggttatttagggaagcggagatagacatagttgcaaaatatatggaggacatcgagggtgtgatagtgcaacctaatcagcacgataggtggggttggagggtggatccaagcaagagtctaccaacaaaggttaatttcagaagaaggaatgtggatttgaatgatgtctcttgccctttctgtagacctaaggaggaggatgcatcccatctgttcttcaactgttataaaatattgcctttatggtgggaatcattgtcttggttaaatatagttgatgtttccccggaatag

SEQ ID NO: 56104 - DNA, 984 bp, Glycine max
  Peptide Sequence Number=SeqID_172882
atggccatcacaccgtgttgcacatgccccttcccaaggactaaaccaccacccttaaggctgaaattaaggcaacccgaaagaggccacggcagctttccaacaggaagaaaagtaatagagatcaatcttggattttggagtagaaattgtggaaactcgtcctttggtcttcttaatacttcttcagctgttatccaggtggaaactgcagaatcttattcagtttcaatgaaaaatgtggtaatcaatgtttcagttgaggaccgtaagaaaattatttttgagcaatctaatgcattagcagaaagtgtaaatggccaaattcttattccaaaaggtttgcttgacgaggttgtaaatcttgttgaggcaccttttcccgtgcttggaaagtttaaggaaaccttcttagatcttctaaaagatcttttgattatggttatgcaaaagcatcaaaagtattttgctgtatgtgatgctaatggacaattattgccttattttgttgctgttgcaaatggagcaattgatgagactacagtgaggaaaggaaatgaagctgtgctctgggctcgctatgaagatgctaagttcttttatgagatggacacttgtaaaaggttttcagaattccgaaagcaactgaaaaacattctctttcatgagaagcttggaaccatgctggataagatgactcgtgttgaaaacatggttactaaactaagttgcctcctagatatcaatgaagatgtgcaacaaattatccgggatgcttcctcacttgctatgtctgttcttgccactgcagttgtcactgaatttacatcactttcaggaattatggggcgtcattatgcccttagagatggatactcagaccagattgcagaggccttgcttgagatcacacttcctagattttctggggacatacttcccaaaagtgatgctgacatagttttggcaattgctgataggtga

SEQ ID NO: 56105 - DNA, 408 bp, Glycine max
  Peptide Sequence Number=SeqID_172883
atgggtgaaaaggaactatggattgagttcaacaagtgggaaggctttagggaggtctacattgtaaggaaccgaaatagaagtggtcgtagatacaagtttgtgagattcaaaggggtggataatgcaaagaaactaaaaagacaactaggcaatctggttctggaaggtttaaagctttacgtgaacttaccgaagcacgaaagggaacaaaatccgatagagacaatcaacaagaaacaccagccaaaagaggaggcaaccatagcgaagcagcaccatcccaatcaagcatgggtgatgtgttgggggattctgctacactcatgggatgaggaaaacatcacaaagattgtgaatggtattggtgaggtggtggatgtggatgacgacatagaagacctatag

SEQ ID NO: 56106 - DNA, 654 bp, Glycine max
  Peptide Sequence Number=SeqID_172884
atggagatgaaggtgaagggcactggctttatatatttggaaggaaaatgggccggagatttcaattgcatcagaagtccatcagaaagagttggagtgtgtcaaaggatacaaagtgggggtagcttgaaggaatttaatgattggattgctgactttgaggttgaggaagtacctaataaatcattcaagaaggtagtacaagactactggatggaaaattctgtaactagctgggggggatatgtcctgaaagaaaaactcaagaaactaaagcagagactaaaagaatggaatataaatcaattaggagatgctcaagagaaattgaagaaagtggagttagagcttaataaactggaaaaagaaggagatagtaggcagctgaatgagcaagaggacaaattgagaaagcaattacaagagaacttgtggtgggcagcgagctcatttgaatccattgccggacaaaaggcaagatcaagatggattaaggaaggggacgacaattctagatatttccacttggatgaacttgaattcaaaagaccgaggctagatgggatcaaattcaagtccattgatcaacaacataatgatatgttggtgacacgaattgaagaggaggaagtgagggcaacaatctgggattga

SEQ ID NO: 56107 - DNA, 402 bp, Glycine max
  Peptide Sequence Number=SeqID_172885
atgcatgctgatggcttagactggttcctcatgatttttggtctctttggggccattggtgatggcataggcacccctttggtgttgtttatcaccagcaaaattatgaacaatattggtggtttttctagcaacataggcagcactttcatccacagcatcaatgagaatgccgtggttttgttatatttggctggtgggtctttcattgcttgtttcctagagggttattgttggacaagaacaggagaaaggcaagctgcaagaatgagagttaggtaccttaaagcagttctcaggcaagaagtagcatactttgatttgcatgtcacaagcacatcggaggtcatcaccagcgtctctaatgatagcctcgtaattcaagattgtcttagtgaaaag

SEQ ID NO: 56108 - DNA, 3153 bp, Glycine max
  Peptide Sequence Number=SeqID_172886
atgataaggttggctagaaagatcagagaagagagtaacaaggctggtacaatagcagaacaagcaatatcttccatcagaactgtttattccttcgtgggggaaagcaagaccataaatgctttctctgatgctctacaaggctctgttaagttggggctgagacaaggcttagctaaaggtttagccattggaagcaaaggtgctgtgtttgctatatggtctttcatgtgctattatggaagtagattggtcatgtaccatggtgctaaaggagggactgtattcgcagttggatcagtcatatgtattggtggatcggcattaggtgctagtttatctgagttgaagtacttcacagaagcatgcgctgctggggaacgcataatggaaattataaaaagagttcccaatattgattccgaaaatatggctggggagattctagagagggtctcaggagaagtggaatttgataatgtgaaatttgtgtatccatcaaggccagacagtgttattctgaatgatttctgcctaaagattccagcagggaacacagtggcattggttggaggaagtgggtcaggaaagtccactctgatttcacttttgcaaagattttatgacccaattgagggagagatacgtcttgatggtgtggctattaataggttgcaactcaagtggtttaggtctcaaatgggtttggttagccaagagcctactctttttgcaactagcattaaggagaatatactttttggaaaagaagatgccaatgaggaagacattgttgaggctgccaaagctgccaatgctcacgatttcatttcgcagttgccacaaggatacaatacccgggttggagagaaaggagttcaaatatcaggggggcaaaaacagaggattgctattgcacgagcaataataaaaaaaccccaaatccttcttctagatgaggcaacaagtgcactagactccgaatcagaacgcaaagtgcaagaagctcttgataaaattgttctggatcgaactaccattgtcgtagctcatcgcttatccacaataagagatgcacatgtcattattgttttggagaatgggaagatcatagagatgggttctcatggtgagctcacacaaattgacaatgggctttacacatctcttgttcatttccaacaaattgagaaatccaaaaatgacacactctttcacccttctattttaaatgaagacatgcaaaacacaagtagtgatattgtaattagtcattctatttctacaaacgcaatggctcaattttctcttgttgatgaagataatgccaaaatagccaaagatgatcaaaagctctcacctccttcattttggaaattgttagcattgaatctgcctgagtggaaacaagcatgtttggggtgtttgaatgcaacgttatttggtgcaattgagccattgtatgcatttgcaatgggctccatgatatcaatttttttcctcacagatcatgatgagattaaaaagaaagttgttatctattgtttattttttatgggattggctgtgttttcattggttgttaatatcatccaacattatagttttgcttacatgggagaatacttgagcaaaagggtgaaagaaagcatgctttccaagatactcaattttgaagttgcatggttcgatcaggacaaaaattccaccggtgtgatttgctctagattaactaaagaagccaatatagttaggtctttagtgggagatagaatggctctgttggtacaaactatttcagcagtggtgatagcatgcacaatgggcctaatcattgcatggagatttgccattatattgattgttgttcaacctattggcattgcaagtttctacacaagacttgtactcctcaagggtatgtctaaaaaggctatcaaagcccaagatgaaactagcaaaatagctattgaagctatttctaaccttcgaaccatcactgccttttcctcacaagaccaggtcataaaaatgttaaaaaaggctcaagaaggcccaatccgtgaaaatattagacaatcatggtttgcaggcattgggcttggatgtgctcgaagccttacaactttcactcgggctttagaatattggtatggtggaaagcttgttttcgatggctatattacttcaaaacaattatttcaaacatgcttaatattggcaaatacaggtagggtcatagcagatgctagtagccttactagtgacgttgcaaaaggggcagatgccattggcctagttttctcaatcttaaacagaaacacaaaaatagattctgatgaaatgactgcatacatgccccaaaagttaataggccatatagaatttcaagatgtctattttgcatacccatcaagacccaatgtgatgattttccaagaattctcaatcaaaattgatgcaggtatatccacagcagtggtaggacaaagtgggtctggcaaatcaactataatgggcttaatagagaggttttatgacccacttaaagggatagtaatgatagatggaagagacataaggtcatatcaccttaggtcactaaggaactacatttcacttgtgagccaagagccaacactttttaatgggaccataagggaaaacattgcatatggagcatttgatatgactaatgaagttgagatcattgaagcagccagaatagctaatgctcatgactttattgcaggcatgaaggacggttatgacacatggtgtggagataggggagttcaattatctggggggcaaaagcagaggattgcaatagctagggctgtgctaaaaaacccaaaagtgttgcttttggatgaggctactagtgcacttgatagtcaatcagagaaggtggttcaagatgctttggaacgagtgatggtaggaaggacgagtgtggtggtggctcataggttgagcactataaagaattgtaatcgaattgttgtgttgaacaaagggagggtggtagaagaagggacccatttgtgtttgttgtctaaaggaccaagtggagtttactactctatggtgagtcttcaaagaagtgcaacaaccactagtgctattgataatgaattttccattaactaa

SEQ ID NO: 56109 - DNA, 435 bp, Glycine max
  Peptide Sequence Number=SeqID_172887
atgttggttggtgttgtggttggggttgttggatttgtgtttgataaaaatgatggtgttaataaaagaactgcagcaatggggaatgatgcagactcaaacagtggaacagaggatgacattcattcttcaactgactttgaattctacttacaaggattagagagggccaagataatagtgaacaaaccattaacacaacccacgggaataatcagtcttccaaccgctatgtgcttatatgcaattagttgtcattatggagtgttaggaggaggtcactatacagcatttgtccgttatggctatgataaatggtatgattttgatgacagcagggtcgaatctattagtgaggacatgataaagactcctgctgcttatgttcttttctacaggaaaattaagatgaaaattttagatgcaattgtgtaa

SEQ ID NO: 56110 - DNA, 1075 bp, Glycine max
  Peptide Sequence Number=SeqID_172888
atggtggcagagatgatggtggaggcgggggcttcggaggtggtggtggtggatgtggcggcgggcgttgacgccgatgagcgacagagcaagaggatgaagggcgacgatgcgaacgacggcgaggacggcggttgcaagaaagagcctgagaaagacagagccataaaccatgcttgggaacatttctctggtcgtcagaggatggaaggggaggaggaacgtaggagtgtggaagcacgggctgccttgggctgtttgggttgccccattcctgaggataaagctgaggaggatcgtaggagtgtggaggcacgtgaggacgaggcggaggagctggcgacggcgctgaagaaggaaacagtggtggcggtgacagcggcggcgatggtggctgggctgaagaaggaaacagtagtggcggcgacagtgacggctgtggtggcggcatcgatgcaggaaacgggaagcgctggcgaaatatcacgatcggaatccattgcggcgaggttggccatggctgcctcgagccggtccaggctggcatcgagaggttcgacatctgccattgaagaacaacagagaagggggcagggagttgagagagggaaaggaaatacgtttgatccttttcatcttgccatgcacattataacaagcaatcaacaaatatctacaatcggacttaagctaattccaaatctaacaatgcatgccaacaaagcaacaccaaacacatcaactaataaaaggtcaaaaccaaaagcagaaacagaggccaccatggaaaacgaattaaatggaaatagacgcataccagatgcaacaacaacaatatgtcctcatgacccccatgacaacaatggcgacttcaacggtgacagagcgatggtgcaggctacaatggcgacactgacagaggcggaggaaaccgttgttgaaatgttggttgtatttacaaaactgtcaccactactcagacgagatagggatctcaagaggtgtcttgtagaggtgttctacaagatgtgtctcaatactaggttctttgaggggctagaaaatcatggaaagg

SEQ ID NO: 56111 - DNA, 162 bp, Glycine max
  Peptide Sequence Number=SeqID_172889
atggttgctcttgactatgcttgtgggtatggaggtgcagactgctcagcaatacaaccaggagcaagctgttataatccaaacactgtctgcgatcatgcttcatatgcattcaatgattactaccagaagaatccagcaccaaccagcttaaaagcatga

SEQ ID NO: 56112 - DNA, 294 bp, Glycine max
  Peptide Sequence Number=SeqID_172890
atggaacgatatgttatcacattggaatgcacctgggaacctttccaagtggttctatcagcattcgggatcacgtcattcgcttgtcagttgtcctttagttcctacgccctaaagcgaggaacattattcatgaacatcaacaacctcaacagcagcattaggaccaacaacaacaataacaataataagacaatgaccaaccaaatgaccagtaacaagatgatgaccagcatagacactctcccatttaatctttcgattgctcacttagcaacacaaaattactattaa

SEQ ID NO: 56113 - DNA, 327 bp, Glycine max
  Peptide Sequence Number=SeqID_172891
atgtgcaaaatgcgcgtggatcagaaccatactattgttaacacgaagaagaagaagaagaaaaatgggtcaattagatccattttcatgcatgctgatagcctagattggtttttaatggttttgggtgtctttggagccatgggtgatggcttcaccacccctatctcggtgtacatcatgagcggaatcgtgaacaatgttggtggtgttttaaaaatgacaccaagtactttcatccacaacgtcaataagtattcactggcgttgacatacttggcttgtgcatccttttttgcttccttcctcgttctcaatttcttataa

SEQ ID NO: 56114 - DNA, 165 bp, Glycine max
  Peptide Sequence Number=SeqID_172892
atgagtgttgctaggtgcggtgaaggtgaaggtaccggtgttgagcgttgcggtggtcgatggcagcaaacgaggcacgcagaaggtggtgactgtgtcgggaatgtacggatcacttacggatcaagttggtgtgttaatcttatggatcaagttgatcagtaa

SEQ ID NO: 56115 - DNA, 855 bp, Glycine max
  Peptide Sequence Number=SeqID_172893
atggaggaagattcactccacgtgccagtgatggaaaggttaaggagttgtacaactgatggagatatattacacttagttagggatgcttttgaaaatgagaatgagataaatgtttattttcatcatgaagtagatccaattttagaagaagtcccacagatgttgtacttggaatgtgatccaattccagaagctgttgagaatgaggatgatttagatgatatgttggtgctggtgagcatgttggtgctggagagcagagagatggtggtgagcagagggatgctgatgctagtgaatagagagatggtgagggatgctggtgagcagagagatgctggtgagcgaagggatgttgatgctggtgagcagagagatggtggtggtgaagagagagatgttgctgatagtgaggaggaaaaggaagttgacaatgatgagtggtttacaaatttctcttgtatgatgaatgaagttgaagctgaagttgagacaaatgatgaggatgttgaagtttatcctcaatatagtcaaagtagtggagttggtgaacagaagttggaattagggatgaagtttggtactctatatgaatttaaatctgccttgagggagtatagcatattgatgggcaaggagttcaagtggaagaagaatgataaacagagggctagagcaaaatgcaagaagacattttgtgattgggaaatctactgtgcaaagaatgaagttagaaactcttttcagataaagacatttaagcataaccataattgctgcagagaagtgaacaacaaacaagcaaatagacagtgggtggtcagtaaacttaagggcaaactcagaatgtag

SEQ ID NO: 56116 - DNA, 240 bp, Glycine max
  Peptide Sequence Number=SeqID_172894
atgcgagaggatcagaaccatattggtgttgacacgaagaagaaaaatgggtctattgggtccattttcatgcatgctgatggcctagattggtttttaatggttttgggtgtctttggagccatgggtgatggcttcagctcccctgtcatgatgtacttcattggcagaatcgtgaacaatattggtgatgtttcaaaaatcacaccaatattcactggcgttgtcatattttgctag

SEQ ID NO: 56117 - DNA, 1404 bp, Glycine max
  Peptide Sequence Number=SeqID_172895
atggaggtggagaatgatcagaagccaagaagatatcatcaaaggctacgcaattggttcaatagcaagcaaaaggaagataggccatcatcattcagtttgaatgaaatacaagatggagtagaagatgaaagtgatgattatgagggcaatctctccctgcgctcattggaattagatccatgcatttcaacaaataaactaagggtctttgttggtacttggaatgttgctggaagatctcctgtaggaagtttggctgttgacttggatgagtggttgaatctcaagaatgctgcagatatatatgttcttgggtttcaagagattgtacctttgaagaccttaactgtgataggagcagaggatccagctgtggcaactagctggaaccagctaataggaaaaacactgaatgccaagtttggatgcccttggatgacaccaatgcagaattcttcatcatgtgatgatgatgacaataattatcagtatgtggagaatccaaacacaaaaggtggcaacaacaacaacagaaataatgataagtacacactggtggccagcaagaagatggttggagtgttcataagtgtgtggatgagggaagaggtgttgaggaagcatagtgtctcaaatgtgagagtgtgctcagtggcatgtggggtgatggggtatttgggaaacaaaggatcagtggcagttagcatgtcaattgaagggacaagtttttgttttgtagcagcacacttagcatctggggagaagaagggtgatgaagggagaaggaaccatcaggtagcagagatttttaggagaacatctttttctaggaccacaaaagaccataatcattttcctctaaccatcttaggccacgaccgtatattctggttcggggatctcaactataggctatacttggaggacaattttgccagacatttgataagaaagcaagattggaaggctttgcaagagtttgaccagctccagaaagaactagaagaaggtggagtattcgagggttggaaagagggtgacatagaattcgctccaacatataaatactcatcctccactaccaatagatactgtggtagcctccctagtagatccggagaaaaacaaagaactccagcatggtgtgatagaattttatggtatggtaaaggagtggagcaacttcactattttcggagtgaaagcaagttctctgatcatcgtcctgtttcagcacttttctctacacaaattgaaattaaatcatctaatagaggactgatggagttacataatatccccccaacaatgttgaatcccaagaatgggatgaacagaggagatgaagacggaaaatcttccttattatcattgttaacgaagaatttacaaggcttctaa

SEQ ID NO: 56118 - DNA, 3387 bp, Glycine max
  Peptide Sequence Number=SeqID_172896
atgagagttaagtatttaaaagcagtgcttagacaagatgtatcatattttgatttgcatgtcacaagcaagtctgaagtcctcacctgtgtctctagtgatagtctcgttattcaagaagttcttagtgaaaaggtgttcgttggaagctacatagcagcttttgttttgttgtggaaattggccattgtggcgtttccctttgtggtgcttcttgtgatccctggtttaatttatgggaagactatgatggggttggctagaaggatcagagaagagagtaataaggctggtacaatagcagaacaagcaatattttccatcagaaccgtttattcctttgtaggggaaagcaagaccataaatgctttctctgaagctctacaaggctctgttaagttagggctgagacaaggcttagctaaaggattagccattggaagcaatggtgttgtgtttgctatatggtctttcatggtctattatggaagcagattggtcatgtaccatggtgctaaaggagggactgtgtttgcggttggatcagtcatatgtattggtggatcggccttaggtgctagtttatctgagttgaagtacatcacagaagcatgtgttgctggggaacgcataatggaaatgataaaaagagttcccaatattgattctgaaaatatggctggggtgattctagagaaagtctcaggggaagtggaatttgatcatgttaaatttatctacccatcaaggcccgacaacgttattttgaatgatttttgcctgaggattccggcagggaaaacattggctttagttggagggagtggctcaggaaaatccactgtgatatcacttttgcaaagattttatgacccaattgagggagagatacgtcttgatggtgtggcttatcataggttgcaactcaagtggctaaggtcacagatgggtttggttagccaagagcctactctttttgcaaccagcattaagaagaatatactttttggaagagaagatgctaatgaggaagagattgttgaggctgccaaagctgccaatgctcatgatttcatttcacagttgccacaaggatacaatacccaggttggagagaaaggagttcaaatatcagggggacaaaagcagaaaattgctattgcacgagcaataataaaaaaaccccaaatccttcttctagatgaggcaacaagtgcactagactctgaatctgaacgcaaagtacaagaagctcttgataaaattgtactggatcgaactaccattatcatagctcatcgcttatccacaataagagatgcacatgtcattattgttttggagaatgggaagatcatggagatgggttctcatgatgagcttatacaaaacaacaatgggtattacacatctctagttcatttccagcaagttgagaaatccaaaaatgatgcattctttcaccctcttatttcaaatggagacatgcaaaacacaagtagtcatatggcacgacattctgtttctacaaactcaatggctcaattttcttttgttgatggagataataccgaaaaagttagagatgatgatcaaaagctcccatctccttcattttggagattgttatcatctaatcttcgagagtggaaacaaacatgtttcgggtgtttgagtgcattgttattcggtgcaattgagcccttgtacgcatttgcaatgggttccatggtatcaatttttttcctctcaaatcatgatgagattaaaaggaaaattatattatattctctattttttgtgggattggctgtgctttcattagttcttaatatcatccaacactatagttttgcttacatgggagagtacttgaccaaaaggctgaaagagaaaatgctttccaagatactcaactttgaaattgcatggttcgatcgtgatgaaaattccacgggtgttgtttgctctagactaattaaagaagccaatatagttcgatctttggtcggagatagaatggctcaattggtacaaactatctctagtgtggtaatagcatgtacaatgggactaatcattgcatggagatatgccattgtaataattgttgttcagcctattattattgcatgtttctacacaagatgtgtactgctcaagggcatgtctgaaaaggccatcaaagcccaagataaaagtagcaaaatagccattgaagctatttccaactttcgaaccatcacttccttttcctcacaagaccatgtcataaaaatgctaaaaaaggctcaagaaggtccaagccatgaaagcattcaacaatcatggtttgtaggcattggacttgggtgtgctcgaagccttaaaactttaactcaagctttagaattttggtatggtggaaagcttgttttccatggctacattacttcaaaagcactgtttgagatttgtttaatatttgcaaatataggaagagtcatagcagatgctagtagcctggccaacgacattgcaaaaggagtaactgtctctggcttagttttctcaatcttagatagaaacacaaaaatagagcctcatgaaacgaatgcatacaagccccaaaagttaacgggagatatagaactccaagatgtctattttgcatacccatcaagacccaatgtaatgattttccaagacttctcaatgaaaattgaagcaggcaaatccacagcattggtagggcaaagtgggtcgggcaaatcaactataataggcttaatagagagattttatgatccacttgaagggatagtaaccatggatggcattgacataaggtcatatcaccttaggtcactaaggaactacattgcacttgtgagccaagagccaacactttttaatgggaccataagggaaaacattgcatatggagcatttgataagactaatgaagctgagatcattgaagctgcaaggatagctaatgctcatgactttattgcaagcatgaaggatggttatgacacatggtgtggagatagaggattgcaattatctgggggccaaaagcagaggattgcaatagctagggctgtgttgaagaacccaaatgtgttacttttggatgaggccaccagtgcaattgatagtcaagcagagaatgtggttcaaaatgctttggagagagtgatggtaggaaggacgagtgtagtggtggctcacaggttgaacactataaagaattgtaatcaaattgttgttttagataaaggaagggttgtagaagaaggaaaccatacctctttgttggctaagggaccaaatggagtttactactctttggcgagtcttcaaagaagtttagtaaccaccagtgttattaataccgaataa

SEQ ID NO: 56119 - DNA, 333 bp, Glycine max
  Peptide Sequence Number=SeqID_172897
atgtcgtatggaattgatgctgtaaactcatgccatggaactgcatgtcggaaggagacacgtgaagtgcatgtttgtttcccagtttgttttgctgcaatgtgcgttccgtggcagatccaacggatgaacggagaagggagggagatatccgtttgccaatgtaccttcaatgcaaatccaatgccaacggattctcaacatgctcaaagctatggaggaggcgaaactgttgtattggatgttgaaaatggacacaatctcttatgcgaggtagtggcggagaagaggaagatacttactacacaaatttgtcagtttagaggatcatag

SEQ ID NO: 56120 - DNA, 501 bp, Glycine max
  Peptide Sequence Number=SeqID_172898
atggcttcaagtcaggaagaggtaacgcttttgggagttattggaagcccgtttgcatgcagggtgaagattgccctcaagttgaaaggagttgaatacaaatatgtggaagaaaatttggtcaacaagagtgaactgcttcacaaatccaacccagttcacaagaaggttccagtgtttattcacaatgagaagcccatagtttttggtgctgcacaaaaagctgctttcacagctgatgagaaagagcgtgagaagaatgttgaggaagaacatgaggctctgcagtttcttgagaatgagataaaggacaagaagttctttggaggagaggaggttggattggtagatattgctgctgtctacttagcattttggattcctatgtttcaagaaattgcggggttggagttatttacaagtgagaaatttcctaagctctacaagtggagccaacaaattctgaaccatccagttgccaaaagaatgtctgccccctag

SEQ ID NO: 56121 - DNA, 765 bp, Glycine max
  Peptide Sequence Number=SeqID_172899
atggcttcaagtcaggaagaggtgactcttttgggagtaattggaagcccatttgcttgcagggtgaagattgcccttaagttgaagggagttgaatacaaatatgtggaagaaaatttggccaacaagagtgatttgcttctcaaatccaacccagttcacaagaaagttccagtttttattcacaatgagaagcccatagcagagtctcttgtgattgttgagtacattgatgagacatggaagaacaaccccatcttgccttctgatccttaccaaagagccttggctcgtttctggtccaaattcattgatgacaagatcacactttttactttaaggtggctcgccagattttgtaatattagtatagcatgtgttaaaaagaatatgctagagagtgcgttgattgtgggtgctgcatggaatgctgttttcacggttgatgagaaagagcgtgagaagaatgttgtagaaacatatgaggctctgcagtttcttgagaatgagatcaaggacaagaaattctttggaggagaagaggttgggttggtagatatagctggtgtctacatagcattttgggtccctttgattcaagaaattgcagggttggagctattaagcagtgagaaatttcctaagctttacaagtggagccaagaatttgtgaaccatccaattgtcaaagaaggtcttccccctagagacccagtttttgcctttttcaaaggacgctatgaaagcctttctgcttcaagatag

SEQ ID NO: 56122 - DNA, 308 bp, Glycine max
  Peptide Sequence Number=SeqID_172900
ttcgaatagctgcacgtcatccatggtggcattgccgaatgaaactaccagaaaatgcacaacaactgccacttgcagacatggagaaatcaagtgaacaagaagcagcgactgagcctcagaggagaagaagaagaagcgactcagcttgggaaaccagcagcttcgtaaaccctaatttatttggggaagaagaagaagcaaccttgcgtgagagagaatttatagatgcagacctcagtgccacgttggacaatctacgtggcactgaattgccacctatgcacctcactaacgtcgtcacctga

SEQ ID NO: 56123 - DNA, 531 bp, Glycine max
  Peptide Sequence Number=SeqID_172901
atggagatgaagagagagattattaccaaggaggaagagcacaaggaggatagcatgcacactatagtgttcacagcaggtacatttcttctgatggtgtgtctaaagcactttctagttgagcaatggcgtgcttgggttttcctcatcctcaatgtcattttgttagccattttattcatgtctatgaggccagccaagctggaggatcacagttcaggaagtgaaatcagtgttgaagaagtgaaaagtgacaataataaattagagaaaaagaggtctcgagaaactgaggaaggaaaagattgctacacaaaacaatgttgtagtagtactagtagtagtacttatgttcatgttgagaatgaaaaagaagaggatgaggaagaggaagaggaggaggaagagcaggttccagtgctgtccaaggaggaattgaatgagagggtggaggctttcattgccatgtttaggcagcatttgatctctgatgtcaaacaagctgaaaatttcagtctccacaagattgaa

SEQ ID NO: 56124 - DNA, 286 bp, Glycine max
  Peptide Sequence Number=SeqID_172902
ggccttctttgatgctgcaggaactggattgttctggttattgttgcttggaatcatagtaacagcattgcttccgcatttggttatttgtagagaagcagagaagattgcgtatgacagggttgttgaaagtggacagtatatctgtttattaccagatttcattggttgctatccgaaggatagaggttttgttatcactgcagagcagaaaaagaaaaagttgattgcatgttacaatccttgcctccttgatgatgttgaatttatcccttcattctgttga

SEQ ID NO: 56125 - DNA, 303 bp, Glycine max
  Peptide Sequence Number=SeqID_172903
ttgataattttgttattccgatttgatattgagctcgagagagaaactcgtcgattttggatcgtagaaaggagagcaaggacggttgccggtgttgatttaataattttgaagttgaagaaaagcaataagcagagaaaaaggcctgcggttgtttttcttcatagttcgtacagtaacaaagaatccctgcgtccattgctaaaggcgtatgcttctcgaggatatatagcaatttctgttgattctcgttaccatggagaacgtgccaccaacacaaccacctatattgatgtacaataa

SEQ ID NO: 56126 - DNA, 234 bp, Glycine max
  Peptide Sequence Number=SeqID_172904
atggttttctgtaactctattagggtctttctgggaaagacattggagaatgtcaagacgatcttccaaccgatgttggtattcaacgacactgtgttatcaccacgcgtcgtaaccgatgtagaaagagatacaaagacaactggaatggcaatgatcctgagcaaggtgctttataattttacaacaacacagggcttgaagaacacgagggcaccacgggctaagggttga

SEQ ID NO: 56127 - DNA, 238 bp, Glycine max
  Peptide Sequence Number=SeqID_172905
atgccatacatatacgacacgggatttcaatgggccatagacaacgataaatgccagggtcgtgttgatagtataaaacctctttttgaggtggctcgtgatcatttgggtaaagttgctattgacaaagaagtggcgaggaaggtgtgggaccgaattgctcctggtttagcttcccaatttaactcaccctattcaattccaactatcgcaccacatccgctgcttattcttaatg

SEQ ID NO: 56128 - DNA, 459 bp, Glycine max
  Peptide Sequence Number=SeqID_172906
atgaataaaaaaattagggtaaacagaggattgggcattgtgtataccttggtggcgaaaacaaggttgcattcggtcttgcagatgcagcaaaggcgatcgtcacagatgaaatgtagacgagcgacgcacgtggaacacacctcccggtgcaagcagggtccgtacgcaacccattccaaaggctcaacacaagcggcacaacagtcgtccatctcttctcctatctctttctctctccttttgattcttgattatggatcacagaaagcgcaaaccctaattccaatgcccagatcacgacacgaggttagaggtggtggggtcgaaggacaaggttttggtgagggggtggaagataaggggctaggggatggccggggagaagttgtgggtggtggcgacgacgaggaggacgaggcggttggaggaggcggagataaactgtgtgagggttaa

SEQ ID NO: 56129 - DNA, 366 bp, Glycine max
  Peptide Sequence Number=SeqID_172907
ggatttcgatgggccatagacaacgatgagtttcagggtcgagttgagactataaagcctctttttgaggtggctcgtgatgatttgggtaaagctgctattgacaaagacgtggtggagaaggtgtgggaccgaattgctcctggttttgcttcccaatttgattcaccctattcaattccagctattgcaccacgtccgttgcttattcttaatgctaacttggaattgaagcatttgcttgggtgtttgggaactctaggtgcggaagatcctcagtgtcctcttggaggcttggaaattccaagaactaaggcaagcaaagcatacagaatgtttaactgttccgacaatttcaaggtatga

SEQ ID NO: 56130 - DNA, 276 bp, Glycine max
  Peptide Sequence Number=SeqID_172908
atgtcgtgtgcggaagatcctcggtgtcctcttggaggcttggaaattccaagagcaaaggcaaccaaggcatacagaaagtttcattgtttagataatttcagggtgtatcctcttaagttggatgagataaaactcgatggtgtgtttggttgggaattctttttagaatatgtttggaatgaatttattgcagaagctggaatcggacaccaagtaacgagatttatgataaaagaatcagctgattggtttgataggttcttaaacccttag

SEQ ID NO: 56131 - DNA, 101 bp, Glycine max
  Peptide Sequence Number=SeqID_172909
atggatgtcttgtgtcttgttggaacaagtgtgaaaccaaccaaacacagagggcgggcaaggaaagcgtcgattgctgctaggtctatcaaaccatccac

SEQ ID NO: 56132 - DNA, 2121 bp, Glycine max
  Peptide Sequence Number=SeqID_172910
atggatgcccccagaattgaggaggtgaaaaggttgactgatgaagtgatccactggaatgaaatggaggaaaaaatgttgatgcaaagatccaaaattgactggattcgggctgaagatggcaataatgcattttttcatgcatatctgaaatccagacaaaatgctaaaagaattaaagttatccacaaagatgatggcactatcctcactactcagaaggaaattactcaagaagtgctagctttttatgggaagctcatggatcatgatagtagaagcctccaacatgttgatattgatgctttaagaagaggagatcatctcaccatggttcaaagagaggatttagtgagacctgtcactgttaaagagattgaagatgctctaaatggaattagtgacttaaaatcgcctggagttgatggctatagctctaagttttttaagtcatgctggaacatagtgaaagaggatgtggtcaatgctgctcaggaattttttgctcaagatcaattattcttgccctttaatcaaactatggtgacattggttccaaagagtgataatgcaagtactgttaaggagtacagaccaattgcagtttgtacaactttctacaaaatcctgtccaagattctcactgctaaactgaataaggtgctccctagtgtggttagcctttctcaggcaacttttatcccaggtcaggccaaaagaggcattaggcaaggggatcctatttcccccttgctttttgtagtgatgatggaatatcttaacaggctgttggttaaattacagctggaccctaattttaatcaccatgctaagtgtgagaaattggggatcattcatcttacttttgcagatgatgtactcctgttctgtagaggtgatgttatgtctgtggaaatgatgcttcatgtgataaataagttctctgccactacaggctttgtggttaatcctaacaaatgcaggatttattttgggggggtagatggtactaccaagagtaaaatccagcagatttcttcttatgaggagggccagctgccagttcgttatcttggggtgccactaactagtaaaaaactcaatataaaatactacctgccgctgattgataagattacgactcgaattcgacactggacttcaaagctgctcagtatagcagggagagttcagatgtgtctacctattcctatgagtgtcataaaaaagattgatagcatgtgtagaagttttgtttggtcagggagcactgaaattactagaaaaagtcttattgcctggaattctgtctgcagacctaaaggccaagggggtctgaatattttcaatctgaaggtttggaatcatattgccatgctcaagtgtctatggaacctgtgtaaaaaggctgataatctatgggtgaaatggatccatgctcactatataaaaaactcctctgttatgaatactatgattacaaataatttttcctgggtgctgaagaatgtgttaagtcaaagagagtacattcacacattgcagcctgtgtgggatgagttgctgaatagtgaaagatttaaaatgaaaaaggcttatgataaaatgatggaggctgatagagtgcattggagcggtctggtgaggaaaaactgtgctagacctagagcaattcacacaacatggcttgcttgccatggtagattagggaccaaggataggttggtcagatttggtatgatcactgataagatttgcagcttgtgtaaggaggtagaggaaactcaaaaccatattcttttttcttgtaaaattgctactgatatttggagtaatgttctaaactggataggaattgatcatgtccctcaggagtggccgttagaacttgactggttgctgaacttgactaataggaaaggttggagagcttatttgctaaaactttcagtcacggagacaatttatggcatatggatccacagaaatagtaagatttttggagataatacttataggaatactagcaaagatgttagtgatgggattatagaaaacatagtgtatagaggctggggatcaaagaagctaagaaagcatatagcttctttgatgatatag

SEQ ID NO: 56133 - DNA, 2292 bp, Glycine max
  Peptide Sequence Number=SeqID_172911
atggagagggttgcagagccaaaggtactccctcgaaccttgcctatcctggttgaggtatcgaactcacgcacagctgctgcaagagagtccggtcagagactaaatcgccaggaagtttcgggtgtcggtgggatttcactgagagaagtgaatcaattgtccagaacaagggatgtgcatgttcctattacacatctggcctccatcagagaagtggctcagttgacgaatgcacggatatatttggtgcaagaagatacaggatttgatgctcgatcctctgaagaatccctcacctttgagcctactatgacatggaaaggaaatggctcttcaccagaagaagctgaagaatttgtgcccgatattgagacattgaaggggagcagtgattcatttgaggatggtggttcgagtttatttgctggtgctagtcatccccctgaacctgttgatacagatctcatgagaacggtttttgtaccgataggtcaaaacaaatccgaggctggatgcttaattaagaacttgcccacaaagggccctttcctggaggatctctcgattcgtgttcctgcaaagaaaccaagtccagctgttctttcccctgaagaaagtctggttgaagaactaaatggcatagggaacttatcatttttaggtcctcgaacattgcagagtactgagaactctctcctccctccagatgctgaggaaaaagaatgtgtttgggatgcttctttgcctcctagtggcaatgtcagtccacttagtagtattgatagtatcggtgttgtcactgcgatgagcattgttaatagttgtgctagtacgtatcggagtgatgcaatgaccagtgatggcatgcttagtttagacaggaactgtgacagtaataaaggtagtgtaaggggggattcactagagagtgctaaaactagtgttagtcggccaagtgatagcagtggcctcagcgatgacagcaactggagcaacattactggtagtgccaataaacctcacaaaggaaatgatcctaggtggaaggctatccttgccatccggttacgggatgggattttgggcatgagtcattttaggttactcaaacgactaggatgcggcgatattggaagtgtctatctctcagagctgagtggaactcggtgttattttgcaatgaaagttatggataaggcatccctagcaagcagaaagaagctgactagagtacagacagagagggagatattgcagttgctggaccatccatttctaccgactttgtatacacattttgagactgaccgattctcgtgtttggtaatggaatattgtccaggtggtgatctgcacactttaaggcagcggcaacctgggaaacatttttcagaatatgctgcacgcttttatgctgcggaggtcctgcttgctcttgaatatcttcacatgcttggagttgtgtatagagacctcaaacctgaaaatgtgttggtccgagatgatggtcacataatgctatcagattttgatctttccctcagatgtgctgtgtcacctactcttattagaacttcctatgatggtgacccttcaaaacgggcaggtggtgcattctgtgttcaacctgcatgtattgagccatcatcaatgtgcatccaacctgcatgttttattccccggttatttcctcagaaaaacaagaagtcacggaagccaagagctgatcctgggttgccgtccagcacacttccagagcttgttgctgagcctactcaagctcgatctatgtcctttgttggcactcatgagtaccttgccccagaaattatcaagggtgaaggtcatggaagtgcagttgattggtggacattcggaattttcttgcatgagctattatatggtaagacccctttcaaagggtcaggaaatcgcgctacacttttcaatgtagttggtcagcaactcaggtttcccgaatcaccggcgaccagttatgccagcagggatctgatccgtgggttgctcgtgaaggagccacagcatcgtcttggggttaaaaggggagcaactgagatcaagcagcatcccttctttgaaggtgtgaactgggcattgattaggtgcagcacaccgccagaagtgccgagaccgatggaaaatgaagtaccagcagggaaggttgtgggaccagttgatcctgttggggttggcagcactagtaagaggatagcaggtactgacaacatgaagtctgggggtaaatatctggactttgagttcttttag

SEQ ID NO: 56134 - DNA, 2400 bp, Glycine max
  Peptide Sequence Number=SeqID_172912
atgggttgcacggcgtcgaaactcgacaacgaggaaaccgtgaggcgctgcaaggaacggcgtcgtttcatgaaagatgccgtttacgcgcgccaccaccttgcggcggcgcactctgactactgccgctgcctccgcctcaccggctccgctctctacaccttcgccgccggcgaacccctcgccgtctccgacgacactcccgccgtcatcctcaaaaccactaccaccgccgccgccgataatccccaaacgcatcctcctcctccttccgccgccgcaacaagccccaaactccctcgcataataacctccgacgtcacgcgccgccgaaaaccgccatcgaagcttcctcatatactctctgaatcgagcctctgttccacgcctggaagcgagtattcaaacttcttcgccaccgcacctacttcgaaaccaccacatcctcctcctccttccgccgccgcgcgtcgccgcaagcctaccccgaaactccctcacatcctctccgaatcgagcctctgttcctcgccgcgaagcgagtattcgaatttcttccccagggcgcaacaagttcaatccaccacgcctacttcgcaagcctcttcggtttggaattgggagaatttctatcctcccccgtctcctccaggctccgattacttccgccaaaaaaatcacaaatcggaaacgccgaatctcgaaacgtcggaatcggaatctgaatcgacctataatccgttcggttcaaaagttcaacgtatacgcaaaatcgaaaacattactaacgttgattcaatttcacagcaacaaaacgcggaacgtgaagttttggaatcggaatcggaatacggatacttacgtgaaccggttcagacggagcgtgaggaggttctatgcagcgagtgggaggaccgttacagttcctcgagttcgtcgtcgtcggaggaggaagggaccgccaaaaatagatcgccggcgaaggcggaatctgacgccggcggcgatgctccggagaagaaggatgagaaggttgatgatgacgtggcggaggcggctaaggttgccgtgaggcatagggatttgaaggagatagtggaagcggttagggagaattttgagaaggctgcgatggccggagatcagttatcggagatgctcgaagttagcaaagcgcaccttgatcggagtttcaagcaattgaggaaaacactttaccattcaaatagtatactgagcaacctgagttcgagttggacctctaaaccgccgttggtggttaagtaccggttcgacgccggttcgttggacggaccgggaggttcgaagagtctgtgtgctactttggaacggcttttagcttgggagaagaagctgtatcaggaagtgaaggctagagaaggtgtgaagattgagcatgaaaataaattatcagcactgcaaagtcaagaatgcaaagggggtgatgaagcaaagctagataagaccaaggcctccataacaaggttgcagtcattaattgttgtcacatctcaggccgtgtctaccacctcagctgccattaatggccttagggactctgatcttgttcctcagcttgttgagctctgtcatggaatcttatacatgtggaagtcaatgcatcagtaccatgaaattcaaagcaacattgtgcagcaagtccgtggccttgtgaaccaatcatccgaaggtcactcaacatctgaatcacacaagcaggcaactcgtgatcttgaatcagctgtgtcagcttggcactccagtttctgccgcctcataaagtttcaacgtgacttcatcctgtctctacatggctggctcaagttgaaccttattccagtcaacaatgacaacaacagcagcagtgaaccatctggtgtgctttctttctgtgatgaatggaaactagcccttgaccgtgttccggacacagttgcttccgaagcaatcaaaagcttcatcaatgttgtccatgtgatatctgtcaagcaatctgaagagctcaagattaagaggagaactgagaattcttccaaggaatttgagaaaaaatcttcatctctgagaagcatagaaaggaagttttacagctcctattctatggtaggtattacccctcctgagtcagggcctggtaatggacaaggcttggatgcaagagaccctcttgctgaaaaaaaaatggaactagcagcacaccaaaggcgcgttgaagatgaaatggtgaggcattcaaaggctgttgaggtgactagagccatgacactcaacaatctacagacaggcttgcctggagtgtttcaggcattgaccagtttttctactttgttcactgaggctcttgagtcagtatgtagccgttcatatgccatcaagtaa

SEQ ID NO: 56135 - DNA, 630 bp, Glycine max
  Peptide Sequence Number=SeqID_172913
atgaaaaggagatcctattgcaccattcttgttcttattggtagtggaagggctaagcagcttgcttcagatttgaaggtgaacttctttaaaagtaaggtggtggggattggggtggatgaagcttccatgaggagatatgcaaaagtacttaattgtgaaatcatgaagacacgtttcatctatttaggcattccgattggcgcaaatcataggagagcctctacatgggagcctattgttcaaaagttcaaaaacaagtggtcaacgtggaagcaaagaacactatccattggtggaaggggaaggaggaaaataacttgggtaggttgggaggatatttgtttgccaaaggaaaaaggaggaaatggaaatggagggtatatagtgatcataattgcctttggcaacaagtattatgttctaaatatagccaaggggcctgcggagaagagatatatgaccaatggtttgacaaaaatgtatatcggagggtgggtgatggaaggggatatggggttgtgggttggtggtagttgggagtggaattttcattggaggagtgatatgaatcttcatgtcctcatcaaggaggcaatggttccaataggaattacccatgttcactag

SEQ ID NO: 56136 - DNA, 744 bp, Glycine max
  Peptide Sequence Number=SeqID_172914
atgcctcgcgttcatagttctcggcctcatctactctgccttcatctcccgcctctccccccccacgcgctgccacctcctcttctctgtcgcctcctcctccacctcctggccccgccgtctcccctacatcaacctctggtactcccccaccaccacccaccccctcgcattcctcgacaaaacaccacccaacgtcacctcgacgattcctcgccgtcgttggtgatctccaacgacacctcctccttcccctacacgttccgcggcgggctgtggtccgcgatccgtgtgccatggatcgcaacgagacgggcgtgcggtgcggtagaggtggatagagatgcttcttgtgtttcattcaccactgtcaacattctggctctgatttacaaacggattgatccacaggcattggctcataaactcatttattatgcaagtctgctgactgccatacgtaaagaatgtctaagagttatggattataaagagttgctttttaacgattgtggtaatcgtgttgctcagttgttacatgttcagtcagttaccccctttgtacaaaacccaaaaggcagtgttccccaagagtttctgattgtgaacagccacttgttatttcctcatgattcaagtatgtgcatagtgagattgaatgaggtttaccaaatattgcaatatgtggaattgtatcagagagaaaataggctcaaatccatgcctattatactctgtgggtga

SEQ ID NO: 56137 - DNA, 528 bp, Glycine max
  Peptide Sequence Number=SeqID_172915
atggctagaggaaagatccagatcaagaggatagagaacaccaccaagaaggccaatgagctcaccgttctctgcgatgccaaggtttctattattatgttctccagcactggaaaactccacaagatcgagcaatcaacaaagcaattcttcgatcaataccagatgactctgggagttgatatttggaactctcattacgagaatatgcaagagaacttgaagaaactgaaagaggtgaataggaatcttcgtaaggagtttaggtatatatatctttcatcacttcgatcgatctctttgagaatgggagattgtctgaatgagctgggcatggaagatctcaggctccttgaggaaggaatggacaaggccgccaaggttgttcgtgagcgtaagcttagagaactagtactacaggatattggtacttatgactggccagttgaagaatgccattattgttgtcgatgccttgtctgtatgatgctgtggaatttttttcatgcgggtccacttgttacatga

SEQ ID NO: 56138 - DNA, 1017 bp, Glycine max
  Peptide Sequence Number=SeqID_172916
atggggagggttgagtactccccattgtttgagacaagaaggtgcagaggaagatttagccacataacaaagggtgaagatggaaactgggcatggcttggtatgcttgcttcagagctgtggtttggcttttactgggtccttactcaagcccttagatggaaccttgtgttcagacaacccttcaaaaacagactctctcaaagatatgagaaaaagttgccaagagtggacatatttgtgtgcacagcagatccagatattgagccagcaatgatggtgattaacacagtgctatctgttatggcttatgattatccaactgaaaaattgagtgtgtatctctctggtgatgttggatcgcaaatcacgttctatgctctgctaaaggcttcaaactttgcaaaacattgggtcccattctgcaagaggttcaaagtggaacccaggtcaccatctgcatattttaaaagcatagtctcatcaggttaccctacagacccaagtcaagccaaagaactgggagctattaagaatgggaagcaaatggttgaagaatgggctttgacagccttagcatatgttgcagattcttcagaggtgcaatttcagaagtattatgatgttgtgatgccatacttaaaagctattttggtgaacgcaaatgataaatctaatcgtatgcttcgagccaaagcaatggagtgcattagtttggtaggaatggttgttggaaaggagaagttcagggatgatgccaaacaggtcatggatgtcttgatgtcactgcaacaatctcaactggatgctgatgatccaactgcaagttacatgttacaagcatgggcacggctttgcaagtgccttgggcaggattttctcccatatatgggttttgtgatgcctcctttgctccagtctgcacaactgaagcccgatgtgaccattacatcagcggattctgatactgaatttgatgaagatgatgacaggtgccctttcagttattgttactga

SEQ ID NO: 56139 - DNA, 369 bp, Glycine max
  Peptide Sequence Number=SeqID_172917
atgacagttggcggaaaccgtcgtagaagacaaagtgatgatagtattgtaattaagttcattgacaatgaagacgattttcaaataaccatttttaaattcggtaggggcatggtttgccacattgaggtaaaggtgtgggtggtagtaaagaccgttgagttcgacccatgggataagttgaaagatttgagaaaaaagcttgtacttaagcaagccagtgggataattttaatagcacttgatgaagtacaagttcatatattggagaatgaaattgaaattcaagagtatacaaccgtaagctctgatgcaatattgcttgcaactgatgagcttgatgttgtatctcctacaaggctgctttag

SEQ ID NO: 56140 - DNA, 438 bp, Glycine max
  Peptide Sequence Number=SeqID_172918
atggcgcgggaaagggggggggggggcaccgccacgaagggtggtgctcaccagcaagatgaaacaaaccaaatagcaaacccaaaaacaaacaacgaaaaagaagaagagagggaaggaggagtgaaggagaggagaagggagaaaggaagagaggaaagggaaggaatgaggggatacctaggagacccatcctccttctctagctatagtgccaaatggcgtgatgctactggtatagctgatttagatgatgaggcgtctgcagatttaaggacaaatcctcttcaagaggaaggggatgatgcaatcctcccaaggaagggacccatcaccagagctatggctaggagactccaggaagattgggccagggatgcaagagaaggccctagggttctcataagccttagggtagattttgagcccatgggctaa

SEQ ID NO: 56141 - DNA, 516 bp, Glycine max
  Peptide Sequence Number=SeqID_172919
atgatctcccctgtcaaggtggggaacttcatcttcagatgtggcgtagagatgatgcctccaggctcgttaagtgttttgctaccaatcaaagcaaaatacgatgtatttgcatcaacaaatgtcaatggagctgccctggtcgatgaggaccatggacactatgaagttagcgattatgatgaagataaccatgggatcgtcttggttgatgaggttgatacccctaaagtctctactagtgaaattgatgtcggcgtcccggatggcatgaaggtgacacttgcgggattgactctactgtcctctataggagaatccgcccgcgatggtgttgattacacctctgatttgctgggcaggctcctattcttgtggaggttgtcaactgcgtcttggctagttgtgtctatgtcttccttgatcttccattttgtttcttcttctgtttgcgttatgattcctatggtgctcctcttggtctcgctcctacttggtagtcgtttggccccttaa

SEQ ID NO: 56142 - DNA, 852 bp, Glycine max
  Peptide Sequence Number=SeqID_172920
atgctagatactaacaccttccagcaactccaaaaacgtattgcggaaatggaacgatgccataaggaagagttgagaaagatgaaggctcaccataatcagctcgaggcttgtgcaagacaccctcacggtgatgagcactcggccaacatattgcctgagcgcacccaaggggaattacacccccgacgcacagtcaacactcaagatgatccaaatgaacatctggatgcctttctcactcaggaaaatctgtacaccaatgacgatgcaatcatgtgtcgtgtctttctaatgtccctcaaaagggaaacattgacctggtacgatagacttcctccaacgtccatcaatagctttgacactcttgtcgagtgcttcagtgcacaatatgcaaccaatcggtcacatcgcatgacattggctgcactagccaatttgcagcaagcagatgatgaatttcttcagaaattcatggacaaatttggatgcattgccattcagatccaaaacttcaacccagaggtagcactgcactctatgctcctcgccctatggcctgacaattttgcagacagtctgtgggagaaatgttcaggttcaggaatgaagtttgacaaatcggacataagcacgacaagcgagaaggaagcaccaaggtatgagcattacgcatccttgatggccaatcgcactataatccttaaggaggctttcaacttggaggtacccatcaagctaccttcgaggaaacttcccaagtcggggtcagacacagccaaattcagcagataccatcacgatatcggtcacaacacagatgactgtcgggccctaaaagacaaaatgtaa

SEQ ID NO: 56143 - DNA, 1338 bp, Glycine max
  Peptide Sequence Number=SeqID_172921
atgcctgaggtagtagccttgacaagtaggaaggtgatgagtttgtcaagcccccaagcacggatgagtgttattcgatgtcgggtgtgggtggacatgcttttggttttgcaggcgaggtctatcgtgtcaggtattccttctttgacaatgtcttccttccttttcgattctgctattggcctaggtggtagcaatttcgagggttcgattcagcaacccctaatggatcaggaggtcattttcaatggcggtccctcctcagagaatactcgctatggtgccttcgacagtgaatcctcttcctcaggaaggttgacggcttcacatcatattggggggaggcatctcttgcaccatactaagtgggtgagggacgatgttctgaattatatgtcttccctcacctctgcgacaactgtcgctgctctgcaatgtcaggtgaaactgaaaagtcccgaggactcctgcaagatagtcgtacatgcttgtgggaacgatgatttccctttcttgagggcagcgtcgggtagttttccctttttcttcatgtataggtgtgtgtttgaggtcatgggtctctttttccctttgaaaatcttccaatatgctctgcttgagcacatgaagctgatgagcaagattggttgggtttccttgaataacgtgtccaagaagctgtttgagtttgactcaaacatctttcatcgcttcaaagaccatttcttcaaggctgatcccaccaggttcaagtcttttgacgaggacctgttgacctttatggagaaggtcgacaaggtcgtcttggagcagctgttggcctcactggacgcgcgggccattttgtctcttccttcggtgagcgatccccttgctgccttggatggtaaagtcaaacctgttggtgggaccatgtcaccatctgttgttgctcctgctgttggagaaagcggtcaacctgttgctgaggttagccctactgttgaggtcgtccccaatgtcccttcctctgtgttggctaagaggaagcgtgatgaaaacactggggttaaaggccttaaaaagtcaagggcgtcttccagccttcgttccctgaggcaagttgcagggctaacgcccgatttgggttacccttcaagtttgcaagatgtgtctccggctccatcgaccatcgaggctcctacttatgttgttgttgtttttgttactcttgcttctccacctccccctactatgcttgtccaagaggttgcccccgttgttgctgaagttagtgctgcggccattttgggcgatcctgttgtggcgcctcctccaccgtcgctgcacccttgctga

SEQ ID NO: 56144 - DNA, 387 bp, Glycine max
  Peptide Sequence Number=SeqID_172922
atgtcgaaactgagattcgccgcaactattagaaggtcaccatcaacgccgatgaaggccactggagaagagaggtcaccagtcttccttgactgcgaccccacctcttctctctctaagctaagggtgtcgtctccaactccgatgaggtcgtggcaacaacaacgactacactatcaagaacaaagtttggaccttggtgacgacatttttgaagaagtcgaagacaaaatcatcgaagcgaaagggaccaaagtgttgtgttccgtcttggcttcgaagccaaagtggctcggtctccgttccgcgtcgcttccaacaaacctctctcgcaatctacatttagtttcagtgcagttattgatttcaaattccactgttgaatga

SEQ ID NO: 56145 - DNA, 591 bp, Glycine max
  Peptide Sequence Number=SeqID_172923
atgtcgttggaggcggcgaagaaggcgaggacgagggtgatgaagtggtgctccccgtcgctaaggatctctgttgcggaagttggaagaaacaaccttaagacttcaattgaaagttcacaggaggttgctaagaagtcccttgaaaaagctgctgagcgtgtgagatgccttgaggatgatttagcaaagtctagagaagagtataataatcgacctaatcatatgctactgaatttaacagtaaaagggtctagggaagggtccatcctaatgtgggtgtatgacagggctgcattacctgacatgatgacaactccaaccttgcaccttggcttcccttctagattactgatatacctacatgctttctgtatagcatgtaatgtatgggttctaaatctgaaattttgtgtcttcaggagtgagactattaaaactgaagccaaaggcattttagaaagaaatgttgagttttctcagctggttgttgactaccaacaaaaatggcgtgaaagctctgagtcattgattgctgccgaggagctttggcggaaacttactatggaggttaataccctttttcactaa

SEQ ID NO: 56146 - DNA, 654 bp, Glycine max
  Peptide Sequence Number=SeqID_172924
atgtgcctcaacacggaaaaatgtacttttggggtcggcggatgcaagttcctaggattcatgatcactcatcgaggaattgaagccaaccttaacaaatgcactgccatactagagatgtgcagcctgaccaacgtccaacaagttcgaaaactaaatgataggctagcatccctgtccatgttcctcctaaagctcgccgaaaaggtttggcgaaagcctgaactcacagggaggatggtggcatggtccatcaaacttttagaatttgaccatcattatgaaccttgcggccacacgaagacacaattcaagggaagtggggcaggaatcatcctcaaaggccctgaccatgtcactctagagcaagccctcagtctcaacttcaaagcctcaaacaatcaggtagagtacgagacgttcattgcaagtctaaaactagcaacaaaagtcggcccaagaagctacgattctacacagactcgcaacttgtccaaggataggttgccaacagtagaagttaaaaggataagatttcaagtgctttggaagaaaattgatgcaaaaattggaagaaaaagccttgaagaaaagttaaagattggtacaacacgcttagtgcacaagataggcccaacgcgtctcctcgcttag

SEQ ID NO: 56147 - DNA, 405 bp, Glycine max
  Peptide Sequence Number=SeqID_172925
atgacagtgctacgcagaaagcctgaaggtggcaccttatcttcccaccaaggaacctatcaaacctcacccacagcgaatggtgctactcagctcatgagcgtggacgaagggtctccaccatctaacatgctgagaatccatcctagcatattttccacaagctcatcatctgtccccagggtgtgtcccaaagatgcataccctctacccaacatcgacatgctagttgatggagtgtctgggttccaagtactaagcttcttggacacctactctgggtacaaccagattcgaatgcacgctccaaacgaggagaaaatggaattcatcactgaagatgccaacttctactatagggccatgccctttggccttaaaaacgcaaatgctagacaccaatga

SEQ ID NO: 56148 - DNA, 387 bp, Glycine max
  Peptide Sequence Number=SeqID_172926
atggaagaacgttcttccgtaggaacgattctcccttatggaaaaaggttctttcgtatgtacgtacagaagaaggttcttccatatgaatccacagaagaacgttcttccataagggacattcgttcatacggaagaacgttcttccgtggattcataggaagaaccttcttccgtgcaaacgattttcatacttcaacgaatacgaaagaagcattaaagggctgggagatagaaaatactgacctcgaaggcggagatgacgcaaacgcaccaacaaagctccaaaaatggacgaaggtggcagcaagcaaccggagaacgcaggggagaagcgggagagtaagagtggaagaaggagagacaaacggaagaagctgggagtga

SEQ ID NO: 56149 - DNA, 372 bp, Glycine max
  Peptide Sequence Number=SeqID_172927
atgaatttgagcattgcagttgtaggtgttgcaacctacctttcggcgggagggcaaggcaagataaaaagggcgtcctccaaaaaaggaaaatgcacgggagtcgccaccaacctttatttgagaaaaacactagaaaaagcaaaaagggtctgcaaatttcaaagaaaagggttcgggagttgtttacatgcggggaaggaaatgagggggtttagcactttggcagcttgtccaggcgagttgttgcttcaacctaaagtaatcttgctcgcccaagcaagctcagctaacctaggcgagctggttacttcacccctaagctatttggggccccgggcaaaccagggtttagaaaaaggcttaaaatga

SEQ ID NO: 56150 - DNA, 333 bp, Glycine max
  Peptide Sequence Number=SeqID_172928
atgaaaaaaaagagagatagcgaggaagagaaaaagactaagagtgagttggcaagagagaagaagaaagaggttgtcccaagttcaggaaaggaagcaccatatcctttggtgtcatctaaaaaggacaaggaacaacacttttcttgtttccttgatatcttcaagaaattggagataactattccgtttggagaagcctttcgtagagattgtgaagacttcccaaatgtgatggcaagggcaagacaacataatgatgatggcataggcaatccaaggaaagcaacaaagaaagcacgagcacaagaggcacttgtgttcaaaggatga

SEQ ID NO: 56151 - DNA, 288 bp, Glycine max
  Peptide Sequence Number=SeqID_172929
atggccttgacgagcaacatcaagaatggactcaatgatatcgttgctcggggtcacattgacaatgatgaccttcatgcagggttccacaggttgggccaccaggaagggaagggggtgatcttgggcttgttcttggagcctgcgggcctgccatgtggcttcttggtgggtgggtttgtaagagggagtttctctaggggttggtttgtagctggtgatggtggacaacgagggcactgggaggaggagctagtgtggttgagccaagaggatgtcaagtcttag

SEQ ID NO: 56152 - DNA, 387 bp, Glycine max
  Peptide Sequence Number=SeqID_172930
atggtggatataatgctttatgaaagaccacgtccaaaatctgttaacaagaagacaatgggattggtgttcgataaagactgggaggacataaccgaagaaacggtggatataatgctttatgaaagaccaagtccaaaatctgttgacaagaagacaatgggttatgtggttgttattgcaataccgaaagaggaatacagagaaggccttgaagactgcaaaagttatttgcatagcaggattcttttggcaaagggcgtccctcctccaagagtttctgatttgcaagccaaagctttggcatcctttgggacgttggcatatggtcccaattggaaaaggctattgcaattcttctttctccttagtttaagatttacgtaa

SEQ ID NO: 56153 - DNA, 1356 bp, Glycine max
  Peptide Sequence Number=SeqID_172931
tgcggcgctcttgtgccacacgtttacgcctggtgctggtggatgacgccaaagccgacaccgccgcgattggcaaacttgacggggtgaagggctgttttcgcaatgccggacagctgcaggtgatttttggtaccggcgtggtgaataaagtgtatgccgcgtttatccgcgaagctggcatcagtgaaaccagcaagtcggaagcggcggatatcgctgcgcgcaagctcaatccgttccagcgcattgcgcgtctgctgtcgaacatttttgtaccgatcatcccggcgattgtggcctctggcctgctgatgggactgctcggcatggttaaaacctacggctgggttaatcccgataacgcgctgtatatcatgctggatatgtgcagctcggcggcctttatcatcctgccgatcctgattggctttaccgcggcacgtgagtttggcggtaacccgttcctcggtgccacactcggcggcattctgacccatccggcgctcactaacgcctggggcgtggcggccggcttccataccatgaactttttcggtatcgaagtggcgatgatcggctaccagggcacggtgtttccggtgctgctggcggtgtggtttatgagcgtgctggagaagcagctgcgccgggtaattccggacgcgctggatctgatcctgacgccgttcctgacggtgattatcgccggcttcgttgcgctgctggtgattggtccggcagggcggatgctgggtgacggcatttcattcgtcctcagcacgttgattgcccatgctggctggctggccggactggtgtttggcgggctttactcagttatcgtgatcaccggcgtgcaccacagcttccatgcgattgaagccgggctgttgggcaatccggcgattggcgtcaacttcctgctgccgatttgggcgatggctaacgtggcgcagggcggtgcctgtctggcggtgtggtttaaaaccaacgatgtgaaaatcaaagccatttcgctgccgtccggcttttcagcgctgctgggtattaccgaggcggcgattttcggtatcaacctgcgctttatgaaaccctttatcgccggcctgattggcggcgcgctgggcggggcctgggtagtgtcggtgcatgtgtacatgacagctgtcggtctgaccgggctgccgggcatggcgattgtgcaggccagctcattgcttaattatgccattggcatggcggtgatgcgcggtcagccgcgcgcgctgaacgatgcgcattatccgggctggcatctggcacccgtcaccggattacttaacgatccgaacggctttattcacttcgccgggc

SEQ ID NO: 56154 - DNA, 708 bp, Glycine max
  Peptide Sequence Number=SeqID_172932
atggcaatctcaacctctcagaactccgtctccttcgacttagacttgacatcctcttggctcaaccacactagctcctcctcccagtgccctcgttgtccaccatcaccagctacaaaccaaccactagagaatctccctcttacaaacccacccaccaagaagccacatggcaggcccgcaggctccaagaacaagcccaagatcacccccttcctggtggcccaacctgtggaaccctgcatgaaggtcatcattgtcaatgtgaccccgagcagcgatatcattgagtccattcttgatgttgctcatcgaggccatgttagcctcactgtccttagtgcctctggaacgatcaccggagtaaccctcaacaactcttcgcatggtgttgatgccctcacacttcgcgggcccttcaccttgctctccctcaatggctcatacttatacaacaaccactacgcccttcaccctggagccacccctgcccctcccttatcatttgggatcagcttttccacctctcaagggcaagtctttggcggtgccattggtggtagagtcattgccgataatgatgtcagccttacaatttgcaccttcaagaaccctgtgatgtacaagtatgcttctagagacaaagaaagggacacggttatggattggagtccatgggtggtgaatgatgtgaaagttacaacatga

SEQ ID NO: 56155 - DNA, 690 bp, Glycine max
  Peptide Sequence Number=SeqID_172933
atggacatgaatttgggagccctcatctctggtcagattacatctatggcccagtctaactcttctagacttgggttccttgctcttatcatcgctttatgtaagtccagaggggttacttctgacagtctggtcttcgaacgcctgagctcggtcattaacttggcctatatcaagaaaaattgttggaaccctgatgatcggaccgttactatcagaggggccagtagagcgaggacaaggccagctgaggccccttccacatctacagctcctcctccagcacgtaccccagcagctccttctgccacagctcctgcagattttcagcgtcttgaagccatgcttcaaagcatccatcaggggcaaattatcttattacaaagtttacagatgcatatagaggatgagtcatctgagactaccactccagagcccttggtcagaaggaagaaggcagatcaaacacaagaagttgcagccacttctgagaaatctcttgaggccacttctgagccttcagaactagtggcagatacaacttcacttcagcaggtagcatacccttgcactcttgaggatcagactatgccagtcctgtctctgaacacttctcctacaactacccatgtgcttcacttaacagacgaggaggatgttcagacagaggatactcaggaccgatcatag

SEQ ID NO: 56156 - DNA, 105 bp, Glycine max
  Peptide Sequence Number=SeqID_172934
atgacgatttcggtggtggagcatgacaacgatgaagagatcacacagaggcgttggggtgactgcatagtcttcgacactcaagttggagcttatacgctttaa

SEQ ID NO: 56157 - DNA, 489 bp, Glycine max
  Peptide Sequence Number=SeqID_172935
atggagacaaaagcaataacttcgataaagagagaagtcatgggttcatttcttatcgagaaagtcctagtggctataaaggaaaaatggccaagggaggatttggggtctccaatatttatccaacaagataatgcaagaactcatattaatcatgatgatctggagttttttcaagcagctacacaagacggatttgatattcgtttaatgtgccaacctgcaaatccttcggatttgaatgtcttagaccttggtttttttagtgctacacaatcattgcaactcaaggaatcacctaaacccattgatgaacttgtgagtgcagtgttatgcatgatagagatcatgaaagccaaaggttccaataaatataaaattccacatgttaataaggaaaggctagaaagggaaggacaattaccaactcaaatgaagtgcgatcttgttttggcggaagaagttttcacttacgtaaacactagttga

SEQ ID NO: 56158 - DNA, 486 bp, Glycine max
  Peptide Sequence Number=SeqID_172936
atggctacaccacccaactcccctcctcctaagttagcaacacccttttctccatctatgtcgaagaagacaagaaaagcaacacaacttagatcgttggctactagaccagctggggtggagagaccaatggctgaatttgatattcttgaatcgtctgatttgaggacaaagaaaaaaatacttcaaactgccctgacacacgacaaggagagtgaggatgacaaattatgtgagaagtatgacataagaaaagagaagtggactcaaatttgtaagagttgtagagatccttcatggaaggatgttcaaaaaaaggtgcaggccattcataaacaaactactgcccctcatatgttgtctcgtataggttatgattttctagaaaaaaagttaatggaggagaagcaaaagaaacgattggaggaagcaaccccatccaagagcactagcatagtcattgatcctccatctcccattatatga

SEQ ID NO: 56159 - DNA, 132 bp, Glycine max
  Peptide Sequence Number=SeqID_172937
atggagcatgctccaggggaaagctgttggatgcctacagatttctacacaaagataaggacatggagcgaggtttctcatggtctggaaacccagtggggagggccccataatgtaggtagggtaccctag

SEQ ID NO: 56160 - DNA, 186 bp, Glycine max
  Peptide Sequence Number=SeqID_172938
atggaatttggggtgaccatttacttggctagggttatagcaaccattgaattgtcgagtagatatgggagcaagttagcatacgacaccggaatttggggtgaatcctacaggctttttgctgcaaaattcctttttgggatggcctttgtggataactgggtggtgggtaaggagaggagctaa

SEQ ID NO: 56161 - DNA, 240 bp, Glycine max
  Peptide Sequence Number=SeqID_172939
atggataggatctcccaccttgagttagctcttgtattggtttcggtgagggtaatgaagtatccaaaagttggtagccatggtgtttgccttcacattttggaggcattaccgctagtaggatacattgtgagaaccttaggagttgaatctgaggtagaagagatgggtaaaattcttaagaatcttgtcgtgagtttagtttcaaacaatagagctagcttagtagttggagcttga

SEQ ID NO: 56162 - DNA, 255 bp, Glycine max
  Peptide Sequence Number=SeqID_172940
atggcccaggtggtggaaggtaaggtcgaagctcaacacccaaaattcggacagacccaggtggtggtgggaggctcctccatgatggacaagaggtcaagtgtcacccgagatgacctgggtcgcaacatcagtcgtgatggtgatggcgacaacattgagagttgtcaggaagtaccttatattcatcagttgtatgatgtgagacaaatgggtttgtgggggcgtgcaaaacttgggaacaaaacagtggat

SEQ ID NO: 56163 - DNA, 142 bp, Glycine max
  Peptide Sequence Number=SeqID_172941
atggtgagcaaagtttggagctttaatggaggcttcaatggagaggaagaagaagagaaaagcaacgtgagaagtttgcatgccgtttctctggttctagtccctcgcatttctatgcacccgtcggggcccgttttcaaaa

SEQ ID NO: 56164 - DNA, 312 bp, Glycine max
  Peptide Sequence Number=SeqID_172942
atggttcaggttcaaccaatcaacaaaagaaggaatgaagtggacagaaaggtggaggcaaaccttaaagcaattgaggaaataaaagctataactgatatggctctaaggaatgcaaagatggcagattctgcaaaggttgaagttgagggtgaactgaggcttgttgaagaacagttaagggagggacctattatcccattactgtcaagaggcacctcaagagggtacagtagatttcagctcagtggaaattgccctgcatatatcttgttcattatatgctacagttttagtaaccattcaacttga

SEQ ID NO: 56165 - DNA, 273 bp, Glycine max
  Peptide Sequence Number=SeqID_172943
atggctttagccacttgggaactgatgtgggtcaaaaaactcctcaaagaacttaaattttatgaaattcagcatatgcaactacattgtgataatcaggcagaacttcatattgctcttaatccaatattccatgatagaaccaaacacatagaatttgactaccactttgttcaacaaaagttgttggctaaggaaattagtatgggaaaaagtagctctaatgatcaactagagggtgatctgaatcaaccaatctcagttccaggatga

SEQ ID NO: 56166 - DNA, 546 bp, Glycine max
  Peptide Sequence Number=SeqID_172944
atgcctccttcatccaatgtggagccacctaccagtggcatttctcaaaatccacactttttttatgtatccaccacccctaaccaacccaaacatgattcaattataggagtcgatcaatcattaactcaatactgggaaagaatcaaggaagcatacaacaatgataaagagtgtggggagtttacaagaagggaagtcactcaattgaaatatcgatggaaccaaattcaccctccagttcaaaattttaacaattgctacaaatacgaagttactcataagagaagtgtgagttcagagaaagacatcacggctgatgcacatatgatttactcacaggatacagggacacctattgaagttgaagaatatgacacgacatcaccaatgtcttgcccaataagacaaaaagcgaagaaaaggaagagcaaaggaaaaggacatgtaagtgcttctaatagtctcgatttgtcaggcacaaaaagtgtagtgaaggataaaaatcccaacatcgcaaaacttattaagttaaaggagttgtag

SEQ ID NO: 56167 - DNA, 231 bp, Glycine max
  Peptide Sequence Number=SeqID_172945
atgcactattcttctctaatttccaacacttcaatcatccacataatggatccaaaaattgatttagatgcacttttggatcaaatggtagatgaggaacttgaagacaacaccgaacaagaagtcattaggttgatacttgagagccaacaacaagtcggtaacactcgtaagcacaaaaatgagaagaaaggtggtatgcggaatcaccaggaaagacatgatcaatag

SEQ ID NO: 56168 - DNA, 321 bp, Glycine max
  Peptide Sequence Number=SeqID_172946
atggtgtgcggtgctgcagttaaccaaagaacgcgttcaggaagactccacctttggaggaaatccgatgaaaatgaggagaaggcagcctttcttcaggctgtatcgtcttttggcaaggattttaggatgattctacggcatgtaggaacaaagtcaaaagatcggtgcaagaaatttttcatcaagggtcagaattcccataggttggatctcatgcgccatagacttgaaaatattggatctctactgaatgaagtaaatctcagcagcactactaacactaactatgcccaagttggaaaattactggttggttag

SEQ ID NO: 56169 - DNA, 534 bp, Glycine max
  Peptide Sequence Number=SeqID_172947
atggagatggacgggagtggtatcgatggcgcctcacatattgggaggcgaaatgagttcctcgaaggtttgtgtggcttcgaggaggtggcgacttccaatgcggatcttgatgaattcagggtagagcttggtgttcaggaggtgcgtgaccatgttggtgatcttggagacgagataagggtcgagggagtagtgggaggtgagggttttggcggagaggggcttcgctggaacagatgtgttctactgagagggcatggaaggtggagacagagtagtgagagtgagaaagagggtttggaggaattgagggatggagagggagcaacaaatgaatgcgcctacaaaaaaccgtcatgggtcaaaagcaaaaaagtgccaacaatgccgttttttgaacctagccatgactctggctctgactctagcataacctttcaatcaccaaaagaccacaagcgcaagttctggaaaaatgctaacaatgcctctctttgtttgtcctcaaagaggtccattgataatgtgtga

SEQ ID NO: 56170 - DNA, 384 bp, Glycine max
  Peptide Sequence Number=SeqID_172948
atggcccttgcaaaagaacttatgggtttttcctcatttgtttctgcttcctacaaagtgtttctgcacaacaagcatggcaccttctgggtcaatactatcttgcttccttcggataacacaagagttgtgaggttgaggaagggagcaaagtttccgatggcagctattagtgaggatttgataaagaccacactgacagtgcatgcagagaaaccagtacaattcaaagatttcaaagagactatcttgaagcatttggatgccatcaatgataggataggaacaagaaacattgtgctggagcttattagcaccgagattgatccaagtaagccagcctttcacaactcaccattcgaatcattttctttttcaagctag

SEQ ID NO: 56171 - DNA, 753 bp, Glycine max
  Peptide Sequence Number=SeqID_172949
atggagcttagccataccataggggccgctctgagacctcttgtcgagtggccttttgctcctacccctgtcgggacagtgcctttcagctcttgtgcctattggggggtagttgcttgtagtttgtattctaactttccccatcctgtggcttcaaatggccgattggaagaaggtttccacaaaatcatcctagaaggatgtcattcgaagacggtttttgcaaaaccgtctgagaaggatgtcgttctaagacggtcaacctcttgcaacaagtacaaagaagagccctttagcagacacacactcaccgaggtgcgaaagtcgcacgtgggtgacgtcacatttcttcacaaggtttttctcttcttggagcattggggcttgatcaacttcgacactaccccaccttcttcccatgcggatgaagagtatatagaggaggagtattgcaagatgtgtttggatttcaatgtgaagaaccctacttgcgcatccatcacgtatgggatctttcttagcatggattgctccactgttcacagaagtctcgacatgcacatcagctttgtgaggctagtttttgctgattttgtttcaatgccacttcctgtgccaaagtccagtcctcaagcaactcacttgagatttttcactatctttgtaaactctttacaacctttgaacacacattggaatccctcacccttgtgttcaggattcttacaagccaagagacgaacagtttcttga

SEQ ID NO: 56172 - DNA, 300 bp, Glycine max
  Peptide Sequence Number=SeqID_172950
atggctcagacattcagacagagaatagcccaagtagaagctatggctcgtgcagacatgctaaggcaaagtggattgactatcaaagatgatgagatcctgggaccatttacttcatactttcctgaagagggactagatctgagtgaggtgaactattgttactttgaagctggagaaaacaaagaagccttggttaaattggtaacatatgtgcattcaaactcaactacaaaaggcataaagataaagagcaattacaagaaagacaacaagaacaagataggcgaaaaaaggtga

SEQ ID NO: 56173 - DNA, 147 bp, Glycine max
  Peptide Sequence Number=SeqID_172951
atggagaagaaggttagtcttgaagtgaaaccagaagagggtgatagggggaaatgggttcttgattcttcagtggaatacaaaggcagggttccactcagagcttcaattggttcttggaaagatgctttcttcattattgtttaa

SEQ ID NO: 56174 - DNA, 424 bp, Glycine max
  Peptide Sequence Number=SeqID_172952
atgttgtcaaagacagcttgtgcaggagacagtgagaaggtctctaagaagaaccaaaataacaaagtcacaagccttgctgagaaagccatgtctcttcagtttgaccttgtatgggaatgttgtagacagcttcaagcacaagatcttacagttaaagttgaccgtgtttttagtacttatgaattctcaatagaggttgcagctagatttttggtgaatccaaacttgacatcagcaacaaggatggctttacgcctaagctcgaagactaaaggagtaagcacactggatatctggccttggaagtatctagttctatggatgagcgaatctgccacaatgtttgcaaatgtggttagtgctcaagtgatatcacaacttaatgaaccaaacactagcgtagaaactattgataagacag

SEQ ID NO: 56175 - DNA, 618 bp, Glycine max
  Peptide Sequence Number=SeqID_172953
atgattgcggacatcaagctctgtctggctgcccgcgaattgattgccggacagtatgaggccagcctggggggtggtgtttacaaaaaacgcattccgctcggcgccggcaaaagcggcggagccagagcgattgtcgcgttcaaatcacaaaaacacctgttttttgttaacggttacgctaaatcgaccacgaagagtggcatacgtgagattaaagaggatgagcttaatctctacaggcaggtagccagtcaactgtttgccatgacgactgagcaggaaagagcagcgataaaggcgagaaaaatgcgagaggaaatcgcgcatgattttaacccgctgggggtggttagcgatgagcttaccgaaaaaatcgattcacgtgtcagattacgtgagctgcgtacctctctgccggttttacaactgatgtcaggcgaggctattcgtgagttacgtgagcgtcatggtctgagtcaggccatgttagccgcctatattggcctgtccccggccaccgtggtgaaatgggagcgtgaggagaagaagccaaatggcgctgcgctgcgcctgcttaacatcattgatagaaagggtcttgaggtgttgcgttaa

SEQ ID NO: 56176 - DNA, 900 bp, Glycine max
  Peptide Sequence Number=SeqID_172954
atggaattgcgccagatgcggcacttcatcgccgtggcggaacatgaaaatttcacccgcgccgcacagagtatgcatattgtgcaatcggccttgtccacctcgatcaaacagctggaggaggaactgggcacgccgctttttatccgctccactcgccaggtgcgcctgaccatggccgggaaagtgtttcttgattacgccagaaccatcggcgcctttgtcgaaaaagcgtcgcaggaagtggcagcgatcgtggcgcttaagaccggaaccctgtcgattggcacggtgcaaagcgtgccgccgtttatcgatctgccgcaattactggaaacctttattcgtcgctttccggattttgacgtcaagctgtgtcagggatcatcggcgaagctcaacgcaaaagtgcacaatcagcagatcgatctggcgattatgccggtggaggaagtctccgaccggctgtcgtcgcgcatcatcgcctgcgatgaaatcgtggtagcgtttgccgccgattatgccgggttcaccgcgatgcagccggacgtcaccatggcacacctggcgcagcagtcgtttatcgatttcgaagccggccagggcacgcgcaaggtgaatgacaacagttttgccctgcagggactgagccgcaaagtgacgtttgaagtgagcgatctggaaactttgctgagtctggtggagcgcaatatggggattgccctgctgcccgaacaggtagtgaaagcgcgcagcacgacgctgcattattgccgcatcagcgacgttgatatgtgctgggaactggctgtagcctggctcagcgatcgtcccggcagtatgaacgtctacgaccggccagtgcaggagtttatggatattctgggcagcagcgattag

SEQ ID NO: 56177 - DNA, 432 bp, Glycine max
  Peptide Sequence Number=SeqID_172955
ggtctcattctgagcgttttgatatatatattgcctactttcgaaaacgggccccgacgggtgcagagaaacgcgaggaactggaaccagagaggcggcacgcaaaccgaggcaggatttcagcatccaaaaaggtccaatttttctccattgtggctgagtatgaagtcaaatcaaaggaaaaagaaatttcagcagcttcttcctcccttccacgttgcttttttctcttcttcttctccaccattgttgcctccattgaggctccaaattcctcttcatttctaccccaaattgcaaggaatagccatttttggagtcttggagcatacctctacttcgtggggctttaaatttcaggtggaaaagtgtgagattttgagagttagaaaagccaaatttggggttagtggaaattggagtctaaagtga

SEQ ID NO: 56178 - DNA, 150 bp, Glycine max
  Peptide Sequence Number=SeqID_172956
atggacaaggattttactcttcattttaaccaatggtcctctaatcttaaggaaggattagaccaaacatacctacgtgaggtggcgaaggagaagaagcacagacttctgacgatgctcgagtgcaacgaacacgatgctcgaccttag

SEQ ID NO: 56179 - DNA, 1374 bp, Glycine max
  Peptide Sequence Number=SeqID_172957
atggtgccacctgcgaacggcggagttgagacaaagcagtcaggtgaaaaaggctatgtagttcttcaaatagtctctattcctagttcttccttcattagtggtatcagcttggaccttccattggcagttatggcagaagcaactcataatcaagcagcattgtgggaacatgaagaacacttgaaacactgtatcacgtcaaaactcgaaaactttgattcagagattaatgctacggatcaaggaggacctcatcatagagacgagcgccatgcaaattccaattattcttgtggagcacatttggcgcgaattgatttcccgcgctttagtggtgatgcagttcaacaatggatctaccaatgtgaaacgtatttcgcgattgatggaactcctatggattttcgggtgaaattggttgtaatacacttcaaagggaaggcactacagtggcatacctcttttgtgaagactcttccagaaggtaaccttcctaagtggactgaatctacaaacatattgatcgatcattttggtgaagtatgtgatgacccaatggctaaacttatgcaattaagacagaagggtatagtggtggaataccatgatcaatttggtgcaataacttctagattagaacctcaagatgtaagaaaggcattccaattggctaaactgtatgaatccgcttccagttcatacatccctaccaaaaccttccctaaattccagaaaacacaacctagtacaaaagccattttacccacacctaaccttacccacaagcctattgattcacaatttaccttaaacccaactcaacgacaacctaataaaaaactcacacctgcctttatggctgagagacgatccaaaggactttgttatttttgttatgaaccatatagccccaaccatgctttaacacataagaaacttgagattcatgttctggagggggtggctaagaaattgggttgtcttataacagacattcctatcttaagtgtggcaatagctgatggagctcgggattctcttaagtctggtatagtacaaaaaagcagtagtccttttgcaagtcttgttgtcctagttggcaagaaaaatggaacttggatactctgtgttgactacagagaccttaataagcagaaaattaacgacaggttccttattcctttagtaaatgatcttttggatgagttgcatgggtctaagatgttctccaaaattgatttatggtcaggttataaccaagtgagaatggaggatagtgatatccacaagactgcatttaagacacatggaggccactttgagtacttagtcatgccatttggcctaaccaatgcaccagccacattctaa

SEQ ID NO: 56180 - DNA, 207 bp, Glycine max
  Peptide Sequence Number=SeqID_172958
atgaattctgagaaagctaaggtgaagcttaagagtgatctcggtgaagctaaggatgatatcctcaaaaactcacgaagtcggcttattctaggtgactcgtcaagccaagacccgaaccgccagggtgagttgtttcttgaggctgaagtactcgctaaacgcgtgattgaagagcccactcagcctataacttggtttttttaa

SEQ ID NO: 56181 - DNA, 387 bp, Glycine max
  Peptide Sequence Number=SeqID_172959
atggttcccaagaaccgccttagaatatatacacgattgtgtctcggaggcaatgtcgtaattatttttgttgaaaatgaagatggtcttttgcaccagactgttgtttttttgtattaccatctcttgtttaccatctcttcgtactcccctcctgtgtacttcatttaccatctcttcgactattacctccctcgctcatgctcacactcggtgcatgactctcagtccatcactctcagtccatcagtcggtgcatcatcttgggaaccttgttttgtgaccctcagtccatcaatctcttgcctcagtcgtcactactcggtgcatggtctgtgtatcgccatagagtgcctcatcctggttaatggagttgaagtgcattga

SEQ ID NO: 56182 - DNA, 552 bp, Glycine max
  Peptide Sequence Number=SeqID_172960
atgactgagtgggccaaagccggaaagtttcaagctgagaaggatgaagggaagcagaaaaagcatcccgaagatgattgggctcctcctcctcctcttcctacatctagcccaagaaccactatggtgactttgggtcctcaaaatgaagggccttcaaaaaggccaaggttggagttggtgttgattgctactcttttctatagggatgacaaatttgataaggctgatatcgagtcacaattagctcttgttgagtatgcaaaggctgaacaagctttggttgaggctgccaaggggaatgagacattgttgcaactggcagaggattctcagaagtctctgaaggacacaaagactaactttactctagctctccaagacgaggtcgaacaccttgttgagtatgcaaaggatgaacaagctttggttgaggctgccaaggggaatgagacattgttgcaactggcagaggattctcagaagtctctgaaggacacaaagactaagttaagcgaggctgagacccaagagaagtccttaaagacctaa

SEQ ID NO: 56183 - DNA, 2415 bp, Glycine max
  Peptide Sequence Number=SeqID_172961
atggctgtcaagaactggccaataccaacatccttgaaacaactgaggggatttttgggacttacaaggtactatagaaggtttgttcgagggtttggtgggattgcaaggcctttaaccaacatgttgaagaaaaataatttccactggtctgacaaagcaaaagcggcatttcaatccctcaaggatagtctgattcaatcaccagtattagcattacttgacttctctaaggtctttgtggttgaggtggatgcttcaggttatggcattggtgttgctgatcctgacattcaaaaattgatccaagatttgaaaattggtgcttcttcacataaacatcatacttggaaccataatgatttcagaaggaaagggagattggtagttgggaaggatctaactttatggactgatttgttacaatggatacatgctggtcctactagtggccacttgggtagggaagccacattgaagaggttgaaatcagttgtatattggagaggcatgacgaaggatgtcagaatttttgtgctcaactgtgaagtttgccataaatgtaaatatgacaaatctgcctatccaggtctaccaaattccaaaggaaaacaagtgatctatgtggtagtggacagattaagtaaggcggcccactttatgtccctaacacacccctacactgctactgaagttgctcaatccttcttgcacaatgtgctcatgttacatggttttccagactctataaccagcgacagggaccctatctttgtcagccaattttggaaggatttgatggcctttcaaggggttcagttacaactctcttcagcttatcatccacaaacagatggtcaatccgagaatggtggtacaataccaaccatcacacttccatacagtgcagtccttagaggtgatgtttggccagcctcctccaatttaccttccttattttccggaatgaagcaattagcagataagaagagaagtgacagattgtatgagattggtgattttgtgtatgttaagctccatccatacaagcaaatttcagtagcattcagacttaatgcaaagctagcacctaaatactttggaccatttcagatcgaggataaaattggggttgtagtttacaagctaaagctgccacaggggtctaaaatccattatgtttttcatgtttcacaacttaaaagtcatgttggtgaagcaccagtttcaaatttccttcctatagattctgatggtgttatgggaggcaaagaacctgaactaattctggatagagcaactatcaagagaggtaacagggctgtcccaaaggtgttggtaaagtggaaacaccaattaatcgaagatgctacttgggagttcttctatgatttgaagaagatgtggttaattatagctgctcagttaccaggtaggactgacaatgatatcaacaagtattggaacaccaaacttaagaggaaactcatggggttgcttccttcatctcatcaaagaatagcgccctgtcaacaattctcctctcaaaacccttcatcatttccttctcactcatcactatcctcttcacaatatagggactactactacaacaactctaatcattattacatcccagcaccaacctcatatttcatatctcttgaaccaatctctgctccttcaagcaatcatagaaacacaatcacaacctccaactctctccctttttaccaacatcaagagcgcccttggtcagtgagagtcctaggcagtattaccccatcacagacaattccttgcttatgtttggtagtgaaacaagttgcagctcgtctgatggaagctgcgaacatgaacaaattcatgaacattaatcatgatggaggtcaagaatatgtgaaccaatggacacagaacccaaacgggtacattttccagattgaacaaacaacattggattatgatcttgaggtcattaggaacctaatttgtagcaagagtagtagtaatagtaataataggtacttaagtgttgatgaaaacaagacggaggagaaggatagtcctaaccagttactgtatcactttgaacagccaattgataggcttcctttgattcctgggattcttgacattataggcattagatacactgggggcggttgtgagcgctttggcgggggtacgatgctttcgtcgaaggttcctctaatcgaggaaggttctaatgacaatcttttccaccatcatgagggctccgatgctaccggtggcaatgtttccagcattcctaatgctggctccgccctttttggtgttgccattgaaaaagggctttgccctaactttgccattcgtcccaatcccggggaggatgaggccaagttgtctctgcccccatccttctcttaa

SEQ ID NO: 56184 - DNA, 450 bp, Glycine max
  Peptide Sequence Number=SeqID_172962
atgggggcaccagttcaccttagcaacagcgctggtagcggcaactgcaaccgtattggcttccattatcttcttcatgcttatcatggcctccaccattgtggtcattttctctttcatggcctccatgtcggccttcatctactcttgcacctcctctacttcacccattactctagctctagcacgggttcggtaagctgcactgacctccattatctcctttatgctatcatggtctccatcattgtggccattttctctttcaaggcctctgtgtcagccttcatttgctcttgcacctcctatacttcacccattactctagctctagcacagaatgcaatgaacaatgcaaccaatgaaaaggatggatgtgaaactggcagtaacagagatatcaacaatcctaaatgtgttggcagtagacgaagcagtgatgtaacttga

SEQ ID NO: 56185 - DNA, 264 bp, Glycine max
  Peptide Sequence Number=SeqID_172963
atgtcctcacacatttcgaagacaaaaatgccttcagtcattgcatgctttcaaaaggtgacaatgaccattatttacatggtcgaagacgacgatgtcttcagtcattgcatgccttcaaaaggcaacaatgaccctcatttacatttcgaagacgacaatgtcttcagtcattgcatgccttcaaaggtgacaatgtcctcatctacatttcgaagacgacaatgtcttcagtcattgcatgccttcagaaggcgacaatga

SEQ ID NO: 56186 - DNA, 234 bp, Glycine max
  Peptide Sequence Number=SeqID_172964
atggccacaatgatggaggccatgatgaacatgaagaagatgatggaagtcaatgcggctgtagttgccgctaccagcaccgttgcagagttggacccgactcccccatatggcttccatcaagtaaatcatctagcttcggatatggtagttcggggaggcaaagagttgggaagagcaggcggtccccattttgtgcaagttcagaacgagcattccttcccgccagaatga

SEQ ID NO: 56187 - DNA, 264 bp, Glycine max
  Peptide Sequence Number=SeqID_172965
atggaattttcacggatcgcggtgccaagtatcttgaagcggccaatcaaaggttgtatatcatcaaataataatccccggacgaaattagggtatgacaaggaggtagcatcaccggagctcgttcctcacccatcaccagctccagtccttgaagacctagagtcatctgcacctgcactagtgcctgaccagcctcttgctcaggaccctctagctgcactggtgttggatctaaacgagcatgcagaggatcatttgtag

SEQ ID NO: 56188 - DNA, 443 bp, Glycine max
  Peptide Sequence Number=SeqID_172966
gggctctgtggggcaataacagcgagcttaagctccggagagaggaaagggaccaatcacgagtagacagtttgatcttgaaggatgagctgaaggtttgcctaaggtccaagagaagcttgtctcagcatttatgcgagacacagaccaacatgttagccatcatcagcaagtaccaagaagaattaaatctagccacggcccacgaacacaaagtggcggacgagtatgcccgagtgtacgtggaaaaacaggctataggaagggtgtttgactcgttacatcaagaggcgataatgtcgatggaccgatttgctcttactttgaacgggagtcaagaacttccccgattgctggccaaggccaaagcaatggcggaaacctactccgcccctgaggagatccacggacttctcagctattgtcagcatatgatagactaa

SEQ ID NO: 56189 - DNA, 333 bp, Glycine max
  Peptide Sequence Number=SeqID_172967
atgaagaagatcctaggcctacaagctccaatggagcttgcatcaagtggtaatcagagtacaagagcttcaagtaggaaagctggagttgctgcacatgatgtccaacgttatgtcaaggaatcagatcgggctgcacaatgcacaaggcaagataaaatgtcaaatgaagaattgaagctgcaggatccacgatgtcggatacaatgtccaggacatcctgcccgaaaatactggacacataaatctgttatatctttaacagattgtgcaggatccacgatgtcggatacaatgtccaggacatcctgcccgaaaatactggacacataa

SEQ ID NO: 56190 - DNA, 495 bp, Glycine max
  Peptide Sequence Number=SeqID_172968
atggcgcctacccggcaccctctggacccagataagtccaacaaggccctggggtttccggcgctgatcacgggcctctgccaatcctatggagttcccgtcacccctagtaaagtaatcccaccaccgatcacccgggctttcatcgagaagtactgcacgcctaggcaggcgcagggtgatgcacatcaggccgcagacgcgccgccaccacctcggcaggccgatccagctgggtcactgggcgtggagcgttatctacatcatttggtttgccagcaggcggccaaccaccatgggcaggggcagggttctgccccttttgcatgccctactccagagcagtttggggctgaggtcgcatggcctggagactggcccgatgcccaggtaggggaggagcttgcaggatccctcggtgagccagatgagtcccatatggatgaagatatgattgacttgctcggtttcttgggagggagcggagccacatga

SEQ ID NO: 56191 - DNA, 379 bp, Glycine max
  Peptide Sequence Number=SeqID_172969
gggcgcgttccacctaaacgcgacgcgtggcgtgacttgacaggacgatgggacaggggtggaagtggtggcctgccagacacgaccactagtgatggtctgccaggcgctaccagtagtggtggggccctaggcgcgaccactagtggtagcctgtcaagcgcgaccactagtgggaagagggacatggctggcccaccactagtggacgcgcctgacaggctaccacaagtggtcgcgcctggggccccaccactactggtagcgcctggtaggccaccactagtggtcgtgcctggcaggccaccacttccacccctatcacatcgtcctgtcaagtcacgccacatgtcgcgttctggtggaacgcgcccctcag

SEQ ID NO: 56192 - DNA, 250 bp, Glycine max
  Peptide Sequence Number=SeqID_172970
aaaaagaaggagtagagacgagagtcgtcatagactagtcacgaaaagggcaagacggacgaaatcagtgtcttatctttgctttcctcttatctccgataaaagaaaattcgagtcgaagtacttccgtaacgcttccgtaagtgattctgtggaaattcttcatcgttcttcatcgttcttcatccgttcttcgttcgttcttcattcttcaaggttttcttttcttccgttttttaacgtgctttaa

SEQ ID NO: 56193 - DNA, 165 bp, Glycine max
  Peptide Sequence Number=SeqID_172971
atgagttgcgcgccgccgcggtttgagcaaaacggttgcgttttgggcgttgccgacaatgtgcaacagggcgtaaacggttttaccttgtgctccgttggttttgaggttatttacgcaagggtgccatttgagggtcttagggtggctcccaccggtagttaa

SEQ ID NO: 56194 - DNA, 417 bp, Glycine max
  Peptide Sequence Number=SeqID_172972
atggacaacataagattcaccgcacctttcagggttcagaagaaccttctccaagttcctttcacctatcaaaggcaatggctgtgcaactaccccaaatacgttttattccactacgatggcgagatacatttcattaggacacttcctgcagcggcttccaaatttgtgtatggctccaaaaaaagtattaccatccaccacggactttcaaaatccaccaaatggccactcaccatccaccatgacatccctgccattacacaaccatggttcaacctgattcatgaaaaaaatttaagacccggagatgaggtagtcttttactacccttttcatgaccatgcattggagctgctcataaggaaagccatcgaatggaacaacagcaacaccgaccttgactttgatgaataa

SEQ ID NO: 56195 - DNA, 867 bp, Glycine max
  Peptide Sequence Number=SeqID_172973
atgcagctccaccgtgtctccgccgcatcgaaactgagcctcacgtgcctcagcctcgccttgaaactcgtgctgttgtacgccgcggaggcacagcttcagcaccgtggccccgacctacattggtaccccggaaccgccacctggtacggcgaccccgaaggagacggcagtaccggtggggcatgtgggtatggtacgatggtggatgtgaagccgttcagggcgcgggtgggagctttggggccattgctgttcatgaagggggaagggtgtggtgcgtgctacaaggtgaagtgtttggacaagagcatatgttcgagaagagcagtgacagtgataattacggacgagtgccccggttgcccctctgaccaaacacacttcgatctcagtggtgccgcgtttggccgcatggctattgctggcgagaacggtccactcagagaccgtggtcaaatccccgtcatttaccgcagtgttgcagatttgaccgaaagtaactgcccaacgtatgacaattccaaattctggggacgtgtctccttagaacacgtgcctcaacactatcatcattggcactttaggatagatagattatcttccaaagatctcaaagcatgtgatatgggaccaatgttaaacagtaacattcctcatttctccctcactgcagggtctactgagtggctacaaatgaatcacctttggggtgcaaattggtgcattattggaggacctttaaggggaccattctcagtgaaattgagctcttccactgggagaagcctctctgcaagagatgttattccaaccaattgggttccaaaggccacttacacctctcgcctaaatttctacccctag

SEQ ID NO: 56196 - DNA, 162 bp, Glycine max
  Peptide Sequence Number=SeqID_172974
atgggtgagaaagattatgtgttcaagtttccaggcatggaggactatattcgaagtggggcagtgaaaaattttgtgccggacttggaaatcgtgtatattccagaaggaagccattttgtgcatgaacaaatgccagagaaggctaaaggtttggtgtaa

SEQ ID NO: 56197 - DNA, 270 bp, Glycine max
  Peptide Sequence Number=SeqID_172975
gttacaggttgcacactttatggtggagctcatgggtcaggcttgtgtattcccactaaagaaacgtctcatgaagttaattacatgggaaaccagcctggacaaaattttaatgcagtccagggtgggccacctaacaggccacaacaacaagggcctagcttatctgagagaacaacaaagctggaagaaactcttgctcagtttatgcaggtgtcattgactaatcataagagcacagagtcagccataaaaaatctagaggtctag

SEQ ID NO: 56198 - DNA, 738 bp, Glycine max
  Peptide Sequence Number=SeqID_172976
atggagaagatccagcacagtgaggtggaagtaaagggactgaagctgcacgtggcagagattggaagtggtcattttctgagtgcatattggaacacacttcaaaacagctccaaggcagtggtgttcttgcatggattcccagagatctggtacacatggaggcaccaaatgattgctgtggcaaatgctggttatagggcaattgcctttgatttcagaggctatggactctctgagcaaccagcagagcctgaaaaggaaaccatgtttgatctggttcatgaaatagtgggtcttttggatgctttaagcatcagcaaggctttccttgttggcaaggattttggtgccatcccaggacatcttactactgcagtacacccagaaagagtagctggtatcataactttaggcattcctttcatgctcccgggtccctctgcagtggagagccaccttctgctccccaaagggttttatattactaggtggcgggagcctgggagggcagaagcagattttggccgctttcctgtgaaatcagtgataaggaacatctacattctcttctctagaagtgaggttccaatagcagctgatgatcaagaaatcatggacttgtttgacccatctactgccctacctccatggttctctgaggaagaccttgcaacatatgcatcattatatgaaaaatctggattcaaatatgcattgcaggttccttacaggtaa

SEQ ID NO: 56199 - DNA, 130 bp, Glycine max
  Peptide Sequence Number=SeqID_172977
atggagtgtaggatcttcgtgaaagactccaaatctttgtgcaaatcttctagcacctcatggaggtgctccaccatgccattctccattgcacaagctttggatctggcatggcgaggtagaggtagag

SEQ ID NO: 56200 - DNA, 162 bp, Glycine max
  Peptide Sequence Number=SeqID_172978
atgtattttttcaaagatagaagagctagagtgttcagaagaagagaaaggcaatttaaggccccggtgttagaggtccattatgtttcagcaattgtgttgtctaaggagtcatacgacgttgtccgggtggaggaggaggtctctgttgtgagctcataa

SEQ ID NO: 56201 - DNA, 236 bp, Glycine max
  Peptide Sequence Number=SeqID_172979
atggaaatgctgaagaaagagggtaacaagatggggatatgggctcataataggatcaaatcctcctcagaggcttgggaaagtggtacctctgacgctgatcaatggaggaaaataaggtggatgaccggggagatgaaagagaatgaggaattggtgttggtgggtctccggagtttgagaaagcttgggcaccatcacaaagatgggaggaatgagggttctgccaaaaagag

SEQ ID NO: 56202 - DNA, 993 bp, Glycine max
  Peptide Sequence Number=SeqID_172980
aggatacacgtcctcgccttcagaggactacccgtcctcaccttcagagggctacacgccctccccttcaaaggactacatgtcctggcctccataaggctacatgccctcaccttcagagggctacacgttatcaccttcagaaggctacacgccctcaccttcagaggactacacgtcctcgccttcagagggctagacgccctcgccatcagaggactacacgttgtcaccttcataggactacatgtcctcgccttcagaggactacacgtcctcgccttcagaggactacacgtcctcgccttcagaggactacacgtcctcaccttcagaggacaacacgtcctcgccttcagagggctacacgtcctcaccttcaaagggctgcacgccctcgcctttagaggactacacgtcctcaccttcatagggctacacaccctcaccttcaaaggactacacgtcctcacctttatagggctacacgtcctcacctttatagggctacaagccctcaccttcagaggactacataggactacatttcctccccttcaaaggactacacgtcctccccttcagagggctacacgccctcgccttcagaggactacacatcctcaccttctaaggactacacgtccttgccttccgagggctacacgccctccctttcaaaggactacacgtcctcgccttcagagggctacacgccctcccttttatagggctacatgtctttgccttcagaggactactttcctcgcctccagagggctacacgtcctcgccttcagagggctacatgccctcaccttcaacagactacatgtcctcgccttcagagggctacacgccctcgcctttagaggactacacatcctcgccttcagaggactgcacgccctcgccttcatagtgctacacgtcctcgccttcataggactccacatctgcaccttcagagaactcaaggtcctccgcccttaa

SEQ ID NO: 56203 - DNA, 339 bp, Glycine max
  Peptide Sequence Number=SeqID_172981
atgcggggttacgttatggttacccgcaccttttgtcaaccaggggcaaatgagcccgttgacgcaaggagagtaacatcgtcttctgcaccttttgtcatcatttctcgtcaacttatggttacccgcacctttcgtcaaccaggggcaaatgagcccattaacgcccagagattaaatcatcttctgcatgttttatcgtccctacccgtgaagtcaggatacatgcggggttaccttatggttatccacacctttggtcaaccaggggcaaacgagcctgttgacgcgcggggacttacatcgtcttctgcaccttttgtcgtcctgcacctttaa

SEQ ID NO: 56204 - DNA, 729 bp, Glycine max
  Peptide Sequence Number=SeqID_172982
atgggtgttcttcaatctacacttctctacttgatcttagtacattcatgcaagattgttgcttacaaagaccaagagtggaaaaaagccactgcaacttatgccaatgacacagaggggtctcttattaccgaaggagcttgtggttatggagacctccacagggcaagttatgggaaacacagtgctgggttaagcaccattttgttcaacagagggagcacatgtggggcttgctatgaaatcagcccttctgttgttgttactgttacagatttctgtgctccaaattatgggctttctgttgattatggtggctggtgcaattttccaagagaacattttgagatgtcacgggctgcatttgctgaaattgccaagaataaagctgatatagtgccggttcagtatagaagagtgaagtgtgcaaggagtggtggcatgagattcacaatgtgtgggagttctcacttctatcaagttctgatttccaatgttggtctggatggtgaagtgtttgctgtgaaagtgaaaggatctagaacaggatggataccaatggcaaggaactggggacaaaactggcattgcaatttcaacttccaaaatcagcctttgtcctttgaggtaaccagcagtagtggaaagacactcacatcttacaatgtagcacccacaaactggatgtttggacagacatttgaaggaaaacaatttgagcatgagtag

SEQ ID NO: 56205 - DNA, 2226 bp, Glycine max
  Peptide Sequence Number=SeqID_172983
atggcgatgatcaaaagtttaacagccctgttgctgggcaccctgtcgttcgccgcgctggcggaggacaccgctgccgatgcgctggtgcagcgcggtgagtatctggcgcgcgccggtgactgcgtcgcctgccacagcaccgcaggcggcaaaccgtttgccggcggcctgccgatggcgacgccgattggcaccatctactccaccaatatcacgccggataaggcaaccggcattggtgactacagctatgacgacttccagaaagcggtgcgtcatggcgtggcgaataatggcgacacgctctatccggcgatgccctatccgtcttatgcggtggtcagcgatgacgacatgaaggcgctgtatgcctacttcatgcacggcgtggcaccggtggcgcaggctaacaaagagagcgacattccgtggccgctgtcgatgcgctggccgctggcgatctggcgcggcctgtttgcgccagatgtgaaggcgttccagccggccgcgcaggaagatccggcgctggcacgcggtcgctatctggtggaagggctgggccactgcggtgcctgccacacgccgcgcagcttcaccatgcaggagaaagcgctgaataacggtcagggcaatgattatcttgccggtagcagcgcgccgattgacggctggaccgccagcaacctgcgcggtgacaaccgcgatggcctggggcgctggagcgaagcggatctgcagcagttcctgcgctatggccgtaacgatcacacggcggcgtttggtggcatgaccgaggtagtgcagcacagcctgcagtatctcagcgatgcggatatcagcgcgattgcccgttacctgaaatcgctcggcgcgaaagatccgtctcaggcggtgttccgtgaggatgacgcagtggcccgggcgctgtggaaaggtgacgacagccagccgggtgccggcgtgtatgtcgacagctgtgcggcgtgtcataaaaccgacggcagcggctatcaacgcttctatccggcactgcgcggtaatccggtggtgatggcagaggatccgacgtcgctgattcacatcgtactggtaggcggcacgctgccgggcgtgaaaggcgcaccgaccgcgatcactatgccggcgtttggctggcgtctgaacgacagccaggtggctgatgtggtgaactttatccgcagcagctggggcaacggcgtgcagaccaaagtcacggcgaaacaggtggcgaaactgcgccaggatgacagcgtgcagctaaaacagggcagcgcggatatccgggatgaccatatgtctgtaggctattacgacccgaccaaaccggggcaggagaactacgtcaattcaccttatcaatactggaaaggggtggttgaagataagagcgtcagctatatcgaatttgccattaacggccagctgtttaccacccaggttcaggccgatggcagctgggagtatcagctgccgctgcggctggaagaggggagccacaatctcaccgtgcgctttttcgaccgggccggcaacgccgggattccgttccagacgcggctggaagtcgatctcagcccgcccgatatgccggcgattatgcgcgtactggatgattttggaccggtgcagggcccggttggcaacaaaggctttaccgatgataaaacgccagccatttccggttatgccgagccggacagcattgtccgcctgtacagcaacggcgtgctgactggcagcgtgcaggcggcgaaaaatggtcagtggaccattacgccggcactgagtgacggtgaacagcgcctgtccgttaccgccaccgacaaatttggtcaggtgagtgtcgattccccggtctatacgctgttcgtcaactcgccgcgcatcgacaagccgcagctgctggaagtctatgataatgaaggggtgaacaccggtgtgatcaaagccggtagcgaaagcgacgatcgcagcccgcgcctgagcggcaacgcgccgctggacgcagaaaacgtcatcatcttcgtcaacggggtacgcgtcggcgtggcaccggtgattgacgggcagtggcgctgggagagcaacgttgatctgctgggctacggtgaaaacaccattactacccgcgcgcaaaataaccgtggtgagttgagcgatgcgagcgagccgtttacctatacggtggtgcccaccgcgccg

SEQ ID NO: 56206 - DNA, 726 bp, Glycine max
  Peptide Sequence Number=SeqID_172984
atgactaagccttgtgtggtgcagattaagctgtcaaaagatcttcctgacgagttgttatatggaagggctgtggttgtcgatgaagtcattaaaaatggaagggcattgggtaggaagggaagatgcccgttgatgtttgaatggtatggagagaagtactggggtgctgcgcatggattggctgggattatgcatgtgctgatggatatggagttgaagccagatgagcttgaggacgtcaggggaactctcaagtacatgataagcaaccgctttcgcagtggaaactatcctgttagtgaagatgataggaagagcgatgctcttgtgcattggtgtcatggagctcctggaatggcactcacacttgtcaaagcagctaaggtttttggagataaagaattcctggatgcagctatagaagcagcagaagtggtttggaatcgtggtctgcttaagaaagttgggatatgccatggtattagtgggaatgcatatgtctttctgtcactgtaccaacttaccggggatgtgaagtacttatacagggccaaagcttttgcttgctttttgcttgacagagctcataagctgatatctcgaggggaaatgcatgggggtgatagaccatattcaatgtttgaagggctagggggcatggcttacctctttttggatatgagtgatccttccttgtctaaatttccagcttatgaactctga

SEQ ID NO: 56207 - DNA, 288 bp, Glycine max
  Peptide Sequence Number=SeqID_172985
atgacgggtcacggcaaaaacgtcctgagcgtagcggttgacgatatcctgcaggttggaagtcaggatctgttcgtgaaagacggcaaaacccagctgctgatcaaaggcgatgcgcaggacgtggtaaaactggatgacatcctcggcgacggcggtgacgtgggcgattgggtgaaacagcagggcagcaccacggtggctggcgtgaagtatcaggtttacagccacagcggcgtcgatgccgacgtgctgatccaggaaggggtgaaaaccgaactggtgtaa

SEQ ID NO: 56208 - DNA, 3139 bp, Glycine max
  Peptide Sequence Number=SeqID_172986
cgcgcaggaacaagcatttgctgcagagatccgcgccacgctgagcaaagacgatctgcgtaacgcgcgactgaatgcggcgcgcaccggcggcgaagcgggtatcgcctgggctgaggagctgggggataaagtgctgatggatgaggtagcgccgtatgcggtcacgcgcgagctgctgtacggctcaaccgacgttggggatgtgagctgtgtaacgccgacggcgcagtgttttgccccctgctttgccttcggcacgccgctgcacacctggcagctggtggcacagggccgcacgccgattgcccacaaagggatgtgcctcgccgccaaagtgctggccgccaccgcgctgacgctgttgcacgatgatgccgcgctggcgcgttgtcgtgaagagtttgaccgcgtgcgccgcgaacagccgtacgtgtgcccgattccggccggcggtcgccatttatggcgacctggtaccaacgcatcaccattaaaaaaatataagcagtacgcaaacataactgacaagacgactcatgaggatctaccgatggaagtgatgaccgaaaatcgcagccccggcaagctgttcagctggattgagcgggtcggcaacaaagtgccgaacccgttcttactgtttgtctacctgatcgtggtgctgatgatcgccaccgcgcttctcagcagccttgatgtggccgttaaaaatccggccaatggcgaactggtgcgggtcaataacctgctcagcgtggcgggcattcagtggatcctgcccaacatcatcaaaaacttcagcggtttcaccccactgggctccattctggcgctggtgatcggggccggcctggcggaaaaagtcgggctgctgcagtcgctgatggtgaagatggcgtcacgcgtcagccgtcgctacgccagctatatggtgctgtttatcgcgttcttcagccatatctcttccgacgccgcactggtggtgatgccgccgctcggcgcgctgatcttccttgccgtcgggcgtcatccggtggcgggcctgctggcggcgattgccggcgtcgcgtcgggttttaccgcgaatctgctgatcgtcaccaccgacgtactgctctccggcatcagtacagaggccgccaaagcggtcagcgacacggtccacgtcagcgtgatcgataactggttcttcatggccagctcggtcatcgtactgaccgtggccggcgcgctgctgaccgataaatttgtcgagccgcgcctgcccgtctggaacagcggccaccacgatcgcctgccaccactgacggcgcaggagaatcgcggcctgaaggcggccggtctcgccgcactggtgttcatcggcgtgatggcgctgctggtggtgccggagcatgcgccgctgcgcaacccgaaaaccggcggcatcatcccttcgccgtttattcagggcatcgtgccgatcatcatcctgttcttctttgtggtggcgattgcctatggcgctgtgacgcagcagattcgccgcgctgacgacatcccccgactgctggtggatccgatgaagagcatggccggctttatcgtcatggtgtttccgctgtcgcagttcgtggcgttcttcaactggagcaacatgggcaagtttatggccatcggcctgaccgatcggctcggcgatctggtcgatccttgcgccggtatttgtgccgatgtttatgctgctcggctttcacccggcgtttgcccagatgattttccgcatcgccgattccgccgtgctgccgctggcgccgatgtcgccgtttctgccgctgttcctcggtttcctgcagcgctatcaaaaagacgcgcagctcggcacctactacgtgctgatcttcccgtatccgctggtgttctttgtgacgtggatcgcgctgctgctggggtggcgaccgatcgcatcgcgaccgaacgccagacgctggccgggcgcatcgacgctctgccctcttccgccgggctgtggcgctttattacgctgctggcgctcggcggcttctttgagctgtacgatctgtttgaaaccggctacatcagcgccgggctggtcgccgcaggcgtgttccacaccggcaccgctggcgtgtttggtatcgccgatcaggcggcgttcgcctcggcgacctttctcggcctgtttgtcggtgccagcctgctgacgccctatgccgaccgcttcggccgtcgcctgacctttatgtgcgcgctggcgtggtacggtgcgttctcactgctgatggcgttccagcacagcgcagagatgattattctgtgccgcttcctggtcggtatcgttcctgtcggtgccgacggtggcgctgatgtcatggtggctggtaccgcaaaccctgctcggcctcgaaggctggcgctgggtcgtgatcgccggtgcgctgtgctcgctggtgatctggtttatccggaaaaacctgccggagtcggcgcgctggctggcgcagcaggggcggcatcaggacgcgcaccggacgatttctctcagcgtgatgcggcgacacagctgccgaaaaaagggcgctttagcgaaatctgggcaccggcttatcgccagcgtacgctgatgctggtggtgatgaacttcttccaggcgattggtttcttcggcttcggtaactggctgccggcgctgctgtccggcaagggcgccaccgttacccacagcctgctgtacgcctttttcatcacgctggcctatcagctcggctcgctgatctgcagccgctacgccgaccggctggaaaacaaatggcagatcgttttttcatcgctgatgacggtggtgttcggcacgctgttcgcgctgaccagcaatcctctgctgatggtgccggctgtcgaccgccttcagcagtattctgattggcctgattctgcagtatgccggcagtcagggggtgatcgtgtttatcgtgctgagtatgctgatggtgatgctgtcggtcgggatttacgggccgaagacgcgggggctggatctggagaacatttaaaccggatgggcgcagggtgggcggcggccggttcagcccggcaatgcgcaccctttggagcggcacgattcatcgcgcgataa

SEQ ID NO: 56209 - DNA, 1241 bp, Glycine max
  Peptide Sequence Number=SeqID_172987
tgcctcataaagcaggggatgtcaataacgggaaaaatgatccgcttatcggtcaacagctcttcaccctttcatacccattaaagtccgcctttggagcgggctatatggaagcgtcgagccgacagagtgttggtgaaagctggcgtttaaccctgtctggcaactcactgtcggtccaacgaaaggcagttacacctctctcttcgggttcagacaagattccgcataatcccgacaacgtaaacggttgcggggttccgttcgttacacggcctttatgcacattacgcgggcctgaaaatccggcgcgtcagaccggcgacaacagcacactgcccatcccctgggatcgatttcacccgatcgcagcatttgcgcggcgatcacgagcaagtggggccttactggccagtagctggaccggcgccgcacaggcggcggaaagcgatccgcagtacctttctgactggtggcatcagagcgtgaacgtggtaggcagttatcacacccgcttcggaccccagttcaacaatgatgtgtatctcgaatacgaagcctttactaaaaaggactggtttgatttctacggctaccttgacctgaccaacttctttggcgtgggtaacagcaatgccaacggtatttttgaccacggttcgccgatgttcatggaaattgagccacgcttctctatcgataagctgaccggcaccagcctggcgttcggaccgttcaaagagtggtacttcgctaacaactacatctacgacatgggtcgcaacagcgatagccgtcagaacacctggtacatgggtctgggtactgacatcgatacccatagcgatatcggcctgtcactgaacgtgtacgcgaaataccagtgggaaaactacggcgcggcgaatgaaaatagctgggatggttatcgcttcaaggtgaaatactttgtaccgattaccgacctgtggggcggcaagctgagctatatcggcttcaccaactttgactggggttccgatctgcgtgacaagtctgaccgctcacgcaccagcaactcaattgcctccagccacattctgtcgctgaactacgatcactggcatgtctctaccgtggcgcgttacttccacaacggcggccagtgggctgatggccaggagctcaacttcggcaacggtccgtttgaagtgaaatcaaccggctggggttactacctggtggtgggttacaacttctaa

SEQ ID NO: 56210 - DNA, 216 bp, Glycine max
  Peptide Sequence Number=SeqID_172988
atggcctgcaccagcctggtggcaaatattgattttgtcagcatcattgcgcgcgacgtgattgaagaccctacgcacggcgggcagctgatcgcgctggatctcgacgatccgctgccgaaagccaccttctatctgattcagcgtaaagacaccgcgctgacgccgatgagcgcttacatggcgcagctgttccgccgctactgccagccgtga

SEQ ID NO: 56211 - DNA, 2076 bp, Glycine max
  Peptide Sequence Number=SeqID_172989
atggtcaatataggcacccagtataatcgccccgagcgggcgcatcaggaagccggcaccaaaggtcatcagcgtcagcatcagcgaagcaaacggatcgtcgcccggaaaaaaggtttttgcaatggcggtggcgtagtagccaaacaccataaaatcgtacatctcaagaaagttaccgctgcctgccggcgcgcgaatagatgtgatcctgttcaccattgcactttacaaaagtacaaacaaagctttgaccccttttcatccattaataccttgcgagtgggcacaccttatccgctgctgagcggcagcctgccggcgcatgccggtgaagtcattgaattcattatcaacgatcaccgctacagcacgccgattgccgccgacggcagctggtcatttcagccgccgtgcgcgctgagcgaaggcagccatgacgtggtggcgtgcatcagcgacagcggtgagccgcatccgttctctgttgacgtcgcgctctcggtgccggacaaaccggcgatcaccgcgctgtttgatgacgttggcagcgaaaccggcccggtcgggcgcggtcacaccattgatgacaccacacccaaagtgcagggctatgcgctgccgggcagcacggtgcggctgtacgatcacgacaggctgattggcagcaccgtggccagtaaaagcggcgaatggtcgctggagccgctgctgggcgcgggcgggcatcagctaaccgtcactgccaccgacgagtttggccgcgtcagcgaaccttctgaccactttgacatcactgtggttgacagcggaccggtgccaccgaccatcagctacgccattgacgatgtcggcaccgtacagggccagctcgccagcggttccaccaccgacgacttctcgccgctgatcgtgggccgcgcggagccgaacagcatcgtttatctgttcgcgcagaacgatcacggcggcatcggctataaaggcagcgtcaagaccgatgccaacggcgactgggtgattcagtcgcgcgcgatgatcagcggtgacggcatctacaccttctatgcctcctacgagaacagcaaagacgactaccgcccggatttcagccttaatatgtcggcgctggaaaatctgcgtccggctatcgactgcgcgcgtgacgataccggcgcccataccggccaggtgtaccatcgcggcaccaccgacgataaaacgccggtgctggaaggtcgtggtgcgccgggcagcatcgttgagattgagtacaacctgagtaacagcggctggcacagcgcgggcagcgtgacggtcgatgcgcagggcaactggcagttcgccggcttcgaactcacctattttggcgaatggggtttccgctcgcgcggcgtggccgatggcaaagccagcgcgtggagcgataagttcgagttgctggtgatccccggcgcgccgctggaaccgaccatcgactacgcctgggacaacgcgggcccgctgcaggggccggtttatcagcacgactcaaccgatgacaccacgcccacgctgcacggcagcggcacgccgggtcaggtgattgagatcgagtatggcgtgcagggcgaaggtctgcgccacgccggcagcgtgctggtcgatgccgacggcaaatggagctttacctcaccctatctgcatcagccaggcgtgtgggaatatcaggcgcgcgcctcaaccggcgagatgaagagcaactggagcagcaaattcgtgctcaacgtcagcccggacgccgcgttcgatcagcaggcgcaggatgaagcccagccggatgcgctgacgctgcaccagctgctgagcgaaggtggcaaaggcctgttcgttgaggatgacagcacccagcttctggttaacggcaagccaggcgacagcgtgcagctgcaggatattctgccggcaggtgaagcggtcgacggctggacgcagcagaccggcacgctgaccatcgccggtacgcaatatcacgtctggagccacggcgacgccgagttgctggtgcaggacggcgtgaaaatcgagctggtgtaa

SEQ ID NO: 56212 - DNA, 908 bp, Glycine max
  Peptide Sequence Number=SeqID_172990
atgcggatttacgcacgctggataggagcgctgctgctgagcatgctggcgctgaatgcctttgccgacgacgggcgcggctggcagccgattgatgaaaccatccgcaagagcgatcacgatccgcgcagttatcaggccattaccctgagcaacggcatgacagtgctgctggtgtcagatgctgccgcgccgaaatcgctggcagcgctgacgttaccgatcggttctctggacgatcccgacagtcagctgggcctggcacactatctggaacacatggtgctgatgggatcaaaaaattatccgcagccggataacctggcggagtttctcaagaagcacggtggcagccacaatgccagcacagcctcgtaccgcaccgcgttttatctggaagtcgaaaacgatgcgctgcaaccggcggtggatcgtctggcggatgcaattgcgcaacccctgctcgacccaaccaatgcggaccgcgagcggcatgcggttaacgctgagctgacgatggcacgctcgcgcgatgggctgcgtatggcgcaggttggcgcggaaaccctcaatccggcgcaccccggttcgcgttattcgggcggtaaccttgatactctgagtgacaaacccgacagcaacctgcatcaggcgctgctcgatttctatcaccgccactactcggcgaatctgatgaaagcggtgatttacagtaacaaaccgctgccggagatggcgacgatcgctgcacagacctttggtcgcgtggccaatcatcaggccagcgtgccggacattaccgtgccggtggtcaccgatgcgcagaaaggcatcatcattcattacgtgccagcacagccgcgcaagcatctgaaaattgagtttcgcatcgccaacgacagcgacca

SEQ ID NO: 56213 - DNA, 1341 bp, Glycine max
  Peptide Sequence Number=SeqID_172991
atgaacgacggcgtgtatccgcgcaccctggcgccgctcggttttgacctgatgcagcagcagacgcggaaaggcgatcgcagccggcgtgatgatgaccgctatctgttccttgaagcgctgatctcggcgcagcagcagctgtacatcagctacattggccgggcgattcaggacaacaccgagcgctatccctcggtgctggtgactgaactggtggattatctggcgcaaagcttctgtctgccgggcgatgaagcctgtgagccggacgtcagtgagcagcgggtgcgggcacatttgcaatgcctgcacagccgcatgccgtttgcagcggaaaatttccagccgggaagccacgtgcagagctttgccgcagagtggttgccggcggcgaccggcagcggcgtggcgcagcccgggtttgtccagccgctgccggttcagccgctgaccacgctgtcgctggagcagctgctgcgcttctggcgtcatccggtgcgggcgtggtttcagcagcgcctcggcgtggctttctggatggaggagagcgagctgccggacagcgaaccgttcgcaccggacagcctggagcgctatcagattaacgctgaactgctcaatacgctggtcaacggtgacgatccggcccagctgtatgcgcaccaccgcgccgccggtaatctgccttacggcgccttcggggaacttttctggcaaagccagaccgaagagatgcaggaggtggcggcggaagtgagcgcgcagcggctgccggcggagagctgggaagtcaacctgacgctgggcgcaacgcagttgaccggctggctgactcaggtgcaagctgatgggctgttacgctggcgtccgggcgtgctcaacatcaacgatggcctgctgctgtggctggaacatctggtgtattgtgcgctgggcggcaacggcatcagccgcatgtacgggcgcaaacagagccgctggcgcttcgcggcggtggctcccgcccaggcgcaggcgcagctggctgaatatgtggccgcctgtgaggcgggtctggcgcagccgctgctgctgctgaataaatccggcggcgcctggctggacgccagctttgacagcaaatctggccagcttcaggaagatgacgccacgcagaaaaaggcgctcagcaagctgttgcaggcgtggcagggcggctaccaggttgaaggcgagggcagcgatccctatctgcagcgcctgtgccgcacgctggacgagccgacgcagcagcagatcatcgctgcggcgcgtcagtggtatttaccggtgcgcctcgcgcatcaggatgatgtatag

SEQ ID NO: 56214 - DNA, 1502 bp, Glycine max
  Peptide Sequence Number=SeqID_172992
ctgcggttctcactctttcgaatcagccagagaacatggacaacagcgataatctcaccgccatgatgctgtttgcacgcgtcgttgagcggcaaagcttcagcgaagcggcccgtacgctggggatatcaaaatcgcacgtcagccgcgaaatcgcccggctggaggtgcggctgggtatcaaactgctgcagcgcaccacgcgcaaagtggcgctgaccgagctgggccaggcttactatccgttctgcacccgcatgctggaagagatgcatcgcgccgacgcgtttgtgcagcaggtgcatcagcagcctgccggcaacgtgcgattgcaggcgccgatcaccttcggctgtcagtgcgtggtgccgacgctgaacacctttatccgccgtcatattcacatcaacgtcgatctcgaactgaccaccagcgacgatccgcagcccagtgcggacgtggcgattgtgatccgcgcgcgtgcgccggaggtggcgaactaccgcgagctgagcagcattgactggggactgtatgcgtcgccagcgtatctggctgcgcatccggccatcgatcatcccgaacgtctgatgcgccacgatctgctgctgtttcacggcccggcacacacggcggcgttgccgtttcgccgtgataagcagcgcctggcgctggatcatggcgctgctcaatgcggccctggccggaaccggcgtggcgtatctgccggcctatatgacgcaggaggcgctggcgcgcggcgagattcagcaggtgctgccggaatggcagatggatcgcctgcacagttacctgctgctgaaagagcagccgcagccctcgtcaccggtcaccttgctctgcgacgcgctgatcactacgctgggtgcgcccctgctaaaaaagccaaaaacagggatatcactatgtcgcattcttctatcgcgttagcgcctgagcagcaacactggcggcgcaatttgtgggaaccggccgcgattgcgcgctggtcaggcgccgcctacggtgccacctttcttagcgcggcgctgacggcaccgctgtggggcaaactggcggatcgctatggccgcaagctgatgctgatccgcgccagcctcggaatggccgtcgccatgtcgctgattggtatggccaccgcgccgtggcagctggtagcgctgcgcctgctagccggtctgctcggcggctatgcgtcgggttccactattctggtggcggcgcaaacgccgaaagcgcagaccggctgggcgctgggcgtgctgtcctccggcatcatggccgggaatgtggtcggcccgctgctgggcggcgtgctgccaccgctgatcggtatccgccacactttctggctcaccggcgcggtgatttttctcgcgtttctcgccaccacttttctgctgaaagaagcgccacgtgcggcgaagaaagccgcagccggggagggtgatgagccggaggcgtcgatcaaccggccagtg

SEQ ID NO: 56215 - DNA, 123 bp, Glycine max
  Peptide Sequence Number=SeqID_172993
atggctcacaaattctgctttgaggcacttgatcacagtcttagagatatcatcaaacacaactcaaaggacagtacaatctttggagatcctgccagtcattccaagaggcagccgcaataa

SEQ ID NO: 56216 - DNA, 267 bp, Glycine max
  Peptide Sequence Number=SeqID_172994
atgaatcctgttgaaacttgggctgtcagatttaagttccgttcacaattacgccaatcatctgtgttggatgtgagtgaagaactccatcatattcgatcattgatagccacccttgggttgaagtcttctgattacgatcctggaaactctacctgtttaactccaaccaaaaggattagttgtcagcaaaccagttatgatttcgattctgatgagcatgcacagtatccgttatcaactaacaaacatatcaaagttgagtaa

SEQ ID NO: 56217 - DNA, 210 bp, Glycine max
  Peptide Sequence Number=SeqID_172995
atgtcatgccaacatgactttgttggttactcgttcacaggaaaaaatccaaaaaagtttgacattccttccaagtgtaccatcgatgaactgaaggatttgatcaagcaagttacacctcaagggattcccccttatggtattcatgaatcacaaacggtaatggaaatggaagacgacgtgtctcggtcgcaacatgattcaatgtaa

SEQ ID NO: 56218 - DNA, 583 bp, Glycine max
  Peptide Sequence Number=SeqID_172996
atggatattgctgcttcaagaatttgatttggtcatcaaggacaagaaaggatctgaaaatgtggtagtcgatcacctatccggattggtgaatgaggatgtcacctcaaaggaagcagaaataagagataagttccctgacgaatctttgtttttgattgaagggagaccctggtttgctgacatggctaattttaaggcagccgggatatgtgtggcaagtgaggaggctaagggcatactgtggcactgtcacaattcaccgtgtggtgggcattatggcagaagcaaaatagtagccaaggtcttacaatcaggatttttttggccaacaattttcaaagacgcccatcatcatgtcttaaagtgtgaccaatgtcagagaatagggggaatttctcgaagaaatgagatgcctctgcaaaacattatggaagttgaagtttttgattgctggggtattgatttcatgggcctttttccttcatcggcagggaatgagtatattctagtggctgttgattatgtatctaaatgggtggaagctatggccatgcaaggaatgatgctaaaactgtggtga

SEQ ID NO: 56219 - DNA, 728 bp, Glycine max
  Peptide Sequence Number=SeqID_172997
gactacaagtcctcaccttcagagggctacatgcccttgccttcagaggactacacgtcctcaccttcagagtgctgcacgccttcaccttcatagggctacatgccctcagctttagaggactacacatcctcgccttcagagggctacacgccctcgcctgtagagggctacacgccttcgcctttagaggactacatgtactcacattcagaggactacacatcgtcgccttcagtgggctacacgtcctcaccttcagagggctgcacgccctcatagggctacatgccctcgccttcagaggattacacatcctcgccttcagaggactacatgtcctcgcctttagagggctgcacgtcttctctttcagtgggatccacatatgtgccttcagagaactcaagggccaactgggcgagcacaaccaaaggaggaggctatcacacagctaccgtgcataccggggcaagattttgctcagaccactgcaaggagacgaggattgcgcccacaagacacccagtggacccgaagaagtccaacagggtcctggggtttccagctctgattatgggcctctgtcagttatacggagtgcccgtcacccccagcaaggcaggcatagggcgaggtaccacaacagcctggggacggctagcagcgggcaacagatgcaccgccaccacctccagagtccacctcagctcatctacaaaggctga

SEQ ID NO: 56220 - DNA, 201 bp, Glycine max
  Peptide Sequence Number=SeqID_172998
atggaaaaatctgacacgaaaaccttcaatgataagaaagaaatgaaagcttacatcacttgggaagataacgatatggattcattcagagactcaaaaaatgaagtcatgaatctaagtctcatggccaaaaattatgaaagtgaagaagagatgcattcaatgacttgcataaagaatcagtcaaacttgcaaaactag

SEQ ID NO: 56221 - DNA, 207 bp, Glycine max
  Peptide Sequence Number=SeqID_172999
atggaagacgcacccgtgagcctcgcctcgctcgcccgcaaaaggaaagttataactagtcaagatctgagtgacaatacaaactccctaacggctcctaattatatgggccatcaagtctatcatatgctgacaatagctgaggagcccatggatttcctcgggggcagagtacgcgtccaccatttctttggccttcgccagtaa

SEQ ID NO: 56222 - DNA, 476 bp, Glycine max
  Peptide Sequence Number=SeqID_173000
atgggatcgagtcaggcaccttcgcttaaaaataggttctatcagatcaagatcaagagcctaggagttgccagtctgaaagagttaggacagttgatgggtcaactccagcgacaagcctttcgcaaagccaatggtaagatctgggagctaaccatggcagaggtctccatagaggccattgcctccctcgcccaattttatgaccagcctttgaggtgcttcacctttggggacttccagttaacacccatggtggaagagtttgaagaaatcctgggatgccctttaggaggaaggaaaccgtatcttttctcaggcttctatccctccttggctagagtttctaaaatagtcaaaatctcgacacaggaattggaccgcgaaaagcaagtcgaaaatggggtggttggagtaccaacgaaatgtttggaagcagaggcgagaaccttggccagtcaagacgaattggcccc

SEQ ID NO: 56223 - DNA, 1047 bp, Glycine max
  Peptide Sequence Number=SeqID_173001
atggcattacaaattcatgaaggacaaaactttggatttggacgcctcttgttagcagtgctatacgaatcgcttggtgaggcatgcgatgatctgaagaaatcgaaggatgggtcttccttcttagtatctgggcctatgtggcttctccagttgtggcttaatgccactttcgaacaagaaatgggattaataatcccacaagattatgctgaagaagttgccaatcgctcgatcgaaggccagagagcacttcgactaacacccaagtccttaaatcaaagctcacaaaagctgttcctaaagtatatgaggattttcctgagctttgacaagtttcttccccaacatgctccattcattagtcgagaggttggcccagcctggttcactgactatttccctgctgtcgatccggacaatgaagaagaagtgaacgaaatatggtccttttacttgaatccacagatcctgtcttgtcgtacaggtgttcaatcgaactatttaggcctggttggataccagcctaatttggtttcaagacaatttggcctctcgcaaatccgccctaaaagcttgttcgaagatcctcgagacgtcataagaggggccaatctttcggaaaagactttcaagaagtttttgaagatttctcttgatgaaaactataacctgcatccttttgagttcaaccattcccacttctgcaccatggggtttgttacctggtgggagaaatattattcgacccgttcaattggagacactactatcatgatctccagacttgagagtggttttacacaaccaacggtcgagaatattcgctcaaaccttcaagctcgaggcaaaacaatcatgacgaagaaaagcactgaaacgtctcgagctgatgtgagacccaagaaacccactggggtgaagatccaagaggggaaacaagaagagaaggaagaagaggaaagaccactcataagaaaaagaaagttaccttcgacttcgaccaagtctgctgaacaaacagagacaggcaattctcaggcttaa

SEQ ID NO: 56224 - DNA, 270 bp, Glycine max
  Peptide Sequence Number=SeqID_173002
atgcgtctaccggggaaggagagtctgctgatgaaatctcccataaccataaatgagattttggatgttagcatttcgtttctaaatgaccatttagaggaaacactgggttcgacaaaaatagaagaaaaccactcaaagtgtatcaatctcgcacagtgcggggcgaggaaaaaaaggtcgctagcgcacgggatttcggttggtaatcaaagggagaagaccattttaggtcgtggattcctttccttctttttgttcatttggtga

SEQ ID NO: 56225 - DNA, 1109 bp, Glycine max
  Peptide Sequence Number=SeqID_173003
gtcttccttgctgatgtcgagcagttcgccgcgctgcgccagggcctggtcgagatcggcgcgcgagaaaccgagccgcgcgctgggcgccgggtcgcgggtctggtggttggtggccggttcggcgtggcggcgcgggtagttgcgcttgagcaggccgttgaagaccacggcgatgctgagcaggatggcggaattcaaggccaccggccacaacgcgaagccatagcccagcgccgccacctgcggtccgcccagcaccgcggtcagggccactgcgccgctgggcggatgcaggcagcgcagccagaacatggtggcaatcgccagcgcggcggccgtggcggcggccacgccggggtcggcgatcgattgggcgcagaacacgccgatcagggccgagacgaaattgcccgccatgatcgaccagggctgggccagcgggctggcgggcgcggcgaacagcagcacggcggaagcgcccatgggcgcgatgaaccacggattggcgctgcccagcgcatggtgtccgacccattcggtgcagaacagcccgaccagcgcgcctaccgcgccatagagcttctcgcgtgtattgacgccgaccggcgctggcgcgaacgcacccagccagcgcttgattgccacacccaaaaccttctcctcgccgttccagatatatcgggggacgacaatttatcacgcggcgcgccgggcggcggcatgagcttatgcctgcaagtgggaagccgacaggctggccaggatgcgctcggccttgtcggtcagcaccacttcgacgcggcggccatcggcggcatcgggttcgcggctgaccaggtcgagccgctccagccggttgaccagttcggcggcggtgtgcggtcgcaccagcaggcgttcggcgatctcgcccacgtacaggccgcgtcggccgggcgcgccggggcggctgcccttgatggccagcagcgcctggtgctgctgcggcatcagttcaaggccggcggcggcgttttcgctgaaggcggcgaacttgcgcagcgcgtagcggaaatcggccagcagttcgtagtccgaggcggagggcagggcggggggcttggaac

SEQ ID NO: 56226 - DNA, 456 bp, Glycine max
  Peptide Sequence Number=SeqID_173004
atgaccataatttgtctctgcgtgccaccggactcaatcgtctctggatggcaaaaggttgcgtggattaccattatttttctccgcatgtcatcgggctcgccgcctctggatgacaaaaggtgcagaatgaccataatttgtctctgcgtgccaccggactcaatcgtctctggatgggagaaaggagcgcggatgaacataaattgtctccgcatgtcatcgggctctccgcctctgcattacaaaaggtgccgaatgaccataatttgtctctgcggtgcaccggactcgatcgtctctggatggcaaaaaggtgtgcgaatgaacataatttgtcttcgcttgtcatcgggctctccgcctctggatgacaaaaggtgcagaatgaccataatttgtctctgcgtgccaccggactcgatcgtctctggatggcgaaaggtgcacggatga

SEQ ID NO: 56227 - DNA, 725 bp, Glycine max
  Peptide Sequence Number=SeqID_173005
gtctgagttcctcattggaggatacgtaggagcaagagcctcgcttttgtcgaccgcaccgctttttgttaccatgacccaagagctggtagcccgcggagacaccttacggttatccgcacctcgtcattcagtgaccctaagtgtgattgatgagcaaaggcctgtgtggtcatttgcgccctttccggagatgtcagcatcttccggtggagactttttcaagtctcacaagttatctagaactacgtcatgtgacatgcaccctttgtcatccaaaggcggcgggcccgatgacacgcggagataccttacggttatccgcaccttttgtcatccagaggcggcgagcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcaaccttttgtcatccagaggcggcgggcccgatgacaagcagagaccaaatttggcggcgggcccgatgacaagcagagaccaagtttggtcattctgcacccttgtatcatccagaggcggcgggcccgatgatacgcagagataccttacggttatccgcacccttttgtcatccagaggcggcgggcccgatgacaagcagagaccaa

SEQ ID NO: 56228 - DNA, 249 bp, Glycine max
  Peptide Sequence Number=SeqID_173006
atgcttcagaccaaccaatgcttcagtctcgtcatgaacagggttctagcatgcgtaaccaatctcgcaggaagcactggcgagactgcctacatggagcatctcgcagttagcactggcgagattgccctaacccagtacctatcttgcacacatctcgccaagaagaatggtggcatcagtgcagctcttgcctgtgctgctagcgggactcctttctcgcctgtcctgctagcggcttcaccgtag

SEQ ID NO: 56229 - DNA, 111 bp, Glycine max
  Peptide Sequence Number=SeqID_173007
atggggcttggattggctagcaagataagctcaagcagtatatcacaggtgactaacattcttactcataggctatgtgggttgataactgctaaatatgagttattttga

SEQ ID NO: 56230 - DNA, 264 bp, Glycine max
  Peptide Sequence Number=SeqID_173008
atggccattattcccagtcatgattgcgacttgcaagctaaagttgtggactttgttgctcctaatgggggattgtatatccctaagttacaagttgtatcgcctatggagtatactaacgatgttcctgcctggaaattcaatatggatgaggaatttaatctggattttgattatagatctattactagtcataataacagcggtgatcctttatttatttggcattggcttggtactaagaggataagaatctttttctag

SEQ ID NO: 56231 - DNA, 375 bp, Glycine max
  Peptide Sequence Number=SeqID_173009
atgatcgaaagttttcaacaacaacaacaaatgtcagttctagaattgtacgtagaaaaggatattgctggtgagtctttcgaagaagatgatattgttgatggaatatctgatacagacgatgaagtcaccgacatcgttgaaccagtttcaattgttcatccaactgaaggtgtaccaggaattcaaaatccattttggaatgatgctttgcattataataatatcaattgcagtcatccggacgaggaggacatttgtggtttggacatgccaacgacttttaatgttggacaagaattatatgttggcatgaattttgacagtaaagatgcggtaaaaaatgcactgaaacaatatgtgatgaaggcatga

SEQ ID NO: 56232 - DNA, 1398 bp, Glycine max
  Peptide Sequence Number=SeqID_173010
atggagaaggcgagagcttcctacgtggctgtctcgccaatgcagaaggcgagaccttcttgtgtcgcctgtctcgccaatggagaaggcaagagcttctcctacgtggcccgtgtcgccagtgcagaaggcgagaccttcttgtcgcctgtctcgccaatggagaaggcgagaccttctcctacgtggcccgtgtcaggtcctgtaacgccaatgccagtggcggatcatgttcacaaccaccaagaagtttcttcagccacctttgtcaaacccaacctctctggtcacctaaagcaagctgcagaggttttggatagattcagtagatgcaactccactgtagagtacaatggccgcaaagttgcttggctcggcgattctcagcattccggcaaatgggtttttgataatgtttcacatccactttacaacgagtcagattgcccttacatgtctgaccaattggcctgtcacaagcatggaaggtctgatttggggtaccagtactggagatggcaaccacataactgcaatttgaaaaggtggaatgtgaaagaaatgtgggagaagttgagaggcaaaaggctaatgtttgttggagattcactaaatagagggcaatggatatctatggtatgtttgttacaatcagtaattcctgctgataagagatcaatgtcaccaaatgctcatctcaccattttcagagcagaggaatacaatgcaactgtggaatttctctgggctcctcttcttgttgaatctaattctgatgacccagtaaatcacagactagatgaacggataattcgtcctgatacggttcttagacatgcatcactgtgggaaaatgctgatatacttgtttttaacacatacttatggtggagacaaggcccagtcaagctattatggacagctgaagaaaatggagcttgtgaagaattggatgggcatggagccatggagttagccatgggagcctgggcagattgggtatcttcaaaagttgacccactcatgaagcgtgtcttttttgtgacaatgtcgccaactcatctctggagccgagagtggaaaccaggaagcaagggtaactgttatggggagaaggatcccattgaccttgagggctactggggaagtggttcagatttgcctacaatgagcaccgtggagaagatcctaagacatttgaactcaaaagtttctgtcatcaacattactcaactatcagagtatagaaaggatggtcatccttccatttttcgcaaattttgggagccccttcggccggaacaattgtcaaatcccccgtcttactctgattgcattcattggtgcttgcctggggtacctgatgtgtggaatgagttactcttccattttttgtag

SEQ ID NO: 56233 - DNA, 2396 bp, Glycine max
  Peptide Sequence Number=SeqID_173011
tggaatcaatgctgcagaagggcctgattcgacctagcactagtcccttcttttctccggtgctccttgtccgcaagcatgatgaatcatggaggttctgcgtggactaccgagccctcaacgccattaccatccgcgataggttccccattccaacaattgatgaattgttggatgaattgggccaagcctacattgcgaaaacggccttctgcacgcatcacggacactatgaatttaaagttatgcccttcgagctatgcaatactccctccacttttcaggcgacgatgaacatgcttttccgaccattcctccactggtttctcattgtcttctttgatgacattttaatttatagcatcacttttaatgatcatgttcttcatttacaacaagcttttcaggttctgttggacaatcaattcgtcctcaagttgtccaaatgcacttttgctcaaccgcaagtggagtacctcggccatgtggtattgcagcgaggtgtagaaccagtctcttccaaggtggatgcgctgccatttacggtcgagactgatgcatccggcattgggatgggtgcagttctctcccaaaggggtcaccccatagcctatttcagtaaaccttttcctccaaagctccgccattcttccgcatatgtccgtgagctatttgcggtgacgacggcggttaagaagtggtgccagtatcttcttggccaccgattcacgatcatcacggaccaccgtagcttgaaggagttactcacacaagtggtgcagacccctgagcaacacacatacctggctcgtctgatggggtatgacttccaaattcagttccgtttcggcgccactaatcaggcagcggatgcgttatcacgactttccaaggaagagtcctccttctccctcattttgtctgacattcaagccactcctgccaaatatcctgacttcagcatttcaaacaatctcattctacgcaaaggtcgcatatggcttcctcctcacctacctctgcttaccacccttctcactaagtaccatgccacccctaccggaggacaccttggcatagctaagaccatagctcaattaatggacaaattttattgggatgggttgcgagacgatgtagcaaggtttgtctctaattgcttggactgtcagcattctaaatatgaaacaaaatgcgtcgccggtctcctgtgccctctgccggttccccaccgtccatgggaggacctctccttagacttcatcaccggtttgcctgcctttcaggggaacaccaccatccttgtggtcgttgataggttctctaaaggcattcatttgggaatgcttcccacttcacacacggcttacacagttgcagctttattcatgaacattgtcggtaaaattcatggtctccctcgtagcatgatttctgatcgtgatcccctgttcctcagccggttttggcaagacttatttcgtctcagtggcacccacttacggatgagttcttcataccatcctcaaagcgatggtcagacagaagctctgaaccgtgccattgaacagtacctcagggcttttgttcaccggcgaccaagttcatggggaaagctattgatgtgggtggaatggtcccacaatacttcttggaatgttgctactggctccactccgtacagaatcacatttggtagaaagccctttaattaccctgaataccttgccgaggattctaagcttgaagttgttgatgatatgctcacaaaccgagaagacacttttcgcctgatccgtaaaaagctcctcaaagctcaagaattgatgaagaagccccatcgtcaaacctcggccaagcctcaatcctccagctccgggaaactttcgaaacgtttttacggaccattcacgatcactgaacggattggtcctgtggcctatcgcctgaagctccctgagggtgcccgtattcaccctgtgtttcattgttcaatcttaaaaccattcaaagggacgccgacaccagcagattctgtttcccttcctgaccaatttgctcacgatcagcccattgtttctccattagccattttggactaccgttataactctgacattctaggatccccgtgggaggtactagtgcagtggtcgggcctggctcctgatgagacgtcctgggaatcctggtcacagctgagtcgagaatatcaccttgagggcaaggtgaatttccaaggcccgtgggatgatagacaaacaggggtgcagcaagtaacaaaggtgcaacaagcaattcaagaacagggtgcaaacatcaacaaaaaggtgcaaacagaaggcagagcaaaaagggtgatcactaaaccttcatacctgaaggacttcgtgtga

SEQ ID NO: 56234 - DNA, 438 bp, Glycine max
  Peptide Sequence Number=SeqID_173012
atggcttgccaagtccgagtagaacaagtcccacaatctctaaagcgggctgtaagagctataattcttcaaccttggattctttcaaacaaggtgttcaagtttttatgcgatatcgagttcgggtacgttgttgtcaaccctctaatatttccttttctggggagggttctgctcgctccagcgatggtcgaatgttgtcaccggaggtcagtccaccttcatggtgattttgacattgttaggaaccaagttttcgacgtttttgttggtgatgtcatcattggaggcgtcccgatccctcttaatgctagtgccatcgtccctataagtggtgcagctgctgggaaagggtgttgttcctattctagtgtgcattttattcctatggaggatgaggctgaatcccctctaccaaatgctcctcaaatgttatag

SEQ ID NO: 56235 - DNA, 789 bp, Glycine max
  Peptide Sequence Number=SeqID_173013
atggccgaccaaccacacggcacctcatcctccccgatcgaaaccgctatcctcaagcttactaccttacaggtctccctcggtgaaactgttcaatccatggcccagaaattcgatgagctcttgctacggctaccctccacatccccttctccatcatcacaacctattccttccatctcccctgtaccttcacatcaacaccgcatgaaattagacattccacgcttcaatggtactgaccccttcgggtggacgcgtttcgccccttcccactatgatgaccccaccggtaacctcttcaagctcacccagcgtggttcggtgactcagtatttgtcagaatttaaggaattggctaaccgtattgttggccttcctccccaatttctcctcagttgcttcatttcaggccttactcccaaaattcgtcgcgaggtgcaatctttgcagcccctgactttggtgcaggccgcgggtcttgcgcgtctccaggaggagaagctcctcgacacgcattccaccttccgcaatcacactccgccggtcctttccgttcctcaacctcggccgatttcaatgcctggtcttctccaagctccttcttctcctgcaccgtcatcacagcctcctccattggtgaagcgtctgtcgccggctaagatagcttcttgctgtgaacgcgggttgtgttttacctacgaggagaagtaccatagaggtcacagatgtgactctagggttttcctcctggtagctgctgaggacgacaaccctgaccctatatag

SEQ ID NO: 56236 - DNA, 171 bp, Glycine max
  Peptide Sequence Number=SeqID_173014
atggtcactagactcaaaattgatcatcagattcaagatggtcactggactcaaaatgacgtaaaatggtcactggatgtgacaccagatgctggacatggaaatgatccctggatgcgacacgggatgctagacgcaaaaaggatcactggacgtgacattggacactga

SEQ ID NO: 56237 - DNA, 489 bp, Glycine max
  Peptide Sequence Number=SeqID_173015
atggaggatcacctcgacggcaccaacatccacaactggcattggtctgagaacaattgccttgattggttcaaaaccttcttctctaacctcccaatcctcgacagcgagggaaacctcttcctcaaaatgacatcacttcacgccctcaaaggcgaggcctacgtcaatgccagcaaggggaaaatcgtctctggctacaaatttccccaagtattcaacgtctctgatgagaacgccaatgaggatcccaaggtaaaggtcattgttaactatgaggaattgagcatggccaaaggcgaccctattaaagatgaatgggaaccaaagaaggtgtcgtcgttgatgtctttggtagcaacaatgacaagagcgacgacgacgaaagtgaatgctcctctaaaggagaattcgacgaggaagaaggagaaggagaaggagaagaaggcaaggaagagtattagcatgatatatcggtttaattgttag

SEQ ID NO: 56238 - DNA, 444 bp, Glycine max
  Peptide Sequence Number=SeqID_173016
atggctactccacctgcctcgcctcctcctcctcttcctcctcctcctgcagatgcatcagcgtcttcgtctatgttgaagcagacacacaaggcgacatggctacgatcgttggtcactagaccacctggggcagaaagacctgtggtcaacattgatcttgctaccggcaaggccaacggtccccacaagaagaaattaagaacatatttagggattgtcactcgtgataaggtcgacgtgacatacgagaccttgaaggaagtccctgctgctcagaaggatttgatatgggaggatattcagactgtcggcgagcggtggaggcagcttaaatctgacttgactaggaaatgggcacttgcagtcaacaaggacggtgtggatgacattgtctgtgaaaaatacgacattagcaaggagaaatgggcccagtttggttag

SEQ ID NO: 56239 - DNA, 165 bp, Glycine max
  Peptide Sequence Number=SeqID_173017
atgaaagaaaatggcttggacgcgctaagcgcgagaagagacaacgtccttgctgggcgggctggctgcgcgctaagcgcactgctctctggctcaacattctctagggttttgttctcgcttagtgagtctggctccctcgctaagcggatgagcctcgcttag

SEQ ID NO: 56240 - DNA, 519 bp, Glycine max
  Peptide Sequence Number=SeqID_173018
atggcttctaaaaagagacgtgcatcatcttccaggccccaggagccttatgatacgtctagatttgtgtctaaaatcggttgggagcgatatgagaccaatgttcatcacaggaacatcctccctaagcagaatgtggagctggcctattcacagtacgatgaattccttcgggaattggagcgtcgccagtggcacaagaacctcacaaggcagatggagaaccacattggcttagctttggtcaaggagttctactccaacttggagaaatactcagcatactttcgctactgccacattcaccatgaccatcaagctattgtaactaaattatgtttaccagggcaggggtttgtacttaatgccgatggggctctgtggaagcttttgaggaaggacctgaccaccctatcacagacctggagtgtcctttcctactccaaccttgctcctacttctcatacctctgatcttaatatggacagagagcaaggttggtgtatgacttggtcatga

SEQ ID NO: 56241 - DNA, 243 bp, Glycine max
  Peptide Sequence Number=SeqID_173019
atggctactccgaagaatgatgcaaagactgttgtcaaatttttaaagaagaacatcttctcgcgctttggggtactgaaggttttgattagtgatggtggctctcatttctgtaatattcaacttcagaaggtgttgaggcactacagtgtaacacataaggtggcctcaccttatcactcacaaataaatgaggaaactgtagctcttagagctagaggagatgaggttgaatgcttgtga

SEQ ID NO: 56242 - DNA, 237 bp, Glycine max
  Peptide Sequence Number=SeqID_173020
atgggcatgatcgtgtcactgcggggcgcggaagggctgactggagctggaatgggtgctagaggtgtaggggctagaactgatgcatctgaaggagcccaagccttggcctttcgggacccaggaaatcacaaagacttgaacatcaaggaatcagacacaacccctctggctaagcataatgcggtgataagggctggaaagcccaaccaagaggagttggactgggcgatctga

SEQ ID NO: 56243 - DNA, 279 bp, Glycine max
  Peptide Sequence Number=SeqID_173021
atggtagaggaagtttctgctttgcacaagatagatacttgggacattgtctctcttcctctaggaaaaagtgcaaatggatcttgttgggtctacaagatcaaagccaaacccgatgggtatgaagagatacaaagctcacttggttgtcaaagggttttctcaacagtatgttcattgggtaatttttcttttcatcattcactatctttgaggcacccaatttcagagtattcttttttcctcatcttcttcctggaagttatgtgcttattctag

SEQ ID NO: 56244 - DNA, 210 bp, Glycine max
  Peptide Sequence Number=SeqID_173022
atgcaaatcgcagaagatattgacgagttcgggctggggatgacacgtggcactggtctcgccagtctaaccggcgatttgagctccatgcaactcgccagtttgactggcgagttgagcttggtctctttattaagttccatgcaactggcgagttgtggctgcacaattccatgcactgctagtcccacttgcaggtctctttattaa

SEQ ID NO: 56245 - DNA, 405 bp, Glycine max
  Peptide Sequence Number=SeqID_173023
atgtcgttgattggtgaaaggattgaagtgggtctgaaaagaggcaaatttgatcatcctgcttggacgaatgagaaaactggggcaaatgaagaaggtgagaatgaaggagaaacccatgccgcgacagccgttcctacatggaaaatcccccaccagctcaacaacatcattactcagccaatatcagcccttctcattacccaccacccagattcaccccaaattccggtgtcatatgctaacttgctcctatatctacttgataatgcaatggtagccataacccttgccagggtccctcaacctccatttttccaaggatacggctcgaatgcaacatgtgcatatcatggaggaatttcgggacattccattgagcactgtatgaccttgaagcgtaag

SEQ ID NO: 56246 - DNA, 354 bp, Glycine max
  Peptide Sequence Number=SeqID_173024
atggcattagtagcccattatgacttggagccacatcagatggataagaaaactgtctttcttaatggagatttagaggagaatatttatatggaccaaccaatggggttctcaattgagggaaaagaacacaagattgattcaaggtgttttgatgataacaaagatgatgacaaaaagcccaagagaatgatttcaagattgagtcaagaacaattcaagaataaagagaaagattcaagcgaaagtttcttcaagaagattcaagattcaagattcaagaataatcaagatcaagattcaagactcaaagattcaagaatcaagagaagacttaatcaagataagtattaa

SEQ ID NO: 56247 - DNA, 914 bp, Glycine max
  Peptide Sequence Number=SeqID_173025
gggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttgggtgctttggatgcgcgtggttctaagttaatgccagataaaaaagattttggttatagttttccttgcgatggcccgggacgaggcggtacttgcgatatttcggcttgggacgcattttatttggcagttttctggatgttaaataccattgggtgggttactttttattggcattggaaacacattacactatggcagggtaatgtttcacagtttaatgaatcttctacctatttgatgggatggttaagagattatctatggttgaactcttcacaacttatcaacggatataacccttttggtatgaatagtttatcagtctgggcatggatgttcttgtttggacatcttgtttgggctactggatttatgttcttaatttcctggcgcggatattggcaggaattgattgaaactttagcatgggctcatgaacgcacacctttggctaatttgattcgatggagagataaaccagtggctctttccattgtgcaagcaagattg

SEQ ID NO: 56248 - DNA, 165 bp, Glycine max
  Peptide Sequence Number=SeqID_173026
atgggtgttgcgcttagcagacactcgctaagccagcggattggcttagcgagaagctttgcttgtcctcaagcaaaaagagaacaactcacttgtcctcaagtgataatagcatgcagtgatcttgtacaaaggtgtatggagcaaaaattactgatagcatga

SEQ ID NO: 56249 - DNA, 887 bp, Glycine max
  Peptide Sequence Number=SeqID_173027
taagcatggggactatcaaactagcaagaggttttaccaagtcaaggagaaaggtctagataccaccagcatcaaggaattagggcggttgatggaacctctccaaatgcaagccttacgcaagacttacggaaagatcttagatttgaccatagcagaggtatccatagaggccattgcgtcactcacccaatactacgaccagcctttgagatgcttcacgtttggggacttccaattggtaccaaccattgaagaatttgaggagattctaggatgtcctctcgggggaagaaaaccatatcttttctccgggtgtctcccctctttgagcagaattgcaactgtggtcaaggattcagcaaggggtttggaccgcgtaaaacagactcgaaacggcatagcgggcctaccacggaagtacctagaagataaggcgagggatatggcaattcaaggagattgggtcccgtttatggatgtgttagcattgctaatttttggggttgtcctctttccaaacgtagatgatgcgagaagagtagcgcacggattatctgttgcttgcccgctctctgtgtttggttggtttcacacctgttccagcaagacacaaggcatccatgtccgctccaaagccatcgctcggtacccaaacattccactgataggaacgaggggttgtattaactacaatcatgtgctcgctataaggcaactagggtaccccatgaggggagcaccgatggaagaaagcatgtctcctttccttgtgagagatttcggcgtgcaaaatttcaaggctatacaaagaatccataaggcatgggaaaccccgttaaggaaagatcaagaacttaggggcattcgcaatggcatcattggtg

SEQ ID NO: 56250 - DNA, 456 bp, Glycine max
  Peptide Sequence Number=SeqID_173028
atggttatgggagatttcatcagcagactctccttccccgcatgtttgcattttagtggagaaaacaccgagactttttcaagtctcacaagttatccagaactacgtaggtctgagttcctcattggaggatacgtaggagcaagagcctcgcttttgtcgaccataccgccttttgttgccataactcaagagctggtagcccgcggagacaccttacggttatccgcacctcgtcattcagtgaccccaagtgtgattgacgagcagaggccaatatggtcatctgcgccctttctggagatgtcagcattttccgatggagacttttcaagtctcacaagttatccagaactacgtaggtctaagttcctcattggaggatacgtaggagcagagccttgcttttgtcggccgccccataatctttatcatactgaccctgaggtcatgtga

SEQ ID NO: 56251 - DNA, 558 bp, Glycine max
  Peptide Sequence Number=SeqID_173029
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggcccccccccccccccccaaaaaagggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 56252 - DNA, 279 bp, Glycine max
  Peptide Sequence Number=SeqID_173030
atggctccgagaaagctttctgcaaagagatctaggaaggacgccgcggctgaagggaccagtgccgccctcgaggacgatgagtacaccaactttcaggaagacatagctcgccagggttggacatcgctggtcacccccatggctaagtttgagccagagatagtcctggaattttatgccaatgcttggcccacgaagaagagcgtgcgggacatgcgacgccctcagccagttcctgggagacccgctagtgttagaggagggccaggagtgcga

SEQ ID NO: 56253 - DNA, 306 bp, Glycine max
  Peptide Sequence Number=SeqID_173031
ttagtcatgttggtgctactcatgaagtctatgttagttatgatgatatgacctataatgtggttaatgctagtagtgaaacatataaagctcgatacgatgatattgaagattatgttgatggatgtaatggtgatgagagtgataaattaagtgattttgaggaaaatactgatgtaatagatgaagtgcactcaaatgatgatataaatgaaatatatgttgagagaggtattttggggaaaccttttgagaggcaagtagatgacaagatgaagtttgaaaaaggggaaattgttcttgaat

SEQ ID NO: 56254 - DNA, 824 bp, Glycine max
  Peptide Sequence Number=SeqID_173032
gggggtaccattagaggaaggcctcacaccttttattgcgcaatgtttcaatagcaccaacgtcggggtgcttcggagggtctgcaaggcatgggaaatggtgcaaaagaaagacgaagaactttggggaagtagcaatgggcccatcggtggttaccataagtggttgaaagcctacgcacaaggtctgggttggctcccgaatttgagagccactaaagaggtggaggttgaagctccggaagaaggcgaagaggtacaagccctcagaatgaagctcgagcaagcccaagcggtcaaggaaaagttcaagtcagcagtcgctaggatccgaaaggagaatgccgaactaagagacatcaacatagccaccaccaaggccttggtgcaaaagaccaagagggctcgcaagaaagaacatggccggaacaagtttcgaggagaggaaagggaccagtcgcgagtagatggcatgattctgaaagacgaattgaagacttgcctaaggtcgaagaggagtttgtctcagcagttatgcgagaccgaaacaaacatgttggccatcattagcaagtacaaagaagaattagatttggccaccgcccacgagcacaaagtggcggacgaatacgcccgagtgtacgcagaaaaagaggctaggggaagggtgattgactcattacagcaagaagcgacgatgtggatggattggtttgcttttactttgaacgggaatcaagatcttccccgattactggcaaaggccaaagtaatggcagacgcatacttcgcccccgaggaaatccacgttctcctcagctatt

SEQ ID NO: 56255 - DNA, 249 bp, Glycine max
  Peptide Sequence Number=SeqID_173033
atgacgttagtctctgcatcctaccagactttgagtctgacggatagcaaaagagtgtttatatggattaccacttggttaggatcaacagaaattgtttgtgcggataaccacttgggtatctccccatgtcaccagacctcacgattcaagatgatagaaaccgtttgtacgaataaccgcttgggtatctttgcatgtcacctgacttcacgggtcagaatgacgaaggtgcagaagacgacgtaa

SEQ ID NO: 56256 - DNA, 216 bp, Glycine max
  Peptide Sequence Number=SeqID_173034
atgactttgagcttagctcatcattgggctaagcgcgcatcgaccgctaagcgcagcttcagcgcgcttagcgcgacaaaagactctggcagagcatcaatatcaaggtcgtgtgctaagcgcgagaccagtgcactaagtgcagcagttgtcttcagccaggctcaacggacgactagcactaagcgcaacatcgcatattcagagcctatttaa

SEQ ID NO: 56257 - DNA, 366 bp, Glycine max
  Peptide Sequence Number=SeqID_173035
atggttttgccactgaagcaacctcattttgtgttagttccacttcttgcacaaggccacatgatccccatggtggacatggcaaggattttggcagagagaggggttattatcacgttggtaagtacccttaacaatgcctcaagatttgagcaaacagttattagagcagcaaaatctggcattccaattcaactcctacaaatcccatttccatgccaaaaagttggacttccattaggctgtgaaaaccttgatactttaccatcaagaaacctactcagaaacttctatattgcccttgagatgacgcaagaacctttggagaagtacctccaaaccacccttctcctccaagttgcataa

SEQ ID NO: 56258 - DNA, 891 bp, Glycine max
  Peptide Sequence Number=SeqID_173036
gagaggcgtgtccagctcagggaggatgagtatatggactttcaggaggagatagctcgcaggcgttggacactgctagtgactcccatggccaagttcgaccctgagatagtcctagagttctatgctaatgcctggcccacggaggagggagtttgggacatgtgctcatggtgtgagttcagccagaggaggagcagggccgacagtttcgatgaggaagccaccgcccagctgttatgcataccggggcaggatttcgctcggaccgctgcagggaggcgggtgtggatcatgcgcaccagcatgaccactttgacccaaacatggatgacactgctgctcagcaatgtcttgcctagcgatcacaagtccgatctccctctacctaagtgccagttggtgtatgtcatcctgacatggatgagggtccatgtggcccaggtgattgctgatgtcatttatttgtttgtagcgcctactaggcaccctctagacccagataagtccaacagggccctggggttttcggcgctgatcacgggcctctaccattcctacggagttcccgtcacccccaataagggtgatgcacatcaggtcgcaggcgcactgccaccacctcggcaggccgatccagctgggccactgggcgtggaccattatctacagcatttggttcgccacctcagtcagcaggggcagggttccgccccttttgtatgccctaccccggagcagtttggggctgaggtcgcatggcttggagactggcccgatgcccaggtaggggaggagcctacaggatcccccgatgaggcaaatgaatcccgtatggatgaagatatgactgacctgctcggtttcttgggagggagcggagccacatga

SEQ ID NO: 56259 - DNA, 492 bp, Glycine max
  Peptide Sequence Number=SeqID_173037
atggtttatgggttagaaactccttttaaacctttttttgtctttatcttctctcttttcttcgtctcaattaaagttccatccacatacaggaggaatgtgcgaggtcaggagtttggaggaatgtattgtgcattactaatagtcaatacttcttacagtttgttttttggatgtggaagttcatctgtggtatctgcgggcatgcttagaatttttggctcagatgttgctgaactccctttagttgcaacgagtaatgggaaccatggaaagggctacttccaaacactcttctcctgcatcgagaggctgctggctttcttgaatgtgaagaatcttgtactgccagctgcagaagaagcagaatcaatatggactgataaatttgggtttagcaagatgaatccagatgagctcaccaactatagaaagaactgccatcagatggtgtttgaacatacgtcgttttcttttctgcgagaattgtga

SEQ ID NO: 56260 - DNA, 264 bp, Glycine max
  Peptide Sequence Number=SeqID_173038
atgataacatggcctttatttgctgagcaattcttaaatgaaaaatttattgtgcaagttttgaagattggagttagaataggtgttgaggttccggtaaggtggggtgatgaagagaaagttggtgcaatggtgaagaaaagtagaatcatggaagctatagagatgtgcatgctgggaggtgaagaggaagaaaagaggaggaatagagcaatagagcttggaaagatggcaagaaatgccatagtgaagggagggtattaa

SEQ ID NO: 56261 - DNA, 879 bp, Glycine max
  Peptide Sequence Number=SeqID_173039
atgggctctggaattgtttgtcgatgctgcaacactgaggtattccttaagaatctatcagcccttcacagtttgaggtccatgcaggctgggcttctcgcaagaaaccattttaatgtaagtacgataatgttggccagttatgcatacatttacacgtcaaatggggtgtctctccatgagttggcaatatctctctcaaaagatagaaaatactctgcaaaggacaatgatgatctatgcattgtttgttgggatggtggtaatctattgctttgtgatggatgcccaagagcatttcataaagaatgtgcagctctatcaagtattccacgtggtgactggtactgccaattttgccaaaacatgttccagagagaaaagtttgtggcgcacaacgccaatgctgtggcagctggaagggttgaaggagttgatcctattgaacagattgccaatagatgcattcgcatagtcaaagacattgaagctgatcttagtagctgtgctttatgcaggggtgttgatttcagcagatctgggtttggtccacgcacaataatactctgcgatcagtgtgaaaaggaatatcatgttggttgtttgagggatcacaagatggcatatttaaaggaactgccagaaggtaattggctttgttgcaatgattgcacaagaatacactctactttggagaatcttttggttaagggggctgagagactccctgaatctctcttgggtgttataaagaagaagcaagaggaaaaaggattagaacccatcattgatgtaagatggaggcttcttaatggcaaaattgcttctcctgaaactagaccattgcttttggaggctgtttcaatctttcataggtag

SEQ ID NO: 56262 - DNA, 222 bp, Glycine max
  Peptide Sequence Number=SeqID_173040
atgggatttccaaagtttttaatagaggaacaggcgggtacaaaaggagttcaagttcaaattgcaggacgtatcgacggaaaagaaattgcacgtgttgaatggatcagagaaggtagagttcctctacaaaccattcgagcgaaaatcgattattgttgctatacagttcgaactatttatggggttttagggatcaaagtttggatattttctaaataa

SEQ ID NO: 56263 - DNA, 564 bp, Glycine max
  Peptide Sequence Number=SeqID_173041
atggacgccgccgtgaagccggagacggaatacgcggccgtttcgacggatcagcctcggaaagtttcggtggtgaatggttacattgtctacactcgcgccaagaggtcactggattcgtgcaacggtttttcagaacacgcggaattgaaggataacgccgaggttgaagttaaaacggagaacggagagtgtgagaagctgaaaaatgagtccacagaggtggttgcgaggacgcgcaagcggagccggcgatcggcgttggaagcgaaggttgagtgttgtgatcagatggttgtgagtgagacggaacaagtagttgcgaatggcggaagcggaatcaacggtgcattgggagctccgaggaataagatggagttgaagatgtcgaagaagattgtggtcaacaggaagcctatgactgtgaaaaagctctttgatacaggttttcttgatggcgtttccgtggtttacatgggcggcattaagaaggcttcgggattacgaggtgtgattagagatgggggaatattgtgctcgtgctgtctatgcaatggacgcagg

SEQ ID NO: 56264 - DNA, 336 bp, Glycine max
  Peptide Sequence Number=SeqID_173042
atgattgaaccaaaaggaaacaccgacaaaaatgcaccatatgcatctccaccacctccactgccacagaggcagcgagggctattattcgagaaggggtgcagtttggagaggaaaagggtgaaatggagattctcaattgagcatcttccaaagcatatgccactgccacctccattgctctccacatctgatatacacttttccggaaaacacggttacaaaattcagatagatttaccatatgtttgtattctagttgaagttgtggtagtatgcattttgatgcaatcctaccctgcaaaggcattaaatagaagactccaagaagattaa

SEQ ID NO: 56265 - DNA, 369 bp, Glycine max
  Peptide Sequence Number=SeqID_173043
aactggaaggaggtcccctactgctcagaagggccctcattttgggaggatattcagggaggaatttgatatcccagaggcttctgacagtaggacgaaaaggaagttactgcagacccgtgggggagagatggaggcagacggtgttgaggacactgtctgtgagaaatccggcatcagcaaggaaaagtgggcccagttttgccagactcgtagagaccctcctgagaggtatgatgagtgcatgaaggcacaggccatccagaagcagaatactgcccctcacgttttgtctcgtgggggttatgattatttggagcagaagctcctggctgagaagacgaagaagaagctggaggaagctgcata

SEQ ID NO: 56266 - DNA, 525 bp, Glycine max
  Peptide Sequence Number=SeqID_173044
atggcactaaatgagcaaaagggcaaggatgatatcccagaaagtcaatatcagaaaggagtgaaacacttgtgtgagaaaggtcatcttaatgcggtgcctaagaagtacatacttcctgtttccgaaagacccaccaagagtagtgtggaggattcaaatgttgtgaagcaaaatcttcaattacccatcattgatttttccgaattgcttggtccaaataggccccaagtccttcgatccctagccaatgcttgtcaacagtatggatttttccagttggtaaatcattgcatctcggaggatgttgtgaggagcatgatagatgtgagtgggaggttcttcgatctccctttggaggagagagctaagtacatgacaactgatatgcgagcaccgggatttcttgaaactcctgtgccatcccttaccagatttactcctccattggcctgcttcaccagtggactttcggtgagtagtggactactagtgtactactacaagcaagttaggttcagctag

SEQ ID NO: 56267 - DNA, 537 bp, Glycine max
  Peptide Sequence Number=SeqID_173045
atggaagccatcctagagagcttaggaattgtggaagccaaccaagaagaggatgacaatattctcaaagagtttgaaaatgggagccaaatgatggtggccaatttctacccaccatgccctcaaccagaccttacccttgggatgccccctcactccgactatggcttcctcacacttctcctacaagacgaggtagaaggcttgcaaatccaacaccaagacaaatgggtcaccgttcaacccattcccaatgccttcgttgtcaatgttggtgatcacttagagatatatagcaacggaaaatacaagagcgtattgcatagagttgtggcgaatgaaattaagagtagggtgtcggtggcttcgctgcacagccttcccttcaactgcacggtgagaccgtcgccaaaactcgttgacgaagcgaatccgaagcgttacatggacactgattttgggacctttcttgcctacgtatcctccacagagcctaacaaaaaggatttcctcgagtctagaaaagtgttacactga

SEQ ID NO: 56268 - DNA, 1086 bp, Glycine max
  Peptide Sequence Number=SeqID_173046
atgggtttgcttcaaagccaaccgaatctcactcgtttcctcgcctcctcatgcttgacattgcatctttctctctctctttcttcacttcacacctgtaatataagacttccaagtttggaaacgcaactctggcaaacccaaaatacgttactagctattagaggtgccattatttacatcagcttccactctcttcattgcttcttccattctctctttaccatgcaaaagcaagaggaattacatgcggtgtgcaaggattacatgcaaatcatcaagggcaagcgcaccaagcgacaaaggcttccatccccacttaggttaaccatgtcaacaacatgttccagtttaggaagaagcagcaccgacaactccgtaggttttgatattccaacaacctcaaatgaatcaaggaacgaagaggaggacatggcaaattgtttgattctcttagctcaaggtcacaacaatactccaaaaccctcacgcaccaacaagggagggttatacctttacgagtgcaagacttgtaaccgatgcttcccttcatttcaagcccttggtggccacagagccagccacaagaaatattccaaggcaagtgcagaagaaaagcaaggagttgcaactacttttgtgaattatgaagtcgataataataataataatcataatcatgatgattattgtgaccccacaagcacccccctcaccttacaattatcaacggctttgtataataatagcagcagcattaggagtactattaatgctaaagctaaagttcatgagtgttccatatgtggggcagaattttcatctgggcaagcgttggggggacacatgagaaagcatagaaattttctgagtgcacctattattggggcaattaatattgcaaatggtggtgatggaagccctaaagttccggaagccaagaaacacaaagatgttttgaacttggacttgaatcttccggcacctgaggatgatcatctcagagaatccaacttgtttccttttcaggccaaagaaaaagttattgtcttctcagcaacttctttggtggattgccattactaa

SEQ ID NO: 56269 - DNA, 864 bp, Glycine max
  Peptide Sequence Number=SeqID_173047
atggcgttccctttgggagccctcatgaccaccacactattgctctttcttgttgcattttcactaattcctaatgtccatgcaacgattaggtcctcatggggacatgctgctcataacatggttggaagagataacaagatagttgacctccacaagcatcaccccgtttttgggcctggcccttggaggcaagcttatgctactttctatgagggaggctctggaacatttggaggagcttgtgggtatgatgatgtggttaaagatggttatgggcttgacacggcagcattgagctcagttttgttcaagcacggtgaggcatgtggggcatgttacgagatcaaatgtgtaaactctactcaatggtgtaagccaaaaccctctgtttttgtgacagcaaccaacctttgcccccccaattattctcaaccaggtgacaatggaggatggtgcaaccctccacgccagcactttgatttagccaaacctgcttatctcaaaattgcacagtacaaggctggcatcgtcccagtccaatatcgcagggtaccatgcaagaagcaagggggtattcggttcacaatcactgggaatccttacttcaacctagtaaaagtgtggaatgtgggaggagctggggacatcacagaagtacaggtgaagggtgacaagaagctgatcaattggacaaatttgaagcgaaattggggtgagaaatgggagactaatgccatgttagtgggagagacattgacttttagggttaaagccagtgatggcaggtactctacctcttccagtgttgcccccaagaattggcagtttggtcaaacctttgaaggcaaaaacttcccataa

SEQ ID NO: 56270 - DNA, 396 bp, Glycine max
  Peptide Sequence Number=SeqID_173048
atgcatataacaccactaacaaggcagattgaaacagacagcaaatttttggaagcacagcacatcatggactacagccttcttctaagtgttcactgtcgagctccccagcatctgcgttctctcgtttcacacaaccaaagtagaagtgtggatggattagcaatgcttgcagaggaagaccctctggaggatgaagtatcctatccacaaggccttgttctagttcctcgaggagcagatgatgacagtgttgttgttggctcacacatgaggggtagccggttgcgagcttcatctgctggtgacgaggaggtggatctacttctacctggtacagcaaggtatggtttcttgatgttcttggctcggtcgtttcaccttcaggttaaataa

SEQ ID NO: 56271 - DNA, 297 bp, Glycine max
  Peptide Sequence Number=SeqID_173049
atgccatcaagggcagagcagatttcagaaaaacaagaaaagcaaatgttccatgaggtgtacgatgtggtgctgtaccttggtatcattgacatattgcagaactacaacatgactaagaggattgaacatgcatataaatctcttcagtttgattcattgtctatctcagctgtagaccctacgttctactctcgtcgcttcctggaatttattcagaaggtgtttccaccaaatgcaacgacagtgggtgaccacgtgggcaccttgttgatggtggtaataggaatcgagtga

SEQ ID NO: 56272 - DNA, 2955 bp, Glycine max
  Peptide Sequence Number=SeqID_173050
atggtgaaggcctacctccgatacgagccggcggcgtcgtttggggtgatagcgtcggtggattccaacatttcatacgacagctccggcaaacacctcctctctccggcactcgagaaaattggcgtctggcacgtgcggcagggcctctgcaccaaaaccctaactccttcctcttcgtcgcgcggtccttctccctccgtcacctccattgcctcctccccttcctccctgattgctggtggttacggtgatggtagcataaggatttgggactccgataaaggaacgtgcgagactacgttgaatggacacaagggagctgtcactactcttcgttacaacaaggctggctccttgctcgcctctggtagcagggataatgatgtcattttgtgggatgtggttggcgagactgggctctttcgccttcgcggccaccgcgatcaggtgactgatgttgttttcatgagttctgggaaaaagcttgttagttcctccaaagacaagttcttgagagtgtgggatattgatacccagcactgtatgcaaattgttggtggccatcatagtgaaatatggtccctagatgttgatctggatgaaagatatctggtcactggttctgcggataatgaacttcgtttttatgccatcaagcatgagtctgtggatggggagtctgtaaatggcggtgaagaatcttctgttcaaaacaaatgggaagtgttgaggcattttggtgaaattcagcggcaaagtaaggatagagttgcaacggtccagttcaacaagtctggaagtctgctagcttgccaagttgctggaaagacggtagaaatataccgcatattggatgatgctgaagcaaagcgcaaagcaaaacgaagggttcaccgtaagaaagagaagaaacatagtaaagaagctttggaaggaatagaaaatggagacaggaataatgagaacaaaggagacgattcttctgtcactcatgggcccatggaaacaagtaaccccacagttactgtggctgatgtttttaagctgttgcatactatcagagctggcaaaaagatatgctctatttctttctgtccagtcactccgaagaattcactggctagtttagcgttgtccctgaacaataatctacttgagttttactccattgaacaaggggaaaccaaaaaaacacttgctattgatctccaagggcaccgttctgatgttagaagtgtcacgcttagttcagacaacacttttctgatgtcaaccagtcacaatgctataaagatttggaacccaagtactggctcttgcctaaggaccattgattctgggtatggactgtgcagtttaattcttcccaccaacaagtatggacttgttggaactaaagatggaaccatagaaattattgacattggaagtggtacttgtgttgaagtaatggaagctcatggtggttccgttcgctcaattgctgcccttccacataaaaatggttttgtcacaggaagtgcagatcatgatgtgaagttttgggagtaccaaattaagcaaaaacccggtcaagctgctaagcaactcacagtgtcaaatgtcagtaccatgaaaatgaatgatgatgctcttgtggttgcaattagccctgatgctaaatatattgctgttgctctcttggatagtactgtgaagcctgtgtacatccacatggaggtgtcagttcaagtgtttgaattgacgattttgcactatgagcttgtggtcactcatgttcactttgcagacacattcaaattcttcctttcattatatggccacaagctgcctgttctgtgtatggatatctcatcagatggagatttaattgtaaccggctctgcagataaaaatataaagatctggggtttggactttggtgactgtcataaatccatctttgcgcatgctgacagtgttatggcagtgcaatttgttcccaagacacattatgtgttcagtgttgggaaagatcgcctagtaaaatattgggatgccgataaatttgagctgctcttgacacttgaaggacatcatgctgatatttggtgtcttgcagtcagtaatcgtggtgattttatcgtcactggatctcatgatcgttctatccgcctctgggatcgcactgaagagcagtttttcattgaggaagaaaaggagaaaaggttggaggaaatgtttgaggctgatattgacaatgcatttgaaaacaagtatgtgtcaaaggaagaaataccagaagagggagctgtggctttagctgggaaacaaacccaggaaaccctttctgcaactgacttaattattgagagattagacattgcagaagctgaagaaaagcgtattgcagaacatcaggaggagaaaaataacagaaatgttgctgttttccaagcaaatccgcttatgaatgggctttcaccttctgactatgttctaagtgcattttcagatgttcactccaatgatttggagcaaacattattgaagagcatcagtgcatctggtgttagtggaatgaccataggtgctttaccattttcagatgctttgaagcttctgtcgtacttgaaagactggacttcatactctgataaggttgagcttgtttgcagaataggtacgctgctgttgcagacacattacaaccagcttcttaccacgccagctgcccgacctatcttgactgttttcagtgacatttttcatgaaagggtcaagggatggaaagacatctttggttttaaccttgccgccatggatcatattcagcaaatgatggcttcaagatcagatgctctttttcatgatgcaagatcaaaactgctagagatacgtgctcgacaatccaaacgtttagaagaaaggtctgatactggggaagtgaaacggaagaagaagaagacataa

SEQ ID NO: 56273 - DNA, 696 bp, Glycine max
  Peptide Sequence Number=SeqID_173051
atgaactcaaggcatcgtccattacatgctagtggagtctccatcttagcaactgttgacattgccatagaaaaaacacaacatatcaatggaccattaggttcaacattgagaagggtagcaaatttagccaaatttgccaccccttttatctacgccatgcaaatccaatggctaacaattctctccttcatcgatgatgccattctagcaattgaaaaatttacggagaaattgtttcccccttcaacccacgtgttcgacatagttgatgaaattgtgctaatgatagtgttcctgccagaaaaatttgatggtgcggtgaacaagttttctacaataatccaccaagtgccattcttggattgggcactgacccttgtaatctcaaggttgaacagattggtttccacgttgaactattggggacatgaaaattcaagagtaaacgagaaaacaataggtgttgataggagttgcaatgaagggtaccttcccatggattcctcggatgatattaaccatgagagtttggaaaattttcctcctatgataccagaatgtgaacataaagcggttcatgacatttcattgtcgagtcgtgtaaaagggtcatacaaggaagcattggagagggggaaagaagagaccccaaatgagaaaatggagagagagtgtgagattgttgagaattga

SEQ ID NO: 56274 - DNA, 261 bp, Glycine max
  Peptide Sequence Number=SeqID_173052
atgccaagaaggctgaacccttttcttcttcactccccccctatttatagcaaaataggggaggagcttgccacccagctcgcccaggtgagcaaggttacttcctccagaagcaacagccttctggaggaaggatctggaaggcccaactttcgaaggagttacggaaactcacggattatgcaaaaacacctcttttcgatttccgccacatcacggaatttcacggattgcgctagcctacttccttttgatttctga

SEQ ID NO: 56275 - DNA, 345 bp, Glycine max
  Peptide Sequence Number=SeqID_173053
atgggcagttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacagctattggaattatggattttcagtttatggggggcagtatgggatccgcagtaggtgagaaaatcacccgtttggtagaatatgctactaatcaacttttacctcttatctggtatgtgcgtccggaggagcgcgtatgcagaaggaagtttgagcttgatccaaatggctaa

SEQ ID NO: 56276 - DNA, 225 bp, Glycine max
  Peptide Sequence Number=SeqID_173054
atgggggagacacatgaaattccccaccacaatctacctgacttcaagccttgcctcggatatgccattgaagggaaagcacttggtgccaatatcaacccttctcattacccaccacctagtcatccacaaaggccatccctaaataaaccacaaagcttgcccgccgcacatccggtgccaaaacaccaaccaaaaaggaattttgtagcgaaaagcctgtag

SEQ ID NO: 56277 - DNA, 585 bp, Glycine max
  Peptide Sequence Number=SeqID_173055
atggacccttggagggctacacgtcctcaccttgagaggactacacgtcctcgccttgagaggactacacgtcctcactatcagagggcagcacgccctcacctacaaaggactacatgtcctcgccttgagagggctacacgccctcaccttgggactacatgtcctcgccttgagagggctacacgccctcaccagcagagcactgcataccctcatcgtcagaggactacacgtcctcaccttcagagggctacacgccctcgccatcagaggactgcatatcctcaccatcagagggttacacgccctcgcctccagaggactacatgtcctcaccttgagagggctacacaccctcacctttgggtactagttaccttcaccgtcagagggctacacgccctcaccttgaaaggactacacgtcctcgccagcagagggctgcacgccctcacctccagaggactacacctcctcgccttgagagggatgcacgccctcacctttagagggctacgtgtcctcatttttagtgtgctcgacatccacaccttaaaagaatttaaggtcctctgcccttaa

SEQ ID NO: 56278 - DNA, 201 bp, Glycine max
  Peptide Sequence Number=SeqID_173056
atgacacttcctccgtcagagaagcctccatgtcctctctcaaggacattgccgcactgtaattacctctctctcctcgctgctttcctttccctgcttcgttcttcaaagcctcaccggtcatcgcgtgttcttttcaggaatcctcttctcgttctcgattgctgcgccgtcgtttcgcgcggtggacgtcgggactga

SEQ ID NO: 56279 - DNA, 252 bp, Glycine max
  Peptide Sequence Number=SeqID_173057
atgggtgcattcatgaggaaagatgagtgctacaagctgataaagcttttacatgatactaataaatgcacttcaactagcacaagcaaaacaattgatgatgttcaagagaaacgaagagggaaaagggaacgtaaaccgaaagttcactttgatgaggtaacatacccaatgaagtctgaaagaaaggttcgtcggttgaagataatgcggtacctcggccttgctcctccagttggttctcccttttga

SEQ ID NO: 56280 - DNA, 903 bp, Glycine max
  Peptide Sequence Number=SeqID_173058
atggccaagaagagaaccacgcctcagaagaagaagacccagacgataattcccatgccaaaacattctcaacagccaagaagctcacctcccaaacgccgcactgatttctctttcttcacgcgctccccctcctccttctccaaccctacttctggttcctcaccaggttcatcttctggtgaagtgaggttgtccaatgttgcttcaagcagtttgcaggggaggaaaatggtaatgaaacaattttctgaagatataatggttcaatgcagcatttaccaagagggtagaccagtatgttcatctgagtcttttgatactccagttgtggaagttgattcagctgttcaagatgaaattctcaaccttggaggacatagggctgcttgcaatgaaaaaattgatatttccaagatgtcagaatctacccgtcttgaatcatatgtctgtgatagcagttctcttgctgcaactcctggaaatgttgtatgggcgaggacagatggtcaagtgtggtggcctgctgagatcctggaagaaacatctgcattatccaaccctggcagtggtggacatgttttagttcagttttatggaaatcttcccagtgcctggattgatccaatgacagatatttcaacttttgaggattcttttgaagacaagagcaacaacccttcagaagattttcaacaggctttaaagaaggccttacagaggaaggcacaacttagttcttgccaaaagttgactcttgataggtctgctcactctgatatgcaagaacgttcatctggtactatcttgatttctactttgaattatgttgtgtatggtgaagacgagaattgggataggaacaccaaaactcaacaaggcaaagtgtttacagaagagtag

SEQ ID NO: 56281 - DNA, 606 bp, Glycine max
  Peptide Sequence Number=SeqID_173059
atgcaggttgagggaagaaccattgacttttggttcactttgcattttgaagcatctcttgccaaggtttctgccatttctaatcctgatgaaaattattcgctgtctgaagcttggcatagtaaaatacctctactagtcgaagctgtaaagtccttgcttgaggagcagaatttaggtgttcgaaaggcactttctgagttaatcgtggttatggcttctcactgttatttggttggttcgtctggagagttgttcattgaatatcttgtacgccattgcgctataacagatcaaaatcggagtgatcttgagagcacaccaaataagagaatagagatgaaaattggtgcagttactcctggtgagttaagagcagtttgtgagaaaggtctccttttggtaactattacgattcctgaaatggagcatattctttggccttttctgttgaggatgattattccattgacctacactggtgctgtggccacggtgtgcaggtgtatctcagaattgtggcggcataggtcatatagcaatgatatgttgagtgagtgtaaaacccgtcctgatataccatctgctgaggtaggatatctttaa

SEQ ID NO: 56282 - DNA, 2184 bp, Glycine max
  Peptide Sequence Number=SeqID_173060
atgggattggttgctgcatcacacttggatacagtgttagagaagctgaaggatattttagacaatgttggacaaagcatatttcagaggatactgtcattgttctctgatagtttcagaacagaagagtctgatgacatacatgctgctttggcactaatgtatggatatgctgcaaagtatgccccatcaacagttattgaagccagaataaatgcccttgttggcaccaacatgctctctcggcttcttcatgtgcgtctccccaaagcaaagcaagctgtcatcaccgcaattgatttactaggtaatgctgtcattaatgctgctgaaagtggctcgccatttccattgaaaagaagggaccaactgcttgattatattttaactttgatgggccgggatgatgaagatggttttgctgattacaatgatcttttgcgtactcaggcccttgctataagtgcctgcactactttggtctctgtggaaccaaagctaacagttgaaactagaagccatgtaatgaaggctacgttggggttctttgctataccaaatgatcctgttgatgttgtcaatccccttatagacaacttgattactcttttatgtgcaattcttctcactggtggagaagatggaagaagtcgagcagagctgctaatgcttatcttgaggcaaattgatcaatttgtctgttctcctgttgagtatcagaggaaaagaggctgtcttgctgtccatgagatgcttctaaagtttcggatgatttgtgtcagtgggtattgtgcactgggctgtcgtgggagttgtgcacataacaagcaaatggaccgaactctatatgggaatttttcaaagctgccatctgcatttgtattaccaagtcgagaagctttgtgcttgggtgatagggtaataatgtatcttccacgttgtgcagacacaaattctgaagtcagaaaaatatcagcacaaattcttgatctactcttcagcatctctctttcacttccaagacctgctggttcatctatatctgctgaagatatagaattgtcatacagcgcattatcttctcttgaggatgttatagccatattgaggaatgatacttcaattgatccatcagaagttttcaacaggattgtttcctctctctgcattctgttgacaaaggaggaggcaagtgtctttgattctctggttgctacactgcatggttgctcagtggctatatgtgataagatcaagcagtcagctgaaggggctattcaagctgttgttgaatttgttacgaagagagggagagaattgactgagattgatatctcaagtacatgttgttatcttattagagggcgagccctgatggtaaagttatgccttggcgaccggttggtcatgggtttgaatctagaaacagcctctttgcatatgcaagggcaaattcatcctttacttgtgaaaaagatttcttctttggctgaaaacactagcccaagaactgtttttgatgaagtcctggctgctgctggaagggatacaatcacaaaggatatatctaggttacgtgggggatggccaatgcaggatgcattctatgcattttctcagcacatggtactgtcagttttgtttctagaacatgtgatatctgttcttagccagattcctatccttaaaggtgatgtggagagacttgaggatagccaggttgacagtcatacagaagatggcaaactgcaagctgcaatttttgctcttaccgctttcttcagaggtgggggaaaagttggaaaaagggccgttgaacaaaactatgcttctgttctttctgagcttacactgcaacttggaagctgtcatggtttaacctattctggtcagcatgaaccattgagttttcaagggaaattagggagatatttaaatctgaatcttcttactgcatttcaggcattctgtgaatgcgttggtgacctagagatgggcaagattttagctagagatggagaactattggaaaatgagaggtggattagtctcattggagacatagcaggctgcatatctataaagcgaccaaaagagttggagatgagttcaatcctcactgcctctattgcattagggggtatgttgggttacaagtgtgacgtgaagtcccacatcgagtag

SEQ ID NO: 56283 - DNA, 184 bp, Glycine max
  Peptide Sequence Number=SeqID_173061
atgactaacgctacggccagaaaagaggaagagcatacagagattgaaacacatcaagaaagcatttgtcaagttaccttaatccatcatcaattgaccaacgaagaggaaacgcctgaagtctctagtactccagaatatccctacttggctactgttggctatgttggagggaaagataaag

SEQ ID NO: 56284 - DNA, 429 bp, Glycine max
  Peptide Sequence Number=SeqID_173062
atggccgcggctgaagcgaaacaggaatcaattggacaaggctcagagagggaacaaggcttcaaggagagaaatcaaacacaagtgttgaacaaatggattaaggaatccgggtttgaggaaaagaccaagggggtgggtcttttgattcgaggttgggctcctcaggtacttagaattggagtaagagttggggtggaaagtccggtaatctggggtgatgaagagaaaagtggggtgttggtgaagaaagaagatgttgtgagggctatagagaagttaatggatgagggaaatgaaagggaagagaagagaaaaagggctagagatcttgcggagatggctaagaaagctgtagaaggaggatcttctcacttcaatgtaacccagctaatccaagatatcatgcaacagtccaacaaaaactaa

SEQ ID NO: 56285 - DNA, 1458 bp, Glycine max
  Peptide Sequence Number=SeqID_173063
atggcttccgaagcagcaccacacttcgtcttgtttccactgatggctcaaggccacatgatccccatgatggacatagcaaaaatattggtgcaccgcaacgttattgtgactgtagtcacaactccacataacgcagcacgtttcacatcaatcattgatcgttatattgagtcagggtttcctataagattggttcaacttcaattcccatgtgaagaagctggagtaccagacggatgcgagaatctcgatatgataccttcacttgccacggccacaagtttcttcaaagcaacacaacttctacaacaaccagcggaaaaactgtttgaagagttaacaccaccaagctgcatagtctctgatatgtgtttgccatatacaacccaaatcgccaaaaagttcaatgttcccaggatttcttttgttggagtaagttgcttttgtcttctgtgtatgcataatataaacatccataatgttagggagagcgtaacatctgagtcagagtactttgttctgcccggtatccctgaaaaaattgagatgaccctcgcacagactggacaacctatgaatgaaagctggaaacagattaatgaagaaattagggaagctgaaatgtctagttatggagtagtcatgaattcttttgaagagttggagccagcatatgcaacgggctacaagaagatcagaggcgataaattgtggtgtataggccctgtgtctcttattaacaaggatcatttagataaggctcaaagaggtacggcctcaatagatgtgtcgcaacacataaaatggcttgattgtcagaagccaggaactgtaatctatgcatgtcttggaagcctatgcaatttaacaacaccccagttgaaagagcttggtttagccttggaagcatcaaaaagacccttcatttgggttatcagggaaggaggtcattccgaagaattagaaaagtggattaaggaatatggatttgaggaaaggaccaatgctagaagccttctcattcggggatgggcgcctcaaatattaatattatctcaccctgctattggagggtttataacacactgtggttggaactctaccttagaagcaatatgtgccggggtgccaatgcttacgtggccactatttgcggatcagtttttgaatgaaagcctagtggtgcatgtactaaaagttggagtgaaggttggggtggaaattccgcttacatggggtaaggaagtggaaattggtgtgcaagtgaagaagaaagatgttgaaagggcaatagcaaagttgatggatgagacaagcgaaagtgaaaaaagaagaaaaagggtgagagagcttgctgagatggctaacagagccgtagagaaagggggatcctcttattctaatgtgaccttgcttatccaggatatcatgcagaaaaacaagagagatgtgtga

SEQ ID NO: 56286 - DNA, 441 bp, Glycine max
  Peptide Sequence Number=SeqID_173064
atggtgggtggtgacaatgaatcaggaacccaattggtggattgtggtgtggaagatgcaatgaagctttctatcagtgtccccacagcatcgcatccccacaacggtagatctagatctgggtcgagcgtgttggtctgctgttgtggtattgtggttgagatttgggagttaagtggatcccggtggatgatagtggaggtgatccaaccgcaccttccagtacggctaccttgttacgacttcactccagtcactagccctgccttcgacattcccttctttgcggttaaggtaacaacttcgggcatggccagctcccatagtgtgacgggcagtgtgtataaggcccgggaacgaattcaccgccgtttggctgaccgacaattactagcgattccaacttcatggagacgagttgtaacctacaatccgaattga

SEQ ID NO: 56287 - DNA, 1271 bp, Glycine max
  Peptide Sequence Number=SeqID_173065
gcctccaaatccggctagttcaactccactttccatccaaagaagcaggactacccgaagggtgcgagaatttcgacatgttaacatcaatggacatgatgtacaaagtcttccacgccatcagcatgctccaaaagtcagcagaggagttgtttgaagcactgataccaaaaccaagttgcataatctctgacttttgcattccttggaccgctcaagtagctgaaaagcatcatattccaaggatttcgtttcacgaatccgagtacttcactatccccggcatacctggtcaaattcaagctaccaaagagcagatacctatgatgatctcaaattcagatgaagaaatgaagcacttcggggaccagatgcgtgatgctgaaatgaagtcatacgggctaatcataaacacttttgaagagttggagaaggcatacgtgacggattacaagaaggtgagaaatgataaggtgtggtgcattggtcctgtttcattctgtaacaaagatgatttggataaagctcaaagaggcgaccaggcctcaattaatgagcaccattgcctgaaatggctagatttgcagaaatccaagtctgtggtctatgtttgttttggaagcttatgcaacttgattccttcacaacttgtagagctggcattggccttggaagatactaaaagaccatttgtatgggttattagagagggaagtaagtaccaagagttggaaaaatggatcagtgaagaagggtttgaggaaaggaccaaagggagaggccttataattcgaggttgggctccacaagtgctaatattatcacaccatgccattggaggattcttaacacattgtggttggaattcaacacttgaagggataggtgctggattgccaatgattacctggcctctatttgctgatcaatttttgaatgagaagcttgttactaaagtgttgaagattggtgtgagcgtaggggtagaggttcccatgaagtttggagaggaagagaaaacaggggtgttggtgaagaaggaagatattaatagggcaatatgcatggtgatggatgatgatggagaagaaagcaaagagagaagagaaagggcaaccaaactcagtgagatggcaaagagagcagttgaaaatggagggtcttctcatcttgacttgagtttgcttatccaagacattatgcaacaatctagtagcaaggaggaaataatgtcgacgcctaaagagtcacaattttcatgtaacgtttga

SEQ ID NO: 56288 - DNA, 1482 bp, Glycine max
  Peptide Sequence Number=SeqID_173066
atggcttttcaagctcaccaccaacacttccttcttgttcccttcatgtcccaaagccatctcattcccttcacacacttggccaaattacttgcatccaatggcgtctctgtcaccatagtccttacaccccttaatgcagcaaagttcaacacgctcattgaccaagcaaaagccttaaaactcaaaatacagtttcatgtactaccctttccttccgcagaagcagggttaccagaagggtgtgaaaacctggacacccttccttcccctcaatacaaacacttgtttttctctgcttccaatatgctgaaagagccacttgagaaatggctctcagagttggaaacacttcccacttgcatggtttccgacatatgcttaccttggactactactgttgcatcgaagttcaagataccgagggttgtcttccacggaatctcatgcttcgccctcttgtgctcacacaagattggccattccaaggtgcatgaaaatgtcacctcaatgtcagagccattcgtggtgccggacttgcctgacgcaattgaattcaccaaggcacagttacctggggcaatgagtcaggactcgaaggcttggaagcacgccgttgaacaattcaaagctggggaacattctgcagcagggatattggtgaacacttttgaggagttggagaagatgtacgtgagagggtacgagaaagtgggaagaaaaatttggtgtataggaccactttctttacatgacaagttattcttggaaagggctgggagagatggtaatgagacatcactggatgaatctgaatgtctaaattttctttcttccaacaagccttgttctgtgatctatgtctgttttggaagcttgtgtcgcattaatgcttcacaactaaaggagattgctttgggcttggaagcatcaagccaccccttcatttgggtgattggaaagagtgattgttctcaagagatagagaaatggttagaagaagagaattttcaagagaggaatagaagaaagggtgtcatcattagaggatgggcaccacaagttgagatactgtcccatccttcaactggtgggttcttatctcattgtggttggaattcaacactggaagcagtttctgcagggattccaatgataacttggccaatgtctgctgagcagttcatcaatgagaagctcattgtgcaagtgctgaagattggtgtgaggattggggttgaagctcctgtagaccccatggagacacagaaagcattggtgaagaaagagtgtgtgaaaaaggctgttgaccagctcatggagcaaggtggggatggggaacagagaaggaacagagctagagagatcaaagaaatggctcagaaggcagttgaagatggtggatcatcagcttcaaattgcgaattatttattcaagaaattggggcagttgaagatggtggatcatcagcttcaaaatag

SEQ ID NO: 56289 - DNA, 1680 bp, Glycine max
  Peptide Sequence Number=SeqID_173067
atggtttccgaagcacaaaagccacactttgtcttgtttccattgatggcccaaggccacatgatccccatgatggacatcgcaaagatattggtgcaccgcaatgttattgtgactgtggtcacaacgccacataacgcagctcgtttcacaccaatctttgatcgttatattgagtctggctttcctgtaagattggttcaacttcaattcccatgtgaagaagctggagtaccaaaaggatgcgagaatctcgatatgataccttcacttgccacggccacaagtttcttcaaagcagcaaaccttctacaacaaccagtggaaaaactgtttgaagagttaacaccaccaccaagctgcatcatctctgatatgtgtttgccatacacaatccacatcgccaaaaaattcaatattcccaggatttcttttggaggagtaggttgcttttatcttttgtgtttgcataatatacgcatccataatgttggggagaacataacatctgagtccgagaaatttgttgtgcctggtatccctgacaaaattgagatgacaaaagcacaggctggacaaccgatgaatgaaagctggaatcagtttggttatgatgttatggcggctgaaatgggtacttatggggtaatcacgaattcttttgaagagttggagccagcatatgtaagggactacaagaatatcagaggcgataaagtgtggtgtataggccctgtgtcactcattaacaaggatcatttggataaggctcaaagaggtagggcctcaattgatgtgtcccaatacttagaatggcttgattgtcagaagccagggactgtaatctatgcatgtcttggaagcctatgcaatttaacaacaccccaattgatagagcttggtttagccttggaagcatcagaaagacccttcatttgggttatcagggaaggaggtcattcagaagaattagaaaagtggattaaggaatatggatttgaggaaagcaccaatgctagaagccttctcattcggggttgggctcctcaattgttaatattagcacaccctgctattggagggttcataacacactgtggttggaactctacaatagaagcaatatgtgctggggtgccaatgcttacgtggccactatttgcagatcagtttttgaatgaaagtctagtggtgcatgtactaaaagttggattgaaggttggggtggaaattccacttacatggggtaaggaagtggaaattggtgtgcaagtgaagaagaaagatgttgaaagggcaatagcaaagttgatggatgagacaagcgaaagtgaagaaagaagaaaaagggtgagagagcttgctgagatggctaacagagccgtagagaaaggggaagttccaatgaattggggagaggaagagaaaactggtgtgttggtgaagaaagaggacattaagagggcaatatgcatgctgatggatgatgatggagaagaaatcaaagagagaagagaaagggcaaccaaactctgtgagatggcaaagaaagcggttgaaaaagggggctcttctcatcttgaaatgacttggcttatccaagacatcatgcaacaatcaagtagcaaggaggatataaagttgacacccaaagagtcgcaatttacatgtagtgcatga

SEQ ID NO: 56290 - DNA, 513 bp, Glycine max
  Peptide Sequence Number=SeqID_173068
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcaatgcgataagatcttgtgaagtaaggtttgaagtgagtgatcccacttctgattgggacccgctgttcattaataggggttcttccggaactgcttgtagaagaaagaagatcaggcagtttactgctaaatggggcaggcgaatagacgacctactaaagacagatcgtcagtggggctatgaacggagcttagccataccacaggggtcgctctga

SEQ ID NO: 56291 - DNA, 255 bp, Glycine max
  Peptide Sequence Number=SeqID_173069
atgccaatcacccgctgcaaaagtatcagttggtctgtgtcgtcccgacatgggaatcgcacccacaagacacccagtggacccggaaaagtccaacagggccctggggtttccagctctggttacgggcctctatcagtcctacagggtgcccgtacccccccggcaaggtcacgtcatcatagggatcgcacctgcaagacacctagtggacccgaagaagtccaacagggtcttggagttgtcaagcgctaa

SEQ ID NO: 56292 - DNA, 645 bp, Glycine max
  Peptide Sequence Number=SeqID_173070
atggaaccacggcacgccaagttcggtggtgaccttgttgatcgccggatacagggtcaggtcatcattgacgatgtcacccagggtggtgcccatgcgcgccctggtctgaccgaccagcggcgccacgatcgactgctggtagtagccgatgtccttcaggctggcggtctgcgaatcggtgaacaccagcatctggaaaccacgacggctgtcatggcgatccgactgcagggcgaaatcccagttgcgggtgacgtcgctggtggcggcgatgccgccgtacttcagcgccggcgaaccgttcggacggtagtggcgccagaacgaaggcaggccatcggccgccttcgggaacgaatacgcatcgggcttgatcacgaacacggtctggccatcacgcaccggcaggctgtagctgccgtcggcggcggtcttgacgagggtctcgccgttggagacctgcaccccggccaggcccggatcggtcgcgccgcgccccggccggccgtcgcgctccagatagaccttgccggtgaccacggtgtccgcggcccaggccggcgaggtcagcaacaggcagcacagccacgcggcaggcagtttcatgggagagatccagcagaaagagacgcggtattgtag

SEQ ID NO: 56293 - DNA, 480 bp, Glycine max
  Peptide Sequence Number=SeqID_173071
atggcgcttttccagcaccgcccgcgcatcctccagcgacagcccgcgcgcgcgcagcagcaccagcaggtggtacagcaggtccgaagcctcgcccagcagcgcctcgtcatcctgcgccaccgccgccaaggcggtctccacgccctcctcgcccaccttctgcgcgatgcggcggatgccgccctcgaacaggctcgtggtgtagctgcccgttggccgctgcgcctcgcgcatcgccaccagctggcccagcccgccaaggaagtccttcggcgcgccatcgaagcagctctccgcaccggtgtgacaggtcggcccggccgggcgtgccatcaccagcagcgtatcggcatcgcagtccacgctgatcgactgcaccaccagcacgttgccggactgctcgcccttggtccacagccgctgcttgctgcggctgaagaacgtcatgtgcccgatcgccagggtggccgccaatga

SEQ ID NO: 56294 - DNA, 684 bp, Glycine max
  Peptide Sequence Number=SeqID_173072
atggagttgaaggaatccattttgattaagcttctgctgctgctaccctttttctcggttctatgtgcttcaccggacttcaatttcttctactttgttcagcagtggccaggatcatactgtgacacacagaagagttgttgctaccccacaactgggaagcctgcagcagattttggcattcatggtctgtggcctaattacaatgatggcacatacccatctaactgtgatcctaacaaccctttcaatccatctgggatttctgatctcactagcagtttgcaaagtaattggcccacactggcatgcccaagcagcgatgggataacattctggacccatgaatgggacaaacatggcacttgttcagagtcagtccttaagcagcatgactattttgaagcagctctcaaccttagacaaaaagccaacctcctccaagctcttacaaatgcaggaatacaaccagatgggcaatcctacagcttgagtgacatcaaagaggctataaagaatggaattgggtatgctccattcattgagtgcaatgtggactcatccggcaacagccagctataccaagtttacttgtgtgtgaacacttctgggtcagacttcatggagtgccctgtgttccccaggagcaaatgtggctcagacattgagttcccatctttttag

SEQ ID NO: 56295 - DNA, 201 bp, Glycine max
  Peptide Sequence Number=SeqID_173073
atgagtcatgggcgtttatatcaaaaacgagtgaagaacgctttgacaagaaggagcagaatcgtcttaggcgatggtcaaatatcgggccaaatccaaagacagagacaaatcgaggtaaacagtaacgtggccacggtttgctgcgctttgtcatttcttgctttcaggtacttagggacggacgcgagtagaggctag

SEQ ID NO: 56296 - DNA, 303 bp, Glycine max
  Peptide Sequence Number=SeqID_173074
atgcagtccaagtttcagtcgcaaatgcaatcacagggactcgcactgcctcctgagcctgaggaagagtttatgagggatccacaaccgttcacaatattccctttgttgcatgttcaagtcaaggttggtgtggaggaggttagagatgtagatgctcccattcctatacccactaaagaggttaagttagtggggcagacacctaacaccttccttgcttggccgacacatctagtcaagcgtttatcagaacagggagctgagggaccagcaaaacctgcagataggccaaatcatgag

SEQ ID NO: 56297 - DNA, 468 bp, Glycine max
  Peptide Sequence Number=SeqID_173075
atgtctcttgcaaatctttttggaaagcttcaggaacacgaaatggaacttatgagactaaatcaacatgaagaaaatgacaagaaaaagaaaggaattgcacttaaagcctcatcttctattcaagaagaaaaagatgatgattttagtttcttcgtaaaaagattcaacaagtttctaaggaacaaaggaaatcaaagaagaacaaatttcaatccaaagaaaaaaggagaagactctccttctattccaaagtgctatgaatgtaatcaacctggacatctaagagttgatttcccaagtttcaagaaaaagatggagaagtctaacaagaaaaatttcaaagacaagaaagcaaagaaaacttacatcacttggaaggataatgatatagattcatcaggagattcagaaaatgaagtcgtgaatctgagtctcatggccaaaaactatgatattgaagaagag

SEQ ID NO: 56298 - DNA, 402 bp, Glycine max
  Peptide Sequence Number=SeqID_173076
tatgcggtggtggagtacgcgcgcaacgtgctgggctgggaggatgctggtcatgccgagaccgaccctgacgcgcgctgggtgattgcgccactggcctgctcgctggtcgagcagcgcggtgaggtcacgtttgagccgggttcgcgtattgctcaggcctacggcgcgctgcagagtaacgaaggctatcactgcaactttggcgttaacgctgagttcagcgaggcgctggccacgcgcaatctgcgtattacctcatgggatctggagggggatgtgcgcggggtagagctgaccgatcatccgttctttgtcgccacgctgttccagtctgaacgcgccgcgttacaaaaccggctgtcaccgctggtcgtggcgtggctgcaggcggcgcgataa

SEQ ID NO: 56299 - DNA, 444 bp, Glycine max
  Peptide Sequence Number=SeqID_173077
atgaattcattgcctagcgctgttcatgtgtcctccaccttcgagtctggagccccgcgaattcattgcctagcgaacttcgccagttctccattctccacttttattcggagccccatgaatttattgcctagcgttgtgcatgtgacctccaccttcgacgctgttcatgtgtcctccaccttcgagtctggagccccgcgaattcattgcttggcgaagttcgccaattctccattctcctcttttattcggagccccatgaattcattgcctagagctgttcatgtatactccaccttcgagtctggagccccgcgaattgatcgcctagcgctattcgccaattctcctttctccacttttattcagagccccatgaatttattgcctagcgttgttcatgtgtcctccaccttcgagttctggagccctgcgaattga

SEQ ID NO: 56300 - DNA, 1986 bp, Glycine max
  Peptide Sequence Number=SeqID_173078
atggcttcgttctatatggatggcccaacactctcatggtaccaatggatgacccgtaataggttcatcttgtcttggctgacactgttacaggcactggagtcgcgattatacccagagttgcgacgggaagtacaggcacttcagccactatccctgccacaggttgttgcgcttgccaagctccaggaggaaaagcttcatgaccgacgacgccatggtcttccaccagcttcccctcccatctctccactcccaccgtccacagcccgtcctttgtgggttgtcggtcaccgatgccgtccccgccttcactttctcattgctgatgatgacgctgatagctttgatacttcagccccaccctcaccaggtgtcgtcagtgaacctttccaccatcaggaccagctcaacgtcccacagattagccttaatgcgttaactggcatgccgacacccaaaatgtttcgcatctatggcactatagctcgccaccaagtcatgattcttgttgacggcggcagcacgcataatttcattcaagccagactcgccgttttcctgcacctcgatcaagttcccaccgccacaatgcgtgtcatgatcggcaaaaacatcactattgactgtgataccaaatgccctttagtccctattctcatccagggccactccttctcggttgacctatatcagttgcccatcggtggcacggacatcgtcctgggagtacagtggttcaagcttcttggatcggtcaccactgactatgcctcattgactatgagcttcaattacttgaagcaacccatttccctgcatgctgacattcctttgtgcccgagtttggcttcggcccaacaacaaaagcggttctcccaaacccatggtatatccgctttatatcacttaacccatattcccgacccggcccaccttgccaatcccgttacaaccccacccacttcctcttcccacccagccctggctcatcttcttcatcgttacgaagccattttccaagaaccacaccagctcccacctccccgcaacatcactcatcgcattcatcttttgctaaacacgaaccccgtgaacgtgactacgatgttagaagccgacatgatcaggcccagccataacccattttcctcgccggtgttactcatcaagaagaaggacgacaactggagatgttgtgtcaactaccgagccctcaacgccgtcaccatcaaagatcatttccccatgccaatgatcaatgagttactggacgagatcagtcatgcctcgtggttctccaagctggatctctggcaagggttccaccatattcgcatgcacgacgaggatataccaaaaacagctttctgcactcatcaaggacactatgagttcatggtaatgcctttcggcttgtccaatgccccctccacttttcaggcaaccatgaatgaccttctccgatcattcctccagaagtttgtagctgtcttcttcgacgatatccttgtttacagctcctccttccccactcacctggaccacttggaagcagtcttttccacacttctaaagggttcgttcttccttcgccgttccaaatgcatcatcacggaacaatgtttgaactatctcggacatatcatatcactgcagggtgtggcacctgactcagagaagatccaggcaatgacacagtggcctataccaatgtctacctttgatctccaaagtttccttgtccttactggcttctatcggaaattcatcaagaactatgccaccaccgccgtgccattaacgatactattatgtaaggataagttctcgtggagccccgaggcacaagcaactttccaacaattgaagtatttgatgactcaagcaccaatattagctacgtcggactttacggtgcccttcacattggagacggacgcctccggcacaactatcgaagccgtcttactccaacaatcatga

SEQ ID NO: 56301 - DNA, 420 bp, Glycine max
  Peptide Sequence Number=SeqID_173079
atggaggaagagaatgagagagagagagaagggggggcgtggaaattgaaggagaacagggagaaaacctatcacatgggaaacttccttgagaagcaaggaagattattaaagatcaattcaaacaagattaaagaatcaagaagattcaagagaagactcaagatatgcaagagcctcaagaaaagcatcaagagacggtctacttggttgaatcactggacacaaaggagtaacgccctttggggttctttgcaagaaatggaatttgcatcttggcataatcactggacactaaggagtaacatcctttgggtttcattgcaagaggtgggattgcctcttggtgtaatcattgaacacaaaggaggaaggtcctttggggttcattgcaagaggtgggattgcctcttggtgtaa

SEQ ID NO: 56302 - DNA, 300 bp, Glycine max
  Peptide Sequence Number=SeqID_173080
atgatcaaggaggccttggtaatcaaagaattggcaaattttgaaaatccaactgatagggtcctggccgtcgaagcgcggggcgtcgagcttcatatgaggcttggtggggtgggtggatggggtgaaggtgttcggaggtggctgtgtaggggacgaagggttgacggtgatcgccacaaggtgctcgagcatggaatccattttggcgttcatggaggattgtgtttggacaagggcaacgtggttttgggtgagagtggcctggccctgggtcaaggtggcttagatctgggttag

SEQ ID NO: 56303 - DNA, 1826 bp, Glycine max
  Peptide Sequence Number=SeqID_173081
atggcaacaacacccattctccaatgcgtctcacattctctcacaaaactcaacacagaagccccaagacacgaacccaatacagctgcacttgaaccaccttcatcttccatactttctctcatacccaaatgcacctctctcagagagctcaagcaaatccaagcctacaccatcaaaacccaccaaaacaaccccaccgtcctcacaaagctcataaatttctgcacttcaaaccccacaatcgcctccatggaccacgcccaccgcatgttcgacaaaattccccaaccagatattgttcttttcaacaccatggcacgcgggtatgcgcgctttgatgacccacttagagcaattcttctgtgttctcaggtgttatgctctggcctccttccggatgactacactttctcctctcttctcaaggcctgtgcaaggctcaaggcacttgaagaaggtaaacagctgcattgccttgctgttaaactaggggtcggtgataacatgtatgtgtgcccgactctcattaacatgtacactgcctgcaacgacgtggatgctgctaggagggtctttgacaagattggtgaaccgtgtgttgtcgcgtataatgcgatcatcacgagctgtgcgcggaacagccgccccaatgaggccttggctctgttcagagagttgcaggagagtggcctcaagccaactgatgtcaccatgctcgttgcgctttcatcgtgcgctttgctcggggcattggacttggggaggtggatccatgagtatgtcaagaagaatgggtttgatcagtatgttaaggtgaacactgcacttattgatatgtatgcgaaatgtgggagtttggatgatgcagtttctgtgttcaaggacatgcctaggagagacacgcaggcgtggtcggcgatgattgttgcttatgcaacacatgggcatggctcccaagccatatcaatgttgagggaaatgaagaaggcgaaagtgcagcctgatgagataacgtttttgggtatattgtacgcgtgcagtcacactggattggtggaggaaggttatgagtacttccatagtatgactcatgagtatgggattgttccgagtatcaaacattatggatgtatgattgatttgcttggtcgagctggacgcttggaagaagcctgtaagttcatagatgagctgccgatcaagccgacaccaattctgtggcggacattgctatcttcttgtagcagtcatggcaatgttgaaatggcaaagctagtaattcagagaatctttgagctggatgattcccatggcggcgattatgtcattttgtcaaacttgtgtgcaagaaatggaagatgggatgatgtgaatcacttgaggaaaatgatggtagacaaaggagcactaaaagtccctggctgtagctcaatagaggtcaacaatgttgtgcatgaattcttctccggggatggagttcattccacttcgaccatattgcaccatgcacttgatgagttggtaaaagaattgaagctggctgggtatgtgcctgacacatctttggtcttttatgcagacatagaggatgaagagaaagaaattgttctcagatatcacagtgagaaattggccattacttatggtcttctgaatactcctcctggaacaacaattcgtgtggtaaagaaccttagagtctgtgtggattgccataatgctgctaaatttatatcattgatctttggtaggcaaattattctaagagatgtccagcggtttcatcatttcaaagatgggaaatgctcctgtggggattactg

SEQ ID NO: 56304 - DNA, 198 bp, Glycine max
  Peptide Sequence Number=SeqID_173082
atggaaacatgttttggtgttgttgaagacgtagctagcaacaacattggcgtgggagttctactcgttgagggggatgccgagtttgtcaaagacatgaaggattcagggtcggaggcaatagcacaaatcttgaaagtcgatgggggatctcatggagaggaagtggtcaaaggcaaaactcgagatagaggttga

SEQ ID NO: 56305 - DNA, 891 bp, Glycine max
  Peptide Sequence Number=SeqID_173083
atggacctaaccaaggacaccaacacccttgacacaaattctcaaaccccaccacaacccttcaccaccaacggctccctcaaggaccatcaccatcaccaccccaccaccgtgtcaccgccgcaacagccaccgtctacggcggttgcctacaaagagtgcctcaaaaaccatgcagccagcattggtggccacgcgcttgatgggtgcggtgagttcatgccctcctctttctccaaccccaacgaaccgcgctcgctaacgtgcgccgcgtgtggatgccaccgtaacttccaccgtcgccgcgacacaccggaaaatcatcaccgctccaactccaggcccaatttcttaagcttctaccactccccgccaccgtctcgtcacggggcgggcccgagctccagcccaagcccaagcccgatgtcgagcccgagcccaccgccaatctctcatcatttcccaccttcctcccaccatttccaaggcccaataccagcccacgggctcttgggccttggaaatgaacatcatcatcacatgagttttaattttaactcttcttcccactggaatccagaaaactcgggtgggaagaagaggcataggaccaagttcagccatgaacagaaagaaaaaatgcacaatttcgccgagaaattgggttggagaatgcagaaaggggatgaaggattggtgcaagatttctgcaaggagattggcgtttcaagaggggtcttcaaggtgtggatgcacaacaacaagaacacttctggcaggaagaaatcgttggaaccaggtgaaagaatcaatggcaccggtagtgatagtacagataataataataatcatccttacaacacaaacagcaccaacgatgacacccactga

SEQ ID NO: 56306 - DNA, 542 bp, Glycine max
  Peptide Sequence Number=SeqID_173084
aagaggatgatcctgcattacaactagatccaccagacgaggttgagacagctggtgaccccagtttgcaagatcatcatttgtcttataatgctttaaaaggctcatcaggtcttggaataatgaagtttcaaggatcaataaatggattgggagtgcagattctactagatagtgggagttcagataacttcctccagcctagactagctcaatgcctgaagttacctgtagaaccaattcctaatttgcaggttttggttgtaaatggaaatgccttgactgctgaaggattaattcaagacttggaggtgaaaatccaaggtcatacactaaagctaccagtttacctacttccagtttctggtgctgatctagtgcttggggctgcatggttggcaacaattgggcctgatctttctgattatagtactctgacattgaagttttacttggtctttgatgtgccatcaggtttaccccctagaagaactcacaatcattcaatcccattggttgaaggtgcgaaaggatcagattga

SEQ ID NO: 56307 - DNA, 151 bp, Glycine max
  Peptide Sequence Number=SeqID_173085
gtcgaagaaaactacgaaaggaaagggtgggaagcgattttggaagtccattgtggttggctttaagactcccagggaagccatcgaagtaatggatttgagtcatttgatgttgcgggatgtattcttaaagtccaataagctggtttaa

SEQ ID NO: 56308 - DNA, 747 bp, Glycine max
  Peptide Sequence Number=SeqID_173086
atgggtgtcattgaattgtgcgttgaagtagatattgccggtgcttttgcgttgaatgtgaaaaattcgctattatcatgtgggaataatatagttggcaatgaatcaaaagttcaaagatttgtaacaaatttagatgaagattctgacgatgatgattatatgatatataattcatatgttgaggactcgtcggatgaggaggaagatatcaatgatatatctgacacagatgaagaaggtggaagtgagattgcattttgggaatctgcttctaattatagtaacattaattggagtcatccagatgaagaagatattcgtggtttcgatatgggatcaaccttcaatattggccaagaattatttgttggcatggaatttgaaagcaaaaatgcagtaaaaaaatgcactgcaacaccaatcatacaagtcgacgatacattcttgtatggaaaatatcgtgagacgctgttaatgacaacaacacaagatggaaatggtcatgttcttccgctcgcatttgctgtggttgagggagaaacattaacagcatggccatggtttttggcacacttgcgtgaacatgtcacagataaagatgatatatgtctcatttctaatcgtcatgttatgaaacagattcagaaaaatcaagaaaaggcttgttctcacattgtccgcatttatgatattcagagaacaatgtttgaagttgaggaggcttacaatcctatgtctcaatga

SEQ ID NO: 56309 - DNA, 144 bp, Glycine max
  Peptide Sequence Number=SeqID_173087
atggcgcaatacgttgtacttagggaatttgagcaaaagattgctccaactgacatgacacaataccttttcagctgttatagcaactcattgcgcatagctgttggcacaacagctcaatgtcatatgtcagcttcccgttga

SEQ ID NO: 56310 - DNA, 270 bp, Glycine max
  Peptide Sequence Number=SeqID_173088
atggaagggagcaagaaaatacttacggggaagaaggaagctgctggaaaagggggtgttatgcaagtgagggaacaacatgtattttcaatttataagcgaagaaggagacgaaggagtaaggagtattgcgccaggggggttggcgcaacatctttatgtgtgtacttgcgtcactatgccctgtgcagcacctgcgccctgcaccctatgcctatactgaccaaaagtggttgtgccactgcagctgtagcaacccattgcgcatag

SEQ ID NO: 56311 - DNA, 294 bp, Glycine max
  Peptide Sequence Number=SeqID_173089
atgtatccaatgccttcttttttatggcgtcacagagttgtgattaaaagtggaggagtgagaggaaggggtgggggagaggaagaggaggttgttagtgtcattggggaaagtggcgaacaaaagagaaattgcgattggtggtgccataatcacgcgcacaacaacaatgccattacgtacaaattcgaggcagaggaggtggcgcgcattgatcctggggacggaggtggcggctcgactaggaggaaagagggggtgagtggtggtggtggtggtcacgagcatgattga

SEQ ID NO: 56312 - DNA, 594 bp, Glycine max
  Peptide Sequence Number=SeqID_173090
atgggatgcctgctacctaggtatcaaacacaggcatcttgcataggcattcaagatagtctggagttttacatgcatccatatcaacctgggtatactgcccccccacctcgtcctaatcctgaagaaactactattgatataggaggtggctggacaatatctggcacacccttagacttgcgtgatcctcgactcttggcaattgcagaagcagaacgtcagttcttggatgctgaatatgatgagtatgctgcttccaacgccagtggagctgcattttgccgctcagctgctttaattttaatggcccttttactcctgcggcatgcactttctgtctcagatggtgataattctgatgatgatccatccagttttttctcccttttcttgcttcgtgctgctggatttctattaccttgctacatcatggcttgggcaatcagtattctgcagcgtcggcgacaaagacaagaggctgcagcactagcggcaacccaagttgcttttgttctacaatctggtcagcgtagaggtttacagtttgcaatagcaccaggaccacccacactacaccaggaacaagtataa

SEQ ID NO: 56313 - DNA, 816 bp, Glycine max
  Peptide Sequence Number=SeqID_173091
cccacagagaatgagaagaaggattgcaagactttgtgcctgttgcaccaaaacatagacacaaccaacttcgacacgatagaagttgcaaccactgtgaaggaggcatgggaaatcttggagaagtgtcatgcaggtgctgaaaagttgacgaaggttgtggggaaaacattcttgtgttctcttgacttaagaaagaagtatgggaactttgcaaatgagtgtcacaacaacaataatcaacaaagaaaatttgataatgaggctcacttggcacaagataatgatttcagttcagatccaattgtgtttatggtgacaccaaattttgatttggggaattttgaaacttggtatcttgactcaggttgctctaactatatgaccattcatagagaatggttaattgactttgatggtaccaagaagagtaaggtcagattcgcagacaacataacaatgcctgttgaaggagtgggaaatgtgattattaaaaggaaaaatgggaaatttgcaatgatttctggtgttctatatgtgccaaatatgaagaacaatttgcttagtgttacaacgataaggaatggtctacggtttgagaaaaaggattcgagagtcgtttatgcacaggaaagggttgaaaaacccaagtcgcctcgcgtagaaaatagcagaaaccaccacagagggtggcatgtgcttgtggcaccactagtgcaaggtccagcggcacgaggaagccaaggggcgatggtagcgcagagggcgaatggtgatggcaacactcctacactaccatgggataacgacaaatag

SEQ ID NO: 56314 - DNA, 327 bp, Glycine max
  Peptide Sequence Number=SeqID_173092
atggtgtttcatccttctagaacaaccattcttcttctctttgttgggttcttaatatcaattcaaacagagaatgtgctaggcctgagaagttcagaaattgcactaagacacagccacaaagaccaaaggatattgctgcagaatcaacatactctgaaggctacaaaggaattatcgaacacagagaagaattcagcaaatgccaacaaagggcttgatccctcaaagaagaactcagcaaatttcaaccaagagtttgatccaaatcagtcaagcaaaagaagagtgccaagaggatcagatcctatccacaataggatttga

SEQ ID NO: 56315 - DNA, 744 bp, Glycine max
  Peptide Sequence Number=SeqID_173093
atggagcaattcatgaaggctatgttttattgtaaacatttactcatcctatgcaatggaagggaaaagacaactatggtcaaagctcttcatgatcaaacgcagatttccatctggctcatggtacctagcggaggacttcatgccatttgcaatcgtcatgacttgaaaggtacctcaaactatcataattccactgacatggctgagttttccttattcatcaactctatggacgtcaatgaagtatcttcaactggaaaaagatttttgtggttcagctctgatggcaaatcaatgggcaaggtgactatgaaaaatggcataaggaagtggattcttcttggatactatctaaattcaatgataagttgcgtgcaacaaagtatcaaaaccactttcaatcagaggattgatcaaaagtccaaagaacttgaagatttggactctctcatcatggaaggatcgactcacaatgaacaagactcatggatttggctactggatccaatctctggcttttcggttgcagcaacatataaattggtgcaaaatgctttggcacaagaacataatccaacacaacatggatctacatacaacaagttatgggactgcatggcgccttcaaaggttactattcatggtttggcgcttactcaacaacagacttctaactctggaccagctgctaaaaaggaatattcaaattcaggatcaacattcactatgttgtttttgtag

SEQ ID NO: 56316 - DNA, 270 bp, Glycine max
  Peptide Sequence Number=SeqID_173094
atgtcttttctccagattgtgaccattttgctaaataggccttgtgcaggggaagagattcagttacattctcctagtggaaatccccaaatcctcttggaggagacaatagtccaccttgggtgtcaacaacagggagcgaatttgcttccgcttgaccttgtcccaaatgcctctaatattcaacgaaaatatctttatggagtgtcgagcttcaaccttgagatgacctggggaagacagtctttctcttccatgaagcgaatttga

SEQ ID NO: 56317 - DNA, 315 bp, Glycine max
  Peptide Sequence Number=SeqID_173095
atggccagcagcatgtggcataattacagaaatgccctcgttgcacttgtctttattacaaagcgaaagcgtcgtttacgctcaagaaggtggggaaaagtcacatatgtcttcatatcttcccgacgaaacaagaataggtggagctataggtttgtaaggttctggggtgttagggatgaaggggctttgaaggaaagactcaacaacatatacattaaaggcacaaagatgtttgtgaataggccaaagtatgggaaacaaagggcacaactaaagcatttccagagaggcaagaggccgataatgaactag

SEQ ID NO: 56318 - DNA, 736 bp, Glycine max
  Peptide Sequence Number=SeqID_173096
aaagagcattggtgcaaggcccatagctcaatatgacacaagaatattccactccttcgaggcctggaccagatacatagacaatgtgataggaagacatatactagataagaggaaggtagaaatatacaatatagagttggatgagttcaaggctgaattggagaggcgtaacttccataagcgcctcaccaatttagctgacagcagcatcgacctagccttggtgaaggacctcaacaccttcctggagacacctgtggtactggctgagggagaatccttacccgcttacaccagatactgcaggatgcccactgatatcagagagattgaggctgctttatgtatacttggccgagggtttggtttaaatgctgaaggccatcctaggaagatcctcaggaaaaatctgacaaatcttgctcagctggacatgaatgtaggagctctcatctctggccatatcacatctatggcccagtctaactcctctagacttgggttccctggtcttatcacaactctatgggctaggagagcgagggcaaggccagctgaggctccgtccacatctgtagctcctcctccagcatgtaccttagcagctccttctaccccatcttctacagactttcaacactctatcccttctgttgaacagtttaatgaatgggtagcctggcccgggactcagcctccccttcacaggaaggacgaaggtatcactgctcag

SEQ ID NO: 56319 - DNA, 414 bp, Glycine max
  Peptide Sequence Number=SeqID_173097
atgaactgcgttttcgttcatgtttcctccaccttcgagtttggagctatgcgtagtgattgcctagtgcaattctccgttctcaacctttttcggagccccatgaattgcgttttcgttcatgtgtcctccaccttcgagtttggagccatgcgtagtgattgcttagtccaattctccattctcaacgtttttcggagccccatgaattgcgttttcattaatatgtcctccatcttcgtgttaggagccatgcgtagtgattgcttagtgcaattctccattctcaacctttttcggagccccgtgaattacgttttcattcatgtgtcctccaccttcgagtttggagccatgcgtaatgattgctttgtgcaattctccattttctacccatttttcggagccccatga

SEQ ID NO: 56320 - DNA, 186 bp, Glycine max
  Peptide Sequence Number=SeqID_173098
atggcgcaccctccaagactcccatacgatccttgggtgaggtgggacatagtctgcctcctaagagtaaagaagcagaaggaacaaaaagaagtggaaaccaagcaattccaaagtgatgatgcacagagaagagagaaaaatttgagtgacccaagaagagatgtttttctttctttaaactga

SEQ ID NO: 56321 - DNA, 180 bp, Glycine max
  Peptide Sequence Number=SeqID_173099
atggttggttgtgaccctaaagggaccttctcagttggggctaagctttcccgctctaggatcttttttggcttcctctcggactcgccatacgaggtcgccagtctctttgtcgatgattccccaccttctatggggatcatggtgtttgtgccatatggtgtacaatggtacgcctag

SEQ ID NO: 56322 - DNA, 351 bp, Glycine max
  Peptide Sequence Number=SeqID_173100
atggctctctacaaagctctgtatgaaagaaggtgtaggacacctctgtgctggctagaacctagagagaacctcaccttagggtctgaagtggtacaacaaaccactgagaaggtcaagttaatccaagaaaggatgaggattgctcagagtaggcggaaaaacaatcaggacaagaggaggaaagacctgaaattcgagaatatccatgatccatctcatgtagtcgaattggatgatgtacaagtgaaggagaacttgacatataagccattacctttgaggatcgaggataggcaaacaaagcacctaatagggaaggagatttcattggtcaaggtgatctggtga

SEQ ID NO: 56323 - DNA, 510 bp, Glycine max
  Peptide Sequence Number=SeqID_173101
atggcggcgctacgtggagtggctctaccaacacaaggagttgggactctacctagacaagaacaaagagtaccaagagaagctaagctaccccttgttgtgctcagggtagtggaaattatatactctaaagccaactccgaggaagaattgttgcatgcaccattcaccagccagattttgcacattgtgaaagtccctttgagcccatttatcgaatttctcaagctcaccacttgcactttactaagagaaagggatagtgggcataatccttcaataggtgtcgaatcgttgtacccatgtagtgctggtctttcattgccatctatgttgcattcatttcctcctattgctgctctgatggtttatgatcacagggctgaaagtggagctagcctaggcatgctttcttcaagcagtctttatggtggatatggatcttttttgatgggggataatggctatggatctatgtcctcgtatgccaccaagctgtacggcggctga

SEQ ID NO: 56324 - DNA, 249 bp, Glycine max
  Peptide Sequence Number=SeqID_173102
gtatgcttgaagtggtgtctaatccttggaggtttacagtagggaactggttatgtgactcagatctggttagtcctactggaattgaacgggttctaactgaaaaagaccttctggctgactcatattcagacctagaggcttctatccttgatgaaaaagaatttctcctattgaaggttatctctacctttccggagttatcttgcttaatatgctctatggttggagcgggtcggggaatagacg

SEQ ID NO: 56325 - DNA, 354 bp, Glycine max
  Peptide Sequence Number=SeqID_173103
atggatgatcttcagtgcgaaacaccatctaaggaatcccgtgtttctgaaaaccttaacaagataaaggacaggataacccagattatcaacaatggctatgcgtacgaagttgatggtaatgttttctatgttgatgataaatgcccaaattatggtatgctatctagacaaaggctagcacataatacagctggagaaaaagtagtggtaggttcaagaaagtgtcacccaactgattttgcattgtggaaggctgctaaactaggtgagcctagcaaggacaacccttgggatcttggaggacctggatggcacatggaatgctcacttgaaggactcgtatcaccttga

SEQ ID NO: 56326 - DNA, 297 bp, Glycine max
  Peptide Sequence Number=SeqID_173104
atggtatcagaagttttttgtttccgtgtctcttgcttcatattgaagctatttatggttctgcacggtggtgtggatagtgctacaagccctcgttttgcagcgttgagccctgactcgaggggatgtgttgcgagtcccacatcggatgacttagttgctgatgtggtgttgtggatgaattggcgtgaagcggttgcggtgctcgtttatgccaccgcattgtggtacttcttcgagcgtgtcggttacaatttcttgtccttcgtcaccaaagtttttgccaacaagctttga

SEQ ID NO: 56327 - DNA, 231 bp, Glycine max
  Peptide Sequence Number=SeqID_173105
atgttgctcaacaacaatggatcctccccgatctcatatgctcgcttaatttccacgctcacttgctatgcttttccgtcacgtagaagttttcttgaagatgaaatggcagataaagtcatcgagtttggagaccacgaaggcttgggtagcagcgaagatgagttgagttgtagtgagtttggcaatggcgtcctcgagacggttcaggctagatttggaatgtgttga

SEQ ID NO: 56328 - DNA, 441 bp, Glycine max
  Peptide Sequence Number=SeqID_173106
atggcgccgatagcagcttcaccctcagctcctccagctgctcccagttcatgcggcgttgaaggagattacggtccaaacgatgtgcagtttgaggtcgccattggtgtagaaggagttagtgatgcttcgattgtcactgctagggaactcgatccggaggagacgaatctcgttgaagttcttgaggacttgggttggggagtggtgggtgacgccgctgtcaaagtcttcgtcggaaccgatggcgagggaggaggtggaagaaggggatgtggcagcggtagtggcgacggaggaagaggggtgtttgggaccgaggaattggctgagggtttgaatgggtttcatgattccgccaaagacgaggcggaggaggttctagaaagggttgtcgttggaggcggcagaggaggaggaacaatcgccgtcagagatcac

SEQ ID NO: 56329 - DNA, 129 bp, Glycine max
  Peptide Sequence Number=SeqID_173107
atgacggcagacagcggacggcggctagagcagctactagggaagatgcataagttattagaggacaatttccttgttttagccttgaggacaaggttgcttctgcacctgggagtattgatagcctag

SEQ ID NO: 56330 - DNA, 1287 bp, Glycine max
  Peptide Sequence Number=SeqID_173108
atggagagtgtacctactattgtgtattacgatggtgacatgatttcatcatctgaaaggatattgtttgaatatcctagtggttctcaagtcattagaataagcgagaatatatcacttgatgctttaaggaaaacaattatggatgccatccaagggagcccaaaagcctcacttaacgtgaacaaggagcaggaagaggttctacgctccaaaccctccatcctcgccctcatcgatgagctcgataagctccggcaacctctcgccaccgctctctccgaagagctccaaatcaacgacacatcttctcaaaaccctcaccatgagaccgagatcgaaaacgaaaccctagccgagagctccggctcgattgagccgaactcgaactcgaggaatgatgtcgttgtggaggacctgcttaattttctctattttggttcacttttcgatgtgaagagtgactttgtgtccacgatgcttaccagaacgcatgagcgtggctgctgcttgacctacgactacgtcatcgacgacgccaccgatctgctcggcgagaaggacttggattcgatctctgcactgagagggttgcttgtttcgcggcccgcggattcaagcttttcacacaagagtgtgctgcactgctgcgtggaacatgccaagctgtggcttgctaagtcggagcaacccattaggcctgatgctgatgttacttatgctgcattaagggagaagttgaacaatattatgtcttcggagtactttactaccacacctgagatgaaggctccggttgaagttgctgtggcggctgctgggggcaattacgtttccttccatgtgccggtgcatgggtttgtggttccggttgaagtggagcagcctgtttttcaatctcaagagaaggtgatttctgtttatggttgcacagaatgttgttgggaagaaagcttgcctgatgatgttgttgcaaacttcattatcaatcttctctttgcgggaaatgaaacaaccaccaaaacaatgctctttgcagtctatttccttactcaatgtcctatagccatgaagcaactgctggatgaacatgattgctttgtggttccatttctttcagcagtccatttagatgagaatgtatacattggagctctatatattaatccttggagatggatggaacctgaaaatgaggaaaagagaaattggagaactagtccattctatgcaccctttggaggaggggctagattctgtccaggagcagagttggctcgcctataa

SEQ ID NO: 56331 - DNA, 754 bp, Glycine max
  Peptide Sequence Number=SeqID_173109
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggtggtcgctgcaaaacccagggcgcgagcccgggcggagcggtcgtcggtgcagatcttggtgtcgatcctaaagggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 56332 - DNA, 1304 bp, Glycine max
  Peptide Sequence Number=SeqID_173110
gttctgatgaaggagtgtatgcttgggttgttgctaattatgcacttgacactcttggaggtgatcctttggaaacaactgggattattgaacttggtggtgcttctgctcagaatgctgctcaggactcgttgaaagaagcacttgtattgggagaatttaacttagcttctcaatctcttcaaaaagggttgcggatagatccttgtactcctacaggatactcttataatgttgaatcatggaagttccctcctagctcagagagtgaaaaaaaccaatatcagtccactgtacaagccaggggaaacttttcagagtgcagatctgtagcactaacactgctacaaaaagggaaagggatgcattggagaatggaaattatagtaatgtgctgtaatcctattatttctcggatagctgacatgcagcatgctcaggcctatctgtccaagttgatgaatgctgggaaagaattctgtggcaaggattggttaaggctgaagaaaaaatatgtctcccatgatgaggaagatttacttcggtattgcttctcttcagcatacattgttgctctgcttcacgacagtcttggaattgctttggatgatgagagggagagtgatgggggcactgccttttttcttttgaaactggacctcaagatttacttgttttctgtccatggattgcaatgcatgtgggtcagggctgtggggaaggctcaatcacccaatagcattggctactggcatttgacgccgttaaatcaccaagccaatgctgtggtcacagccaccatctctcacttctccatatccctagttgaagacattaacaaggggcttattggtttgagcaaagttgggagttattttggggttggctcattggagatttgcaaaagtcttggttgtttaactgcagagagggatgatgctctgctggttaaatggagggtcaaggttgctaatcaggtgggaagtattccgcttgattgggctttgggagcttttattctgcaaacagcagctgacgcagatataaagaaccataattggatcgccaccattttcagtgatgaatcacatactctcctctcaattattggaatttttatagtgttgttaacggcatggtctatatctaggtggaggaaacctcagttgaagacaatttacgatctagaaaagggacgatatattatcacacgagttggtcatgccagcggtggggctcagattgtaaatcattggattttggatgcagtatatggagttactcttgctgaggaactagtgtag

SEQ ID NO: 56333 - DNA, 252 bp, Glycine max
  Peptide Sequence Number=SeqID_173111
atgacttatctcatgcacttgatcaacaatatgatatttgccataagttctcgacttgcattcatgttgcctattgccagtacctcaacaacctggatgcttgccataagtaccatggcaagtaactactctagcatacttgtacaaccatctctcctaagtgagctatcatgggtatttgtgcatctgcccattgttagctacttagagttggaggattatgtgatgagggatgtgataaccaccagatag

SEQ ID NO: 56334 - DNA, 354 bp, Glycine max
  Peptide Sequence Number=SeqID_173112
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaagctttttgtcgttgctggaactatgtggtatggttcagcaacaacccctattga

SEQ ID NO: 56335 - DNA, 348 bp, Glycine max
  Peptide Sequence Number=SeqID_173113
atgggtggtggtgcatggccgttcttagttggtggagcgatttgtctggaattccctagtaagcgcgagtcatcagctcgcgttgactacgtccctgcccctttgtacacacccgccccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 56336 - DNA, 183 bp, Glycine max
  Peptide Sequence Number=SeqID_173114
atggtgcagcgtctcacctaccgcaagcggcacagctatgccaccaagtccaaccaacacagggtcgtcaaaacccctggtgggaagctcgtttatcagactaccaagaagagggccagcggacccaagtgccccgtcactggcaagaggattcaggggtgttcggctgttcattttttttaa

SEQ ID NO: 56337 - DNA, 1545 bp, Glycine max
  Peptide Sequence Number=SeqID_173115
atggtggatgctacacggaatcacgttctcaaatgtgaaattgaagatcgcatggaaaatcatctcagttccaagattgatgaaagattcatggagatggcagcttcgatgcagcaaactcttcacgattccctgacgcagtcattagccttgtcgatgttacaacaaatgcaagaccttctacacaacaacagtaatgacgcaaatcattctccaacggagggaaacccaattcgaggattgctaaacttgacggtggttgtttacgacacaaagttaaacatgtctatagttagaggattccagtggacaattcaacaaaccaaattcacttctgatatgttactcattccattgggatgctgcgatttggtcttgggagtgaagtggctgatggagttctatgttaagggaaggagacatgtgttgagaggggccttcactgggctgaaaacagttaagaagcaacaattggggaaggctatgttaactggtgttcatttgtcaattttgcaagtatgtgatggacaaaggggtcttctaaactcacttactactcaagctgttgataaagaagtctctcatgttgttgtcaagttattggatgagttctctgatttatttcaggaacctagtgggttacctcctagcagacctggtgttggtcccatcagtaagagaccatacaggtatgctaaacaacagaaatatgagattgataagttagtacaggaatacttgtcgactagtataattcaaaatagtagtagtccctttgcaagcctagtagttttggtgggtaaaaaggatggatcatggaggttgtgtgtggattacacgattcttaacaagcatacagttaagaacaagttcccaattcctttagtagatgatctgttggatgaattggttggttctagcattttctccaaaatcgatttgaggtcaggatataatcaagtgagaatggatcctgctgatgtgtataagactgcttttaagactcatgctgggcattttgaatacttagtgatgccctttggtctcactaatgcacctgcaatatttcaagggcttatgaacttagtttttaagaagtttttgcggaagtttctgttggtgttctttgatgacattttggtttacaactgttcattagaagaccatttgctgcatttacacaaagttttggtaactataagggcaaattccttgtttgctaagaggaataagtgctattttggggtttctaagatagagtaccttggccacttcatttctaaggagggggtatcaactgatccagctaaagtgcacgcaatagaccagtggccattacctcagaatttgaaacagcttagaggtttcctggggttaactggatattacagaaggtttgtcaagggatatggtggcattgctaaacccttaactaacatgcttcaaaaagataactttatatggactgatgtagcaaaattggcttttcagcaattgaagaagaagcttattgaggctccagttttggctttacctgacttttaa

SEQ ID NO: 56338 - DNA, 288 bp, Glycine max
  Peptide Sequence Number=SeqID_173116
atggggatgtgtttgaaacatcatttggccaagttgatcaccgaaccactgagaaaatgtgaacgagctgaatcaagcacactaattccacacttgaggcctgcagagtacaagaggtcaaggttacccagaaaccgtaggactgtcaaccgtgcatatggtggagttttatctggaagtgccgtcagggagaggattatccgagccttcttagttgaagagcaaaagattgtgaagaaggtcttgaagatccagaaggcaaaggaaaagcaggcctcaaaggcttga

SEQ ID NO: 56339 - DNA, 495 bp, Glycine max
  Peptide Sequence Number=SeqID_173117
atgtctggcggaggcagtgttgagggagcttatggtccaaacaatgcgcagtttgaggtccccgttggtgtagaaggagtcagtgatgctttgattgtcgctgctagggaactcgatccggaggaggaaaatctcgttgaagttcttgaggacttgggttggggagtggtgggtgacgccgtcgtcaaagtcttcgtcggaatcgacggcgagggaggaggtggaggaagggaatgtggcagcggtagcggtgacagaggaagaaaggcgtttgggactcaggaattggttgagggtttgaatgggtttcatgattctgtcgaagacgaggcggaggaggttctagaaagggcctccgttggaggcggtagaagaggaggaacagtcgtagtcagagatcaagtagtcgacgcggacaacgacattttcgacctgcgggacgagggagtggaagcggcgcttgctctttcgagaatgagggagcacaaagagtag

SEQ ID NO: 56340 - DNA, 528 bp, Glycine max
  Peptide Sequence Number=SeqID_173118
atgaccttgatgtgtttggaacgccattttagggatgtcttcgtccgccatgtgtatttgatggaaaccttgactaaggattggagaagaaaagggattgtggctaagttgaatgaatccgacttcaagcaacaattgaatttgtttctccaattcaactttctggctgtgggggtggcctcgatgaaaatttttagcatatcggaaaaggagtgtgctgagttctggtggttctgtgtgttggtcaaggctcagggaagtggtaatcgggcccaattggcgaagccagtgtaccccgagaacaatgtcggctccactgatggccattgcgttgaggctaaggtggggagtattggtctggtaaaggcaaaaggcattagcttggagggcatgtgggtcatccggcaccaaaagagggtaagggtattcaatatcatcctcgactatgaggagatggaaatggggctaacaacggtagtggttttgttgggagcacaagtggggaaagagaacagtgttgttgagtag

SEQ ID NO: 56341 - DNA, 636 bp, Glycine max
  Peptide Sequence Number=SeqID_173119
atggccaacaatcaggaagaggtgatacttttaggagctgtgggaagcccatatgtgtgcagggtgaaaattgccctcaagttgaaggaagttcaatacaaatttttggaagaaaatttggcaaataagagtgaactgcttctcaaatccaacccagttcacaagaaggttccagtgtttattcacaatgagaagcccatagcagaatcccttgtgattgttgagtacattgatgagacatggaagaacaaccccatcttgccttctgatccttaccaaagatccttggcttctgttttcactgctgatgagaaagagcgtgagaagaatgttgatcaatcatttgaggctcttcagtttcttgagaatgagctaaaggacaagaagttctttagagaagaggagtttggcttggtagatatttctggtatcttcgtagcattttggatccctatagttcaagaagtagtgggtttgaagttattaaacagtgagaaatttcctaagctcaacaaatggtgcgaagaattcaccaaccaccctgttgtcaaagaagttcttcctcctagagacacactttttgccttcttcaaaactatctttgaaagactcagaatttctaaaataggctcgtga

SEQ ID NO: 56342 - DNA, 804 bp, Glycine max
  Peptide Sequence Number=SeqID_173120
atggacttcatcatgggacttccccagtcccatggctttaccacaattttggtggtggtcgaccgtttctctaaaggggcccattttggtgctttacccccacaccattccgcatacaaggtcgccaccctatttatggacatcttctgcaagttgcatggtttccccaggagtatcatttcagatcgagagccaatcttcattagcttgttttggcgagaactttttcgactcagtggcaccgagttgcgatttagcaccgtggctatcaccattcgaagatacatacaacaaacctcccccgtcccctccatcatcattgctcgactcttctccgatggaagtcatgacttctatgacttggtatacgtctgcccactgccttatcgccaaacctatgtgtgtccctattacaccaaaatttcaaagaggttctacggacccttcccaataacagataaagtaggccctgtagcataccactttgaactcccgatggattctaaaatccatcatgtattccatatttcactcttgaaagcgcacaaaggaccttcacccactcaaaccgctactctcccacccatccaaacagagaaccatccggtggttgaacctttgtcattcttagattggaaatgggatcatttaacaacaacaccttcatgtatggttttggtgcagtggaacggcctcactccagaggatgcctcttgggaagaatggaccaccttgcacaatgcgtacgacctcgaggatgatgtcgagtttcctagggagggttttgttagcaattcaaactag

SEQ ID NO: 56343 - DNA, 678 bp, Glycine max
  Peptide Sequence Number=SeqID_173121
atggcttcaagtcacgaagaggttacccttttgggagcaattgcaagcgcatttgcttgcagggtgaagattgccctcaagttgaagggagttaaatacaaatatgtggaagaaaatttgaggaacaagagtgaactgcttctcaaatccaacccagttcacaagaagattccagtgtttgttcacaatgagaagcccatagcagagtcccttgtgattgttgaatacattgatgagacatggaagaacaaccccatcttgccttctgatccttaccaaagatccttggctcgtttctggtccaaattcattgatgacaagattgtgggtgctgtatcgaaatctgttttcacggttgatgagaaagagcgtgagaagaatgttgaagaaacatatgaggctcttcagtttcttgagaatgagctgaaggacaagaagttttttggaggagaggaatttgggttggtagatattgctgctgtcttcatagcattttggatcccaatttttcaggaaatagcagggttgcagttattcaccagtgagaaatttcctatactctacaaatggagccaagaattccttaaccacccttttgtgcacgaagtccttcctcctagagacccactttttgcctacttcaaagcccgctatgaaagtctttctgcttcaaaatag

SEQ ID NO: 56344 - DNA, 1224 bp, Glycine max
  Peptide Sequence Number=SeqID_173122
atggctcggctctacaggcgttgcccgatgggtcagcgcagcttggccagcaccgcgtcggtggctgcagcggtgctcacggcctggcccttggcggccaggtcggcagtgaacaccccatcatccagcaccgcatgcacggccgcttccaccgcggcggcttcggcttccaggcccagcgaatggcgcagcagcatcgccgcgctgaagatcgttgcgtacggattggcgatgcccttgccggcgatgtccggggccgaaccgtggatgggctccgaggccgacggcagcaggcccagcgagccggccagcatcgaggcttcatcggtgaggatgtcgccgaacatgttctcggtcacgatcacgtcgtactcgcgcggcttggccagcaggtgcatggccatcgaatcgaccagctggtgctccagggcaacgtccgggaactcctcgcggccgatgcgcgcggcgacgtcacgccacaggcgcgaggtttccagcacattggccttgtccaccgaggcggaaggcactgcgcagcacgcgttcgatctcggccacggtgtagcggcacaggtcgctggcgctgtcggcgtcgcgggtcttgtcgccgaagtagatgccaccggtcagttcgcgcaccaccacgaagtccacgccctgcagcagctcggccttgatgggcgaggcgtgcagcgcggcttcatgggtgcgcaccgggcgcaggttggcatacaggcccagcgccttgcggattgccagcaggccctgttccgggcggaccttggcattcgggtcggaccacttcgggccgcccacggcgcccagcagcacggcgttggcggcctggcaggcagccagcgtcgacgcaggcagcggttcgccgtggcggtcgatggcaatgccaccgatatcgtgctcgctgaaggtgaaggtgtgattgaagcgtccggcgacggacttcaggacggcaaccgcggcggcggccacttccgggccgatgccatcaccaggcaggacaacaatttcagcgtgcatgctcactctcgtaacgttcgatttcagggacacggcccaacagataccccaactggtcgacaccttccagcaggcaggtctgcgagaagccgtccagcgggaaggaatagacgcggccctcgggggtgcgcagttcgcgcgcggccacatcgatggtcagcgcgtcgtccgggcgctgcatcagcgcct

SEQ ID NO: 56345 - DNA, 2148 bp, Glycine max
  Peptide Sequence Number=SeqID_173123
atggatagtactttcacccagcaagaagtgagagagcaaacccaacaacatcaacatcagaagaagcattgtggccctttggtgaggctcagtagaaggtccactaatcctaacccattttccattctggtgttctgggtgtctaaatctcttagaagtttgtgtttcagagttcagctctcacaacaagggttttgcttgaggaggattcagtaccatcatggcatggtgattaacacccctgttctccatgcttcttcttcttcttctgaagaagaagaagaagggaaagcttctcatgctgcaatggagggtttgagtttggctgagaagagtactgaggctgttgaagaaagtaataaaggaattgaaaatggttcaaagagagaaacttttgctgatttgattgaagaaaagggtcgtgagagcagtttcagctctgagtttctgtcatctgagaccactcatggcgagcatagtaggagtagcactgaggactcatcttcatctccttctgtggggtggccggttcaggaaattgctgcatctgattgtgctagtcctcatggaagtgaagatggtgagaagaagcacttggttttggagaataaggagtttgagaaacgagtttcagccttgccagaggttgagatgatgaaggagaggtttgcaaaattgttacttggagaagatatgtcaggttgcggaaatggggtcactacagccctggctatttcaaatgccataaccaatctatgtgctaccctctttgggcaactttggagattagagcccctacgttcagagaagaaagcaatgtggcgacgagaaatagagtggtttctttctgtcagtgatcatatagttgaattgacacctaattggcagacctttccagatggaagcaagcttgaggtcatgacctgtcgaccacgctcagatctttatgtcaatcttccagctctgcgcaaattagataacatgcttcttgaaattctagatagttttgtcaatacagagttctggtatatagaccaaggggttctagctccagatgctgatggtccatcttcttttcgacaagcacttcagcgacaggaggagaaatggtggcttcctgtaccgcgagtccctccatgtggcctaaatgaaaactcaaggaagcagttgcagcacaagcgtgattccacaaaccaaatattaaaggctgcaatggccattaacagcatcactttagctgaaatggacatccctgagtcctatttggaatctcttccaaagaatgctagagtaagcttgggggatgttatttatcgttatatcacatcggatcatttctctcctgagtgcttgctagcttgccttgatttatcttctgagcatcaagctatagagattgcgaaccgagccgaggcttccatgtatatttggcgtaaaaggacaaactccaagcctgccagtatcagtgccaggtctagttcaagaacatcatgggaaatggtcaaggatctgatggttgatgcagacaaaagggatttgtttgcagagagagcagaaagccttttgctttccttgaagcagcgttttcctggtctccctcaaacagccttggatatgagcaaaatccaatacaacaaggatattgggaaagccattctggagagctactctcgcgtgctagagagtttggcgtttaacatggtagcgcgaattgatgatgtgctctatgtagacgacttgaccaaaaatttagataaaatctcatctctctcaaaagttggtgtagttactcacaagagtatatcagttccacactcagtgcctatcccaggcactccatacaaatcggctttcggcacgccaaccctttctccagcacatgggattagtagtcctgccaagctagggaagtccccactcatcaatgacagcagccttccccaaagagggtcagggatcaagaagtctttgactgattttcttagcattgatccaaaagggaaggaaagtggcagttcaattgagaaacaagttccagaatcaaatacacttgatgaagtgacaacatgtgaaacagatgtggagtccagtgattgcacagaaggtggtgccagcccaagtatcttggaccggaaatggcacgtgtga

SEQ ID NO: 56346 - DNA, 681 bp, Glycine max
  Peptide Sequence Number=SeqID_173124
atggcaactaatcaggaagaggtgtctcttttgggagttgttggaagcccatttgtgtgcagggtgcagattgccctcaagttgaagggaattcaatacaagttttttgaagaaaatttggtcaacaagagtgaactgcttctcaaatacaaccctgttcacaagaaggttccggtgtttgttcacaatgagaagcccatagcagagtctcttgtgattgttgaatacattgatgagacatggaagaacaaccccatcttgccttctgatccttaccaaagagccttggctcgtttctggtccaaattcattgatgacaagattgggggtgctgtatggaaatctgttttcacggttgatgagaaagagcgtgagaagaatgttgaagaatcgttggaggctctgcagtttcttgagagtgagatcaagggcaagaagttctttggaggagaggagtttgggatggtagatattgctgctatcttcatagcattttgggtccctatggttcaagaaattgcagggttggagttattcacaagtgagaaatttcctaagctctacaattggagccaagagttcatgagccaccctgttgtgaaagaagttcttcctcctagagacccactttttgccttcttcaaagcccgctacgaaagcctgctcgctgattcaaaatag

SEQ ID NO: 56347 - DNA, 301 bp, Glycine max
  Peptide Sequence Number=SeqID_173125
atgcaggatttgaacgatcttcaactgtttgctttggtggtgcgacatggtggtttcgccgcagccgagcgggcgagcggcgaagccaaatccaaactcagcaaacgcgtggctcgtctggaggcgagttacggtgcgcggttaatcgaacgttcgacgcgcagtttccgcgtcacggatattggccgcgatgtgtatcggcagtgtgaggcgattatcgagcggttggaggcgaccgatgccattgtcgcccgtgcgcgcgacgaagtgagcggctgcctgcgcatcagttcgccgcccg

SEQ ID NO: 56348 - DNA, 413 bp, Glycine max
  Peptide Sequence Number=SeqID_173126
atgctgctaggggcttttgtcttttcaggcgcaacagtcgcggcaacgcaaatcaatagtcaacaggcggacgccctgacgccgcgccaggtgattaccgttagcggtgccgcgaatctgagcgatgcggaaaagatgttggcggacaaaaccgccaaggcaggcgcccgttactacaaaatcatcgcgatccgtggccgaggtgttgatttcaccctgcgtcacgccatcgcgctgataagggtaataataagcgcccatgccgatgataaagtgactgttcaggctgccgccggcggcgacggcgcagccctacccctttggcgcgccggccctgcgttggcattggtcagcacgctgggcgtcgggagggccagcagggttatttgctggacaggaacattctccgaacg

SEQ ID NO: 56349 - DNA, 159 bp, Glycine max
  Peptide Sequence Number=SeqID_173127
atgggttctggcaatgcaatgtggttggactctcatgtcgatctgaatgaatcatcctttccacggagatgtaactccagttacttcggaaatggtaagatctttggcgccagaacgcaagaggaggggttgatccgtatcatcttgacttggttctga

SEQ ID NO: 56350 - DNA, 258 bp, Glycine max
  Peptide Sequence Number=SeqID_173128
atggtgatttttagccatggagttgcaacggaagataaagaagaagaggtgagaggagccatgggaggcttcctcgggaagctagaggaagaaagcttccttgagaagctagagggggctacttacacccctccaatagctaagctcacccccatgccaaaatacatgaaaatacaatgggtagcttccttaagaagcaaggaagaaagcttccttgagaaactagaggggtgctactcacacccctccaatagctaa

SEQ ID NO: 56351 - DNA, 381 bp, Glycine max
  Peptide Sequence Number=SeqID_173129
atggttgtgggcgaaactgagggccctccaaagtgtttggcatgggtataccaccaactgcttgcccttcagtggtatatccgaggcaaggctcgaagttggctagattgtggtggggaatttcatgtgcctcccccatgggttgagagacatttcaatgagtatgggagcggagttattgaaatcctcattgggaatgtatgccacattgggtggtgtatagttgggaggccagccatatggtgggaaggcatgcttgttttgaatttgcgcataatggggggccgcccgtacttccctaatctttgcctactgtcataccctaatttcgttcggggacctttccttgatgacatgcgacctttctttggtccttgtgag

SEQ ID NO: 56352 - DNA, 432 bp, Glycine max
  Peptide Sequence Number=SeqID_173130
atggagagcttaaatgacaagatggaagatgagagtgagttttttgtttattcaaaaaggtggcaagggatacaagaagttatcaatcttgttaaagtttatgcttcatgcaatcttgttaataagaggggcatatgggagaaacttgtttcattaaaaagaagtatgggtgagagtctttggtgtgtggtgggaaatttcaatgtcgtgaggagaagggaagaagaagtcaagagatcagagaagggtagtcaacaaggtggaaggaaaatggaagaattaaattcttttattaacaaaatggagttaattgacacacctttggtgggaatgaagtttacttgggtaagagctgggggaaatgccatgagtcggattgacaggattttggtgtcaatggagtggttacaattttggccaaatgctatttaa

SEQ ID NO: 56353 - DNA, 222 bp, Glycine max
  Peptide Sequence Number=SeqID_173131
atggtaatggaagatacaatggatgagatcttagtttcaataggagcaatacatgttgcaaaaaatgtggaatgttattggggaaattcagccaaagcaaaatatgtagaatggatgggaatggacctaaatgaggagaacaagtatgtggtgagggaggtatatgatagcttgatcatggaaggaaatgtggaggatgcagagttctatcaacaaatttga

SEQ ID NO: 56354 - DNA, 495 bp, Glycine max
  Peptide Sequence Number=SeqID_173132
atggaggtgtccttgacacaaaaagatctccgacaaggtaatcccctagcactttttctcttcttggtggtagcagagggtttgagtggtttgattaggaacaacttggtgggcactcatgtggatcaaaggaaagttcttagctttgcaaaaatcttgaattgcacaactatgaccatcccttttatctacttgggattacctgtggaagcggatgcaatgaaggtgagtacatggcaaccaatgattgacaaaatgaagaggaaacttacaccatggagaatgaggcacttgtcatttagagggagaatttccttggtaaaatttgtcctatccttgtattatatttccttctttaaagtcactaagaaagtccttgatatccttaatcaaattcaaaggaacttcctttggggagcaaaaggtgaggaaaacaaggtggcatgggtgaggtgggaggtagtaggctcttctgttaagaatgatgggttatga

SEQ ID NO: 56355 - DNA, 408 bp, Glycine max
  Peptide Sequence Number=SeqID_173133
atgaccggtcctctcgatgagtcgatctcttgctttctcataagggtggacccttggggctacacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttgggtactagttaccctcaccgtcagaggactacacgtcctcgccttgagaggactacacgtcctcaccatcagagggctgcacgcccttacctccagaggactataagtcctcgccttgagagggctacacgccctcaccttgggtactacttaccctcaccgtcagaggactacacgtcctcgccttga

SEQ ID NO: 56356 - DNA, 306 bp, Glycine max
  Peptide Sequence Number=SeqID_173134
atggatccaaagcacctaaactactgtacaccaaccaaatcgccctccatactttcgtcttccccttccctaaccaataacattggtgttggaggaagtgatttttccagtccaaaggttgaacctatgatactcctaaccaactatagcactggcaccaaacctaagaggcaaaaaaatgcacatagtgttcgcctcatgcaccaagatgtttgtcctaacaagattgtccattgttggaagcttgttcttagacaacctgatggaagcttgcttgtgaagcttctatggaggctggatctttga

SEQ ID NO: 56357 - DNA, 581 bp, Glycine max
  Peptide Sequence Number=SeqID_173135
atggaagggttagtggacctagcagcgattcacgctttcctcgcctttcatcatggcaaggaaagcccggtcgacgccattttggccatgtatgacacattcgaccggggaggtgaaaagagtggcgcaagaattgtttgttgtgcactggctctctatgtgtggctggtttcacacctttttctccaagaaggaaggaagaatcgggattctatcttcatacgaaggatgtccaaaggttcccttgatggaacaaggggttgtattaattataatcccgtcctcgccataagacagcttggctacctcatgagaggagtgccatcagacgaaagcatcacacctttcatcgcacggggtttcagtgaccacaacgtgagggacagagagcttaggggaagcagtaatgggagcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcccgagtagtcgaagagaagttcaa

SEQ ID NO: 56358 - DNA, 384 bp, Glycine max
  Peptide Sequence Number=SeqID_173136
atggaaacaactaaatcaactcaacaagcactccaaagtgtagaaatccaggttggtgagctggcagaagcagtaactcaatttatgtccagacgagaaaaatcctttgtagaggctgaagctcaagagaaaagccctgtaaaagagcatgagtcaagagaaaaagataaggagaaaaatgaggaacaagcacaacaacaatgggagaagtactcaacagtagaaaaccaacaagaaaatattctccaaatcaatgaccttcctcatcaaatgattgtcaagaaaggaaggcaaggagagcatgaggaaattttcatggaatttctcgctaaaaggcgaaacttcaaggaagatgtgttctttgtgactttcacgccaccttaa

SEQ ID NO: 56359 - DNA, 939 bp, Glycine max
  Peptide Sequence Number=SeqID_173137
atgaattcttacagagaaacactaatgccacctaaggcgaagaattcctctggtggaggaggaaggtctagcaaaggaacaatactggctctaccagagccaaacaccaaaaaggcatcctcaacattttctgggtcatctacccagaaatcaaagcttgaagagtcatcaactcaggactccccaaaaccaatcaccaccaaacagattgtggcaaactatgtctggtcaatccaaaccctccaagctcttaaagaaatgggcctcaccaaagttctaaggttagccaaaaagacctgggcagaaatggcttcaaaatcagatgatgattctgaaatagaactccaaaaacaaatccaaattgccaagaaaaccaagacggttaacaaccccgaaggcaaacaaacaatgatggagtcagagtattgggacaagaatccctttaaggcaactgcaaaagctttcctgcagggattccattacaagccgacgagcctcaacaaaaccagaaaattctatgagttcatcttagtggatacaaattcagtatccattaaacacttcaaagactccaaagatccaaacccgaatacccattcaaccattcaaatcctaaaaatatgggaagacagaaaacatcaagcaattttcacccctgtaaagacacgcttttgtcaaatgatggactcaattcgacacatcaaaagcaactccagaccaagtcaaaacttgtctcagctagtagcattcttggctagctccaaatccaaagaaagtctggcaaagaatctaaaagaggttctccatctacttcaacaagaagaagaaagtatcacaaagaaggaagttgaatccccagaagaaaatgatgatcaagatgacaatcccttctatcagaatgaggattattgttttggcatctctttagaagatgattaa

SEQ ID NO: 56360 - DNA, 153 bp, Glycine max
  Peptide Sequence Number=SeqID_173138
atggataatgatgatgatatatttcaaggtttggatagggcagcttcattgttgaatggttgttggttcttcacaggcatatttcataacaaatatggagcctatgaaattctgggagttcgtgtcattggtagtgaaaggtcttggatatga

SEQ ID NO: 56361 - DNA, 552 bp, Glycine max
  Peptide Sequence Number=SeqID_173139
atggaaggaaggaaaaaaatgggttcttcttctttcacttctgagctctttggatccaaccagttccagaaatctgctgcttctggaatttttgaatctatgtttcctccaccgtctaaggtgttagggagagagtctctgcgttctgaagtgtgtgagaaaactgccaatgagaggtggagctccaaaattggtattcccgattacatcagcaagggaagtgatggtgaaactcagagcacgacacataaggatatgagttctatctatcaggaacaaagacttcaaccatgtcaacttagctcatcaatccattatggtggccaggacatatgttcttgtcccaagagtacacaagattcaggatacaactctttgctgtacaagaaagatggggttgaagatgatttaggaagtaacctgtggcaaggtaagacggggtccctattattaagatcacacttgccaaaggacatgctccttaaggtatacgagtttcttatagccttagccaaatggtactcaattcctgtaaacaggaggatagtttag

SEQ ID NO: 56362 - DNA, 660 bp, Glycine max
  Peptide Sequence Number=SeqID_173140
atggagggttgtgtgaagaagttgctatgccttgttgggtttgtggtgcttgtgagtactattggtggggtggagagtgctggtgaatgtgggaaatctacaacccctgataatgaggcttataagcttgcaccatgtgcctcagcagcacaagatgagaatgctagtgtttctcagagttgctgtgctcaggtgaagaaaattgggcagaaccctagttgcctctgtgcagttcttctctctaacacagccaaaatggctggcgtcaaccctcaagttgctgtcaccatccccaagcgttgtaacctggctaatcgccctgttggttacaagtgtggaccagtgcgtggcaatttcttggcttccatggagtacaaagatgcaacaatgactaaggttaagaatctatcacggtggcataaactgaaagaacctacattggcggagaccgtgactgcgactgaggggaagaaagaagaagaaggccgtggcgaccgggaaggaggtcacggcggaggaagaagaaagaaacaacgtatgaggatagagggagggggaggggaggagaagagaagaagaaaggtcaggagaggagaaggagaagaaaaagaaaaaggaagtgtaggttgggagaaggaagtgtactttggggtagggtag

SEQ ID NO: 56363 - DNA, 457 bp, Glycine max
  Peptide Sequence Number=SeqID_173141
accagctggtgctgagagaccagtggtccatgttgattctgctaccggtaaggccgacggtccccacaggaagaaattaagaacatatttggggattgtggcacgtgataaggtggacgtgatgtacgagaactggaagaaggcggaatttgaaatcccagaggctcttgacaataggacgaaaaaaaacctcacgaggaaatgggcccttgcagccgatcaggacggtgtggacgacactgtctgtgagaaatatgacataagcaaggaaaaatgggcccagttttgccaaactcgcagagacccttcttgggaggatgtgtggaaaaaggcacaggccatccagaaacagaacactgccccccacgctgagaagatgaagaagaagctggaggaagctgtacagtcaggaagcgttgatggcatgatcgacccttcatcccccgtcagacgccac

SEQ ID NO: 56364 - DNA, 261 bp, Glycine max
  Peptide Sequence Number=SeqID_173142
atggcagctagtcacgaagaggttacccttttgggatttaggggaagtgcattcattagtagggttgtgtttcctgcatggaatgttgtttttaaggttgatgagaaagaatgtgagaaaaatgttgaagaaacatttgaggctctacagtttcatgagaatgaacttaaggacaagaagttctttggaggagaggagtttgggttggtagatattgttgttgtctacatagcattttgggtccctatagttaagaaatag

SEQ ID NO: 56365 - DNA, 669 bp, Glycine max
  Peptide Sequence Number=SeqID_173143
atggcttcaagtcacgaagaggttacccttttgggagcaattgcaagcgcatttgcttgcagggtgaagattgccctcaagttgaagggagttaaatacaaatatgtggaagaaaatttgaggaacaagagtgaactgcttctcaaatccaacccagttcacaagaagattccagtgtttattcacaatgagaagcccatagcagaatcccttgtgattgttgagtacattgatgagacatggaagaacaaccccatcttgccttctgatcttaccaaagagccttggctcgtttctggtccaaattcattgatgacaagtatagtatgtgttagaaagaatatgttagagagtatgttgattgtggatgttgcacgggaatctgttttcacggttgatgagaaagagcgtgagaagaatgttacagaaacgtatgagggtctgcagtttcttgagaatgagctaaaggacaagaagttctttggaggagaagaggttgggttggtagatatagctggtgtctacatagcattttgggtccctttcattcaagaaattgcagggttgaagttattaaccagtgagaaatttcctaagctctacaagtggagtcaagaatttgtgaaccatccagttgtcaaagaaagccttccccctagagacccatga

SEQ ID NO: 56366 - DNA, 456 bp, Glycine max
  Peptide Sequence Number=SeqID_173144
atggaacttatgagactaaaccaacatgaagaaaatgacaagaaaaataaaggaattgaacttcaagcctcatcttctattcaagaagaaagtaacaaagaagacttaaatgaaatagaagaaaatgatgatttcagattttttgtgaagggattcaataaatttcttagaaacaaaggaaatcaaaggagatcaaacttcaattcaaagaagaaaagagaagattcctccttagttccaaaatgctatgaatgcgatctacctgggcacttgagatttgattgtcctatctttaaaagaagaatggaaaaatccgacaagaaaaatttcaaagataagaaagaagagaaagcatacatcacttgggaagatgatgacatggatttatcaagtgattcagaaattgaaatcataaatctaggcctcatggccaaagattatgaaagcggagaagag

SEQ ID NO: 56367 - DNA, 531 bp, Glycine max
  Peptide Sequence Number=SeqID_173145
gatggtattcattactctgaggtgcaaaatattcccattgttattgatcagtccttattcttttccttgactaaattgcccattcaaggtgttccttttgagggcacgcttgttgatgactggaaatttgattattctagtcttgatgcttgccgcatggtctgcaatgaccaggctgacatgaccggcagattacttgttggatcgactacccatttagttcagtaccagatgcataaggcattatgggccaatgcacctctcccttatcctcaccttgtcactctttttcttcatcatttcaatattcctttggatgatgaaccatttgtcaaggtcaaacgatctttctctattggtgctagtgtggttacctcctttggttactggaaagatgtcgatggtcagtgggttcataaacaaaacttgcctctgtctattcttggtgaacgtaccccatctcctccaccacaaagggctgattcctcttcagttctgaccgaattcctcacaaaactccatggtctttga

SEQ ID NO: 56368 - DNA, 885 bp, Glycine max
  Peptide Sequence Number=SeqID_173146
atggattacaccaaaattatcaaagaaataggccgcggcaaaaaccatgcgcgcgacctggatcggcagaccgcctttgagctgtatcaggcgatgctggccggggaggtccccgagctggagctgggcggcattctgatcgcgctgcgcatcaagggcgaagccgaagaggagatgctgggcttctaccaggcgatgcagcagcaggtgttgccgctgcaggcgccgcaggggcggccgctgccggtggtgctgccgagctataacggcgcgcgcaagcaggccaacctgacgccgctgctggcgctgctgctcgcgaaagtgggcctgccggtggtggtgcacggcgtgctggacgacagcacccgcgtgaccagcgccgagattttccgcgccctggggctgccgtggtcggaacaggccgttcacgcccagcagcgtctcgataacggcgaggcagtgttcatgccggtttccacgctgtcggcgccgctggcgcggcagctcgggctgcgttggcgcatgggggtgcgcaacagcgcccatacgttggccaagctggcgacgccgttcggcgaacaggatgcgctgcgcctcgccagcgtctcacacccagagtatgtcggccgggtggcgtcgtttttccgccagatcggcgcccgcgggctgttgatgcacggcaccgaaggcgaagcctacgccaacccgctgcgctgcccgcagattcactatattgccggcggcgaacagcgcgtgttgctggagcgcaccttgcaggatgaaacgccgacgttgccggcggcgaaagacgcggaaaccaccgcgcgctggaccgagcgctgcctggcgggcgaggtggcgatcccgcaggccatccagcggcag

SEQ ID NO: 56369 - DNA, 474 bp, Glycine max
  Peptide Sequence Number=SeqID_173147
atgtgcaaatctgcagcatgtgattatgttgacaatttgtcacatgggtcagcgcttgaagtgctgccaaaagctaagaatggggtgtggagagtgaagttgttgattgacccgagacaacttgaggaaattttatctaagcaagtgaatactgaagcgctgattgagaagatgaggatggctgcgcaacttcatgttctactactactctttctccttcaaggagcccaagcccaactacaagttctaagaaaaaaagcatttagtatgctagctaagttttctctaacaaatattgggtctatatatcatactttgacaagaccttcagtctccaaaaattcagtcatatcatggtggactaggctatccatactcccaggtgcagaagcagccttgtccttaaggctaaaacaaggaaattgtcctttgataacatctgcatcttccctagtagctttaatgattggttga

SEQ ID NO: 56370 - DNA, 366 bp, Glycine max
  Peptide Sequence Number=SeqID_173148
atgtactatcagcagcacacagattctcaagttgttgataatctcattggtgtcatctttgctgcacatgacaccacaacaagtgctctaacatgggtcctcaagtacttgcacgataacaccaatctattggaagctgtgacggtgatccaagaaacattgagaagtgcaagcattttgtcattcacattcaaagaagcagtgacagatgttgagttggaaggttacactattccaaaaggttggaaggtccttccactcttcagaagcattcatcattctactgacttcttccctcagtcagagaagtttgacccttcaagattcgagaaattaaggctgagacatataaccacgagcaaataa

SEQ ID NO: 56371 - DNA, 363 bp, Glycine max
  Peptide Sequence Number=SeqID_173149
atgacttctaccaacaaatgctcgatgctgataggagagctaagaagtggatcttcaagactgatagatcttaatgactatattcgtaaccttcataagaaagggttgcttgatgccctcagcttttgtgagtattgtcttttcatgagtgagttgttagtgactgctttttgtagaccaagttcaaataattattttttcacccaagctgtagccccaccaaaggtggaggtctgggctttaagccccaacttcccagttgaaaaggaagccttcctaccaattatgcctaacaaaaatggctccttttcctttaaaggaaaatataatgaagtaactaatgtcattgccaatgtcgtctaa

SEQ ID NO: 56372 - DNA, 372 bp, Glycine max
  Peptide Sequence Number=SeqID_173150
atggaggatgaccaaggaacagaaagaacagggtctaaagttgacatttttagaaccataacacaatggaacttcaaaggcagctggaaggggaaccttggcaacattcaaaaccataccaaactgatagagaaggagaatacgggatcaacagaggccatttctgatcaaggagaagaagccctaatggagaaagagaagggaacgcaagggctggaacaatcaagttgtcaataccggaaaacagggattgaaatgtgcccaaaaggagacaacaaagctgttaaaactgggtgcacagtgccggaagaagccatttctgaccaaagaaacgaaaccctaatagagaaaaaggaggaaacacgaggctga

SEQ ID NO: 56373 - DNA, 224 bp, Glycine max
  Peptide Sequence Number=SeqID_173151
atggagaaccagatgggcaagttcatttaccttagaatagaaatgaagggaatcaaaatgaagagacttgctctccaaatgaagttatggaagaggcaaatacagacactgacttcgagccgggaagttcctcgacgtcgtggggttgaatggaaggagaagaggctagggtatgttgctggattgtcaaagattgaagggttcaatggtgaacaacgaagagg

SEQ ID NO: 56374 - DNA, 762 bp, Glycine max
  Peptide Sequence Number=SeqID_173152
tctcggccaaaagacactgacatcttcgggaagggtacagacgctaacatctccggaaagggtgcatgtggtgacgttattcacttcttgctgtcgtgctttgattcttacggataccaaatgagactttttcgtagtgtcggatcgaaagacgctcacatctccggaaagggtgcagacgctgacaactccgagaatggtgcagaagacgctgacatctccgtaaagggtgctgacgctgacatcttcgggaagggtacagacgctaacatctccggaaagggtgcaggtggtgacgttattcactgcttgctgtcgtgctttgattcttacggataccagatgagactttttcgtagtgtcgatcggaagacgctgacatctctggaaagggtgcagccggaagacgctgagatctccgggaagcgtgcagcaaatgcgactttttcgttgtgtcggatgaaagatgctcacatctccggaaagggtgcagacgctgacaactccgagaatggtgcagaagacgctgacatctccgtaaagggtgctgacactgacatcttcgggaagggtacagacgctaacatctccggaaagggtgcaggtggtgatgttattcactgcttgctgtcgtgctttgattcttacggataccagatgagactttttcgtagtgtcgatcggaagacgctgacatctctggaaagggtgcagtctcggccgaaagacgctgacatcttcgggaagggtgcaggttacgac

SEQ ID NO: 56375 - DNA, 258 bp, Glycine max
  Peptide Sequence Number=SeqID_173153
atgagctcacccaggcgagttggtttcttcaccatgaagttatttagtggcccaagcaagccagaggctagcctggtcgcgggaagtgatgacaaatcaccaaatccactgcataggctcacaactcaaatgaaaaatcgttatgctacaaacaatggaaccacgtctactttggaatccgatgctattcaaaaaattgctaaccatcttgatctttccttgatgtcagaagatgagaaattgaacaagtctttctag

SEQ ID NO: 56376 - DNA, 411 bp, Glycine max
  Peptide Sequence Number=SeqID_173154
atgccccagactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagaatcaatgagcccggtattgttatttattgtcactacctccccgtgtcaggattgggtaatttgcgctcctgctgccttccttggatgtggtagccgtttctcaggctccctctccggaatcgaaccctaa

SEQ ID NO: 56377 - DNA, 378 bp, Glycine max
  Peptide Sequence Number=SeqID_173155
atggatccgaagctaaaagaggtttctcagctcttcgatcgctttaaggcttcgtttatcaggaacgactttgatacctgttccaatctcctttctcagctaaaggtaaaatctataatggaacatattacagctggaagttggatgattgatttactagttacccaccctagctcaatgatagaagggatggtgttacttacaggtttcagaagccttccaccgttgtttgcagatacacctaatgcagttcatgaattaacaatagcaagggatatatacgagcatgctgttgtccttagtgtgaaaaatgaggatcaagatgcttttgaaagggatttcttccagttgaagccttattatacagatgcctggtaa

SEQ ID NO: 56378 - DNA, 207 bp, Glycine max
  Peptide Sequence Number=SeqID_173156
atgccttggatgagaacaccgcattgttgtgcgcacctccacccaaacaacaacgccaagcaacccatgagatctagaacttcacaaacactcacggtggtccatgacacagcgaagctcctccggcaagacgacagatccaagcgtcgtttggactgcgctgttgagctcatcggcgaagatcttgctgtcgttgttggcatctaa

SEQ ID NO: 56379 - DNA, 657 bp, Glycine max
  Peptide Sequence Number=SeqID_173157
atggaaaaggagcctctgctcccatacttcagccccagaaagaagcctcaactatgtcccttgccagagcacgacgaaatcgttcttccaatgaccccttcagaattcaaggaccgtctcatctttggtccttctccttcctctgcttccccaagggacccttcacctcttgctgatgccttaacactttctcacaattccccaaaatgttcctcttctaactcacaggactatgcatcatcaccactatttgattcccaacaaaaacaacaacaactcaactcttggctccttgaccccaattacgagtcgtggcggaaaacgaaccttcatcggtcgaaaaccgcgccggccatggccgtgatcagcgatttcaatccccactccaccgtgcaaagacccaaatttgccagccagagtattgtgtgccagggtgttattcttcttgctctttatttggcattaggggttgtcatttattggttcaatcgtcataattttacagctactgagactcatcctatagttgatgcattgtatttttgtatagtgacaatgtgcacaatagggtacggtgatatcactcccaatagagaatcatatgttgacggcagtgaagggaaaggaggggtgagaaggatgggaagtcttatataa

SEQ ID NO: 56380 - DNA, 333 bp, Glycine max
  Peptide Sequence Number=SeqID_173158
atggctgatcctgagttggaagcaatcagacagagaaggttgcaggagcttatggctggccatggtggcgtgggaaatcaacagaactctgaacaggagaaagctcaggatgatgcaaagagggaggctgaggaacggagacagatgatgcttagtcagatattgtctgctgaagcgcgagaaaggcttgctcgaatagctttggtgaaacctgagaaagcaaggggtgttgaagattttatattgagagctgctcagatgggtcagataactgaaaagattggtgaagttctagttgtaccatttatttgttcgaagttagaacatcaataa

SEQ ID NO: 56381 - DNA, 105 bp, Glycine max
  Peptide Sequence Number=SeqID_173159
atggagataggggttcaaaacccactagaagcaccttatggtcagatcctagccgctaatacccaagtggagactactcctgcaccacaccctaagaaagcttaa

SEQ ID NO: 56382 - DNA, 282 bp, Glycine max
  Peptide Sequence Number=SeqID_173160
atggaaaatctgatgttgtgctttgcttttcttgactgctcatcatctatggcttttgctgaatatacggagttttggacatgcagtaaatcggaatatgttatatacaagctcaaggagatgggaaaagtatctgagaaggacatcatgcagtgttgccaatttgagaagggagtgtcagattctcaagttgatgggaactttcttcttctggggattgggagggatatcaggttgtcaaagacgcaagctggtgattttccccttaccctcttgtcatga

SEQ ID NO: 56383 - DNA, 333 bp, Glycine max
  Peptide Sequence Number=SeqID_173161
gccgtagaagcaccgccaccacctcatcaggctgatcctgctgggtcattaggcatggagcggtatctacagcaggcggccaaccaccgggggcaggtgcaaatacatgagtgtctctaccagcttagcctcagtcagcaaggccagagtttcgttccttttgggtgctctactcttgatcagtttagggctgaggtcggatggcccagagattggcccgaggtccaggcaggggaggcgcctgcagaggctcccggcgatgcagaggaggcacgcatggatgaggagatgacagatttgctcggtttcttgggagggagcggagccacatga

SEQ ID NO: 56384 - DNA, 237 bp, Glycine max
  Peptide Sequence Number=SeqID_173162
atggagagttgttggtttggtgagtttagcaatgtcaccatgcttttgtgttacctttgtttttggacggaggaggaaggaggagggtatggtggtggtggttggggattacccgtgccagaggtgttgccaaagtcaccgttggaagatggagggacagaaaagaagacatgttttgatgaggcagggtccatgatattattacatatgcgcctttataaatctaatgactcttaa

SEQ ID NO: 56385 - DNA, 1077 bp, Glycine max
  Peptide Sequence Number=SeqID_173163
atgtctgttgaacctaaggaactttactaccaggaccttgtcctagaccccaatattaataatcaacatcagggcacagaagcaggatctaataatactatgtacgaaaagcacttttcctctaccataattccttcagattcaacagcatatgattcatcacaagcctttgatccctcttacatgagtttaactgagtgtttgcaagggggcatggactacaattcacttgcaacttcttttggcctttctccttcctcgtctgaggttttttcttctgttgatgggaaccaaaagccagcagtagaaggaggagatggaggtggtggtggtggtggcagtgaaacccttgcgacccttaactcttcagtctcttcttcatcttctgaagccggggctgaggaagattctggaaagagcaaaaaagaaaggcaggtgaaaacagaagaaggagaagaaaactctaagaaagggaacaaggagaagaagaaaggagagaagaagcaaaaggagccaaggtttgccttcatgaccaagagtgaggttgatcaccttgaagatggatacagatggagaaaatatggacagaaagctgtcaagaatagcccttacccaaggagctactacaggtgcacaacacagaagtgcacagtgaagaaacgcgtggagaggtcatttcaggacccaaccactgtgataacaacgtatgaaggtcagcacaaccatccggtccccacttctctcagagggaatgcggctgcgggaatgttcacaccttcttctttgctagccacaccaactccacttgcagccgggtcaaacttcccccaagatctcttccttcacatgcatcaccctcaccaccaatatcacattcacaacaacctcttcaccacacagtcgactacaaacactactactgctactactaccactccatcctcgttttactcttcctataacaacattaacaactctcttcttcacaaccagtttcttcctccggaatacggcctccttcaagacatagtcccttccatgttccacaacaagaccggccaccatcaccagaattaa

SEQ ID NO: 56386 - DNA, 132 bp, Glycine max
  Peptide Sequence Number=SeqID_173164
atgccagccgacgtcggccaggaaaagatgacagatcgaggtctcaagaagaagcatgaccggatgactccgatcgaacatttccaaatcgacatcgtccaaaggaagcttcttttgttcggtatcgcctaa

SEQ ID NO: 56387 - DNA, 357 bp, Glycine max
  Peptide Sequence Number=SeqID_173165
atgagtacctcatcctccaccgcttcaaccagaatcagatatccaattgtgagaccacctgcaatcatgcaattcagagtagctttccacaataaccagagatacctccattttatcatcaacaatgggcacccaattacccacacgaagttcggttcaaatacaatggagcaacctacccaatacgggtccaacaacactgaggaagatatttttttgcagatggactctcagaggaagaatgcacctcctctgcaatgggacgtcgttacacctgaccgcggcattaaagataaaagtatcgtctggccatggtacaagtttctcaaggaaaacgatttccatcacggagacgag

SEQ ID NO: 56388 - DNA, 270 bp, Glycine max
  Peptide Sequence Number=SeqID_173166
atgaagtctaaactgatggtggtggagctcgcttcttgtatgcgaggtaaaactccagcaggggatttagctccaatggatttggagattgaagttacttgcaggagaaacaacgcagaaaagaggaagagagcgctacaagagaggatagtgagtccaagtagcgagagaactctttcatctgaatcatcatcatcatttccaacaaatttgagaaagttcgaagttggtgaatccgaagctaacattatggcagacaatcaaccgtag

SEQ ID NO: 56389 - DNA, 414 bp, Glycine max
  Peptide Sequence Number=SeqID_173167
atggctggacttttgaatggcgtcgtagactatttgagtgggagaatgtattgttggaagaccttaagactcatcttcaaagttttgctctacaacaagagaactcagatacatgggagtggaaacaagttgaccaagagaggtgtcattttccagaatatagattactcttgcgcattctaccgcgcaactataggagatagcaaccatctctttttgagttgtgcattcacaaaaatcatttggaagattgtgtttagatggctaggtattgactttgtagaatcattgacaggatacgagtgttatcttagcaatggcttctctacaaaaatggcactaagtcagggactatatttcttcgtggtgcatgaacctgttgatgtgttactaagaaggaaaagacctttttga

SEQ ID NO: 56390 - DNA, 258 bp, Glycine max
  Peptide Sequence Number=SeqID_173168
atggcacaggtggcttggcccggagtcccacctttctttttgggggcaggtgaggctcttgtggcccaggagccatacatacaggttcctgaagatcctgaagacactctagttgaagcagctgcggatgataccccagaagcaaaggcggaagctgaggagacacttgtagatacaccgatggaggcggctgaggagggaggcacaacagaggcaggcattgacgaggactatgtagtatatgtcactgcggcatag

SEQ ID NO: 56391 - DNA, 342 bp, Glycine max
  Peptide Sequence Number=SeqID_173169
atggcctcaaagaagagacgtgcttcatcctctagacctcacgagccctatgacacatccagatttgtgtctgaggtcgcatgggagagaaatatggagatagcttactcccattatgacgagttcctccaagagctggagaggcgccagtggcacaggaacttgacaaggcaaatggagaatcacattgaccttgccttgataatgcaaagtgaaggggaagatgatcaaattcgacgccgcaacactaaatgccttcttggagacctcggtggtactagagcctggggagagggggcgccgtggaagttattgaggaaggacctgaccactctcgcatag

SEQ ID NO: 56392 - DNA, 291 bp, Glycine max
  Peptide Sequence Number=SeqID_173170
atggagcataaagcatattgggctttgaagttcctaaattttgatgcgggtctatcaagggagaaaaggaagctgcaactactggagttggaggagatgagactgaatgcatatgaatcctccaggctatacaagcaaaaggaagtaaagccatacggatcagtggagttaatggatcctcagtcaacaactcctgagagaagttggactgtgaatgggaaaagattgaagttgtatcatggtgggaacattgagagattgaccaccatcttgcacttacaggacccttag

SEQ ID NO: 56393 - DNA, 279 bp, Glycine max
  Peptide Sequence Number=SeqID_173171
atggcatcagtgctatacatagaagggccagctggagctagagtcggtgctgaaagtggaggggctggtgctggtgtgagagctggaactgaagctaaagctgaagcgtctgaaggggccctggccttgcgggacccaggaaatgccaggttagtggtcaggctgagagactcgaaggtaagtgaattagacacaacctctttggctatgcatagggctgtgataagagcagggaagcccaacctagaggcgttggactgggccatctgggagatctga

SEQ ID NO: 56394 - DNA, 159 bp, Glycine max
  Peptide Sequence Number=SeqID_173172
atgaagattaacaagagagggaaagaagataacttacttggaattgcaggaatagagcggaaaatgcaagtgcgtagatatgcgcttagtgagttctgcagctctgattggtctgcaacttccgctaagcgggtcatggctcgctcaacggataaatga

SEQ ID NO: 56395 - DNA, 243 bp, Glycine max
  Peptide Sequence Number=SeqID_173173
atgaagaatggaaatgagaaaggttgtggtccacatttagtgttagttactgatactaatgagtacaatgtcgtttcaattcaggaagaagctgagatcgttaggggaatcaaaagaagaaaatttcaagtgctttggagaaaattgatgcaaaaacatgaagaaaaagtcttgaagaaaaagttgaagattaggacagctcgcttagcatgcaagacaggcccagtgcatctcctcgcttag

SEQ ID NO: 56396 - DNA, 345 bp, Glycine max
  Peptide Sequence Number=SeqID_173174
atgacattttccatgggtagctttaaacaagtttcaccggcctctagagctagcaaccccttttgtaacaacatacgtggtagtaggcaacctaccggtggtgatgcgttactcgagatgaggcttcacgatagtcaggaaagtccaaggcccattgtgacactcgttagagctccactccctatggcccactcagacccaggcgtgggtgaaatgtgtgagtggagcaacctagatgactatgcaaccctacttgcaaaacaaccagaaaattcccagacaagtacaacaggtgtcatccaccctaggattcaataccaattatttctacccacaaagcaataa

SEQ ID NO: 56397 - DNA, 276 bp, Glycine max
  Peptide Sequence Number=SeqID_173175
atggacgaagctaaggagaatatccaacatgaattgaattatgagaaaagaaggatggtgcaagatcctgatgcactaactttgattaatattcaaatggaagatttcaagaatcaaaggaagttctttggtgatccaatgtccattagggaagttggtaggaaacctccagcagaatggtgggagacttatggagatgaccatccagagctccaaaagactaattcaaaattggttaaccaaatgcttgaagatattccatctaatggtgaatag

SEQ ID NO: 56398 - DNA, 561 bp, Glycine max
  Peptide Sequence Number=SeqID_173176
atgtggaacattgttcttactttgcaggaaagtttgatgaagaaatcaacctttggaatagatgagagggatgaggaagacgtggaagttggtgaaaaaaggaaaaacactgaagcacatataaatattgcaaggttctactaccttcatgccattccattcaatgtggcaaagagtaaagtatttgccaaaatgattgaatcaatagcaaaacacggctcgggacttaagaagtgttcttaccatgacattagggtgaagtacttgaaagaagaggttaagtctagaaatacatatttggaagcacatagatccacatggaagaaaacaagtctgaaaggcacaatgtttttgaagtccattgatgcatctattatatcaaagacaacaaataagatatttgagatgatggatgatattgttgaagatgtaggcaaagagaacattgtccaagttgtgacgaggaatgctgcaaattacaaagctgctagtagaatgttgatggggaaaaaaggacaaggttttattggactacttgtgcagcacactgtattgatttga

SEQ ID NO: 56399 - DNA, 219 bp, Glycine max
  Peptide Sequence Number=SeqID_173177
atggctgagtctcctcagaagcaggtgaagaggatggagatggttgtggggtctgatctggagtggtctcctcctctactgctgttgctggtgatggtgctggtgttggtggctactcagtcacaggctcctaggctgcagaggccccaccccctccaaaggaatagggttggtctcctagccaggccacctgagcatcaaactcctccatgtttataa

SEQ ID NO: 56400 - DNA, 273 bp, Glycine max
  Peptide Sequence Number=SeqID_173178
atggctgcttctggatatgatggaagtgaaaatgttgatcagcatgactttgtccaagtgttgtgtctagtcaagatgtatcactttgatgatgcttgtgtgtgtttcactaaggatgtcgacaactatgctttcatcaacaagttgaagaacctgccaaccatctttcatgaaaccacttataatctcaccataatagatgaacaagacttcatagatcatgtgactaagctccatgatgcccagaaggcagaacttacaaatatggaataa

SEQ ID NO: 56401 - DNA, 420 bp, Glycine max
  Peptide Sequence Number=SeqID_173179
atgcctaccatgatgatgggttctgcagctacatttgtagactgtgatgaatgctggacattactgctggtgacaagaaaaggatccctgtacttgtgggatttattcaaccgaacctgtcttcttcaagattcgttgacttctctagttgcttcaagtcctaactcgtctggaactattaaagttatatctgtgaaactatcaaaatcgggttcccctcttgttgtgttggctactcgccatgctttcttatttgacatgaatgtcaagtgttggctgagggttgcagatgatttctttcctgcatcaaatttttccagctcatggagtttgggttcgattcaaagcggtgagctggcagcactgcagcttgtagttggtcttggtcctcgatttgaaatgttgttggataccatatga

SEQ ID NO: 56402 - DNA, 285 bp, Glycine max
  Peptide Sequence Number=SeqID_173180
atgaaatcaagaaaggaaaatgttattccttccatctggtgggtgttgcttctaatattggtggtttcaagactaaccaccatccttacaaactcatatttcgatttagcaccaagggtgaggatagagtgtactctattcagagaatatgttgacaagttgaatgcttccttgcttctagagaaggttaatggcttgatttgttttgggagtgtcgggtatgtgatcttaggttctgatttaatttatctcgacaacatgaggctaaaggaaacaatggtgtga

SEQ ID NO: 56403 - DNA, 222 bp, Glycine max
  Peptide Sequence Number=SeqID_173181
atggaaatgggagagtacgttgaagaagaaaaggatggagtgaagtgcggaggagtacaaagaagggaaacagaaatgtcaggtctttgtactgtactggttggattggaatggggagagagagagaggtcaaaggtactgagttgtgattggtggagagggttcttgcgggcgctgagaccacacgatagatacaaacaagcaggaggagagagaaattaa

SEQ ID NO: 56404 - DNA, 433 bp, Glycine max
  Peptide Sequence Number=SeqID_173182
atgacgaaagctgcacattttgtgtttacaaatggcaagccaatatctttacgtgaacaagtagcagtggcactgagaagactgggatctggtgagtcactggtcacaattggtgattcatttggcctaaaccactcaactgtttctcaagtaacctggcgatttgtggaatccatggaagaaaggggtcttcatcatctgcgatggccttcaacagaagtggaaatgaatgcaatcaaatccaaatttgagaaaatacgtggcttgcctaattgctgcggtgtaattgatgctactaacatcacaatgtgtttaccagcatctgaaccttactgtaatgtgtggcttgatcacaagaagaatcatagcatggtcttgcaagcaatagtggatcctgacatgaggttcagggacatagtcactggttggccgg

SEQ ID NO: 56405 - DNA, 2340 bp, Glycine max
  Peptide Sequence Number=SeqID_173183
atggagtcagtggttcttccactagagctgatacaactgttcaggagtttagattttcccactcaacaagagtatgaggcttggttgaggagaaatttgaaggttcttgaagcaggactcctcttgcatcctcaccttcccttagataagtcggacccttctgcacagagcctccagcacataatccacagagcatttgagaaacccatggatattggaaagaacggtgaatcaatgcaaacctttcgaactgttgttatgtctcttgcttgcagatcatctgatgggtctatttctgagacatgccattgggctgatggttttccactgaacctctggatctaccaaactcttttagaagcttgttttgatcttcatgcagaatcttctgtgatagaagaggttgatgaggtcttagaactcattaagaagacctgggttatgcttggaatcaatgagatgctgcataatatttgtttcgcatggatcttatttcatcggtatgttgtcactggccaagtggagaatgaccttctgtttgcatccagtaatctattggcagaagttgggaaagatactggaggctcaaaagatcctatttactcaaaaattttgaggaacacgttgagtttgatattaagttgggcagagaaaggtctcctagcataccatcatactttccataatgtattatcagcaaagatattagaagatatctctcatgactacaatcggaagaaaaaagatgatgtggactacactagaaaattggagaaactggatctcagcaagcatccatctagaaaacagaataaagcctttcccattctttctgtccttgcacgagatattattgaactggctattaatgagaaagcaatatttagtcccaaacttaagagatggcatcctcttgctactggtgttgctgttgctaccctccatgtgtgttatggaaatgagttgaagaagtatgttaagggtattaatgagttgacacctgatgctatagaagtgctgatagctgctgacaaattggagaaagatctggtgcagatagcagtggaagattctgttgacagtgaagatggtggaaaatccattataagggagatgcaaccttacgaggctgaagctgttattgctaccctggttaagtcatggataaatattagagtagatagattgggggaatgggttgacagaaatgtgcgacaagaggtatggaatcctggggaaaataaagagggttttgctccttctgctgttgaagttctacgaatcatagatgacactctggaggctttctttctgttacctatacccatgcatgcagatttgcttcctgaattgatgtctggtctcgacaaatctctgcaacagtacattttgaaagccacatctggctgtggtagccgtagtagcttcatcccaactttgcctgcattgactaggtgttcaacaacatcaaaaactggtgtatttaagaaaaaagaaaagtcacaagtgactcagaggaggaaagcccatgtcggaaccactattggagacaactcaattgatataacccagatgtgtgttcgcatcaatactatgcagcgcattcgcatggaattaggggttttggaaaagaggatagttgccaatctcagcagttctagatccactaatgcggatatagcaaatggggtgagcttgaagttcaagctttccgcatctgctgctgtggaaggcatccatcaactctgcgagtgcatagcatacaaaatcgttttccatgaactctggcatgttatttgggatggcctttatgttggagaagttgcatctgctaggattgagccttttcttcaggagcttgagcaatacttggagattgtatcatctacagtgcatgataaagttagaacacgtgtaattgttaaagtaatgcaggcttcttttgatgggtttctgttggttttgttagccggaggtccatcacgtgctttctctctgcaagattctgttattatagaggaagatttcaagtttctgactggcttgttctggtccaatggagatggattgccagctgaattgatagaaaagcattctaccactgtcaaaggtgtacttcccttgtttcgtgctgatactgagcacataattcagcagttcagtcaacttactatggaaatgtacggttctacagccaaatcccggcttccattgcctccaacagcagatcaatggagtccaacagaaccgaacacacttttgcgagtcttgtgtaataggaatgatgaggcagctgcaaagttccttaagaagaattacaacttacctaagaagctctaa

SEQ ID NO: 56406 - DNA, 2199 bp, Glycine max
  Peptide Sequence Number=SeqID_173184
gttataaagtatgagagtgttatccacgagtttgatccttatttcaactatagagtcacccagtttttgacaaagaatgggatatacgatttctggaactggtttgatgatcgaacttggtatcccctcggtcgtgtaattggtgggactgtctatcctggtttgacgttgacagcaggcaccttatggtgggtactgaattccctaaacatacctctctcagttgaaactgtttgtgtgtttactgcacctatattctcagcctttgcttcatgggcaacttatcttctgacaaaggaggttaagggtgcgggggctggcttgacagcagcagttcttctggctatggtcccttcatatatatctcgatcagtggctggcagctacgacaatgaagctgttgctatatttgctttgatattcactttctatctctatattaagacactcaatacagggtccctcttttatgccactttgaattccatagcatacttttacatggtttgctcatggggagggtacacttttatcattaatcttattccgatgcatgtactcttgtgcatagtaaccggtcgctattcttctcgactgtacattgcatatgcacctcttgttgtattgggaacattgttggctgccttggtgcctgtggttgggtttaatgctgtaatgacatcagagcattttgcatcatttctggttttcattatcatccatgtagtggctcttgtgcactatatcaaaggaattctttcaccaaaaatgttcaaagtagctgtggcactagttgtttctgttggccttgcagtgtgttgtgcaatggtggcagtacttgtagcattggtagcttcaagcccaacaaaaggatggagtggaagaagtttaagtctgcttgatcctacttatgcaagcaagtatataccaatcattgctagtgttagtgagcatcagccacctacttggccttcatactttatggatatcaatgtcttggcattcctcgttccagctggcattattgcatgcttttctcccctatctgatgcaagctcctttgtggtactttatattgttacgtcggtatacttttctggagtcatggttcgcttgatgcttgtacttgctccagcagcatgtatcttgtctgggattgctctttctcaggcttttgatgttttcacaagatctattaagttgcagttgcccagcctattgggtcattctcacgttgatgcaggggaagccagttctgaaagtgttgtgacaaatgattcgatgaagtctgataaaagtgaggacacatcaaaggaacgaacctcaaagaagagcaagaagaaggaaaaggaacctgtggaaaagcctccgagcaagtcacaaattaagaaaaggcttttggttttacctctggaaacatccatcattgctattgtcttgcttgtgttgctaggtgccttctatgtggttcatagtgtatgggcagcagcagaagcttattcagccccttctattgttctaacatcacattcacatgatggacttcatgtttttgacgattttagagaggcttatgcttggctgagtcataatacagaaatagatgataaagtggcttcttggtgggactatggctaccagacaactgccatggctaaccgaactgtcattgttgataataatacctggaataacacacatattgctactgttggtactgccatgtcttccccagagaaggcagcttgggaaattttccactcattggatgtcaaatatgttcttgttgtctttggaggactggttggctatcccagtgatgatatcaataagttcttgtggatggttcgtattggagggggtgtattccctcacataaaggaaccagattatttaagggacggtcaatatcggattgattccatggccacaccaacaatgctaaactgcctcatgtataaactttcatattacagatttgtggagactgatggtaaagctttcgatagagtgaggcggactgaaattgggaagaaatatttcaaacttacgcattttgaggagtgttattctgctttgttccttactaatctaccatgtgtttccttactaatgcattcaggtgttcacaactcaccattggatggttcggatttacaagttgaaaccaccaaagaaccggattcgaggaaagattaa

SEQ ID NO: 56407 - DNA, 315 bp, Glycine max
  Peptide Sequence Number=SeqID_173185
atgaaaatgttcaagcctaaggtttcgaaacttcaccataacctctctccagcttcttctcacgtttcatgtctttgcaataatggaggtttcgaaaccttgccgaggttccactttcctcaccctaatggcgagtttgcattatattctgtcatctctcatcgcgacgcattacattctatattttcttgggttttcttttgtgttgcaaacggttttcactgtttgggttgtggggatttagagatagatggaagggaaaggaggatgggaacaaaggagatgttcaagaaacagaggtgggaacaatgctga

SEQ ID NO: 56408 - DNA, 318 bp, Glycine max
  Peptide Sequence Number=SeqID_173186
atgagtccaatcaaggatggtgtggtgagggttagggctagggtttggggcttgacggagggacgcgtggtagatgttggggattgtgatcacaagcggtttgtcgttgtaggatttggtctcgatggtgtagagggcaaggaagatggcttcaaaccttgcaagggacggtggcttcgaggagtggaggcaggagagatggatgggacgaaggagaggactaccaggcggaggtgggggccagaggagaggaaggtggttagggttttcaaacatagctgtaatcaaatgagagtgagagtgaaagggatagagtaa

SEQ ID NO: 56409 - DNA, 210 bp, Glycine max
  Peptide Sequence Number=SeqID_173187
atgaggagaaatgcttacggagaagagacggatcgagaaggccagaacgccgatgaggagaaggatgaagaacgcgaggacgttgccgaaggcgtgcctgatggagttggtggtggtgccgttaagtcgttgctggagccgaggggggagctaggctgtgttagcttgcggagactgaaaagacgatattgggtctggttttgtggttaa

SEQ ID NO: 56410 - DNA, 129 bp, Glycine max
  Peptide Sequence Number=SeqID_173188
gatgtgtctgccaaagcaaacaccaatggagctgcactgagtgttgattgtagaacatctagtggttctgacattacattgtcaagttctgatgccagttctggacttgatattgctttctacatttag

SEQ ID NO: 56411 - DNA, 324 bp, Glycine max
  Peptide Sequence Number=SeqID_173189
atgaagttgaagaagcttgttcttgctggaaactatcttactggtagaattccaaatgctttttatgggttaaatgagttattaatctttcagttattaatctttgagttaagtagcagttcattatctagctctttgcctttgacacttgggaggttaacttcagcgttgaagcttgatgtcagcaacaaccaccttgaagggaatcttctaaatgaatttgctaatcttaacaatctgacccttatggaccttaggaataataggttcactggaggcttgacccttatgccaccactacacaaggctttgctctctagttga

SEQ ID NO: 56412 - DNA, 186 bp, Glycine max
  Peptide Sequence Number=SeqID_173190
atggggggggtctatttttttattacaaagcgcccccagacaggcgcctccactgtgcacgtgacacgtggcacggacgcggcgcacgaaggagcagcaggtagcgcccctgacgcgggcgcatctgctagtgccctgggtgcgactggtggcgcccctactacaggcgcgaccccaggcgcctag

SEQ ID NO: 56413 - DNA, 327 bp, Glycine max
  Peptide Sequence Number=SeqID_173191
atgacgacgttagtctttgcatgctaccggactctgagtctgacagatagcgaaagagtgtgtgcgggttaccatatagggagcctccgtgtgccaacggacttacaggtcacgatagtgaaaggtggggcagtcgacaaaagcgaggcttttgctcctatgtatcctcaatttgtgatgaggaactcagacctacgtagttcctgcgaaagcagtatgatcacattggtctctacttgtcaatcggacttaggatctccgaatgatgtggtgcggataatcgtaaggtgtctccgcatgctaccggactctcgcgtcgttggataa

SEQ ID NO: 56414 - DNA, 411 bp, Glycine max
  Peptide Sequence Number=SeqID_173192
atggcttgggccatccctggaggaggaagggatcggtttaggagggattatccttcaaggcatgaggataatagggggaatgggattagtggacgtgacaaccgcaacagcaacagcaacaaccctccttccaggcatctttgggttgggaatctatcccacaatattgtagaggaagaacttgctcaccatttcttgaggtacggaccactggagaatgtggcattccagcccggccgcagctatgctttcataaatttcagaatggatgaggatgctattgatgccttgagagcactgcaaggctttcctcttgctggcaacccacttagaatcgagtttgcaaaggcgctgctccagaatatgcaccttactgttaagaagagcatggccaaaagttacttcctttaa

SEQ ID NO: 56415 - DNA, 2322 bp, Glycine max
  Peptide Sequence Number=SeqID_173193
atggaagggacagaagaggttcaggagaatagagtgaagggagaaccgcaggaagttttggagagtattctggagaaatttgctgatgttttcaaggaacccactggtttgcctcccccacgagctcagagacaggtgaaagagttgttggcgaatgggcatatccgatatagccagagtgcttattctagtccagtcatcttggttaagaagaagaacaataagtggcgtatgtgtgtggatttcagggcattgaatagggttacaatacttgacaaattcccaattcctgttatcgaagagttacagggagctaagtatttttctaaactggatttgacctcaagatatcaccaggtgcgtatgaggactgcagacatacctaaaacaacgtttagaacccatgagggccattacgagtacctcgatgttggttttttttatgacatccttgtgtatagcaaaggatggcaagagcacttgcagctgcttcaacaggttctggaagttttgaggcacaacaagctgtttgcaagacgtgagaaatgcacttttggccaagaacaagttgaatacttgggtcatatcatctttgtgcagggagtggcggtcgagcctgccaaggtgaaaagtgttcttgggtggcctagaccaaagaatgtgaagggggtcagaggcttcctaggcctcacgagctattataggaagtttataagggattatgcattcgatgctttgaagaagcgtgtgacggaggcaccagtgttgagattgccaaattttgaagagcaatttgagttagaatacgatgcttcgagaacaggaattggagcaatcctgatgcaaaactgccatccaattgcatatttcaatcagaggagtttaaaacagttgctaagtcaaagggttttaacaggtaatcaacaaaattggttggccaagttgatggggtataattttgagataatttataagcctgggaacgagaataaaggagctgatgccctgtcaaggagtttggaggacgccgaattgactaatatgatctcttatcttgagtggttagattggcagcagttgactcatgaggtgcagcaagatacccactggaaaaaggttatttgtgatttgcgacaggataaagaggcccataccggtttctcctataatcagggagtgctgctttataaagggaggttggtggtgcatgagaaatctccttggattcagaagttactagaggaatttcattctactcctcaggctggtcattcgggtttttataggacatatcggaggttgacttccaatttattttggaaaggtatgaaagaagatgtcaaacggtttgtgcaagcttgtgacatttgtcagcatcagaagtatagtgctacctcacctggaggattgctgcaacctcttcctattccggaacaggtctgggaggatgtatcagttgattttatcacagggttgccttgttcgagaggctatgaagctattctggttgttgtggacaggctgaccaaatatagccattttgttccattgaaacacccttatactgccaagggaattgttgagattttcgtaagggaagtagtgaggctacatggagttccaaaatctctcgggacaatgctcaagatgagtacaacttaccttccgcaaacggatggacagaccaaagcagaattctggatcaataccacataccacgagtctatagggactactcctttcgcagcggtgtacggtcgtgaacctcccaagattatacagtgcattccaggggaagtgagagtagaatcagctcaaagggagttaattgatcgtgatgaggcattgagacagttaaaaacatttttactgagtgcccaagatcgcatgaaaacccaggcggataagcacaaaaaggaaagggagtttgaagtaggagacatggtgtttttaaagcttaaacaacacaggcatcattcagtcatagctagaattagtcctaaactcagtgcaaggtattatgggccatttaaaatactagaaaagattgggaaagtggcttacaaactgcaacttcctcccacttcaagaattcatcccgtgtttcatgtgtccttactcaagaaggcagtggggaattatgaggcagaagcagacttacctactgggctggatgatgatagagctgacatcatcaaacctgaagctgttttagcttctaggagagtgatcaagcatggagaaagattgaaacagtggttgattcaatggaaagggaagtcagtggacgaagcaacatgggaggatgaaatctcaatctag

SEQ ID NO: 56416 - DNA, 222 bp, Glycine max
  Peptide Sequence Number=SeqID_173194
atgttactcaagattgaatatatctacaacttggatagatgttatttggtaattatggaagcacaagacgacaatttcaaatccaaaatgttaaatggaggtggtgaggacaatggtggcagcaatggcaatggtgttagtgatggcaattacaacaatgattgtagcgtcaatggatacaatggtgatgatacaacaatagtggtgttggcaatagagtga

SEQ ID NO: 56417 - DNA, 1455 bp, Glycine max
  Peptide Sequence Number=SeqID_173195
atggaggcacgcatgattcaagtagaaggagagctggattgggttcgatcatcaatcgaggaattgcgtcttaaggctgcagaaagcaaatcgattatggaccagctgcagaaaaaatcagagcaacagaccaaactgatggaagccatatctcgaggttttaggaggaatggagacgaagatggaggtgagaactcagtgggacagaaggagagtgagaaaccgaaggcaagtgtgagcttgaagccattggagggaattgccttggaggaatttcgtcaatccctcaaaaaggtggagttacccatgtttaatggagaggacccagcggggtggattacgagagctgagatttattttcgtgttcacgaaaccagcgaggaagtgaaggtgaacctcgctcagctctgtatggagaatgaaaccatttatttcttcaacgccttactcagcgattacgacgagttgacgtgggacgatctcaaacacgaactattggaacactacggaggtatcggggaaggaagcgtgtttgagcagttgacctctttgcagcaaactggaggtgttgaggaatatatcaagaagtttgaatgtctaacttctcagattccgaggctccatgacgaacagtgttttgcttatttcatccatgggctacgtgaagaaattcgttcgaggatgaggagtttaaatgtggtaagcccaatgtcacatggaaggatgatgaatgccgcaaaagctatcaagctggagctgtctagccatggcagaaactggagtgagaaaaaggagacacgtgggagtggcggatcttatttgggttttcggatcagctccaacgtattggctagaaataacccgaggagttttggaggacaaggagtggtaatgggcctggcccaaatgcaccagctgacattggagaaaaaaaatagaaactggcccagagatagaggaactaagcatttagcttaccaggaccttatggaacgttgtcgaaaagggctttgctttaaatgtggagagtcgtatggcgcattccaccaatgtcctatgaaacaattacgcgtcatattggtaggatacatgcaagctgaatttgatggggaatgtagtgctatgaggttattaagctctcaggtggaacaaattggtgattcacggacaatgaagatgcgaggtaaggtgttcgatgttcccctctttatacttgttcacagcggcgcttcccataattttatttctcggaagttagtggaggctatgggatggaagtgggaggaaacgaggagcatgcgaatcttgttgggtgatggtcacaaaactctgacctgtggggtttgtcacagattaacggtggaggttgatgcatgtcgttttgtggttgacacctgtctttttgatctggaggacatcgatttgattttgggaatggcatggctaagttcttag

SEQ ID NO: 56418 - DNA, 384 bp, Glycine max
  Peptide Sequence Number=SeqID_173196
atggcagatccgttgcggggttcgccagaaaattatggcaaagtagcgattagtgactttgcaattaaacataaaaccactctcaagcacaccgagcacgcggcagatgcttctccggcagaaaaggccacttcatcttcgacgacgcgcacttgcgctccgtcatgccaatttaggactctggcgaggcgagagcgtaagctccgctttattgaagaagagttcattagggcaggcttcgcggtggtgacgctggaaagagtggtcggtatcggctctgatgaagagggggttggattcggagccagtgagaccttcgatgtcgtcttctaccttcgccgagtcgtacgccacaacgggtggacaaacagggaagtgtggtga

SEQ ID NO: 56419 - DNA, 852 bp, Glycine max
  Peptide Sequence Number=SeqID_173197
atgcatgtgttcgcgccgaagtggggagcgccccggtgcggcgcagatggacgtgaagatattggatgtggcggcggagggcggctacgggcgggtgttccggtgcctcgacgtccacacgggcgccctcgtggccatgaagcagatcacgatggtcaggttgagccagggcattccggcgcagatcatccgggaagtgtcgctcctcagagagctccaccacgccaacatcgtgaagctgctcagggtagggttcacagagaacagagtttcatgttccagatactctctgctgtggcttactgtcactcgcggaaggttctgcacagagatttgaaaccaagcaatgtactgatcaatcattccaaaaggttgatcaaactagcagatttcggtttggctagagagtttgcagatgactttttatatactgagaagttaggaacttcctggtatagggcacctgaaatattgtgccactccagacaatattcaactcaagttgatttgtggtctgttggctgcatatttgctgagatgggcctggaaacatttgttactgatctggaaccaagtggcctgaatctactatcaatgatgctatgcttggacccaaatttagaaagcagagtcagtggagcagtcatcgagatgcattcccattccatggtttttcatttagatttaggaagcaaagtcagtggagcagccatcgagatgcattcccattccatgattttacatttgaatcttggagagagttctaaggagagatttgccttttctattttggtcgttcccagatttgttttttggggtcagtatggattcttaaatagtgctaggcattag

SEQ ID NO: 56420 - DNA, 186 bp, Glycine max
  Peptide Sequence Number=SeqID_173198
atggctgaagaatttttgaagggctttgttcatcaaaacggcatcgctgtcataaccctcgatcaccccaaagacgaatgttcgagtttttgtcagcatttcagagtcataggtgatgggaggaagagcattaacatgcagcatttcacagtcatagatgatgggaggaagagcattaacatgcag

SEQ ID NO: 56421 - DNA, 142 bp, Glycine max
  Peptide Sequence Number=SeqID_173199
atggctgagtatgtggtcaaatcaaaggaaaaggcaccattgaagaggattccaatgtggccccacaagtcgaaacaggctttgacaaacaccgatttcagagtgtggaacatcaatagcgtttcgaggccatcaaaagatg

SEQ ID NO: 56422 - DNA, 414 bp, Glycine max
  Peptide Sequence Number=SeqID_173200
atggggactgtggttggtttgaagtataatgatgagaaaaagaataaagaaggagttgaaaaagaaaatgagaaaaatgatgaagtggtgactagtgaaaaagtggaagaaaaagtggtaagtgaagaagagaagaagaaatccaatgaacaaaccactaataaaggtaaaaatatagtaaaccatctaccaattgagcatcttccttatccgcatgctctgtcaaagaaagataaggaaaggcagtacaaaactatcattgcatggcctggggataggcctatttttcaggagaaggatgaagacatggtagatcctgttgattatttcatttggaggagactgagctcctctaccatgaccgtcaaggagactgagctcctccgccatgaccttcaaaaattcgtgaaataa

SEQ ID NO: 56423 - DNA, 186 bp, Glycine max
  Peptide Sequence Number=SeqID_173201
atgacaacagagtataccttcgaacccaacactggggcaatgataggcaccatgcatgagcttcaagcgaacctagaggcagacaacaagtcctcacccgataggttgaaaacccaaaagggtggcctaggaaaaagaaccactgctaaattggcgggaagagtaatgcaaacaacacatgcatga

SEQ ID NO: 56424 - DNA, 492 bp, Glycine max
  Peptide Sequence Number=SeqID_173202
atgggtgatccatttaagattactagagtagaagaagcaggagattggaaatattcaactagagcttctttagtgatgctcagaaaaattgggtgtgtaaaagtcgaagatggactaggagtagcccttagcgcaagagtgaggataaccgttagtagaatgatcaaaagagaaacccaagtcttcatatgtcttctggttgtgcaaaggagggatttcatcaccaacaatagggagtccaaaatagtggctacatcctacatagtaatagtcatgaagccaaaaggaaatataaaggtatttatggcagtcaatcaaaaactcaacaagctaaagatcaagggtcaccctttcgagccatctatagtagggattagagccccaggccagatagtggtcgagaaacgtgacaacatcaataatagcattaacacaaggacaaagggagtcgttaccaaagaagaagaagaagaagaagaagaagaagaatga

SEQ ID NO: 56425 - DNA, 801 bp, Glycine max
  Peptide Sequence Number=SeqID_173203
atgaatgataatgatgaagctaacaaactagaccaacatgcttatggatacaaaaggctaaaaaatgaagctttggattcacccatagaagagtattgtataatggagatcggatcaacgaacccatggcagcaagagatgatggattatctgcataatccgtctaataaagttgaattcaagatgaagcaaagggtgttaaaatatacaatgataggtgatgagttgtataggcaaattttcaatggggtgtcgttaaaatgtttcaatcaagctgaattgatacagctcatgggagaaatacatgaaggcattgatactattggccaacgatcacaaccaattgttaccgttatgctaaagggtttgaaaaataccaaaagtttgaacctttacaaaaaaactcaagccaaagaaatgcatgtggtagccaaaccttggccattcaggggatgggccatgggtgtcattgatgaggtttatttggctttgtctaaaaggcatatttttattttagtatccactaattattttacaaaatgggtggaagctaagccattggttactgcgactcaagaagttgtttttagattcattaaacataacattattttattgctccgcatacctgagtcaatcacaactgaccaaggaattatgattactggagacaaggtgaatttgttcgtacaacaattcgacatcaagcttgtacattcaacacattattataaacaagcaaatgagaaagttgaagctaccaataagatcttgattgatataattaagaagaatttataa

SEQ ID NO: 56426 - DNA, 819 bp, Glycine max
  Peptide Sequence Number=SeqID_173204
atggaacaagggaacagtcttagtcaaactcaaaaaaggaggctacataggacaagagctctcaagaagatgaaacaaacattagctatcatggctgatatgaaatctagaagccaagatggccaggtggaacaagagaaagagttgaaacaaattgaagaatcattactcgaagcatggttgaataaagacgacttactggaagtagatgcgatgagtttcttggctaatgctgagacaacattcgacaagcctacaatagagattgtagaacatttgagaccattctacatgaacgctcaactaaatgaagataaaatgaacattgtgttggttgatgatagcccattttcagctgatgtcaaaatggtagatgttatactctactcaccacacttagttcctattcagataccaaaggattatgaggaaggaagagacttggaggaacatagactaccaatcaaacaaggatttaagccacatcagcaacctccaagacgatgtaaccttcaacttatgcctttgatcaaaggagaaattgatatgatgttggggattggtttcatccgaatggatggatatgtcaattggttgtcaaatatcgtggatcttgggatatacaaatggttagtgatgtcgcttggactaaaaaacatcggtgccacttatcaaagggccaagaatctcgtttttcatgatgatattgggaagaaaatggaagtctacattgatgatgttgtagtcaagtcaattgataaagatcaacagttgggagtttggagcaagatttacaaaaaaagagatttcatgggttaa

SEQ ID NO: 56427 - DNA, 234 bp, Glycine max
  Peptide Sequence Number=SeqID_173205
atgcatggggcatgcaggcaaaccgccattgccactggcgagtttggtctccgtgaaggactcgccactgccagtggcgatatgtccatgcaaggcagaaatcgtcattcgaactggcgatatacacaacgcatagggaactgccagtcaaactggcgagttccaatagctgagggtgcaggtctagccccgcgagagcaggccatggcagtgcagaaaaatgcagacgcgtag

SEQ ID NO: 56428 - DNA, 384 bp, Glycine max
  Peptide Sequence Number=SeqID_173206
atgcgcaggcctttgttttcttccccgcctttttgccttctttcttcttgcttcgtttcttcttcctccgtgccttccatctgccattgttgtgttgctgcgaagcttccgtggtgccgttgctgcatttctgccgtcgaggttaattgtttagttagtttaggagatgatgactttagggtagaagacctcaaaatggcgaagagcaaccgttccattactaccggaagaagttcttccgatagattctccggaagagggtctttcagtagaagaaaagttctttcggagaagctaccggaacaagttcttccggtagctttaccagaagaacattcttctggtagaacgttttgttgtaccggaagaaggttctttcggtaa

SEQ ID NO: 56429 - DNA, 633 bp, Glycine max
  Peptide Sequence Number=SeqID_173207
tgaacgagtcaagattccagaccatcaacaaaaggcgtttggaaaaagagaatctagtgtatgtgccagaaaataaaaactggacgggcagggccatgaaggatttcaccagggtaggtgttcgttgtgcagatgtggtagcaacagttcaggagaggattttcgtggaagggttgttatccattaccattgtaccgatgggagggaaaatggttttgataaaggttgcggaggatgaggatttccaggctctgggaatttcatcacaacggataacaacaaggaagactcgtttggatgttgctagagtgatatacaaacttcaagttcggaggctattaacaggaaccatttgcgaatctctttccaatgtacgccgtgagtacaaaatggtggaggggaggggacgtgaatatttggtggaaagcaataagggtgagctagaggtggctgttattgacgagattgcaatggataaaggtggggttggatcagtttttgcgggtgaagagactgtgggtttggtgggtggtggtggtgatctacgagggaataatttggttgttattgaggaggtttcgattgtgttaagggggaagaagtttcctgtgacagagaagggtgttgggacac

SEQ ID NO: 56430 - DNA, 432 bp, Glycine max
  Peptide Sequence Number=SeqID_173208
atgacacacaccaggaacctcaaagaaaaatatctcaatgtatggacacaacaagctgcattaggttctcctgaggacggcgtcacgactcgcgagctccgagcctcacctttctggcgacggaggtggcgagattccgacaaagcgatgagagagaaagttgaaaccgtgttttttagagagagaagtttcattttggttttggagaaggaagtacacgcttttgaagaaggaatagaatacattatacttggagaacataaaggaaagggaaactggggcacgcctccattaatccagacaacgagagcatgggacctgtttctaacgttgatgcattgcagagttcttgataaccctcaaccaaagattaaggcggtcaaggagaagatgaaaggaaaggtcaacacttcaagcatatctagaagctga

SEQ ID NO: 56431 - DNA, 306 bp, Glycine max
  Peptide Sequence Number=SeqID_173209
atgttgagtcctatgaaagataaaggtgaggactttgagtcctatggaaatataaaggtaaggatgttgagtcctatgaaagataaaggcgaggactttgagtcctatggaaacataaaggcaaggactttgagtcctatgaaagataaaggtgaggactttaagtcctatgggaacataaaggcgaggacgttgagtcctatgaagcataaaggcggggactttgagtcctatggaaacataaaggcgaggacattgtgtcctatgaaacataaaagcgaggactttgagttctatgaaagataa

SEQ ID NO: 56432 - DNA, 173 bp, Glycine max
  Peptide Sequence Number=SeqID_173210
ctggcactggttcaacccgtgcaggtgtgggctcaggaggagcagcctcgttgggtctcaccaatggagagctttggacatctggtcttatggttgctgacggaggagctggagtggatgatgatgggatgtcatatgctctagccctttttctcgatgccatctgtaactaa

SEQ ID NO: 56433 - DNA, 474 bp, Glycine max
  Peptide Sequence Number=SeqID_173211
atgacgctgtttcctccgatgcacgccctttcgaggatgagtcgatgcacgccctttcgaggaggagtcgatggtggccgagcacggcagcgtgacgatagtgaggatagtgacggtgaccatgacgatgatgattgggaaggcatggagagcaccgaattggacgaggcgttcagcgtcgcgacggcgttggtggacgccgccgccgtcgatcggctctcacagaagctttttctgatcaaactccctcatagcttctatttttcacccgttagaggtgagactttcactgtaggttgcagcctctgtgaaacaattggtgcaaggatcatcaacaatctgttgctcaatgctgcaatgtctgagtatgttccagctggggtagatggcaaacgttgtctggaaaatgttgtcaatgaagttgtgttgcttgctgctcgtagagtctctatatcaaattctaatgacagatag

SEQ ID NO: 56434 - DNA, 180 bp, Glycine max
  Peptide Sequence Number=SeqID_173212
atgggttacttgaagaaggttgtcataaacatgattttgctatttatgcttctcttatcaatgaatcttgcaacagcaagggtgcccctttggatttcggagcctctagcacatggacgcttccttaatgctgataatccattcggcggcaattatcataaacgtcctcctaaaccatga

SEQ ID NO: 56435 - DNA, 141 bp, Glycine max
  Peptide Sequence Number=SeqID_173213
atgaatgtacctcaatggatgctcacaagacatgagggaagtagagggaatgctcagaatcagaaaagattaagcaaccatgagggaatgctcaacggaatgtacctcaatctcaacggatgctcaccagaccagttgtag

SEQ ID NO: 56436 - DNA, 126 bp, Glycine max
  Peptide Sequence Number=SeqID_173214
atggcttacttgaaggttgtcataaacatattcgttttgctattcgtgcttctcttatcaatgattctggcaacagcaagggtgcccctttggatatccgaacctcatcacaaagcacaaccatga

SEQ ID NO: 56437 - DNA, 612 bp, Glycine max
  Peptide Sequence Number=SeqID_173215
atgccaacttatgctaaatttatgaaagagcttctgacaaagaaaaggagattcactgatgaggaaactattgaacaagaaacaagttgcagtgcaacaattcaaaaacccctacctcagaagtcaagcaatcctgggagttttactcttcctacacttttggatcttggagcaagcattaatcctatgtcattgcctatgatgaagaggataggtggcttagagtatccttatggagtagttgaagatgttttggtgaaagttgataaattcacgttcccaattgattttgttgtcatagatatggaagaggattctaaagttcctctcattcctggccgaccatttatgaagacagctaaggtgattattgatgttgatgatggtaagctgaaggtgcaagctcaagatgatgaggtgaatttcaaggtgtttgatgcaatgaaacatcctaatgataaaaaggagtgtttcagagtaaatgttattgatgaagtttgttttgaagccaaaaagcagttttttccttcaagtcctttggagaaagcattgatgaatgtgaatgcagttgatgttcttgatgaggaggaagaaaaagaaactgagaaatga

SEQ ID NO: 56438 - DNA, 189 bp, Glycine max
  Peptide Sequence Number=SeqID_173216
atggcggcaaagaaggcaacccacaccattcctgaaagtaagaaaagaaaggtacaagcttccttccaacctcaagttaaaccggaagatatccatcaagaggaggaagagatgggcatgtatttgggtgagccatctacccttgatgaggatggtatggatacatcatcggatgaaaaggcactatga

SEQ ID NO: 56439 - DNA, 1395 bp, Glycine max
  Peptide Sequence Number=SeqID_173217
atggtcacaaaaggcattgttctaggacacaagatttcttcaagaggaactgaagttgataaagctaaggtgaatttccttgaaaagttgccaccaccaacaaatgtcaaaggaatcaaaagcttcttaggccatacaggattctacaagtgctttaccaaagatttctctaaaattgtcaagccattgagcattctccttaataaggacattcattttaaatttgatcataattgtctttctatattttcattgcttaagcaaaaattactttcagctcccataatcatgacacttaattgcaaatatgattttgaactgaattgtgatgctagtgattatgtagttggatttattttagaatttgatttggagatcaaagataaaaagggctatgaaaaattggtggttgaccacttatctagatttgtgaatgatgaggtgactgtaaaggaaactaaagtccttgaaaattttcctggtgaaaaagtttttgcaatacaagaaagaccttggtttgctaatatggaaaatttcaaagttgctgaagttgttctagaagattttaattggtgtcaaagaaagaaattcttcaaggatgcaaaaacaagtggaatttccaagagacatgaactacctctccaaaacatcttagaagtggaggtctttgattgttgggggatcgactttgtgggaccactgccatcttcttactcaaatgaatatattctagtagtagtggactatgtttcaacatgggtggaagtaattgctacacaaaaagcatatgcaaaaattgtcatttgtgttctgaagagaaatattttttgcatgtatggcactccaagagttctaatcgatgatggcaattctcatttctgcaattcatggttgaaaatggtcttagagcattacgatgtcaaacacaagattgtttcaccatatcatccccagaaaaatggtcggattttggagaagacaattggtagtttcagaaaggactgggtcatgaaactagatgataccttgtgggcttacataacaactttcaaaactccaataggactatctccatttcaactggtctatggaaaaacttgtcatcttctagtggagttagaacataaagttttttgggctttgaaatttatgaattttgatcctaaagctgcaagtgataaaaggaggatgcaactccatgaactggtagaaatgagacttcaagcctatgaatcctctagaagatatgaagagaagctagaagatcttggcgctgggagaacatggattgtgaatggtcagatattaaagccatatcttggtggtgacattgagaggctcaccactatggcttatttgagtgatccttggagatcatgtgatgcatctagctaa

SEQ ID NO: 56440 - DNA, 585 bp, Glycine max
  Peptide Sequence Number=SeqID_173218
atggcaacacctggagatcataacaatatcaacaacaatgctagaatacttttgggagactatgctcaccagtcaggactcagacactttaccacaaagacatggttgcaatcacaccccaatcagagcttgactaggaggaaggatgtagaagaaaagttcttagctagatttttccttccatccagatatataagtgttaaatcagctattgctgctttctctcaaaggagtgatgaaccattgtctgaagcttgggagatatataaatccttgctgaggaagtgtcctaaccatggctttaatgatatagctcaattgaatatcttttgtaatggtttgaggccatataccaagatgtttttagatgcctcaataggcggatcaatgatgctgaaaagtcttgaagaagctatcactatcattgatgctctagctactagtgatcatcaagcccattatgataggacccaacatcataggaaaatagttttagaacttgacagtcaaaatgcccttctggctcaaaataaactttgctcacaacagatggaagatcctagaaagcaaatgccaaagttgtag

SEQ ID NO: 56441 - DNA, 417 bp, Glycine max
  Peptide Sequence Number=SeqID_173219
atgttggagtggagtgtaagggttgcctattgctgtattatgaagcgagttgaggatgcaggggaggagttgcaagagaggtttgtggcaaccataaactggcgtgtggtagacgagatcctctatcacgtgatggagttgatgtctttgctggaggtatggaagaaattgaaaagtcaatacatcttgaaatcgttgacgaacaaattggtggatctccaacaagatgtgaatgtattcaatcaaattataagcgatttggcaaagctggaggtgaagattgaggacgaggataaggcatgtattttgttgtgttctttgccttcttcttatgaacatttcgtgacaaccttaacccatgggaaagacttaatcggtctggaggtgatacaatctacagttatgtctcactcttaa

SEQ ID NO: 56442 - DNA, 1143 bp, Glycine max
  Peptide Sequence Number=SeqID_173220
atgtttcttgaaacgcagaagaacattcgaatcaaaacaagagggagcggcacaagatcaagaacagaaagttttagtgatctttcttcagaaatcagtgcctctccagggaccaagacaccaactttggttgcaagattgatgggtcttgatcttcttcctgatgcacattcctcttcttccccatccctttccactccgaaccttcacaaaccacggcaacacatcaaaataatcaaacatagaaacagcacaggcagtaacaccttgcctgagactcctagaatgtcctctggaagaagatcagaagtcgagcatagactctctctccaaatcaacaaggagaacaacacagtcccctttgaggattttgagtctcctcggttttcattttcaaagaggaaatattatgagaacagttgcaggagtccaagccattatgctaggcaaattgtcaaacaagtgaaagaaagtgtgagcagaaaggttggattagacatcaccaacactgtcaagaacagagaacacggaagagaagaatctgtaggccaattcaaattcaagaaaactcctaaaacttcagtgaatgaatccagccctggaaaacactcaaactcatcttactccccaaggctcagcagattcattgataccaaacacaaaccaagcacaacgccaccatcaccaactactccaaaaaaccaaaacacacactcaatactaaaaccaccatcaccaactacttcaaaaaatcaaaacccacactcaatactaaagccaccatcacctcctccagtagtcaacattgaaacacagctttcaagagttttaacaaagccaaagcctcaagcattgcctgagaatgattggcagaaccaaaaatcagccacaaaaggcaagaacactagcagtggaaagttgagttcccgggtcaacaagcctccacagacatcaatcagaaacaagcaagaagagtcatttattactcgtcctccatcagccactaaagccaatgacatcaaaaccaaaagcaagagaactcatccactttcaagcaatcttcttaataacctcaacacggttccaaatcttctccctgtcaagacaagaccttctcctcaaaaacaggtaccctttaattaa

SEQ ID NO: 56443 - DNA, 129 bp, Glycine max
  Peptide Sequence Number=SeqID_173221
atggaaacagtctctggaaaatgtgctttaaatgcattcttagtacatattttggaaaaagcatcaggttctgaacaagccatggacagatttgctcatttctgcagcgggatactgaggcagcagtga

SEQ ID NO: 56444 - DNA, 270 bp, Glycine max
  Peptide Sequence Number=SeqID_173222
atgacattggttaggccagcgccactaaattttagtgattccatagttgttggcagcttgctgaagacatttgcacacggtttgtttgtcagtggtggtgttggcagaacccagaatgttcctcactccgccacagcacgaatccgatcgaaaccgatccaccctgcatcaggatgcgttgagggattggaaaaatgtggcgacgttaatatgaatttatgggaattgattgagatttatattggagtaaaatttggtataaaattttga

SEQ ID NO: 56445 - DNA, 120 bp, Glycine max
  Peptide Sequence Number=SeqID_173223
atggtgttttctggtggccatgtggggcttgaggatttgaagagggcggttaaggataattgtatgtttgtggagaaaaatagctctcctaatgtgattcatgtggtgaaacttgtctag

SEQ ID NO: 56446 - DNA, 306 bp, Glycine max
  Peptide Sequence Number=SeqID_173224
atgaccttcgttattccttcttcttcctctcaaaaaagcttgagcacggtcttcttcctcttcgttcttcgtgaccttcgttcttcttcttcttctccgtgttcttcgtcttcttcgtcgtcatcgaccgcaccgccgtgggtgttgacagtggtgttgctgcgtcctcgcgtcggcattgtcgaggtaagttcctcttcgtcttcgtctttgccgtgggtgttgacagggaaggttccggatcaacttgatcccttacttcatcaaggttatttctttaatacaaggtcttcatttgaactctaa

SEQ ID NO: 56447 - DNA, 237 bp, Glycine max
  Peptide Sequence Number=SeqID_173225
atgccgacgcgaggacgcagcaacaccactgtcaacacccacggcggtgcggtcgatgacgacgaagaagacgaagaacacggagaagaagaagaagaacgaaggaataacgaaggtcatgaagaagaaaatggcgaaaatggcgaagaagctcagaagaagcaggaatggcgaggaagaagcagaagaagtagaaatggcgaagaacacaggattggaagggagaaaggagaatga

SEQ ID NO: 56448 - DNA, 918 bp, Glycine max
  Peptide Sequence Number=SeqID_173226
atggccgccttccatggctgccactcaccgtacgaagcttccatggttgccttccatggtcgtcactcgccgtacggagcttccacggctgcttaccaccacccacactactcctcgtcgtacggaaccctccactatcccacacaacaaccaccacacccccttgaattttcgacagccaccgcggaccgcctcgacgttgtcctggccgaacttgatgtcgcgacacgccgcttggatgcccgactggacgcccttctcctccgactacctcgacgacctagacctctgccgcggattccgctcccacctccgtcattgccgatgccatcgccgttaactccaccgacccctccgcagttgccaccgccacctccaccagcaacaacgcctccaccgccgccacctctgccagccacgacgcctccgccgttgcctctgctgccgcctacaccactgactccaccgccgcctctgccgttgcctcggccgcgaactccggcaccacctccgaggcccccgccgctccaatcaactcagtcacctacgctcactgcacctccgcccataccaactcagtcgccacgccccgcactcatgccgcaacaccccgtccctttaccggatccacttaccattgctactgtccacctcctcgcagacaaccagccccaggcgtcctcccccagccaccatatcctcctctccgaccttgacttattcccttccgtcatgttcatcgccataaccacggacacggagctcgactaccatttccttccctctgacatcaccatcgactctgttggatggctccgcttccgcaacacttatcttcacgccctcattccttcacccattttaatttgggatcccggttcgaattttgaagccgtggtcgtagccccaacaccttga

SEQ ID NO: 56449 - DNA, 1419 bp, Glycine max
  Peptide Sequence Number=SeqID_173227
atgttgttgttgctgctgccactcatgaggcttttccctttccttctcctcctcctccttgttctcttgttcaattatggcttttccgagtcaggtgttggtgctggctaccaactcatggtagcagttcctgtggagtatgaagtggatttcaaagggagggcttttcttgtggagaccaatcagacagctccgaatttcagagtggcattgagcattgaggccatcaatgggaaatactcatgctcattggaagttttccttggggatgtgaaggtgtgggattctggccattactccaggttttacatcactgagaaatgcttgctagaactcactatggatggagatttaaggctgaaaggtccaaaagaaagagtgggatggaagactgggacttctggacaaggtgtgaagagattggaaatacagaggaccggcaatctggtgcttatagatgcactgaacaatataaagtggcagagtttcaatttcccaacgaatgtgatgcttaggggtcagcaacttgatgtggcaactcgcttgacgtcttcccaaagcaactcaagtttgttctactactctttcgaaattgaggacaagaaggttgcattgtacttgaactatggtaagttgagatattcttactgggggtttcagcctaccatgaatagaagtattacatacattaagctgagttcaagagggttggtgttgtttgatgtcaaatacaagaaaatagcacaaattccatcggaggggattcatccactaaggtttctagcactaaataatgaaacgggaaaacttggtctttactactattcacccgagaaaggaaagtttgaggcttcttttcaagcacttaacagcacatgtgatcttccaattgcttgtaggccttatgggatatgcacattctccaattcttgttcatgtattcagcttttgacaaatgaagacaaaggcggtgctgattgcggttgggcaatttcgggagggttttgcaacggtaaggaggcggaaatgctagaactagataatgtaagtagtgtgcttaaaaatgttactaaggtggtaaatattaccaaaaaagcatgtgagaatttgtgcttccaggactgtaaatgtgctgctgctttgtattttgggaatgctagcacagatgaggcagaatgttatctttacaaacttgtgctgggtctcaaacaggtagaaaaaggcacaggatttagttatatggttaaggtcccaaagggaactgttaaaaaccatgagaggcataatgtgaaaagatgggtgtttgttgtggctggaggggttgatggactcattattctacttcttgttggagggtttggatattggttggttaaaaggagaagtcatgccttgcattctcgggccagcactacatga

SEQ ID NO: 56450 - DNA, 2434 bp, Glycine max
  Peptide Sequence Number=SeqID_173228
cgacatcaccgatgacgcgacgcccacctttaaaggtaaaaccgagccgggcgccacagtaatcgtgcgcgataacggtaatgaactggctcgcgcggtagctgataaagacggtaactggagcttcacgccggatcagccgctggcggatggcgaccacagctttaccgttcagccggtggataaggccggaaacaaagggccggaaactgatgccattgacttcaccgtagacacctccaaagtggtgattgctatcactcaggtgtatgacgatgcgggcagcattaccggtaatctcacgtccggtcaggtgacagatgacaccacgccgaccctgaaaggcaccgcaaccggcaacgcgctggtgaaaatttacgacaatggccagctgattggcagcacggtggcagccaaagacggcagctggagctttacgcctggcgttgcgctgagcgaagggccgcacagcctgacggcgaccgccaccacgccggcacacggcgagagtgaggccacagccgccttcgatatcactattgatatcacggcaccaaacaacgcgggtattgaggatgtccgtgatgacgtgggtacagagcagggcaccgtggacaacggcggcgcgactgacgataccacgccaacgctgactggcggcggtaagccgggcgacgtggtaaccattatcgataacggtgaaaccatcggcagcgcggtaattggcgagaatggcaagtggaccttcacgccggaaactccgctcaacgacggtgagcacaaatttgaaaccgtgatcaccgacccggcgggcaacagcagtaagccgtcggatccttatgtagtgaatgtggatacgcaggcaccgaataagccagcgatcactgaagtgtatgacgatcagggcgatcgccgtggaccaatcgctgcaggcgacaccaccgatgacgcgacgccgacggtacgcggtaccgccgaagccgacagtctggtgaatatttatgacaatggcgtgctgataggctcaacccgcactgacggcaaaggcaactggagcttcgagccaccgttaccgctggccaacggtgcccatgcgctgacagcggaagcggtagatgccgctggtaacgtcagcgagtcgtcagacaagtttgagtttggcctgatcagcggcggtgtgccgaatgcgccggcgattaccagcgtaatggataacgtaggagacattcagggcctggtgcagaagggaagcgtcaccgacgatgcacgaccaaccattaacggtaccgcacagccgaacagcctcgtaacgctttatgcagacggcattaagctgggcacggtaacggcagacgccaacggtaactggagctatacgccagccagcgatctgcgtgacggcgtgcataacatcagcgcgacttccaccaatgctgccggcaacgtcagcccggaaaccggcgtctatccgattgaagtggataccacggcgccaggcaacatcatcaatccggtactgacggatgatgtcggccaggtacaggggccgattcgcagcggcgagaccaccgacgatgccacgccgacctttagcggtaaaactgagccgggcgctacagtaattgtgcgcgacaacggcaaagagttgggcagagcggtcgccgatgacagcggtaactggacgtttaccccgggcacgccgctgacagatggcaagcacagcttcaccgcgcagccggtcgatctcgccggtaatcagggcccaattggcggggcgattgactttaccgtcgatacttctgcggtggtggtagcgctgactcgcgtggaagacaacgccggcagtgtcaaaggcgatctgagttccggccaggccaccgatgacaccacgccaacgctgtatggcaccgcgacgccgaacgcgctggtgaaaatttatgacaacggcaagctgattggtcaggtaagcgctaacgcgcagggccagtggaacttcacgccgggtacagcgctcagcgaaggttcgcacgccctgaccgtgacggcgaccactgaagcacacggcgaaagtgagccaaccagccagttcgatctgctgattgacatcaccgcgccgaacaagggcgtgattgactccgtcagcgacgacgtcggcacggttcagggaccaattggcaaaggcggctacaccgatgacaccacgccaaccctgtctggccgcggtacgccaaatgataaggtcaccatcatcgataacggtacgccgattggtgaggtcaccgttggtaacgacgggcgctggagctttaccccgactacgccgcttaacgatggtacgcacaacttcaccgtggtgatgaccgatccggtgggcaacagctcggcaccgtctgacgtctggccggtgattgtcgatacccaggcaccgaatccg

SEQ ID NO: 56451 - DNA, 234 bp, Glycine max
  Peptide Sequence Number=SeqID_173229
gaggttttcggattatggaaagctaaatcctctgttggatcttccctatacgtacctgatggatcggggtacaagaacttagttgtgtatgtgtgtcttaatgcggtcttggttgagtttagtcttaaaagaggaatctgcggacgaggcttgatgaggactaggctaggctatcatgaggaatcggggtctagcagtccaggagacaacacaggaacgcataagcattgttag

SEQ ID NO: 56452 - DNA, 465 bp, Glycine max
  Peptide Sequence Number=SeqID_173230
atggctttccatccacccactagtgatatgtgcaaacatctgaagcctttatacattaaggctcatattaatgggaaaatgttgagcaaggtgatagttgatggaggagccatcttgaatgtcatgtcgattaatactttatggaaaatggacaaggatattgaagatttgactaccactaatatgaagatgacctcatttgaggcacaaaatttcatgctccttctctccctccactcatcttcccctaccttcaagctcttatccatgacttcctatggtggtgagcttcttcttgtctcatcttctcctagaagtggcatctccaatcacctttcttccttcttcgttccgctgcaattaaacttcaagaagcaaaggactctattgatgaagaagatccaaggcttacaagctccacatggagctacatcactttgggggtactggttgccaatatcatga

SEQ ID NO: 56453 - DNA, 606 bp, Glycine max
  Peptide Sequence Number=SeqID_173231
atgagtgtgttcgaaaggttaggaaggctttccaaatcaatgccttcacatgtatcaagaaaggtgtttgttcctcatgaaaaaatcaagaaggcttgtctgtgccgatctgggatgttgaataacctaaacaaagggcatccaaccgggcccaagactacagagctcaggccattgataaacacttgccatcatcaaggcctcccaaaaataggacaaacattgactattgatgaagaaccagtgccaatgcaggtctatgtatcagaggtagagaaggcgttagaagaaacattccgaactgcacttgtgccatttgaatctgaaaagtcaaaagtattgaaagagcctcaacaagaagaagtattgaatgaagctgagaacgaggaggatgtcgatacgcagaatgattctgtattggttactaaggaggagatttatgaaggaatctatggtataataatagatctcgatataataacccaacaagatgatctctctattgatgatgatcttggaaaatcattgttggattcgatgctaaatgagatatatgagttatttaatgatattgacactatgagcctaattcctattgaattttag

SEQ ID NO: 56454 - DNA, 438 bp, Glycine max
  Peptide Sequence Number=SeqID_173232
atggatggatcctccgacgccattcgaggggaaccacgtcttcctcaaggactctctcctccccgccgacgtgaacccggtttgaatgcccacaaaccccatcaccttatgcctgtctccgtcgccgaccccactaccggcggcaccgttgccggcggagtgttcccaaacgatgcgcaccgatcgggggtgcgcgttgacgcagcggctgccacgaatctggccgaggaaagcaacgattccgaagaggaagagggcggagaggaggaggtagagggtggatctgcgcgtgggctggcgcgcgtaggagatggcgtaggacttgggggaagaaggcatggctcacggaatggggcacaccacgaggttgggtgtggtggcggtggtgatggtgaaggtggaggggactacggactgggactagggactagggactag

SEQ ID NO: 56455 - DNA, 621 bp, Glycine max
  Peptide Sequence Number=SeqID_173233
atggggtttgtgggcattcaaaccgggttcacgtcggcggggaggagagagtccttgaggaagacgtggttcccctctgatcgccaaggacttcaacgcttagaagaagctactgggttggcttttaggtttatcattggtagaacaagtgacagagcaaagatgtctgcgcttcaaaaggaagtagcagaatatgatgatttcattttgctggatatacaagaggagtacagtaagctcccatacaaaacgttagctttcttcaaagctgcttatgctctttttgatgctgaattttatgtcaaagctgatgatgacatatatttaaggccagatcgtctatcattactactggcaaaagagcgatctcatcctcagacatacataggatgtatgaaaaagggacctgttttcactgatccaaaactcaaatgggtttcacattatcattcattttatgtactctatttggatgttccattactactctggttttgttttggggggggggggggtctaagaaccaggttggagaatgaggccataagttatttacaagatgaaatgcgtatactttcactcaaaaacttgattcatggtggttcagttcactgtggttga

SEQ ID NO: 56456 - DNA, 324 bp, Glycine max
  Peptide Sequence Number=SeqID_173234
atgtttccaaactcgagaaacttgttccaaggtgacagtatccctcaagagcaagctcagattccagtattgtggaaagctccacagaaagggttatataagatacatgtcgagataaagaataacataggtaggagcatgagtttgatagtttgtgattctcaaggggaagtaataaccaccacaataaaatttatggagtcagagctcgagccgagggtagttgaagcttatgcttttcgttgggcatcttctatggttgtagatctttgcctccagggagtaacttttgagacaaattgtttacaccttagtcaagcatag

SEQ ID NO: 56457 - DNA, 207 bp, Glycine max
  Peptide Sequence Number=SeqID_173235
atgaaagtgatgagatgcaatgcttggaggtccatgggtcacgtggcggtggtgggtagtttgggtggcagcacaatggaaggtttggtgcaatgtggaagtggcgttggttgttgcagtgttggtggtggttgcgtgcggaggccgctattgccactccgactttcattagagggcattgctatggctctccttaacacctcttga

SEQ ID NO: 56458 - DNA, 450 bp, Glycine max
  Peptide Sequence Number=SeqID_173236
atgtataatagtataataacatatattggtctccactgcagtgcacattggcaaatggtcgtcattttgcctaaggaaaatgttgtcatttggttttgttcgttgcataataagccagacaactacctcaaaggcataattaataggtcagtgttgttttttaatacatttgcattagcattagtcagtgctttgaaaggacttgacgatactcaacaaagtaaatccaagcctcctgctaggtggattgttgttaaatgtaatagacaaaaaggaagcactgaatgtgggtattacgtcatgcattggatgtcaactataatcttaggaaatttccagaataattgggaaatgtatttcactgatcctagaccattggaaccagaaagattgaaggcgcttcgcaaccagtgggcaaagtactatttgaaagtgaaaaatgaaacttag

SEQ ID NO: 56459 - DNA, 561 bp, Glycine max
  Peptide Sequence Number=SeqID_173237
ggctgatgaggctatccttcttagttattcactgcatagcaaggcatatagggtattcactaaaagaacattaactgttgaagaatctgtgcatgtgaagaagatgcaagatttcaggaaaaaagattttgttcaagaagatggcatcaaggctaaagaagttgaactgaacaaagagatctctatgaaattgcctaaagaacttcctagagagtggataactcaaaaggatctctccttagacaacattattggagatatctctaagggtgtttctacacgctctagactttgtattctatgtaacaacatgacttttgtttctcaagttgaacctagaaacattgatggagctttatgtgatgaaaattggctaatggaaatgcatgaagagatgaaccagtttaagagaaatgatatggacgtaaaaaatgccttcctcaatggatgcattgaagaagaagtttatgtagaacaacctctaggttttgttgatcatgaacatcctgattatgtctacaaactgaaaaaggaactatatggtttgaagcaagcaccaag

SEQ ID NO: 56460 - DNA, 321 bp, Glycine max
  Peptide Sequence Number=SeqID_173238
atgatgcagatgctaagcgcgcctatggcttctaggaaaagaaaggcaccatctacacccaaccaagttagatttgacagatcaagattcacttcccaagaggcttgggaaagatacacagacattattgttcctaggaagcttctgctagagaagaacgtggtggtctactatacagagtttgatgagttcaaggaggaactcgaaagatgccactgggacaaggagtggactgactttggggatggcaacattgatgttgccattgtgaaggaattctacgtcaacctctatgaccccgaggacaaatcacctaagtag

SEQ ID NO: 56461 - DNA, 213 bp, Glycine max
  Peptide Sequence Number=SeqID_173239
atggagactacgacaaagataaaattgtttgagttggaaaataagggttttgatgatgccaaagaagaatcaaacaaggttgcttacaaggttacttcaacaaacattcaaaggttaagcattgctttaagattaattcaaggtcaagcaaacaagatcaagaaaaagataaggcctcgaacaatctcactggttgattggtttttgccttaa

SEQ ID NO: 56462 - DNA, 273 bp, Glycine max
  Peptide Sequence Number=SeqID_173240
atgagggatccttggaacaacctcattttgcctatttataggaaaaagagggaggaggttgccgcccaactcgcccaggagagctcagctcgcctaggccagctgggttgcttccaccagaagcaatcctgcttcgaaaatactctggaagggttatgggaattttacggaagcattacaggagtcccgaaagcctcggaagccatttttaacaaaacgggagaggtggtttccgcccagctcgctcaggcgagctgggttgcttcctcttga

SEQ ID NO: 56463 - DNA, 234 bp, Glycine max
  Peptide Sequence Number=SeqID_173241
atgcaaatcgctagcatgaacagcgccacactcaggcacgcgacacgtggctgtgtcgcctctgccactggcgacagcagtgatgtcgccacctgcaatggcgctttggccatgcagggtagagtcgctggtcaaaccagcgcttccctacgcgtagcaggtgcagcttttgcaggtctagtgaaggtgcagtgcagcagggaaaacgccagggcctttggcgatttagggtga

SEQ ID NO: 56464 - DNA, 258 bp, Glycine max
  Peptide Sequence Number=SeqID_173242
atggtggtaaagtcgttcgaagatggaaggtcagagataaaatcgagggacaaatcttcccaaattgaagatggtatcgggccttcaccacacccatgtcgcctcaataggagttatatggaattcttccagcaaataaggtataaattgattgtccgttggaagccagatcttgtcgttgaaaaatatgaggttgtggttgattgtgaagcccagatgtgtctctgggcattgttgaatttggacaagaagtgttag

SEQ ID NO: 56465 - DNA, 246 bp, Glycine max
  Peptide Sequence Number=SeqID_173243
atggaataccaggtggatgtgggaggaattgggccacttgagcaaggaattgacggcctctacctgggaaggcccaagcgaatagctgggaatggaaaggtgaaagatcgaagtgttgtaggaccattcggcgagtgttataaatttgaaccactatgctggcctatcatcgacgaatgctcggaggtattatttaagaatgcaattgagaacatctgtttggccgaccgtttgagggtggtataa

SEQ ID NO: 56466 - DNA, 1462 bp, Glycine max
  Peptide Sequence Number=SeqID_173244
tatgatctgccaccatcaaccatgcctgatcacaacacgagacagacaaccactgaccgccatgaagaggccgtcacccgccttacacaaagccaaaacaccttagcccaaaatcatgttgccctgtcccaagcccaaaccgcaatgaactctaaggtcgattcaatcctagaacatcttgcggcaatcaccaccaccacccctcattcacgacctcacatgaagctggagcctctgccacttcctgaggaggctgctctagctaaactacaggaggacaaaatcctggactgtcattgccattccagaactccattcaactatcctcctccgccaaaccaaccaccaggacctctcgcggctttgaatcctaggatgcccgacgtagcctcgactccagatcatccactcaaattcgatccaccttctctcaaacaacttcctcatgacccaccacaaattagtctcaatgctctatctagaatgtcggcccccaaaacctttcgtatctacgaccacatctctcaccactgcgtcatgatccttgtagatggtggtagcacacataatttgatccaggcacaggttgccaagtttctcaacctccccaccgcctccatgtcgactttgcaggtggctactatgctcgatgttggcctcatctggctcagtcagagcccgttctctgaactgataatctttgttaagaagaaggacgacaacttgcattgttgcatcgactatcgtgctatgaacaccattaagatcaaacacagatttctcatacccatcattgacgaacttttagacgaattgggaaaggcttcatggttctcgaagctcaacctttgccatggtttccaccaaatccgcatggcagatgaggaaattccaaaaccagctttttgtactcatcagggcggccactatgaatacagggtcatgttgttcggactttgcaatgcgccgtcaacatttcaggcagccatgaacgaattgtttcaactatttctctgtaaatttgtcgtagttttctacggcgatatcctcatctacagtccatccttctcctcgcatctcaagcatccggaagcagtcttcacctccctctctcagggacaattttacttgctccaatctaagggtcgcaccagacccaaccaaaattcagactatggtagattagcctttccgatggctcagtccgatttgtgcgggtttctcgacctcatagggttctaccgcaagtttattaagggctttgcaactgtggttgtgctattgacgaccctaccgtggaaagacaacttccaatggcaccaggacgcccaactggcatttgacaaaatcaattgtcctcctccaaaactcccaccccatcgcattctacaacaaggctttttgtcctcgtcttcaatgtgcgtccacgtatgtctaggaacttcatgccatcaccatgacg

SEQ ID NO: 56467 - DNA, 1689 bp, Glycine max
  Peptide Sequence Number=SeqID_173245
atggaacagagcgaaacggcgtcggatttagctccaaggaaattggctcgccaattggatttcgcggccgtttacggagatccgtcgcaccagaaactgcctccaccgttgccgcctccacagtcaccgttgcgtccgccgtcgcattctccgttgcgattgcagttggatttgcagccgccggggcaacggccgtggttatattcagaggcgcaggaacaacagccggggttgtattcaccgcggccgaagctagtttcgccggttagacgaattccgcaccccgtggtgaagtttccggtgaaggtgttgcaagtggtaaagccagagtctcccagatcacaacctcgatgtaatgtggaattgaaggacaccactccaaagaaacagaaacaatgtaactgcaaaaattctagatgcctcaagttgtactgtgagtgctttgcagctgggatctattgtgatggctgcaactgtgtaaattgccataataatgtggataatgaggctgccagacaggaggcagttggaataacattggaacgcaatccaaatgctttcagaccaaaaattgctagcagtccacaagaacaaagagattccaaggaatgtgaaattaaagtaataggaaagcacaataaaggatgtcactgcaagaaatcaggctgccttaagaagtattgtgagtgcttccaagccaatatcctctgctctgaaaattgtaaatgcatggactgcaagaattttgaaggaagtgatgaaagaatagcaatatttcacaaagattacaatctagttcacatgaaacaggcagctaatgctaccattagtggagctgttggatcatctggctatggaacccatataacacccaagaagagaaaaaatcaggaaatgtttcctggaaagtcagccatggatcaaactgttaacatgactgctcaatacctacaggaaattgatcctatggcttcatcgccatcatctctgtcagattcctttatttctgacccttccaacacaagaatttcagggtcttcaagatctacataccggtccgtattggcagatgtcctcaagccaaataatgtaaagaatctctgttcactttttgttgttctctcacgagtagctgcaaagacaaatgcagaaatgagaggcaaagtagaccagcaaacaaaaactgggaactttgaagcttctgttgcttcatcagctaaatcactgcaagaaactagagatgtccaccagcctgcttgtgatgatcatgtgaataaagatgaagcagaagcagttgatgtcgctcattataataggccattatcacctgaaacactagcattgatgtgtgatgaacaggatgatatgctttttggaaattgttctgcagatggagttgcatgcaacagcacttttcaaaacatgattcaaaagtcatttaattctgatggatgcactgatgtttacagagagcaggaaaggcttatattgaccaagttcttggacattcttcgcggactcgttactcatggcagcatcaaagggatttgtcttactcagcttacctatgtaaacaacttgcatcatcatattcataaaattaagaatgccaggctagaacataaaaatgagaagccatatattcacccactgcagggtcaccttgttgtcatgcataagcttttctaa

SEQ ID NO: 56468 - DNA, 600 bp, Glycine max
  Peptide Sequence Number=SeqID_173246
atggcacccaccatttccactactaccaatgagttaaaagaactcatggagttcaacaacaattttcatttttcaatcaagcttactgctaccaattaccctgcctggtacaaacaagttcatgctctactcattgttcgtgaccttgaaggctatgtcatcggaaaaattgtttgtccacctgccacagttggttctgatgatgctgcggcaccaaatcctgcatattccttatggattcggcaagataagcttatttatcttgctcttcttggctcgtgtgattttgaagcacgatctatcatggctgctgctgacacttctcgcgatgcttgggtagcccttgcacaacgtctcagttctatcaccaaaggtacctcctcgatttccacttatctactatcgattcataatattgctgatgagttagctctcattagccatccaattgactaccttgaaatggtcatacatactctgaatggtctaggaccaacatttcgagagttcactgcctccattcgaactcgtgattcaccaattgccttcattgagttgtatgataaattggtggatttcaagatgtatttccagcgttaa

SEQ ID NO: 56469 - DNA, 132 bp, Glycine max
  Peptide Sequence Number=SeqID_173247
atgaggttgactggtgttgagactaaggtggagaggaaattgaattgtgaacatgatggttgtgttggcggccatggaaagagtgcccacgaccttgaccatgttgatgacactgaacaacattggcagtga

SEQ ID NO: 56470 - DNA, 138 bp, Glycine max
  Peptide Sequence Number=SeqID_173248
atggcaacagggcggggacgagtattgccttctcagtcctcgactcctcaacatatacccgtactcatccctgatacccgacgggtatccagtattggatatccctgtccatgtcccgttcccggttcaaatttgtaa

SEQ ID NO: 56471 - DNA, 180 bp, Glycine max
  Peptide Sequence Number=SeqID_173249
atggcaacatggcgggacggggacgggtattgcctccccagtcctcgactccccaacatatacccgtatttgtccttgatactccgggttaaattttgttaccccaacttcgtacctatcgggtacgaaaataggtatggaacgggtagtgatattcccgttcctgatttaaaaagttga

SEQ ID NO: 56472 - DNA, 687 bp, Glycine max
  Peptide Sequence Number=SeqID_173250
atgtgggcctccagaacaacaggctcaatggcccattaccctcctttcgcggactgtcaaagctcaaatacacctatctcgacaaaaacaacttcgactccatccctttcgattttttccacggcctctagagctttcaaacaacaacttaacgatcaagattccgtggagtttaaatggctccgcgttgcaggttttgtggttgaacaaccagcaggaagagcgtctcagtgggggattgatgttgtggctattatggtttcgctcaccagtctgtggcttcaaggaaacgctttcactgggacatttcccgagaacattagggatttgagctctctaaaggatcttaaccttaatggcaacaacctcattgggttggttcctcaaggtttgggtggcataaagctagacatgctggatttgaacaacaaccgtttcatgggtccaattctggattttaaagcagttatggtgtcatattattttaatgatttttgtgtgagcaaatcatgggttcttttgagaatgatgaagagaggagtagttgttgttaatggtgccttggttgtcccattgtggctcttcgacgagggttcgcaggagcttgggtggaacagagaaagaggatttgaaaagtctagagttcttcttagggagtcccacacggagaaagagaaatataattaa

SEQ ID NO: 56473 - DNA, 414 bp, Glycine max
  Peptide Sequence Number=SeqID_173251
atgccgagctggttcaggttttgcggtgttcagaaagaaagaatggagccagaggacatgtatgtattatcacacagtgggtgtgtcttgtctgctccatctcctaaaccttggctgcacaagcctcctaagtgtagtgattgtgatccacttttcaagaagattgaagactacccaaaagcaacagcggtgcttgttcgcaaccatgggtgttaccattacctctttgatgctactctcaaacttcatcaaatgggattggactggtcaactccgaatcatggtccaatacaaagtgcaagaaggggtctaagtattgctggggagtcaaatgtatcagttaaagcaagaaaatctaatggtgacagtgatccattcccagtgagttcacataatcctcccttttttgtttaa

SEQ ID NO: 56474 - DNA, 444 bp, Glycine max
  Peptide Sequence Number=SeqID_173252
atgggggagacacatgaaataccccatcgcaatctagccgacatcgagcctcgcctcagatatgccactgaaaggcaagaagttggtgatatacccttgcaaaacactttggagggccctcaatttctcccccaaccacaacccttgcatttcacaatgggtaaaatccctcctgctatggcagaaaagggaaagttggatcatctaaaggaaaggctcagggccattgaaggaggcggaaattatgcctttgctaacctaaaagagttgatcctagtacccgatgtcgtcacccctcccaagttcaaggtgccagagtttgacaaatacaaggggactacttgccccaagaaccatctaaagatgcattgtcggaagatgggggtatacgtgaaagatgaaaaactgctaatacatttcttccaagaaagtcttactgggtag

SEQ ID NO: 56475 - DNA, 219 bp, Glycine max
  Peptide Sequence Number=SeqID_173253
atgaagattagtgttgcgaaggcagagccatttggcggtgtcgatagtgtcgtagagggtgaagaggaaggggtggatattcattttccagagaagggcatcgagtttagaggccatggaggcttgggtggcagtgaaatggagttgagttacagtgagttcggcaatggtggcctcgaggtggtccaggctagatgtggaacgtgcagattcccttag

SEQ ID NO: 56476 - DNA, 225 bp, Glycine max
  Peptide Sequence Number=SeqID_173254
atgaagacgaaggaccaacaaccaccaccaacaacaaccactagcacagaggaagacgaaggaccaacaatcaccaacaacaaccaaccattagcatggaggaagacgaacgatgagcagaagtggaacaagcaccaacaccaaagggtgaaagatatttttgccttttcaccacgactgctgggtgccccagcaaaaatgctgggtgcaccaagtaacacctag

SEQ ID NO: 56477 - DNA, 1115 bp, Glycine max
  Peptide Sequence Number=SeqID_173255
ttcctcttgagccaccagaggtcacggatgcgatgggtgaagctttcccatcggcctgtccctccaaagctgcccttgaagccaacagagccacagcaacacttctcattcaacagctcgctggtgggtctcaagctgggaagactgtggctgctagggagattcggttgctcgcaaaaactggaaaggaaaatcgtgccttcattgcagaagctggggcgattccgtatcttcggaatttactttcatcacccaatgcggttgctcaggagaattctgtgactgcgctgctcaatttgtccatttttgacaagaacaaaagtaggattatggacgaggaagggtgtcttggatcaattgttgacgtgttgagatttggacacaccacagaggcaaaggaaaatgctgctgcaacgttgttcagtctatcggccgtccatgactataagaaaataattgcaggtgagataggagcggttgaggccctagcagggctgttgcaagaggggactccaagaggcaagaaggatgccgtgacagccttgttcaatctttccacacacacagagaattgtgttagaatgatcgaggctggggcagttacagctcttgttggtgctttgggaaatgaaggagttgcagaagaagcagcaggtgcgctggccttgatcgttcggcagccaattggggccaaagcagtggtgaatgaggaatcagcagtggctggactaattgggatgatgcgttgtggaacaccgagaggtaaagagaatgtggttgcagcgttgcttgagttgtgccggagtggaggcgcagctgcaacagaaagagttgtgaaggcaccagctttggccggattacttcaaacccttcttttcacagggacaaaacgcgcaagaagaaaagcagcttcacttgcaagagtttttcagagatgtgagcatgcatctgtacattatggtggattaggtataggctatgcgtttgctggcaattcaactacaactagggataccagctttgccgtcctcagtcaacaaaatgggtgttttcagattgagttgcgtctagctggatattgtgtgagaatgcctcaaatcaaacgtgattcttaa

SEQ ID NO: 56478 - DNA, 330 bp, Glycine max
  Peptide Sequence Number=SeqID_173256
atgcaacagggacagacagatattctcatagctaggttccctgaccctaactatggtgtcaaaacgaatcacgtttatctcgaagaaaaccacgaaggtcagatcagggcttcgttctcaactgaaaccgcgaggcaagcttggaagattccgcttcggttgaagggttcttctcggtgtggggtttcaacggagaacaatggtggtttatggtggctactggtggctgtgggtgatggagaaagagcttgggaagttggaaatggttttggaagaaagaaggagaaggaaatgacttttttccaaggctacacgaaaagcaaaggctga

SEQ ID NO: 56479 - DNA, 833 bp, Glycine max
  Peptide Sequence Number=SeqID_173257
atggcttcaggggcaattttctcgtcgctccggcggagaaggtcgccgacgttggaagcgtttctggcccccgttgacttaagcgccgttgcgttggttcagaccctcatctccgttgccaacgagattgtgtcttgtttttcgaagcgttgtttcttcttccagcgcaagaactcgcggtctctgatccgaaaagttgaagtttttcagttgcttttggagtatttgcgtgattctgattcgcgttcttcgtgtcttccacccacggcggtgctttgtctcaaggagctctacctcttgctctaccgctccaagattctcctcgattactgcgcccaatcgagtaagttgtggctcttgcttcagaaccattccatatctgctcacttccatgatttgaaccaggagatttcgaccattatggatgtttttcctgttaaggatgttttgttgagtaaggatgttagggaacaggttgagctcttgcagaaacaatctagaagggctaagctttttatagacatgaaggatgatgctctcagggttcggtttttctcctttcttgatgagtttgagaatggaaggcttcctgattctgctgaattgagatctttctatgttgagaagttgcagattgttgatgcggctagctgtaggtctgaaattgagggcttggaggagcagattgttaatcatgagggtgacattgagcctactatatctgtgcttaatgggttggtggctatgactagatattgcaggtttttgctctttggttttgaggaggatgagcttggttttgagaggggaagtcacaagaagcctaagaggag

SEQ ID NO: 56480 - DNA, 777 bp, Glycine max
  Peptide Sequence Number=SeqID_173258
tcacctgctgcagcccctaaaccccaagcaaaacctgcccctgccacaccagctcctgctccagcaaaaccattggtcccctcattaccccaatcacccttgtctgattcttcttctaatcaagacatcatcagaattctaaggaaggccaaatcattcaacacgctaattcgcttgctcaaaaccacccaaattatcaaccaagtcaatgcacaacttgtgaccacaaaatctggaggaggtttaaccattctagcacctgatgatggtgccttctcacaactcaaagcaggttacttcaactctctcggcgatcgccaacagaaagcattgatacagttccacgttcttccagtttatgtctcaagctctaactttgactctcttagcaatccagtgatgacactggccagtgatagccccaatgggtatcaaataaatgtgacagcttatgggaacagtgtgaatatttcaactggggtggtaaatgccactctcacaggcattgtgtacactgataagacacttgccatatatcacgtggacaaggtgcttattcctttagatttctcaaagcctaggcctccagctcctgctcccacgttggcaaaggcacctaaagctgataaggataactcatcagcagatgatgatgatcagggagagttaaacaaggccacttctgctgcaaattccatcaatttaattagcattcgtggaacaatgttggtgtcccttggtgttgctttagtcgcagcagtaacattctccatatga

SEQ ID NO: 56481 - DNA, 252 bp, Glycine max
  Peptide Sequence Number=SeqID_173259
atgcaaaaagaagagaagaagcaaagaccccattatctcaaagctcaactcaagtgcactcactcactcaaagtgccaacaaccttatccccaaggaagttaatgaagcagaggcataaagaacatgatgtaacatttcttccaaaaagagagagagaaatgaagaaaaaaagtagaaggcaaacacctcaaacgcctgaatcagaaaaaggaaggggacccgttttgattattaaggctcggatctcttag

SEQ ID NO: 56482 - DNA, 3605 bp, Glycine max
  Peptide Sequence Number=SeqID_173260
atgttacatcatgttctttatgcctctgcttcattaacttccttggggataagcctcaaaattgtgccttgtggtgtttcaagctattggggtagcagcactattgtgtggtcagcaaagttccttcctttgggacctttggttggctcaatgggtttgattgaatgttgggttgtgtttatggaagattctgctgttagaagggttggtgttctgatcatgactagggctgtccgtagtagggtacttaaagatgccaatggtgatattagtgatcatctacgcaaccacatccatttgacaaattgtattcacctgaagaaccatatgcacaagaacagccccatactggctgataggtcaatcatgagggacctagttgtgctgcagagatcgcggtctcttagagacccttctgcaagtcctccatcatggcactcgccttctgtagttgacttgcttttcaaaagagttgaaaatgatgctgtgtctcaagggggaagaaggtctataggtgtcgagcgaaggaaggaagggagaagattgtctggaacttcaccacccttggtgagtataggttcatcaagagttgctccaggtgagattgttaggggtaatgatgggataacggcacctagtgaacgaagtagcaggagtggaatgggagatggaaggagagttgggagagaagaatctggtaggaagaatgataggcctgactttttggatgttaatccagaggagcctctcaatcaagctggcaaaagcttggctgaagatgttatttcaaggcactcagagtctaaagctagaaagagcaaacaaagggggaagaatgttcaagatgctcaagttaagacactttctgagcagctgaatgatgttccattggatagtgatgacttagcatcatcgaacattcattttcgtggaaggtttcctaggcaggagaaaattattaaggaggtagaagcccgaatgcgcagtcatggcagtggaatgaatagggggaaaaggcgtaagtttcgaagtgcgcgaagaactcgggttgctacaacatcaagagatattgtagctgagaatgaactgtctgtggcttccaactcattagctcaggcatcagttcaccataaatatcatttggaggaggctgatgagtttgcagatgaaaatgttactagggctccaaaaaatgggtgtggcattccttggaattggtccagaattcatcatagaggtaaaacattccttgacatggctggaagaagtttgtcttgtggtttatccgattcaaggttgaagaaagggacatttgctgccaatggaagaaatatttctgagatgcctgtggcatctgagcgctcaagctcatgtaccaggtctgatgcagaggcactacctttactagttgaggcgtcaggatctcatgcaagcactgaaaatgcttgttgggatcattactattctggggaactaggtctttttggtgataatttattcaagcatgatgttgattctgacctcgcttctgaagctagatctggtgatcagcggaagttgagagggaatcgtcacagtagacaccaaagtttaacacaaaagtatatgcctcgaaccttcagagatatggttgggcagaatttagtggcacaagctctttcgaacgcagttatgaaaaagaaagttgggttgttgtatgtgttttatggcccccatggcactggaaaaacttcctctgctcgcatatttgccagagctctgaactgtaattcttcagaacacccaaaaccttgtggtttttgcaattattgcgtagcacatgatatgggcaagagtagaaatataagggaagtaggtccagttagtaattttgactttgagagcatcatggaactactcgacaatatgatcgtttcccagcttccgtcacattacagagtgtttatttttgatgactgtgatactctgtcaacagattgttggaatgctatatcaaaggtcattgatcgagcacctagacgtgtggatgcagatattatatatacattggagtggattgcaaccaaagaaggtctagaaattgataaggatgccctgaaactcattgcatcaaggtcagacggatctttgagagatgctgagatgacccttgaacaacttagtttgcttgggcagagaatatccgttcctcttgtccaggaattggtagggctaatctctgatgagaaattggtggatctgcttgatttggcattatctgcagacacagttaacaccgtgaagaatttgagagtgatcatggaaactggtgtcgagccattggctttaatgtcacaacttgctacagtaattactgatatacttgctgggacctatgatttcagaaaagataggcgaagaaggaagttcttccggagaccactgttgtccaaagaagacatggagaagctgcgtcaagctctgaaaactttatcagaggctgagaagcagttgaggatgtccaatgacaagctaacatggttgacagctgccttacttcagcttgctccagaccagcaatatgtgttgccaacttcatctgataatagtttcaaccacagtccctttgctctaaaagatgcagatgcgagagaagcagctagactgactggtaatcccgttgacattcctaacaaaggaagacgattatcaatggatgctagaattgaaaatgtccatgctggaagctcagcagatggtatgacaaggggtcttggttctgagaaaaaacgacatagtgtgtctggttttactcctcaacatgctaattcacaagccactgaaaagattaggatgagcgagaggcagattttgggtataaaccgtacaaaaattgaagagatatggttagaggtgcttgagaggatacaaattactggtctgaaagagtttttgtttaaagaaggcaagctgatctctgttagttttggggcagctccaactgtgcagctaatgttcagttctcaattgaccaaatctactgccgagaagttcagaggtcacatcttacaagcatttgaatctgtccttggatcttctataacaatagaaattagatgtgagttaaataaagatacagcctcggctgttcaacaacctcttacattgccctctactaatgatagttcgtctcagattagagactttaatggtgttggcactctagctcatccatcagtaactgattctgttgaaaagagaaggggtgaaattgtagaagaagcagcttctcaagtggagcaaaagaatagcaagcagcaggttgatgctcatggaacatcttataaaagtttagaaggtacaagtataggacaatcatcagcttcccaaaaaaagccaattgttaagtcgcatttagaccaaagaaagcttatggagcaaggtcaaagtcggagtcttgtaagaagcaaagtatctcttgctcatgtgatccagcaggcagaaggtcagagaagtgggtggtcaaaacgtaaagcggtttctattgctgagaagcttgaacaagagaatctgtatgttgctactccatccttttctcttttgacatatactctatgtatcaagag

SEQ ID NO: 56483 - DNA, 126 bp, Glycine max
  Peptide Sequence Number=SeqID_173261
atggatctggcatttgatttgtccctctatgctcttcttggggataacatctacagcttcggagagctacttgcccatcctatagagagcaattatataaaaaaatttggagcacctatcctttga

SEQ ID NO: 56484 - DNA, 891 bp, Glycine max
  Peptide Sequence Number=SeqID_173262
atgactctatctcttgtgaacagaaccagaacctcctccaacattcgaccttttacattgttcctgcgccaccacacagattcacaattacctcatggcccctcctgcgtcttctccaccaccgagcttcgctctctccgtcagagacgaccaccgcaaagacgaggagagcaagtgcgcttacctcatggttgctctctgcccttgtctcatttgcttcattatcctcttaattgcactttctatcattctcgttgtcaaattccatttcttttgccacacccctctccactccttgctctacaaaaaaaactgctgattccccatctggccactttttccgccttaccctttttccattttcatggaaagtttccgtttttgaattgtcctaggacattttctagtaatgctgattctgtggttgagaatgatgatggtggtggtgatagtgataagggttatgatggtagagatgttagtggtgaatcatgtgcagatcctgctgaggttgagagggtatgcaaggtgattgatgaattgtttgcgttggataggaacatggaggcggttcttgatgaatgtggggttcggttgtcgcatgatttggttgtggatatgctgcaaaggactagacagtttgagaccatggtggcaatgcttgaggaaatgggtgagatgggccttttgacaatggagactttctccgttgctatcaaaacctttgctgaagcaaaccaaaggaaaaaggcagctgggatctttgatctaatgaagaagtatgagtttaaagtgggtgttgatgtgatcaatttcttgcttgatagtctcagtgcggcaaagcttggtaaggaggcacaagccgttttcgagaagcagggtgtggaatga

SEQ ID NO: 56485 - DNA, 1071 bp, Glycine max
  Peptide Sequence Number=SeqID_173263
atgggagcagtgagtgatggaaaccgcagcagaaagaagtcatcatcaagagggcaccacaggtttgtaggggttcgacaaaggccatcagggagatgggtggcagagatcaaagactctctacaaaaggttaggctttggcttggaacatttgacactgctgaggatgcagctcgagcatatgacaatgctgctcgagccttgagaggtgccaatgctagaaccaactttgaattgcctgagtcttcttctggtggtgctactaagcgtggtggttctaagtttgtgcctgattgcactgaacccttttcttttgaggatgtgaatgagccaggttcagaagctgaaggccttcttggtgcacttaaggccaagctgcttgatggaaagaaagggaagtttcagtttcaatttcttggtaattgttctgccccggttgttcaatctggcatggtttcaagatcaactcagaactgttctgggaagaaagaattgctattaccatcatcagctaataatactgttctttcaaggatgaatggaactggaacttgcagccctgtgcatggtttaatgagtactttagcttcatcaaacacttgtgctaagactgtggttatcccaaatcatgatcatgaattagttgctgtagcaagcacaagcagtggtagagtctactctcatcaactttgtcaaaccccacctgtgacaacatggcccaatgaagtggcatatgatttgccttggcctacacaatatatgagtcaagttcctgataatagccttcttgcatcttccggtgctgtagccaccttgtctacatggccactttctggggtaactgagtctactgttgatatgacatacatggatcagggacaatcaaatagcaacaaaagtggccaaatgatgaatatggtgagcatgcaattgcctctagttggtggtgcaaatgaaggcctttggacattggagcagcaacaatttgtgcaatgtgatcagaacaacagctggtttagttttaatggctcttgggatcctctcctctatgtgccctctgagctaacttga

SEQ ID NO: 56486 - DNA, 168 bp, Glycine max
  Peptide Sequence Number=SeqID_173264
atggaagaaacttccagcggaattgtgctggcatatgctcttcctactcttttcaatggcatatccaaaatttggtgcgattattacttgctatatataggacttctatattataacatgataaccttagacacagaattggtgccatgtgaggaaaatggacagtga

SEQ ID NO: 56487 - DNA, 375 bp, Glycine max
  Peptide Sequence Number=SeqID_173265
atgaaggccaaatgcccttcacccaatgttcggagttatacaattatgatacaggacttctgcaaacaaaagatgatgggtgaagttgtagaatatattgatgaaatggtagatcgtgagtgtcaacctgatgctgcactttacacgtgtttgatcactggatgcatcagaaggggtgttgtcctgatgataattcctattccgtatacattgggaatgttagagaaggggatgaaagctcctcagcttgattataacaagtgtgcttctgatatttctaaaattgggaatgctgtcattcttgaggagttagctcgaaagatgaattttgttggtaagtctgaagtgtctaatgtcttagctagttggggctga

SEQ ID NO: 56488 - DNA, 801 bp, Glycine max
  Peptide Sequence Number=SeqID_173266
atggtgcctgtggtcacattcatgatggcattaccatttggattagagaccgtgaaaatcaagagcaaaagtggcagagctaagattcttggttcattggtgtgcataggcggcgcattgatgttgacactttacaaaggcaagccactgtttaatttttctcactatgaatctgtatctcctgtggccaagagttctgaagtgaatctagcttctacaaggacaacgggaaaatggactattggtgtaatagcgttggctttgggaaccattttttggtcttcttggtttattttacagtcaaaaataagcaagagatatccatgccagtattctagcacagccatcatgtccttctttggagccattcaatcagctgttatttgcttcttcactgaccacaacttgtccatttgggttctccagggaaagatacaaatcattgctattctatatgctgggatgataggttcgggtttgtgttttgtgggcatgtcatggtgtgtgaagaagagaggtcctgtctttactgcagcattcagccctcttgttcagataatggcagcaatgattgatatccctgtcttgcatgagcagctccatctgggaagtgtgatgggttccatcttggtgattattggattgtacattcttctatggggtaagagcatggaaatgcagaatcgtgtggtcaagttagtccaagaagctgaagaaaccaaggaacaagagccgcaaccgcaaatacaacagttgacagtgtatgttcacgcagaaacgtgcgattcgcagtgccactga

SEQ ID NO: 56489 - DNA, 678 bp, Glycine max
  Peptide Sequence Number=SeqID_173267
atggctgttgggtttcaatgtgatggtaattggatgtattctggctcagaggatggcacagttaaaatctgggatttgagggcacccggttgtcaaagggaatatgaaagtcgtgcagctgtaaacactgttgttctacacccaaatcaggcatacaccttgcaaaagcacatgatgcttctctttgacctcccacatgttccagaggtggatacagctgtacgctctttaacagtaatgtgggatgggagcttggtagttgcagcaaataatcacgggacatgttatgtgtggcgcttgttgcgagggactcagacaatgacaaactttgagcctcttcacaagctgcaagcacacaagggatacatcctcaaatgtcttttatcacccgagttctgtgaaccccacaggtacttggcaactgcatcttctgatcatactgtcaaaatatggaatgttgatggttttaccctagaaaaaactcttataggtcaccaacgctgggtgtgggactgtgtcttctccgtggatggcgcctaccttattacagcttcctctgatacaactgcgaggctctggtctatgtcaactggtgaagatattaaagtttaccaagggcatcataaagctacaatttgctgtgccctacacgatggggctgaacccgcaacttcctga

SEQ ID NO: 56490 - DNA, 454 bp, Glycine max
  misc_feature (242)..(242): n is a, c, g, or t
  Peptide Sequence Number=SeqID_173268
atgccttcagaatcatcaacgaagtcaagtcaatctccccctgctgaaggcgacaagcacaagcatttggacagggaaataagggagatggtgtctgccatcacccaccgtgtcactgattttcacaaaccaggctccacccaccatttggagaatgaggatgaacatgacatgaggatcattaccctcgcaggaaccaacgatggtgcaacactgagaagcgaattggatgaaaaatcagncaaaacttctcatggtgagcctgaagcattgagcacctttgttaacagcaacttccaagccatcaacaactccatcatgcttggtggtagctaccaagccaatgaccctggtgtgcatttggatatctctgatttcactgatcaacctcctgagagccaccaccacaaggttgagaagccagggaagaagggaaagaagaaagacaaagaag

SEQ ID NO: 56491 - DNA, 234 bp, Glycine max
  Peptide Sequence Number=SeqID_173269
atgtttgagtgccagcgccaggggttgcgcgtgccggagcagatggcgatcgccggttttcacggccacgacatcacgcaggtggtcaatccgcggctggctacggtgctgacgccacgcgaacgcatggggcgtgaatcagccgccatgctgctggcgcggattggcggcgatcgcagcgtgaccgcgccgctggatgtcggttttgagattgccgaaggtggcagcatctga

SEQ ID NO: 56492 - DNA, 2349 bp, Glycine max
  Peptide Sequence Number=SeqID_173270
gcgaacgggccagcgccaacgcgctgacactggccacccgacagctgatgcgggatagcggcggcgcgaaagtcggccagccaaaggcggacgttcttctctaccgtcatattgggaaacagcgcatagctctggaacaccatgccaaatggtacgtttctgcggcggcaacggcaccagatcctggccctgcagcagaaatgggtgccgctgtcgacatcgccgctcgggccgagcagggtgacaaactcaccttcatcggcgctgaaatcgatgttttcaaaaatggtggtaactcatggtcagcctcgttcaggattgagggcattggccagccaggtgaccagcaggacaaccgcaaaataagagatcaccagcgcgctggtgaaatgcccgctgccgttgcgcatgttgtagagataaacctgcagcgtttcatagcgggtgccgaccagcaggttagcaaagacaaactcaccaatcagaaacgagaaggagagcagcacggcaatgaacacccctttgcgcagatttggcagcaccacaaacagggctgcctgccaggtgctggcgcccagcagatgagccgcgtcaatcagctctttcaggttgatggcctgcatgttgttggcaatggcgcggtagataaacggcaacgcaatggtgaagtaacagccgatgagaatccatggcgtgccgcgcggatcgctccacaactgcgtcagccacttcagggtaaagccctgcggcagaatggtatcgctccactcactggagatgccgtacagcagcgtcgccagcagcggtgcggcgagcacaatcagcagcagccagacaatcaggcgatggtagagtttttcgacgcgagacatgtcaggactcctcgcggcgatgcgcaccggcaccacgttgaagttgccggtggtcagcgcgtaaatggtggcgtaggcgcccagcgcgttggccagcaaaatcacaaaggtgccgagcagcgccggaaacagaatcggcaggccgatgtgccaccagtagcgccagcggctggcaccgagcagtgccgccgactcttcccagtctttacgcagcccgtcaaacgccgggtagagcagcagaataccgagcggaatctggaaccaggtgtaaaccagcaccatgccgtcgcgcgaaaacagcttaaagctgtccagccagccgtagtggcgcagcagcagcgtcaggcagccgttcagtccgagcaggatgacaaaggcgaaggccagcggcacgccggcgaagttgctggtcatattggtgaacgacagcaaaaagcgctgaaaacgcccggtgccgagcttgtgcagcgaataaccggcaagcagcgcgatcagcaggccgatatcgctgtagttatcgatgccccagcgctcgttgatatcactccagaagctgttgatggcaatccacagcagcggcgcgagctggaaggcgatccagaacagcacgaacggcagcagcagcagcgaggccaggcgcggctccgccagcagaccgcgacacagcggtttgtcgtgcgtgacgccgagcagggtgcagacggtgccgcacaggtcggtttgctgcggttccaggtcgggctgcagcgagaagccgcggccaaaaacaaacagcggcacctgcgtctcttccggcagaataccgccgtgcgagcgatcgtcgttcatgccgtgatcggcggtgacaataacctgataaccggcggccagccagccgggcatccactgcgacagatagccatccgccattcgtgcccggctgtgcttgtgcccggcatcgtcgatgttcattgggtgaatcagcaggaaatcgggatcgtgctgcaggcgcaggctttcggcatcctcgaacagatgcgagtcggggtaaccgtcgtcccagtagaaatggccgtactggatcggcaggtcgggcgcgttagtgtggcgatcgcgcgcggcgttgaacggcgagcggttatacagttcgctcacccagtgataagcggcagcggcggtagtgagtccggcgtcgcgcgcgtagtgaaagatgctgcgctgattgctcaggcgattgacgccgttgtgaatgatgccgctgcgcaccggtggaatgccgatagcccatggcgtgctgcgctacctgattactcagcccatcgagtaccaccaggattgttttcatccccgctccctcaggtgcgcatgaatgcgcaccctgtaaaaattggtgataggtaccggcgcaatgtattgcgcattgccggaaaacggatgcgcgatacatcgcgccgctacggtatgtgcgactggcaaaacgtctgcgttactgcttcat

SEQ ID NO: 56493 - DNA, 912 bp, Glycine max
  Peptide Sequence Number=SeqID_173271
atggttaaagtcttttgcacggggcgttatccttgcttcagcgcgcggtacagcggcgacgccggtaaaaacagttcagttaacagcagcggtttgccggacaggcgcagccgcgagcggcgtccccacaggtcatcaatctggcccggatcgataaaatcgcggctcagcgtcgaggaggaaaacagcgtgctctccggcaccacggtacggccaatcagccagggttcattgtcaccgcacagcacgatttcacgcagccagaagcgcgtgtcggcaggcaaaaacgccgcttcctgcggcatctcatcggcggtaatgaacgcttcccgcagcagttgtacggtaacctgctggcagtgctgctcaaagcggcgcgtcattgagtcttcttccagcagccagtcaagcagcggcggtgaaagtaacggggaagaggctggcagccagtgcagtgcgcgtaactggggcagcgcgtcatgcgacatcaggacatctccgcgtgacacatctgcttgtgccacgctggcgtcgcgggaggaattactcgcgtttcaggcggttactgttggccagccacagcgtcaccaccagaatcaaaatggccgccgagtagcacaacgtatcgaaaggatttttatggtcgacaatgatcagacgaataatcgccgtgatcccgatatagacgaagtagcgcagcggaaagtgatagccggactgaaagtacttcacaatcagcgcgataaactcgaaatagagaaagtagatcacaatgccttcgatcagcagatacgaggacgcctgctcaccggtactgaacagcacattcgccaggtgaatagtctctttaccaagaaacaccaccagaataacggccagaatcaccaggccaatgttcagtacccactgtaa

SEQ ID NO: 56494 - DNA, 152 bp, Glycine max
  Peptide Sequence Number=SeqID_173272
atgtgccgggttatagatgaggcgcggcggcgcaataaaccagccgcgccgcagttcgcggtagatgacgccctgcgcttccagcaggccaagcgcttcacgcagcgtgatgcgcgtggtggaatattgttcgctcaacgcgcgctcggccg

SEQ ID NO: 56495 - DNA, 987 bp, Glycine max
  Peptide Sequence Number=SeqID_173273
atggcaaataacgtcaccggtttcctgagaatcattaaagccgccggttattcctggcaggggctgcgcgctgcctggcagcatgaagccgcttttcgccaggaggcgattgccgcactggtcgcggttgccattgcctgctggctggatgtcgatgccatcacgcgtgtgttgctgattggctcggtggtgctggtggtcattgttgagatccttaatagtgccatcgaagccgtggtggaccgcatcggtcaggagcgccatccgctggcgggacgcgccaaagacatgggctcggcggcgcgactgtataaacaaccagggggcgggatgaaagcgttaaccagcaggcagcaacaggtctatgacctgattcgcgaccatattaatcagaccggcatgccgccaacgcgtgctgaaattgcttcgcaactgggcttccgctcgcctaacgctgctgaagagcacctgaaagcgctggcgcgtaaaggtgtcattgaaatcgtctccggtgcatcgcgcggtatccgcctgctgatggaagaagaggcgagtgaagggctgccgctgatcggtcgcgtcgccgccggtgaaccgctgctggcgcaggaacatatcgaagcccactatcaggtcgacgccaacctgttcaaaccctctgccgatttcctgctgcgcgtcagcggtatgtcgatgaaagatatcggtattatggacggcgatctgctcgcagtgcataaaacgcaggaagtgcgcaatggccaggtggtggttgcgcgtatcgatgatgaagtcacggtgaaacgctggaagaagcagggcgcgattgtccagctgctgccggaaaacaatgatttccagccgattgtcgtggatacccgtgaacagtcgctgaccgtggaagggctggccgtaggcatcgcgctcgctcaggccgactaccgtaaccctcgggatggggctgatgcagctattttcctcttctga

SEQ ID NO: 56496 - DNA, 837 bp, Glycine max
  Peptide Sequence Number=SeqID_173274
atgcgtattgataaaccgattggcacgctgctgctgctgtggccgacactgtgggcgctgtggctatccggcatggcgattccgccgctgtcggtgctgctggtgttcgtcctcggcgtgtttgtgatgcgcgcggcgggctgcgtgattaatgattacgccgaccgtaacgtcgacggccacgtgaaacgcaccgccgcgcgaccgttagccagcggcgcggtaacggagaaagaggcgaagctgctgtttgccggcctcggtctgctggcgttcctgctggtgctgaccatgaaccgcatgaccattctgctgtcgtttggcgggctggcgctggcgtgggtttacccctttatgaagcgttatacccatctgccgcaggtggtgctgggcgcagcgtttggctgggcgattccgatgggctgggcggcggttagtgagtccttaccctttgtctgctggctggtgtttctcgccaatatttgctggacggtggcctatgacacccagtacgccatggttgaccgcgacgacgatctgaagattggcgtgaaatcgacggcgattctgtttgggcgttacgacaagctgattatcgggctgttacagctggccgcgctgggcctgatggcactggtgggcattttactgcatctgaacggtgcgttttactggtcgctgctgctggcgggcgggctgtttgtgcatcagcagaaactgattgccgggcgtgaacgtgagctgtgcttccaggcattcctcaacaacaactacgttggcctggtgctgtttattggcgtgctgctcaatacccagccgtttgttgcgctgttctga

SEQ ID NO: 56497 - DNA, 447 bp, Glycine max
  Peptide Sequence Number=SeqID_173275
atggcgctgcagcaggggcgcattgccagcactgaggtgatggaggcgcgcgaggtgccggcgcagctggcaattgcgcgccatctgcaactactggaaggcgatcaggtgtaccgcattcgccgcctgcgccgcatagatggtcgcgcagtgctgtacgtcgagcattacctcaatccggccttctttcccggtctgctgcgagaagatctcacccgctcgctgaccgatctgtatgaccagcgctacggcattcactacggcggcgcacggtttaccattgtgcccggtccgcttccggcgcgggcggcgcccgcactgaacgtggcgagcggcacgcccggcctgctgattacgcgtatcaaccgtgaccagcataagcgggtgattgactgcgactgcgagtactggcgttatgacgcgctgtgcgttgatgttgaggtgtga

SEQ ID NO: 56498 - DNA, 1071 bp, Glycine max
  Peptide Sequence Number=SeqID_173276
atgtccggctttcagccacttatctgccgcgttacgtcctgcaataaagcgttagccagcgttcagaatagggctaataaactattccgtcgtagagacagtacacgacaattaaaaggtgatggcagactcatggtgaagacattattcagacgcaagaaaattgcttatgttgttggttttaatgcggtatttgttacctcatcagcatttgctgctggcacctggtacgatgcgcgtaacgatgccatggggggaaccggtgtcgcttcctcaacctggagctcggcagtgctggctaacccggcattgatgaccaaagcgcagcctgaagataacgtcagcatcatttttccttcagccggtgtgcagattactgacaaagacaaattagtggatcgcgtagacgaaattactgatacggtggaccgctatcgtgacgtgatcaacaacatcacgctgccggagatcatcaatggcgcgcctcaggtcagagccgcggcaggtgatatggccaatcagctgcgcgatctgcgcggtgataaagcgaatggcaccgcaggcgtggcgttagccgtcagcattcccaacgagacccttcctttcgccttcatcaccaaagcctacggcacggcacacatccgcgctaacgtggtacagagcgatatcgattatctggatcaggtcgcaaatggccgcattcccttgccgggcgatcaaaataatctgcgctccagcgccaacggcctggctgcgctgatcaccgattacggcgtcgcaatggcacatgagttcaccatcgccggtcacccggtctccgttggcgtcacgccgaagctgcagaaaacctggctgtataactacaccgccagcgtttataactacgacaagaatgatattaacgacagccgctatcgcagcaccgataccggtttcaacgtcgatgccggtatcgctaccgacttcgcggagaactggaccttcggcgtgaccgggcagaacctggtctcgcgcgatatcgacaccaaagaggttaacggctatcgcgatacgtatcagattcgcccgctg

SEQ ID NO: 56499 - DNA, 312 bp, Glycine max
  Peptide Sequence Number=SeqID_173277
atgtccccatcttatccttctttcctcgctcactttcttcttctctccattttcccattcactacatcacaccttcttattgtagccactaattccctcccttgcacctttatgtcaccgtcacaacatcctccaccttcaaatttaggattcagagttatgaatccaaatgtggagaaggttgtggtgatgatgcaagcgagggaaggcattagtggcgatgacgagaaggtgcgatacaatgaagaggaagagagtgggagagggaaaaggggtgaaatggggataccaaaatttttggaggtgtactaa

SEQ ID NO: 56500 - DNA, 560 bp, Glycine max
  Peptide Sequence Number=SeqID_173278
ttaagcttggtgttggagggttcaatatgggaacagctactggcctgtactctgtgtcctgctttactgctggaaaatatgggaatggcaattcttattcggccaacctaagttcagctattggtttaagtggttaccttccatgctcaaatttaaattctggagctattgctggaggagttatgcaccgaagacagacaaggacttctagcagaggtgatgagaactttccgagaaaatgggctgaatgtgacatgggcagggatatctaccattgggaacatggcatcaaatgccctacttacttcagggcctctctacaaagactttcaaaagcttccactgtctttgatccccagtttattaatacctatttactaggtgcaaagaagaatgatatggctccggattccctagcttccacactcgcaactcttggcccaaggcaacaaaatcctcacattagaagctgcacgaaagagcttgttcccacccaagctcaatgtgttcttatactgaaaaattacccaaaccaagatccctcgagtgaattggcctaa

SEQ ID NO: 56501 - DNA, 684 bp, Glycine max
  Peptide Sequence Number=SeqID_173279
atgaaaaaagagttgaaggaggcaataaaaattgagttatcccgaatggcctcacaacactcacccccagttgaggcgctggatacatatatattagctgcatgtgtcagcaataagggaagttgtgctgaagttactgcaaatccattagttgaagagccttttgttgttgatgtggctactatgggcttgtacgtagttggtgagcagtgtacacggttagtggcctggggaaaattatttgatagtgccaccaccatacacaatttcccttacgcaggtgatttggttagggtgagtgttgtaacagtttacgacgctaacgctttgatcccttttttgacgttagagattcagtatgattcacacaatcatgtgccgaaaccggttggacctgttgaaaggtgcaatacagttgcaagagagtatctgttgggagaattgatgaagatcttgtatgatgtttaccagaggctagttgagttgccatgggatgagatgaaatttcggattcctgatctgtggatgatgttaacaatattgatgtcaaatgttccaaataggtttatggatgactggggtacaagcttaggtcatggttccatgtatgacttccttgagcctcaatctatacacaatgttaaggatatatgtcaagaatgtcaacattacattgaagtatga

SEQ ID NO: 56502 - DNA, 345 bp, Glycine max
  Peptide Sequence Number=SeqID_173280
atggaggcgccacctatcaatgacactaacacgctcaaccttaggatgttcatggggacgtggaatgttggaggaaagtcttcgaacgaggggttgaacttaagggattggttgatgttgccttcaccaactgatgtctatgccattggaagtctctacacactagaggtcagggccatggctcagaggttccaagaaattatacctctaaacgcaaggaacatgcttcgaccagaggatagtggacaacatcgaagtggtcgaaccttagtcatcaagccctggactctaacacaagctcctccagtggagttaattctcctacatgcagtccaagtgacatga

SEQ ID NO: 56503 - DNA, 729 bp, Glycine max
  Peptide Sequence Number=SeqID_173281
atgctgaccctgtcccttggtctccctcacctcctatgtatatccaatgatggaagagaaccccatggattcctctccttcaactcactttgccctcactgcatccctactctgattcacactcaaaatgcactagaaaaaacattgtttcgaaaccctcaccttctgggccgtgagagggccatcgttatcaacttggagcacatcaaggccatcatcaccgcccaagagttcctcctcctcaactctcacgacccttccgtcaccccctcccttcatgagcttcaggcaaggatcatccgccaccacaaccaggatgatgttgaccccaaccccaaccccaacgatgccatcaagattctttccttcgagttcgtttccctcgaggcctgtttagaagctgcttgtagcgtcttggaaaatgaggctaaaactttggagcaggaggctcatcctgccttggacaagctcacctccaagatcagtactctcaatttggaacgcatttgtcaaactaagagccgattagacaccatcatcggtcgtgttcagaaggtcaaggaggaattggagcacttactcgatgacgatgaagatatggctgagatgtatctctctgaaaagctagccgagcaacaggtcttggagggtgacgtcgatgatgacgactgtggaagcaatgacttccaagattattttgatgatgtcaaagaatcaagagttaagcaa

SEQ ID NO: 56504 - DNA, 252 bp, Glycine max
  Peptide Sequence Number=SeqID_173282
atgtcaggatttacacgcgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgagccttggctagggttatggctaccattgaattatcaagtggtgttcgtcattggaagtgcggtagacagactttgtggttga

SEQ ID NO: 56505 - DNA, 129 bp, Glycine max
  Peptide Sequence Number=SeqID_173283
atggctcttctaaaggctctcctgggcatgctgcttctggtggaatttttagagaccacatgggagccttggaaggggctccaaactgtggccggtccaaccttttgcttgagtgtgactcttccctag

SEQ ID NO: 56506 - DNA, 174 bp, Glycine max
  Peptide Sequence Number=SeqID_173284
atgaaagaggagagggaggtgagcaagaaacaagtgtcttatgatgggcctatcaagggaaaaggtttagacccaaagtttgaggtgagcttcggtgaaggtgaagggggcggtgttcattgttacggtggttggtttgacatcgacggcaaacgaggtacccatttttgctag

SEQ ID NO: 56507 - DNA, 416 bp, Glycine max
  Peptide Sequence Number=SeqID_173285
tgctaagggacagttgtggcaaggtggtgcttggtttctctgaggaagtgagagcatgcttgatcaacatggatgaggtgaaggcgattgatataaggataaaattgttggttgcgagaggttttgtagatgtcttggttgaattcgattctagttttgtgattaacatcattcaaaacaggcgcatgagtaagcatgcttgtgcccaattggtgcaatccattcatcacctagcggggaattctattgttaggtcttgggctcacgttctacgtgaagcaaaccaagtagccgatttctttgcaaattatggtttaagtcctaatgatttgcttgtttttgactctttgcccacccttgtttacttggagttgatgactgatgtttgtaatgcttctttccttcggggcttttaa

SEQ ID NO: 56508 - DNA, 636 bp, Glycine max
  Peptide Sequence Number=SeqID_173286
atggtgtttgtgggggattcactcaacagaggccaatgggtttcaatggtttgcctagttgaatcttctgtgcccccaactctcaaatctattcggactgttgcaaatggttcactcaacattttcaaggccgaagaaaacaatgcaacaattgagttctattgggccccattgctggtagaatcaaactcggatgaccctctgaaccatagggtagcagaacgaactgtgagagtgcaggccatagagaagcatgctaggtactggactgatgcgacattctgggctcatgaatggggaggagttaagggtgacaattgttacaaagaaacagatcaaattacagaagaagggtattgggggaatggttcaattccaagtatgatgcgagttgtggaaaatgtgattgaggatttgaatggaagaggtttgaatgttcaattgcttaacatcacacagctctcagagtataggaaagaaggacacccatctatctatagaaagcaatgggagcctctaactgaagaacagttatcaaatccaaaaactaatgctgattgcatacattggtgcctaactggtgcgcctgatgcgtggaatgagctcctctatgcctatatttccatcgatgactaa

SEQ ID NO: 56509 - DNA, 303 bp, Glycine max
  Peptide Sequence Number=SeqID_173287
atgaagattaagctttggagcttgaagaagttgtctatttacatgcccgactctttgagtggcatttgtattgattattgcatcttagtctcaatctatccatatgtacatcatgcatcatcatgtagagcaacctttgctaaggctaagaagaagcctctagtcgaagcatgcaagaaggtcaagttagatgagactctagaaaaggaagaggctttagagttggaagaaggtgtgctcgcatctatgaaagctctatcagctaaagaccataagaagaagctagttgaagatgaatattga

SEQ ID NO: 56510 - DNA, 486 bp, Glycine max
  Peptide Sequence Number=SeqID_173288
atggatgaacaaggtaaggtggtaaggaacaaagctaggctaatacctcaaggctataaccaacaagatggtataaacttcattgaagcctttgctcctgctgctaggcttgtagttataagaatcatgcttgcctttgctactcataaaaatataaagttatttccaatgaatgttaaaagtgttttcttaaaaggctttattgaagaggaagtgtatgtcaaacaacctcctgggtttgaagatcatactcttccaaacaataaatacactaaagaagttctaaataagttcaagatggaaggtgccaaactagtgaaaacacctatgcaagcttccaatcctctaagcagagatgaattaggtaaaccattagatcagatgatctacaaaggtatgatcgactcacttttgtatcttactgctagtagacatgatattatgtatagtgtatgttcatgtgctagatttcagtttgatccttga

SEQ ID NO: 56511 - DNA, 807 bp, Glycine max
  Peptide Sequence Number=SeqID_173289
atgtctcgaagatatgacagccgtacaacaatcttctccccggaaggacgtctttaccaagtggaatatgcaatggaggctattgggaatgctggtaccgcaatagggatcttatcaaaagatggggtagtgctggttggtgaaaagaaggtcacatccaagctgctccaaacctcaacttccaccgagaaaatgtacaagattgatgatcatgttgcatgcgctgtggctgggataatgtctgatgccaacatcctaatcaataccgcaagggtccaagcccaacgctacacatacgcctatcaagagcccatgccagttgagcagttagttcagtctctctgcgataccaagcaaggttacacccaattcggtggtcttcggccatttggagtttcgttcctatttgcaggatgggacaaaaactttggctttcagctttacatgagcgaccctagtggaaattatggtggctggaaagctggagccattggggcaaataaccaggcagcacaatcaatactgaaacaggactacaaggatgacatcacaagagaagaagcagtacaacttgcattgaaggtgttaagtaaaaccatggacagcacaagtctaacctcagaaaagcttgaacttgcagaggttttcctttcaccctctgggaaagtcaagtatgaagtttgctccccagaggccctgactaagatgttggtgaagtctgaagacagatattggctcaaacatttttcaagcttaaacattttgcatgttggtaatgctaatggctttgtattgggtacatcttga

SEQ ID NO: 56512 - DNA, 369 bp, Glycine max
  Peptide Sequence Number=SeqID_173290
atggtcttctcattggaagaagattataagggtgccttatttgaaggaccctatattcttgttgatcaatacttgctagttaagagatggaggttgttctttctatccaatgtgaaggaagtgaccaggataccaacatggattcgaataccaaaattgcctctggatctatacactaataagtttttatggaggaaatatgtatgcttagagtttggagagaaagaagggatacataaaattgtggcagtagaagacatctctcatagcgacaatggtgacataagagggttgcagaaggaggatgaagctatggttaacgctgacgtgttagaaaattttggcactaataaattgatcgtaaattag

SEQ ID NO: 56513 - DNA, 270 bp, Glycine max
  Peptide Sequence Number=SeqID_173291
atgccgatctccccctacgaaagtattagttggtctatgtcatcccgacataggggtcgcacccacaagacacccagtggactcggagaagtccaacagggccctggggtttccagctctggttacgaggctctggatcgtgcccgcaagacacccagtggacccggtgaagtccaacagggtcttggggtttccaactctgattacgggcctcattcagtcctacaaagtgcctgtcccccccagcaaggtcatgccatcgtgacatag

SEQ ID NO: 56514 - DNA, 210 bp, Glycine max
  Peptide Sequence Number=SeqID_173292
atgaaacaaaaaggaaaaagaaagaaagaccttgaaggtcgacatgttatagttaggaagcataaatcattcgtaaagagaaaacatatcttctggaaacaagggactgacgccaagagtttattttccggaataaccgagataagaatggatgaattcattgaactgatgaaagaacataattgggaaacgttgagtctatttgtgtaa

SEQ ID NO: 56515 - DNA, 243 bp, Glycine max
  Peptide Sequence Number=SeqID_173293
atgtgtgtgcaagccattggtctgtttgctcaagcgacctgtgctcctgagtttggacttccaagaccgttcaatcagagattactcatcttgcacgttgttgggggcaccgtaaaacaacgaggacaacccttcccttgtgttcaagaatcctctactacaagagacccacggtctcttaatcccttttcagaaacaagaagaagagaagaagaggtctctcgtaaaagaggtagattgtaa

SEQ ID NO: 56516 - DNA, 300 bp, Glycine max
  Peptide Sequence Number=SeqID_173294
atgagattgacaactatcaagacaaatcaaatagttaacgagatcaagaactttgttgattggattcttcaaattggtaacaatggcatggattcatatgataaaggtgaaggtggcattgaaataccaactgatattttggctttagacattgataaaccattcctctcattggttgattttttgtattcaaacatattggaaaatttgaatattccaaatttctttgaagagagagcaatcctagctccggcattagaaactgttgatgaagggatgaaaaataatattcaagtttag

SEQ ID NO: 56517 - DNA, 342 bp, Glycine max
  Peptide Sequence Number=SeqID_173295
atggagcatgaaacattccttgcaacttggttggcagagattgatttctctcccaatggcttggatggtggaagcagtcaatattgtatcatcatcatgattttggaaagaatgttactcagtgaaagagcagtctatgcaatgatgccggtgtttccacctgaattttctcctttgaaaactattttatttggaaatccttcccaagacaccattgaaccactgatggaggctttgaaggaatattataaagatggaaatgagataaatgaatcaaggcagtttattggaggagtattggatcttgaaaagagaatcaatagactagatacattgacttag

SEQ ID NO: 56518 - DNA, 321 bp, Glycine max
  Peptide Sequence Number=SeqID_173296
atgttggtgcgcacaatccgcacttgtctctttgcagtggcacgggtgaaatcgtgccccggtatgcagagtagctgcgtgatagcctccctctctggttgtattcgcacagttggcgccctccaatatcagggggcgaggaagtgtagtcctatgatggcgaggacgtgcagtcctttaaaggcgaggacgtatagtcctctgagggcgtgtagccctacaaaggtgaaggtacatgaccctttgatggagaggacgtgtagtcctctgaaggcgagggcgtgcggccctctgaaggcgaggacgtgtagtcctctgaag

SEQ ID NO: 56519 - DNA, 627 bp, Glycine max
  Peptide Sequence Number=SeqID_173297
atgcttcagcagggggaaaaataaagttgaagacctctgaagaggcaactgagctaattgagaatatgtcagccaacgattatgccattctgcgtgacagagttcatcaacccacaaagaaaagcttgttagaactatcatcacatgatgctttattggcacagaataagttgctttctaggaaacttgagattttaacagaaacacttggttgtagcatatgtggtgaggctcatgaaacagaccaatgtattcccattgaagaaaaaactcaagaagttcactatatgggaaatcaacagagacaaggatatactcaaggaggtaacaatgtcaacaaggatagtggagatcacaccctggcaatcaattcaacaaggaccagggtaacaatgtcaaatcataaaagaactgagttagcactgaaaaaccttgaggtccaggtgggacaactagccaagcagatagctgacaagtcatcctacagttttgtgctgaatacagaaaagaatcccaaggaggaatgtaaagctgtgatgacaaggagtaagaggtttgtggaggcggaggttgaggataatgttgtatccaagaagaaagctgctgaaaagaaagatgaagtgagag

SEQ ID NO: 56520 - DNA, 519 bp, Glycine max
  Peptide Sequence Number=SeqID_173298
atggctactgtcgaccctgataatggatggaggttcgctcaatgctttggtgacaagggcgagatagacgatgttactgaaggtgtgttactatcattccatgtgcaggccttgcttcaagtggaaatccttctgctctataaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 56521 - DNA, 237 bp, Glycine max
  Peptide Sequence Number=SeqID_173299
atggctcacagcgtgttcgctccgtgcccctattcaagggacctatatgggagggagctaacaaggcttttagtgataattcccaatgtggtcatatctctcttgatggtctctagagtccccagtggagtcgccaactgtcgcaacctacccttcggcgggagggcgacgcgaggctcgcgggatgcgtcttccatgaaaggaatacgggcggagtcgccaccaatgtttatttga

SEQ ID NO: 56522 - DNA, 174 bp, Glycine max
  Peptide Sequence Number=SeqID_173300
atgggtttgtcaggcttaaaggagtactcaaacccggtgacccccaaggcctacactccgaagagtccattagggcctctcccttctgattcaggtccaacccctaaaacaattttgcatgcagacactgctcatgaattatacaatacccacgacctcacgctcgtgttttaa

SEQ ID NO: 56523 - DNA, 666 bp, Glycine max
  Peptide Sequence Number=SeqID_173301
atgagaagggcaccactagacgaagacctcacacctattattgcacgaggtttcaatagcgccaacgcggaggcacttcagaaggtctgcaaggcatgggagatggtgcaaaataaggacaaggaacttagaggcagtagcaacgggcccatcggtggctaccataggtggttgaaagcctacatgcaagttgaagttccggaggaggacgaagaggtgcaggccctcaagacagaaatcgagaaagcccaaatagtcaaagaaaagttcaaatcagcagctcttaagatccgaaaggagaatgccgaactgagagacgtaaatatagccaccaccaaggccttagaacaagagaccaaaagggcccgtagggaagaacatggccggaacaaattccgaggggctctgtggggcagtaacaacgagcttaagctccggagagaggaaagggaccaatcacgagtagacagtttgatcttgaaggatgaattgaggatttgcctaaggtccaagagaagcttgtctcagcggttatgcgagaccgagaccaacatgttagccatcatcagcaagtaccaagaagaattaaatctagccacagcccacgagcacaaagtggcagacgaatatgctcgagtgtacgtggaaaaggaggctagaggaagg

SEQ ID NO: 56524 - DNA, 357 bp, Glycine max
  Peptide Sequence Number=SeqID_173302
atggctagagttgccaaggtagtgaaaatctcggcacaagagttggaccaggtaaagcaaaataggaatggggtagttagagtaccaaggaggtgtttggaggaaaaggcaaaggccttggcaaatcaaagcgaatgggcttcttttattgacatcctggcgcttttaatctttggggttgtcctctttccaaatgtggaagggttagtggacctagcagcgattgaatctttcctcgcctttcaccatagcaaggaaagcccggtcattgccattttggtcgacatgtatgacacgttcgaccggagatgtgaaaagtgtggtgcaagaattgtttgctatacaccagctctctat

SEQ ID NO: 56525 - DNA, 441 bp, Glycine max
  Peptide Sequence Number=SeqID_173303
atggagataaccatcattcacactaacaatgaaccttcaatccacgtaaagcacttctttgacatcaatgaactagagaggataggtctcaaacttaatgagattctattgttctatgggcccaatggtccaaagaagaatgttgaagcaaagacaaccactcaaaagatgagggatatgagtgaaactatggaagaagatgatgatgcttcagttgctttaaggaaggcaaaagaagttgttcaaaaccaagctttcccttcacataaaaaggctaaggcagttaaacaatcagtcatccctttagaggttccaagaagggtaaaaacaagaaccaccaaggcgaatcccaagatagttggaaaagaatgggtccctccttcccctccatcatcatccagcaataagactactcatgatgatctagtctctttcctatag

SEQ ID NO: 56526 - DNA, 399 bp, Glycine max
  Peptide Sequence Number=SeqID_173304
atggagaaacttgatgaggtctcaagatcaaaagagcactcagaacaacatccctcaagatctattttagaagcacatgctgaacccatctccaaaagtgaaacctctaagggtggagtatcagaagaagggtctcattctgagcattttgatatatatattgcctactttcgaaaacagaccccgacgggtgcagagaaacgcgaggaactggaaccagagaggcagcatacaaaccaaggctggattttagcatccaaaaagaaaaatggtagagaggtggggagagttaacttagagttaaatgtgagaatggtagtgttggaagtggaaaagtgtgagattttgagggttagaaaagccaaatttggggttagtggaaattggagtctaaagtga

SEQ ID NO: 56527 - DNA, 150 bp, Glycine max
  Peptide Sequence Number=SeqID_173305
atggcttgtatatcgtcatcatcttccatggtgaatagttcatacttacgtgccaacaagttgagcttgttatgttttacctatgacgatccttcacatgtcagagctactatggacctttgtatattcttccttagagagggtgtatag

SEQ ID NO: 56528 - DNA, 756 bp, Glycine max
  Peptide Sequence Number=SeqID_173306
atgggaaggaccatactcaatgataattcaacccctaagcacttctgggctaaagcagtgaatacctcatgttatcttcaaaacaaaatttacataagaccaattttcaaaaagactccttatgaacggtggaagggacaaaaacccaacatatcatacttccatccatttagatgcaatttttttcttaacactaaggacaacttaagaacgtttgactcaaagagtgataatggaacatttcatggatactctaaaacatctaaggcattcagagtttacaacttaagaatgttagcagtggaggaagctattcatgtgaagtttaatgaaccagataaagatttatcagagatagatgaatcttttgcaaattttaggttccatgatgagctaccaaaaagaaagaaggttgttggagcaaaatgggtcttccataacaaattggatgaacatggtaaggttgtaaggaacaaggcaaggttagatgacaaaggttactcacaacaagaaggtatagcttacagagaaacctatgcacctatggctcgtctagaggaaatacaaattttactttcatttacaacttataacaatatgaagttgtatcaaatggacataaagagtgcattcctaaataaactaatccaagagaaagattatgttgaaaaaccttctggatttgaaagtgacattctttgtcatcatttttttaaacttaacaaagagctatgtgttctcaagcaatctccttga

SEQ ID NO: 56529 - DNA, 372 bp, Glycine max
  Peptide Sequence Number=SeqID_173307
atggaccagatggaagaagaagctgaagatgaagctcagcaagagcttatgcaccaatggagtcctttagagtctctcatgattcaaaagatggatgccatgcttcatctccatcaagagcactcagtagatgttcacaacaccttagaaaacataaccactaggctagagaacatagaaactaggctaacccttagtaacctaaactggatgagaatgaagcgtagattgactaagaaaagtaagtctctaatctcaagactcaaaccctccaaatgcactcaatttcatattcaagtttggcatcatcaaaggcaaaaggggaggggggagattgctagagataaggggagcaacatgaacaatatgtag

SEQ ID NO: 56530 - DNA, 626 bp, Glycine max
  Peptide Sequence Number=SeqID_173308
atgcttgatgcatggttcacagacgagaataagaagaacaacttcaagataatatacacaacgaagaatgtgagaatacccaagtttctagacttggagtggttttctcagcaagggtttaacttccctaatctgctcgaagcacagggtctacctaagcttgtgcaaatgaaaggaactttctacccggagttggtgaaaattttctatacttgtgcccgcgccgatatggaagaaatggttatcgatgatacagtttggaaggtggtagccggactggacatgggtggagtctgcaagtttgaagaatctgttgatggttacaataagatgcagacttacagagctatgctccttgacccagcaaggaatctgaggaatcacttaagtgtaggtggtttaactgctagagacagaatgctcgtgtaccttataacagacattctcacaccgaggtccaacaaccacgcacaggtgactaacaatgatttacagatcgtgtatggtctaaaatcagcctctagattcattcattatttcaatgtcgatgtttctaatgagattgtagactttaccaaagcatccaatgagataaccaaaaggcctatcaagaatcttgggatgag

SEQ ID NO: 56531 - DNA, 633 bp, Glycine max
  Peptide Sequence Number=SeqID_173309
atggatgaatctcttcaacggacagggttcgcgcttccacttccagcaataccggaataccgtcacgcaccgggaacgccagtccgtcgggtttgcaaatcaactcctgctgctctttgttgtaatacagttttccgttgcagaccggacaggccacaatctcaagaccgatacgtcagaggattagcataccatagcgcaatcagggacggcgcgccgccatcggcttatatgctgacgtgccagtgcgtggaccaggcggcccgcagcgcatcaggcgcgttttccagcaccacttcgcgggcgccctgccaggcggcgaagcggttaatggctttatgcacatcggcgagaaactgctggctcacgcgcacgccgggctccagccagaaggcccgcagaatcaggcgctgcgcctggcgatccattttggcatcgacgcgtcccttcacgcgcggcggcgatcccataccaccggatcaaacggtgacagcagcgcgctgtgcgtggcggcctgcggctgcgccagctgcggcagcagcgtatggtgcagccacatctcgcccagttgctcaacctcaacgcgctgaatcactccctgctcagcggcctgcgccagacagagtgcgatag

SEQ ID NO: 56532 - DNA, 463 bp, Glycine max
  Peptide Sequence Number=SeqID_173310
atggtggtgcacgtgatggaacgtgcgcgcgagtccggtgccgagcgggtgattgtggccaccgatcatcctgacgtggcggcggcggtgaccgctgccggcggggaagtctgcatgacgcgcgccgaccaccaatctggtaccgagcgtctggccgaggtgattgaaaagtatcagtttgctgacgataccatcatcgtgaatgtacagggcgacgagccgatgattccggcggagattgtgcgtcaggtcgctgacaatctggctcaggcggatgctggcatggccacgctggcggtaccgattcacgaggcagaagaggcgttcaatcccaacgcggtaaaagtggtcaccgatgccagcggctatgcgctctatttttcacgtgcgaccattccgtgggatcgcgaacgttacgcgcagtcgcgtgagcagattggcgacacgctgctgcgccacatcg

SEQ ID NO: 56533 - DNA, 510 bp, Glycine max
  Peptide Sequence Number=SeqID_173311
atgccgatggaagctctcttcggtaaattgcttgcatatgaacatgagctaattcaacataggaggaattgcactcctcaaaggaagattacaaggatagttccagtaaagattgagaacaacaacttcacatgctttgaatgcggcaagcaaggccgtatcaaatttgaatgtcctatctacctaagaaaacatgttggtgaaaagaaaggaaaaaaggacaaaaaaaggaaagccaatatagcttgggaagataatgtgtcaataacctccgactcttctagtgatgaagaaattacaaatgtatgcttaatggaaaagtcaatggatgactcatcaaccattgaagaaactgaggtaaatcctgaatttgaagaagttttggaagcatttaatgaaatgcatgaagaagctccaaggcttgttgttttgaacaaaaagttgaaaagctatatgaagttgcatatcactaaattggcttcaacacaaagtgagatagataaattgtag

SEQ ID NO: 56534 - DNA, 144 bp, Glycine max
  Peptide Sequence Number=SeqID_173312
atgggatctggaaatgaggttcactcaattgtggagttcaatttggatgctaagtggcttatagatcccaagcaactatttgttgggcctaaaattggggaaggtgctcacgccaaagtgtatgaaggaaattttggtttttga

SEQ ID NO: 56535 - DNA, 1722 bp, Glycine max
  Peptide Sequence Number=SeqID_173313
atgcgcagcgcgctcaataatgtggtgctcaatccaccgtggaacgtgcccactacgctggtgcgccaggatatcgtgccgaaggtgaagcaggatccgagctatctgtataagcacggctacactctgctgtcgggctggagcgctgatgcggaagtgatcgatccgtcgatgattgactggcacatggtgtccgccgccagtttcccgtatcgcattcgtcaggcgccgggtgccagtaactcgctgggccgctataaattcaacatgccgagttcagacgcgatttatctgcacgacacgccgaatcatggcctgttccagcgtgatatccgcgcgctcagctccggctgcgtgcgcgtcaacaaagcttctgaactggccgatctgctgttgcaggacgcgggctggaacgacagccgtatctctgacacgctgaagcagggcgatacgcgctacgtgccgattcgccatcgcattccggttaatctctactaccttacggcctgggtggcggacgacggccagccgcagtatcgtacagatatttacaattacgataacccggcgcgctccggcagtcagaccggttttgcgcattctgtgacagattgcgggttgactgctcaccaggctgcggttactgttcggccttcggctggattgtcactgctgccaggtgcagcactggcgtcagtttccacctcccgcccccgggtattaacgctcagtaacatgcataccggtgaaaccctcaaaactgagttttttaacggtaagagttatgacaaggatgagttagctcgcttaaaccacttcttccgtgattaccgcgccaatcaggttaaacacatcgatccgcatctgtttgaccagctctatcgtttgcagacgctgctaaatacgcgcaaaccggtgcagctgatctccggctaccgtacgctggcgaccaataatatgctgcgtgaatcgggccctggcgtggctaaacacagctatcacaccaaagggcaggcgatggatttccacattgagggcatttctctgagcaatgttcgcaaagcggcgttatctatgcgcgccggtggtcgctgcgtgtgtcggtcatggagcgctatgaattacctgattattccggtcaccgccttttcacagaactgttccgttatctgggatgacgagacgcaacaggctgcgctggttgatcccggcggcgatgccgaaaccattattgccgtgctggcggagcgaggcttaacgccgtcgcaaatcctgctgacccacggccatctcgatcacgtcggtgctgctgctgaactggcgcagcactatcaggtgccgatcgtcgggccgcagccagccgatgccttctggctggataacctgcccactcaaagccggatgtttggtttgccggagtgcgcgccgctgacgccagaccgctggctggaagagggcgaaacggtacagctgggcaacgtgacgctggaggtgctgcactgcccgggtcatacgccaggtcatatcgtgttttttgaccgtgctggccgtctgctgatctccggtgatgtgatttttaacggtggcgtcggacgcaccgatttcccacagggcagccacagcgatctgatcgcggccatccgggataaacttctgccgctgggtgatgatgtgacgtttgtccccggccatggcccgatttccaccctcggccacgagcgc

SEQ ID NO: 56536 - DNA, 234 bp, Glycine max
  Peptide Sequence Number=SeqID_173314
atggtggtgagcttcttcttgactcatcttctccctgaagtggcgtctcctctcaactcttcttcttctccattcccactgccattaaaattcaagaagcaaaggactccattgatgaagaagatccaaggcctacaagctccaatggagctacgtcatatagtcactaaagcttctaggatttctgccaactacatcaactcatgcttaactttagcttggtttttatgctaa

SEQ ID NO: 56537 - DNA, 564 bp, Glycine max
  Peptide Sequence Number=SeqID_173315
gagacgacgttagtctctgcgtgctatcaggcttttcgtcttacagacatcaaaaaggtttatacggataaccactcgggtatttccgcccgtcagcgtgactcaaaagtcagtatgacagatcttgtgagcgcggaagatgacgcttttcgtcttacaaatagcaaaaaggtttatacggataaccactcgggtatctccgccggtcagcgtgactcaaaattcagtatgagagatcttgtgagcgcggaagatgatgcttttcgtcttacagatagcaaaaaggtttatacggataaccactcgggtatttccgcccgtcagcgtgactcaaaagtcagtatgacagatcttgtgagcgcggaagattatgcttttcgtcttacacatagcaaaaaggtttatacggataaccactcgggaatctccgcccgtcagcgtgactcaaagtcagagacgactttagtctctgtgtgctatcagcttttcgtcttacagatagcaaaaaaaaatgtttatacggaaaaccactcgggtatctccgcccgtcagcgtgactcaaaa

SEQ ID NO: 56538 - DNA, 771 bp, Glycine max
  Peptide Sequence Number=SeqID_173316
cacgccctcgtcttaagagagctgcacgccttcgacttcagagaacttcacgtcgtcgccttcagagggctacacgtcctcgacttcagaggactacacgtcctcgacttcagagggctatatgccctcgcctttggagggctgcatgtcctcgcctttagagggctatacgtcctcgcctttggagggctacacatcctcgacttcataggactacacgtcctccacttcagagggctacacgccctcgccttaagaaggcttcacgtcctcgccttcagagggctacacaccctcgcctttagagggctgcagggcctcgccttcagagggcttcacatcctcgccttcagagggcttcatatcctcgtcttcagagggttatacgtccttgcctttggagggctacacgtcctcgagttcaaaagactacacgtccttgacttcagagggtttcacatcctcgcctttagagggcttcacatcctcgctgtcagagggctacacgccctcaccttcagagggctgcaggccctcgccttcagagggcttcacatcctcgccttcagagggctacacgtcctcgcctttcgagggctacacgtcctcgacttcagaagactacatgtcgtcgacttcagagggctacaagccctcgccttcagagggcttcacatccttaccttcagaggactacacatcctcaccttcagagggctgcatgccctcgacttcagaggacttcacgtcctcgtcttcataggactacac

SEQ ID NO: 56539 - DNA, 1356 bp, Glycine max
  Peptide Sequence Number=SeqID_173317
atggcaaataaccaagcattgagcacagacaccattgccgccattgccaccgcaccaggtgcaggcggtattggtgtggttagggtgtctggcccactagcggccgagattgccaggcaagttcttggccactgccctgccccaaggcacgctgcatatctttcttttttacaatctgatgccacgttgatagatcgtggcattgctatctatttccctaatccacactcttatactggcgaagatgtactggagttgcaggcccatggcggtactgcgctgatgcaaatattgctggagagatgcatagagtgtggcgcacgccatgcgcaggcgggtgaatttacgcaacgtgcctatttgaatgacaagctggatttggcacaagcggaagcagttgcggacctcattaatgccgcgactgttgaagcggcccgcagtgctgtacggtcgctgtctggtgagttctcccaaaccattcaaaacctattgcagcagttaatcgatttacgtatgtatgtcgaggcgtgcctggactttcccgaagaagagatcgacttcattacacaaggacgtgtgatggaaaaattgcaggctaatcaggctgcgttggaggttatttttaaccaggctaaacaaggtctgttactacgcgaaggcattaatgtggtcttgattggacaacctaatgtggggaaatcgagcctgcttaatgccctatctggtgaggaagtggctattgtgacgccaatagcgggcactactcgcgatacgatcaagagtgcgatccagattgagggtgtaccgctacatatcatcgatactgcagggttacgtgaaacagaggatgctgtagagcaagtgggcattgcccgtacctggaaagcgatcgaaaccgctcatgtggctttattgttaatagatagccaacatgggattggaccactggaaaccgctattttgacgaaattgccggtagaagtgaaaaaagtgtgggtacataataagattgatgtttcacgtgaaacatcacgtgttgaaaaaaatgagaatggacaacacgtgtttttatcggccaagacaggcgatggtattcctggtcttagaaaaacgcttctggatattgttggatatcaaccaggcggtgaaggagtatttatggctcgtgcacgccatttgcaagcattgcaaatggtaaaacatcatctggatcaagcaatgaaacaaatgcatgcggctgagttggtggcagaggagctacgctgtgctcaagaagcgctgggcagcatcacaggggagtttacgccggatgatttgttgggagaaatctttagtcgtttttgtataggtaaataa

SEQ ID NO: 56540 - DNA, 708 bp, Glycine max
  Peptide Sequence Number=SeqID_173318
atgatgatctcaacggaaagtcttgctgctctcaacgcaaccctgctgatgagcagccgtgaaattgccagaataaccggcatcacgcatggcgaagtgaagcgcctgattaaaagcctggaaaccgcgcagcgcctttcccagcctgtcacggtgaatcattacgagcatgaaggtgagacacgtcaggagtttcagctgaataaacgtgactcgctgctggcggttgctcgtctttcccctggctttaccgccgaactgctggaccgctggcaggagcgggaaaaattcacccatttgcccgatttcactaatccggcggaagcggcacgtgcctgggcagaacagtttgagcaacgccgtgcggcggaacagcaactggcgctgacggccccaaaggcagaattctttgatcgctttgttgatgtgcatgagtcgctgggctttcgccagctgtgcaaaatgctcaaggtgaaagagccggagtttcggcagtttctgcttgagcgcaacattatgtaccgtgacaaaggtgcgctgacaccacagcagcaccatctgcaagctggctattttgcgctgcgcagcggaatgggtgaaaaccagcatgctttttcgcaggcaaggtttaccgcgaaaggtgtgaagtgggttgccagcctgtgggccggtcatgtcgctgcacggccgaatggtgtcgccgcctga

SEQ ID NO: 56541 - DNA, 228 bp, Glycine max
  Peptide Sequence Number=SeqID_173319
atggaggtgagtatgcgtaccaccttgatgaagctgccgcagatggcgcattaccttgatatcccctgtaccacgctggcgcgtgctatgtgcaatcgtggcacgctggaaaaattgccgctgccggcggcggttgataacagcatgccgctctcctctcgctgctggtcacgcgaagaggtcaggcagtttcgccatcggctccagcgccgccgccatcagcgctaa

SEQ ID NO: 56542 - DNA, 249 bp, Glycine max
  Peptide Sequence Number=SeqID_173320
atgaagaacccttggcaattgacaccttatcccttgtccctaaccgacttcttcagacagctccttaggacggaagaagaaggatcagacactgaaaagggtaatgttgggatattagaaactatggaggcgcataaagaagttaatggggtgcaggtagtaacagcctgggttaaaatattcacagcccacaataatcctactgcggttgcttttgaggagctcctgtgctatctatgggagctttaa

SEQ ID NO: 56543 - DNA, 264 bp, Glycine max
  Peptide Sequence Number=SeqID_173321
atggtggttatatcactgtcaatgaaactcaaggaagagcactgttctattggtttttcgaggccactcacaaaccagaacaaaaacccgttctcttatggctcagtggagcaaggcaaggttgaggagggcagattgcaatgccaaggtgcatccctagttaccgaacaggtcatagcctttctagttaggctctcaaattggcaccctagaattgtcttcttattagaggtgttcatgttaaacatatttacctatagttga

SEQ ID NO: 56544 - DNA, 348 bp, Glycine max
  Peptide Sequence Number=SeqID_173322
atggtattgcttcggtgtgtgactacgaatgaggccgagcagatactattggacgtacatgaaggatcctttggcacccatgccaatgggcatgtcatagcccgaaagattctgatagccgaatattattggatcaccatggaaaatgattgttgtgttcacgtgaggaagtgccataagtgccaagcctttgcggataatgttaatgctccacctatgtcgttgaatgtgttgtcagcaccatggccgttttcaatgtggggcatagatgtgattggggctatcaaacccaaggcttcaaatgagcattgtttcatcttaatcgcaattgattacttcaccaaatag

SEQ ID NO: 56545 - DNA, 159 bp, Glycine max
  Peptide Sequence Number=SeqID_173323
atggatcccgtcaagtacatcttcgaaaagcccgctttcactggaaggatagctcggtggttaattaggcaagtttgtgaagtgctgattttcaccttctcgctaagcaaatctgctggcttagcgagccatccactgagcgcaacactccccggctga

SEQ ID NO: 56546 - DNA, 754 bp, Glycine max
  Peptide Sequence Number=SeqID_173324
atggcaacaatgctggatgtctcactgcgtgcgggcgtgtcgaaggctaccgtctcgcgcgtgctgaacggcacgggtcaggttaaagagagtacgcgtcagcaggtctttgctgcgatggaagagctgggctaccgccccaactttctcgcgcgctcactggctaaccagaccagcaacagcattggtctggtcgtctccaccttcgacggcttttattttgggcgccttctgcagcaggcgtcgcggcagaccgaaacccacggcaaacagctgatcgtcaccgacggtcacgacgcgccggaacaggaagaacaggcagtgcaaatgctggccgatcgtcagtgtgatgccatcgtgctttacacgcgctatatgagcgaaaaggcgatcatcaaactgatgaataccgtgcaaacgccgctggtggtcatcaaccgtgaagtcagtcaggctccggatcgctgcgtgttcttcgaacagcaggatgccgcatttaaggcggtggattacctgatcaatcagggccatcgggagatcgcctgtattaccgtcccgatccacacgcccacgggtaaagcgcggctgatgggctatcgcaaagcgctggaaaagcacggtattcgcctggacgagcgtcgaattaagtacggtgatgccggaatgacgagaggctatgagctgtgcaaggagctgattgccgacggcgtgccgtttagcgccctgtttgcctgtaacgatgatatggcactgg

SEQ ID NO: 56547 - DNA, 102 bp, Glycine max
  Peptide Sequence Number=SeqID_173325
ccaccttgatgttactctaacatcaagtgttggacctgagtgtgtagagttgatctctaaagtgtgtggagttgatctctattgttcagagagcaatctctg

SEQ ID NO: 56548 - DNA, 421 bp, Glycine max
  Peptide Sequence Number=SeqID_173326
atggccacacgcatgacccttcagttagctgaccgctccatcacaaggccatatggagtcattgaagatgttttggtgaaagttaagcaccttatatttccagctgatttcattgtcatagatatagaagaggatgttgacattcctctctttcttggccgcccattcatgtctactgcaacttgtgtggtagacatggggaagaagatgctgcagatgggcatagaagatcagaagatcaactttgatttgttccatgaggacaaagatctacctagccaaaatgtttgtctgaaagtgcatgtgatggaggaaaggagacttaagaagaaggtccttgaaaaagcgctaagcacagcctgctgtgctaagccccagatgctcactagactttacaacttcaagatgggcttagcacgag

SEQ ID NO: 56549 - DNA, 273 bp, Glycine max
  Peptide Sequence Number=SeqID_173327
atggatctcattgaaaatatgggtgcaagcgacattgctattttgagagatagagctcacattcctaccaaaaagagtttattggagttaacctcccaagatgcattattggcacaaaaaaaattgttgtctaagcaactagaagccttgactgaaacactaagatgtaccatctgtgggggagctcatgaatctggatgttgtattcctattgaagaacaccccactcatgaagtcaattacatgggaaatcagcccagaaacaacttttaa

SEQ ID NO: 56550 - DNA, 984 bp, Glycine max
  Peptide Sequence Number=SeqID_173328
ggcgtcctcaagatatgttttcagatacggctatacaattacaaccggtctttgctcaatggatacaaaatacccatgctttagcaccaggcacaacagccccagtgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctaggttttcgttttccttgtgatggacctggaagaggggggacatgccaagtatccgcttgggatcatgtcttcttaggactattttggatgtacaattccatttcggtagtaatattccatttcagttggaaaatgcagtcagatgtttggggtagtataagtgatcaagggatagtaaatcatatcacaggaggaaattttgcgcagagttccattaccattaatgggtggctccgtgatttcttatgggcacaggcatcccaggtaattcagtcttatgaacttattgaatccattgtttgggctcataatgaagtaaaagttgctcctgctactcagcctagagccttgagcattgtacaaggacgtgctgtaggagtaacacattaccttctaggcttagctcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctg

SEQ ID NO: 56551 - DNA, 213 bp, Glycine max
  Peptide Sequence Number=SeqID_173329
atgacatcaatcgcctactacaaattggagatgcaggagggtttccagggccaatatcgtagaggtgatcattgcaaatccacaataatatttgaggtcgtcacttcacaagacttgtggatttggcatgcattttttggagttgcaagttcaaacaatgacattaatgtgttaaaccaatcgcttgtgtttgatgatgttttgcaaggttga

SEQ ID NO: 56552 - DNA, 294 bp, Glycine max
  Peptide Sequence Number=SeqID_173330
atgactgttgcagacagtattaagatagctctccctaagactgataatgctaaagagtttatgagtatactgaccaccatgaagtttgatgattcacgtactatgcacgatcatgtcattgagatgacaaacgttgcagcaagacttaagaccttgggaatggctgtgaatgagaacttctttgttcagtttatcctaaactcattaccatctgagtatgactcattccaaatgagctataataccctgaaacataaatggaatatgcatgaattgcatagtatgttagtttag

SEQ ID NO: 56553 - DNA, 312 bp, Glycine max
  Peptide Sequence Number=SeqID_173331
atggttaaagcacatcaaaagggggtacggaaaacaaacgaaaataaaaataaaagcatgcgaaacaagtggggaccactaagggtgcatagaatgaattgcttctaccagaaggcactaccttctgttggaaccccttggaaggcccaacggtcaagcgaaggttgcatgccaccaaacaatggtccccggaagaaattagggtatgacacggtgtcgcaacctacccttcggcgggagggcgatgcggggctcacgggtacatcttccaagaaaggaaaatgcgcggagtcgccacccacgcttatttga

SEQ ID NO: 56554 - DNA, 222 bp, Glycine max
  Peptide Sequence Number=SeqID_173332
atgactaaagcacgtcaaaagggggtacggaaattaaatgaaatgaaaataaaagtacgcgaaacaagtggggaccaccaaggggaaaagaggcagaagcttgccacccagctcgaccaggcgagctcggttgcttcctctagaaggcaccgccttctggaggaacttcctggaaggcccaagtggacctggttgctatttgcacccccccatatttactaa

SEQ ID NO: 56555 - DNA, 321 bp, Glycine max
  Peptide Sequence Number=SeqID_173333
atggtcggcaagtatgatggtcttaatgatgatcctacacttttggctgtattgactgcatcttttggtgtaaccggttattccttaccttgggatcaaattggttattgggcagtcaaaattgtaacaggcgtacccgacgctattcctgtaataggatcgtctttggtagagttattacgcggaagttccagtgtgggacaatctaccttaactcgtttttatagtttgcatacttttgtattacctcttcttactgctgtatttatgttaatgcacttttcaatgatacgtaagcaaggcatttctggtcctttatag

SEQ ID NO: 56556 - DNA, 411 bp, Glycine max
  Peptide Sequence Number=SeqID_173334
atgaccacttttacatggatatggatgcgttgttatttaagtaacattttgcccggcgaccacaatgccaatctccccctgcagatgtatcggttgggatcgcgcccacaagaccccagcgggcccgaagaagtccaacagggccctggggtttccagctctggttacgggcctctgtcagtcctacagggtgcccgttcccccagcgaggaatcgcacccacaaagacacccagtggacccggagaagtccaacagggccctggggtttccagctctggttacgggcctctgtagtcctacagggtgcctgttccccccggcaaggtcacgtcatcatagggatcgcgtctgtaaggcacccagtggccccgaagaagtccaacagggtcttggagttatcaagctctaa

SEQ ID NO: 56557 - DNA, 336 bp, Glycine max
  Peptide Sequence Number=SeqID_173335
atgggggagatgcttgccatccagctcgcccaggcgagcaaggtgacttcctccagaagcaaccgccttctggaggaatcttctggagggcccaagtgggcctggttgctatttgcacccccatttgttacggaaacttacgaatttcgtaacgatacctgttttctttccgtaatgttacggaaccttgcggattacataatcatcccctttttgacttacggaatgttacggaacctcacgaattgtgcaacgatgcttccttttgagttccggcatgtcacggaacttcacaaattgcctgacgatggatgccaagtacctcaaaatggttaa

SEQ ID NO: 56558 - DNA, 408 bp, Glycine max
  Peptide Sequence Number=SeqID_173336
atgatattagaggacaagttgaaggcttgtcaaaggtcgaagaggaacttgaccaaacagttgagtaggacagaagagaacatgtgggcaatcattgaccaatataaagagaagcaaaatctagctataacccgtgagcaaaggctagaggacgagcatgcaaaagtatcggtcctgcaagtggaaagggaagcaagggagagagtgatagattcattacacagagaagctatgatgtggatggataggttcactttcaccttaaatggaagtcaagagcttccaagactgttagccaaagccaaggtgatgacgaacgtgtactcagctcctgaggaagttgatgggctttttgattattgtcaacatatgatcaagttaatgtcccacataattaggaaccgttga

SEQ ID NO: 56559 - DNA, 514 bp, Glycine max
  Peptide Sequence Number=SeqID_173337
atgagaaaagcgcagctcaaagggttaaagaaggcgcctcaccggggtgagacgctcgtgatatcaaggcgcgatgggtgtcagataatccagccgcagcggctcggcgagcaggctctccatctggccgataaaggcctggaagtagggctgggcgatatgctcatccagcgcctgctggtcgcgccaggactcacgcatgtagaaggtatccggcgcgtcgcgcagctgaaacagcgcgtagtcgagattgcccggctcctcgcgggttggcagcagcagcgcctgcagcgcgtcgcgcagggcctcggtttgcccggctttcgccttcagaaccgcgataagcgcaatggtgtcgtcgcgcatttagaaaccctccagcacgattttgccgaccgagcgcccggtttccagcttagcgtgggctttttgcagattggcggcgttgatagtgccgtagtgttcgccaagggtagtgcgcagcgtgttatcgtcaatcaacgcggcgacgcgg

SEQ ID NO: 56560 - DNA, 180 bp, Glycine max
  Peptide Sequence Number=SeqID_173338
atgtgcagatcgccattgcctactgcggcgtctgccattccgatctccatcaggcgcgagcgggaatgggccgggacgctgtatccctgcgtgccgggccatgaaatcgttggccgggtgacggcggtcggcgatgccgtctcaggtttacgccggttggcgatctggtgggcgtcggct

SEQ ID NO: 56561 - DNA, 321 bp, Glycine max
  Peptide Sequence Number=SeqID_173339
atgcttaagcttcgaagggctaagagagaccagtcgagagtcgaaggcatgatattggaagacaagttaaagacttgtcaaaggtcaaagaggagtttgtttggagaattgagcaagacggaaggaaacatgtgggccatcattgaccaatacaaagagaagctaagtttagttgcaacccatgaacaaaggctagaggacgagttcgctttcaccttgaatgggagtcaagagcttccaagactactagctaaagccaaggcaatggtggacgtgtactcagcccccgaggaagttcatgggctcttcgattattgttag

SEQ ID NO: 56562 - DNA, 259 bp, Glycine max
  Peptide Sequence Number=SeqID_173340
atgaattgcgtttttgttcatgcgtcctccaccctcgagtttggagccatgcgtagtgattgcttagtgcaattctccattttcaacccttttttggagcccatgaattgcgttcccgttcatgcgtcctccacccacgagtttggagccatgcgtagtgattgcttagtgcaattctccattctcaaccctttttcggagcccatgaattgcgttttcgttcatgcgtcctccaccctcgagtttggagccatgcgta

SEQ ID NO: 56563 - DNA, 519 bp, Glycine max
  Peptide Sequence Number=SeqID_173341
atggacaaggcagaggcaattcctgctctgataccaaatgaggaactagcgagcatgcttctcgccatctgtaatggcagaacacctatgtcgccaggcgacatccatgaaggaacagaccctcctcatcatcattgggaagcgggattcaaggttgatatgccttgctttatttcagcattgaacctatttacaacactaatgatgatgtttatggatgttgatgaagaacacatacagggtattgaacctattttcgacaatgatgatgcggttgttgatgatgagcttgtactggatcatgtgagtactttgtcgatgccacatcgtattgttctaagctatcattctacaaaacataatttacattggactgttgtagattcaatgacaaacctttttgacgagggagggaatgatgtaaaagtatggcgcaaccatggactaaaaagagaccagggtgtgagaggatgtgagagctctactaatgaaatacaatgtcctaagagatacatataa

SEQ ID NO: 56564 - DNA, 147 bp, Glycine max
  Peptide Sequence Number=SeqID_173342
atggagaattggcagacagcactacgcaataacttcgcggggctccagactcgaagagaatggagaattggcgaacagcgctacgcaataacttcgcggggctccagactcgaaggtggaggacacatgaacaacgctaggcaatga

SEQ ID NO: 56565 - DNA, 810 bp, Glycine max
  Peptide Sequence Number=SeqID_173343
atggcactactaatagaagcaactgtgggagctgtgttcaacgagtcgctgagaactgttttggaatttaaaaacaaaacggtttgcttcaaatcatctttggtgcacctccaatccactctagtagctatatctccggtgatcaaggagatagaacagcaaaacaacgagttgaagcttccaaaggaggaacttcaatcgtttatcagaaagatggaggaggggacacagcttgttttcgagtgttcaaaaatccggtggctacactttgtgactagggcttgttacaaggacaaactggaccagttttccgacgagctcgtgaaactatttgccatcgacatgcaagctcagatggcaagagatcggaaggagaccttgcttaaagttaggagaatacttagggttgttgagaaaacgtgcttcgaccctggggaggcaattgacaacacagtgttaaggtactcggaggtgactgaaatcgttagtgtgtcctggctaaaaatcctgggcaggatcaaaactgggatgttgtccccaaatacattgtaccgggcataccttgtgtttaaagaaagcagtgatggaacatggcggaagctcggagtccagtatccaaaggagagtgacgatggtggatggaggtgtttaggacgtgagacttcccttcgtggtcatgccatcggaacgcaaccttcttggccaatggatttcgggatgctcaggatcatgtggactggattgggtaccaatctcaaggctgtgaactccttgccatcttttatggtctctgtcatgtctgcaatctag

SEQ ID NO: 56566 - DNA, 2235 bp, Glycine max
  Peptide Sequence Number=SeqID_173344
atggcagagcatggaacctgccgcaccactacagatcacctcgaggaagccattgctgcccttaccgagaaacattccaacttggccaacaagttcgaggccatgtgcgagcgtctctctcacatgtcttctactgcgccaccgcctcctcagatccctcggccaccggtcaagctcgacgttccacgttttgatgaccatgacccgcttggatggatcttcaaaatttctcagttcttcgactaccaaggaactccagaagaggatcgaatcatggaacggattcatcacttcgtggccagctctcctccaagcaatcgaatcccacttcgctccctcgatctacaacgacccccacgaagctttgttgaagctgattcaacgaggtatagtaacggaactgtcatcgtcggttctcctcagctgtttcatctccggcctgagtctgaaatatgtcgtgaggtacaagctttccatcctgtatctttacctaaagctacagctcttgctcgtcttcaggaagacaaaattaacgatcatcggaaacacgtccggtcctcgtttggccacccaccaccaagtaacaccaccccctctaaccctcacactacccagacagctcgaccgaaacccccttttgtccaaagaacccaagaagatatggcctacaggcgcgaaaaaggcctgtgctataattgtgatgaaaaatggagctcatcccatcattgtaaagggcgagttctcttctttatcgcaaactccgatgagtctccaccatcggaaatggtcacagcaaaaccctcgaatccttccataaccgaacttgacccaatcatagatgaccccagccagcttttcgatccaacctcgcttcaacctcatataagtctccacgccatggctggcgtgccggccacggataccttcagactatacgggcttatcaacaacactcgcgtcaccatactagtggacagcggcaacactcataacttcgttcaaccccgtgttacgaagttcctcaatttacccatgcaagataggatgcctctcagagtgatggtgggcaatggctctattttggactgccagcaattgtgccctgataccaagatactcatccaggatcacacttttgttgtcaccttgcgcgtcttgctgttaagtggaaccaacgttgttttgggtgtggaatggttacgtacgttgggcccaatcgttactgattacaccgcttttactatgcagttcaccttttttggcaggcccattaatctcctcgctaatgttcaagtggatacctacccagtctcggcccatcaggtgaagcgcttgatcaccactaactccacttcgggtttatttcacttatcacttctacccatccctcaacccgaaacagcgagcgacccacctcaccccattcccgccattgatgagcttctgatcaaatatcaatcactgtttaaccagccctcaagcctccctccccctcgccaacatgatcatcaaatcaacctcattccctctactaatcctatcaatgtcaagccctacaggtatccctactttcaaaagactgagattgaaaagcaagtaatgacgctgctcgactccggccttatccaaccaagctgtagccctttttcttctccagtgttactagttaagaagaaagacggaacgtggcgcatgtgtatcgattatcgagcgttaaactccatcacggtgcgcgatcgcttcccgttaccaaccattgaagaactccttgatgagctgggccatgcatcgtggttttcaaaactagacttaagacagggcttccatcagaatttaatggcggaaagggatatcccaaaaacaacctttcgaactcatcagggacattatgagtatagagtcatgcctttcggcctgtgctacgcgccgtcgacgtttcaagtagccatgaacaccctgctaagtccgttcttaaggaaattcacggcagttttctttgacgacatactcctcgattacttagggcacgtcatctccgacaagggtgtgcaaccagacccttctaagattcaggccattattgactggcccaaccctcgctccccaaaggatcttcgcactttcctcggtctcactgggttttacaggaaatttgtgaaaggctatgtagccattgcagcaccattgacaaagctcctttgtaaagatgccttcaaatggatactagattcttag

SEQ ID NO: 56567 - DNA, 324 bp, Glycine max
  Peptide Sequence Number=SeqID_173345
atggaggaatgggaaaaattcaatcatatagaggaaaggctgagggccattgaaggaggcggagatcacgcttttgctgacatggcagagttgtgcctagtgcccaacgtgaaggggactacttgccccaagaaccacttaaaggtgtacaacaggaaaataagggcatatgcgaaagatgaaaaattattgatgcatttcttccaggaaagtcttactgaggcagccgtcacctggatgcagctacagaacatgtgtgatgaaatcctccctaggaagggactagtcactagagccatgagcaagaggctccaagaggattag

SEQ ID NO: 56568 - DNA, 3027 bp, Glycine max
  Peptide Sequence Number=SeqID_173346
atggcggagcacggtactcgccgcgccaccaccgaccgcctcgaggaggccctcaccaccctcgccgcaaaacactccgagctagcctctagagtagacgccatgtgtgaacgcttttcttccataccgccatatcaacaaccatcctcttcccctcgtatacatcagcgccctcctgtcaagcttgacgtaccacgttttgacgaccatgacccactgggatggatctttaagatctcccagttcttcgattaccaggcaacaccagaggaagaccggatcactgtcgcgtcattctaccttgacggcgctgctcttagttggttccaatggatgtatcggaacggattcattacaacctggcaagccttacttcacgcaatcgaaactcgtttcaccccctccatttatgatgatcctcgtggcactttattcaaactcgttcaacgcggttcagtgacggagtacatgaccgaatttgaaagattggcaaaccgtatcgttggtctttcactctccgatttgctaagttgttttatttcaggtttaaatcccgaaatcaggagggaactacaggcattccagccggtttcgttgccccacgccactgcccttgctcgtcttcaagaagacaagatcaatgatcgtcggaaaaactcacggccctcctcactgataccccaaacctcaactccgcaatcctccactctgactcaacaccctcgacccaagactccctttatccagcgcactcctgaagatatgatgcataggcgcgaaaaaggcctatgctacaattgtgacgaaaaatggagctcctcccatcgatgtaaagggcgtgtgctcttgttcatcgcagactccgatgcgccctcagcttccgataataacctccacgaaacccttcctcaacctttaacagaaacacccccaccctacgaccccagtcttctccaacctcacatcagcttacatgttatggcgggagtcccggccaccgataccttccgcttatatggtgttatcaaccacgcacgtgtcactatcttaatagatagtggcagtacacacaattttatacaaccacgtgtcgcaaaatttcttggtctgaacatggaagagacgatggccctcaaggtgatggtcggcaatggttccgtaatggaatgccggcagttatgtccggccactacgttgcttattcagaaccacctgttcacggttacactgcgcgttttacctctaagtggcgccgatgtcgttttaggggttgagtggttacggaccttgggcccaattatcactgattacacctcctttacgatggcattcacctacttggaccagcccattacccttcatgcagacgtttcctccaacactgacccgacatcagcccaccaacttcgacgaagcatccatacccactccatctcgggtttgtttcacttatccctgctacccgtcattcaacccgaaccagacagtgacccacctcatcctaatcccgccattaacacccttctcctcaaatatcaaaatcttttccagcaaccctctaccttacctccacctagacagcatgaccatcacattaacctcattccttcagctcacccagtcaatgttagaccttataggtacccccactctcagaaaaatgaaattgaaaaacaagtcactgccttactcgagtccgggttaatacagccaagcagaagcccattctcttcacccgtgttattggtgaaaaagaaggacggcacatggcacatgtgcattgactacagagcattaaacgcgatcacaataagagaccggtttccaatacccaccattgaagaactcttggatgagcttggccatgcttcatggttttcgaagctggacttacgagagggttttcaccagattttaatggcagatagtgacattcctaaaaccgcctttcgaacccacaatggccactatgagtatagagtgatgcctttcgggttatgcaacgcaccctcgaccttccaagcagccatgaatgctttactcaaccccttcctgaggaaatgcgtagcggtttttttttatgatatattgatatatagcgaaacccttcctgatcatcttcttcacttggaatgcatcttcggggctctatcacaggcccaatattatctcaagcgctcgaagtgctctatcggacaacgacaacttgactacttaggtcacgtcgtctccggcaagggagtacaacctgacccttccaaggttcaggccatcattgactggcctacccctcgttcctcgaaagatcttctaagcttcctgggcctcacaggcttctaccgaaagtttattaaagggtacgcaggcttggcagcaccattgaccagattgctatgtaaagacgcctttcaatggaccatggagtcccagtctaccttcaattccctgaaaaccgccatgactacagcccccatcctcaccctccctaacttcaacctccccttcgtgctcgaaacagacgcttctggcagtgccataggggcagttctccaacaacaaggccatcctatagcgtacttcagcaaacctctttgccctagactgcaacacgcttcagcttatgttagggaactgcacgcaatcacggcagcagttcgacgatggcggcaatacttgctgggccatcggttcacagtctacacagatcaaaggagccttagggaattaatgtctcaggtggttcagacacctgaacaacagttctacctagccaagcttttgggttttgactatgacatacaatataaggcagggtcttctaacatagtcgcagattctctctctcaaattgactgcttgtcccaggctcaatgccttatcctttcgatacctcaccatgagtttatgactcagttaaaggagacgtttaaggccagccctgaattccagcaacaacgcgccgccgtacttgcccatctggagcagtatcgcgattttgccatctccggcgacctcatccttttttga

SEQ ID NO: 56569 - DNA, 141 bp, Glycine max
  Peptide Sequence Number=SeqID_173347
atgcctgttatgatgttcctagcatttctgcaacaaggaactacgagggacgttctagaaggcaaacctcacgccctaagtatctcgaggactacatataggttcacgtacatgatgtatcacgcattagagaccagttag

SEQ ID NO: 56570 - DNA, 801 bp, Glycine max
  Peptide Sequence Number=SeqID_173348
atgactgttgtagtagacgaaggaagcctgaaattcgaagagaaaccagtgaaagtggatagtgatccattccacatccaggctaattatattgaacccatgcaaatcatgatgatgggagcttcgataggatcgccaaagctgaatacttcattatctaaagaggaggtcaatcaggctttggaagaattcaaaaaggaagaagaatcagttttcccactagtaagggaatcattggttgaatttctatcgaagaaacataagtctgagaaaaagaggaagtcgcatgttcctcatgcaaatgtttcatcgaacaaatggtttctaccgaggaataaaggatccaattctagttttaaagcatttggagttaatgatttgatgattcgaagaggaggaaccactgcaggttctaagaaagaatactacgagtatcaaaatcctccatgggtgaataggaacatgtcaaaaacccaatggagaaggcatcaaagaatgaaaagggatgcgatattggggatgcaacaaaataatggtgttagacctttagttcttaacagaataactgaaggtctacctccaggcttcgaaaagaaaagattaagaaaagagcaggaagataaagaagttattatagactgttttgagtatagtttcgaagattctttggaagccatttgtggagtaatttcaatattacccgcagattatgctgaagattatcaaaatgagcatatgttgagagattgtgctagagaagattaccttgatgacccttttctaagcccaaaggtagtttag

SEQ ID NO: 56571 - DNA, 321 bp, Glycine max
  Peptide Sequence Number=SeqID_173349
atgtcgccattgaagctagagatacagctgagtcgccattggcactggcaagatagtgctgacgtggagccagcagcactggcgaaacaggtgaggctagggcagctaggtatggtgttgcagagtaggggtgcagtggttcaggatggtttcactaacatggctggcgagtttgttttgaaagtatctcgtcattgttgctggcgagaaaggtgcctacgtggcacacatgcatgcaaactgaaagtagcagcatataagaagcaggcttttccagaaaccttttcagaaagggtttcgcaagtgggagtggcagaataa

SEQ ID NO: 56572 - DNA, 333 bp, Glycine max
  Peptide Sequence Number=SeqID_173350
atgagattggtgagaattagggacaatgaaaatgatggcatgccaaacatcgattcagccatgcatgcatgtatattgccagcgtgcatgtatatcgtcagcatgcatggcgaaatacgcctgcactggacacgtggctgttccgccagtgtcaccggcgagatagctggcacagttttcgccactttgactggagatttcggtgcagagggtgcaggcaaggtgcaaagggcacaggatagcagtagggcagtagggttcaggctaagctggtttcgcaaccagtgttggcgaaacaaggagcatatatcgccaatggtattgacaaaatag

SEQ ID NO: 56573 - DNA, 430 bp, Glycine max
  Peptide Sequence Number=SeqID_173351
gatcaaaactgggatgttgtccccaaatacattgtacggggcataccttgtgtttaaagaaagcagtgatggtgcctacgggttcaagaacatgcctgttgaggtgtccattggggttatccgagaggttacagattcaagaattatgaacttggtagtaggaagctcagagtccagtatccgagggagagtgacgatggtggatggagtgctccacgacttcctcgccgacacgtgcagggatgacgccaccgttcaggtccccgtccccaaggttctgtcgccacttccacctccctccgatgttgttcctcttggccctgatgcgctcgatgagtctgcctccatgaaggcctttgttttgtgttcagtgtccaaccacctcaacatagagacgagacacctcactcgacaacgcacgcgcctttga

SEQ ID NO: 56574 - DNA, 240 bp, Glycine max
  Peptide Sequence Number=SeqID_173352
atggctcccggggaaaagttctgcttgcttttgaagataataggtcttcaaaaattggggttaggtttgataaatcaatcccagatggcaatgatcttggaggcctttgtgaggatgatcgtgggttcttttgttctggtagatgattctagaggggatgatgcagataaagttgcaattaatgatatttttgaggttgtgccagttctttaccggtccaaaagatgcctctattcctga

SEQ ID NO: 56575 - DNA, 285 bp, Glycine max
  Peptide Sequence Number=SeqID_173353
atgcaacagacgagcctccacgctgaacagaatccaaataacaactggtcagtaatattgaaagacatggaaatgctcaactgtggttggacactgaacacaaaacaaaggccttcatggaggcagactcatcgagcgcatcagggccaagaggaacaacatcggagggaggtggaagtggcgacagaaccttggggacggggacctgaacggtggcgtcatccctgcacgtgtcggcgaggaagtcgtggagcactcaaacgtcgtggagctcaagaaccctag

SEQ ID NO: 56576 - DNA, 1224 bp, Glycine max
  Peptide Sequence Number=SeqID_173354
atggggtgcatggtgtctcagctagccgcgaaattcgccttctttccgccgtctccgccgacgtaccagctcaagaagagcggcgaggacggcaagctcacggtggtctccgcggcggctccgattccccacgccgatgacacctccctggacgttctcctcgtcgacacgaagcatgggaacaagattgtggcgttttatctcagaaacccctacgcgcggctcactcttctctattctcatggcaatgccgctgacttgggtcaactctatgatctcttcgtgcaactcaaggtcaatcttagagttaatctcatgggatatgactactctggatatggagcatctactggcaagcctagtgaatccagcacatatgctgacatagaggcaatatatgaatgccttgaaactgagtatggagttagccaagaagatgtaatcttgtatgggcaatcagttggaagtggaccaacactgcacttggctgctaaattgccaaggttgagaggtgtggttcttcacagtggcattctttctggtcttcgagtgctctgccatgtgaagttcacattttgctttgacatttataagaacatcaacaaaataaagaaggtcaagtgccctgtacttgtaatacatggtacagaagatgatgttgtcaattggttacatggtaatggactttggaagatggcaagggagtcatatgaccccttgtggatcaaaggaggtggtcactgcaacttagagctttaccccgattacatccgccatctttgcaaatttatccaagaaatggagagcatgacaactgagaagcgcctcaaaaagattcggcaaagtgcaaaccaatcaaagtcaaacactggttgcacctgtagtagatgctgtagagtgaagtgttgtagagttaaatgtcctgaatgctctaattgctgttgctgcatgaatgtttcctggtctatcaactgtcctgaatgctgttggagacctagctgcaagtgttgttgcttccccaagttccgtagttgtttcggatcaatctgctgcacaaaatggtcgtggcctagctgttgtgcaacaaaatgttcattgtcattgcctagctgctgctgctgctaccctaagcgtgcaagaccaaattgctgcatgagttgtttctgctggcaatgttgtgtaggaaaacacagtgatggcacaaatggaaaacagaatggctaa

SEQ ID NO: 56577 - DNA, 189 bp, Glycine max
  Peptide Sequence Number=SeqID_173355
atgaaacgaaagcttgagtatgttgctgcatataccatcaagaatgaacagttaacatggcctagtgtcatgaataaacacttaaatcacccaaaggacctagaaggagaacatatgagatggaaattaagccatgtacctttcaacaaccgaggtcatgccataagttgctatctcaggctaagataa

SEQ ID NO: 56578 - DNA, 210 bp, Glycine max
  Peptide Sequence Number=SeqID_173356
atgtctacttcaaaatcttatggctctcactcttatccaaagaaagaccaaggtcaaggcatcttacgggtgacaccttctaagcccaaagatgataaggggaagacaatagaaaagcaagcccctaaaggctacacaagattagtctctaacttgagccttgctatcactccccatccaaaggccttacaaacttctatggctcaatga

SEQ ID NO: 56579 - DNA, 2196 bp, Glycine max
  Peptide Sequence Number=SeqID_173357
atggaaagtggatcaggaagtgaacaattagttgaagacaaatcagggtatgaacaagagagtcatgaagaacccacaaagaagaaacgttatcacaggcacactgctcgccagatccaagaaatggaatctttgttcaaggaatgcccacaccctgatgataagcagaggctgaaactgagccatgaattgggtcttaaaccgcgccaggtcaagttctggttccagaaccgtcgaacccagatgaaggcacaacaagaccgggcagataatatgatacttagagctgagaatgagactctaatgagtgagaattatcggttacaagctgcactgcgtaacgttatttgtcccaactgtggtggcccgtgcataatgggtgctgatatgggtttcgatgaacaccaacttcgcattgaaaatgctcgtttaagagaagagttagaacgcgtgtgttgtctcactacaagatacactgggcgtccaatacaaacaatggcagcagatcctactctaatggccccttcattggatttggacatgaacatgtacccaaggcacttttcggatcccattgctccatgcacagaaatgattcctgtgccaatgttgcctcccgaagcttcaccgttttctgagggtggtgttttaatggaagaagagaagtctctggccttggagcttgcggcttcctctatggctgaacttgtgaagatgtgtcagacaaatgaaccactttggatccaaagcagtgagggtgaaagggaagtgctcaattttgaagagcatgcaagaatgtttgtttggcctcagaatctcaagaaccgaagtgagctaaggacagaagctagccgtgacacttctgtggttataattaatagtgtcactcttgttgatgctttccttgatgctcaaaaatggatggaattgtttcctacaatcgtttcaagagcaaaaactgtccaaatcatatcttctggtgcttccggtcttgcaagcgggactcttcagctgatgtgcgcagaattccaagttctttctcctttggtgtccactcgtgagactcattttcttcgatattgtcaacaaaatgctgaggagggaacctgggccattgttgattttcctgttgatagctttcaccaaaattttcacccttcttaccctagatactgcaggaggtcctctggctgcgttattcaagatatgccaaatgggtattcaagggtaacatgggtggagcatgcaaaagtagaagagaaacctgtgcatcagatattctgcaattatgtgtacagtggaatggcatttggagcacagcgttggttaggagttttgcagagacaatgtgaaagggtcgcaagcctcatggccagaaacatatcagatcttggagtgataccttcgccagatgcgcgaaagaacttgatgaaactagcccaaagaatgataaaaacgtttagccttaatatgagtacctctggtggtcaatcatggacagccatatcagattcccctgaagacactgttagaatcacaactaggaaaatcacagagcctggccaacctaatggcgtgattctaagtgcagtttcaaccacttggttgccctattctcacaccaaggtctttgatctcctcagggatgaacgccacagatctcagatggatactctttcaaacgggaactcattgaatgaagtggctcatattgcaaatggctcacatccaggaaactgcatttctcttcttcgcataaatgtagcaagcaactcatcccagaacgtagagctaatgctgcaagagagttgcaccgaccaatctggaagcctagtagtgtacacaaccatcgacgtggatgcgatccagctagccatgagtggcgaggacccttcttgcattgcacttcttccccaaggcttcaagatagtgccaatgctatcatcacccatcaccgatacaacaaactcatcagagcctccaatatctctcaacaacaactcaggtggttgcctcttaacaatgggggtgcaggttctcgcgagcacaatcccttctgcaaagctcaacctctcgagcgtcaccgccatcaacaaccacctttgcaacaccttgcaccagattgaagctgctctttcttctactaactcccatgagaacggcttcttcctttgcactgaacccaccaagcagtga

SEQ ID NO: 56580 - DNA, 981 bp, Glycine max
  Peptide Sequence Number=SeqID_173358
atggatgagacaagcaaacccttggccgtggacggagggacggaccagtgggcggcgtccgccgtcatggacctgggcggaccgatgttccacgcggcgctgttgatggcgctgcgcgaaaccgtggccgccgaccacgtgtcgcacgtcttctacgggcacgacggctcggtgcagtattcgtcggccgccagcctgttgaaccagtcgctgatcgagtggaccaccacggtttatgtcgacgaccagttctaccgccgcgatcccaactacgcgctgttgcgcgacctggcctgtcgacccgagcatcatccggacctgatcatccaggccgcggcgcccgagcgcatcctggatgccgagtaccgggaactgctgttcgagcggcccggcttcgccagcaagatctcgctgatcggcgcgcgcagcgaaggcgccagctacatcaacctgtacttttcgcgttcgcatccgccggctgtgccggcgcgaggccgcgcccgcgccgatctggtcggatggcctgtccgaacgcgaggtccaggtggcggacctgctgcgccaggggcgcaccgccaaggaagtgggccgcgaactgggcctgtcgccgaccacggtggtgacctacaagaaccgcatcttcaagaagagcaacgtggccagcctgaaggaattcctgatcaaggcgccggccggctgcggagcgcgctccaacgcctgatccctgctggcggacggcaggcgcgcgctttcaccgtttttcacaaaacccacacaaaaaccggcggaacgggcgccggctcattccctatgatccgaggcaccgcgcgccggccgcggcgcccgggcgtcgtgccggccgcgccatgtcgcgccggctccttctcttgccgctgtctctccgctcgctccgcggcgcaggcgtacccgccgcgccgggccgggccgtgggccgccggtcccaaggctattgatgcttaa

SEQ ID NO: 56581 - DNA, 267 bp, Glycine max
  Peptide Sequence Number=SeqID_173359
atggaggccgatcatcgtcttcgggaacggcgactcgctgaagctgcgaaccggttttggaggagccgcagcagattgaaagaactcgccccctccgcgcgagagagaaagcgcgcaattttcccggaaaacggggcgggaaagggaaagctcgagaaaatgttggtggaagcggaagcgagggcgaaagaggagagagaacgtaacggaattgaagagaagccatttttgtattacaacattacacaagacgggaagagaggatga

SEQ ID NO: 56582 - DNA, 513 bp, Glycine max
  Peptide Sequence Number=SeqID_173360
atgatgagcataaaggagatagtggaggtcagtgcggcttaccaaacccgtgctagagctagagtaatgggtgaagtagagaaggtgcaagagcagatgaaggccgacatagaggccatgaaagagcaaatggccacaatgatggaggccataataagcatgaaaaagataagggaagtcgatacggttgtagttgccgctaccagcgctgttgctaaggtgaacccgatgcccccatctggcctcaaccaaatgaatcatccaaccttaaatatggtaggcaaagatttgggaagtacggacggccccatgatgtgcaaattcaaaacgagcacgccttcccatcatatggcttgcctcccaactatacaccacccaatgtggcatacactctcaatgaaaatctcaataactccactcagatactcattgagaaccaataacctcaatctgatcaggcacatatctctcaaaccatgggggagacacatgaaattccccaccacaatctag

SEQ ID NO: 56583 - DNA, 712 bp, Glycine max
  Peptide Sequence Number=SeqID_173361
cttcagaggactacacgtcctcgccttgagagggctacatgtcctcgccatcagagggttgcacgccctaaccttcagagggttacatcccctcaccttcagaggactacacgtcctcaccttaagagggttgcacgccctcgcctttagagggctacacgccctcaccttcagaggactacacggctatacgtcttcaccttcagaggactacacgtccccaccgtcagagaactgcacgtcctcacttttcagagagctacacgccctcgccatcagaggactacacgtcctcaccttcatagggctacacaccctcacctttagaggactacacatcctcatcttcaaaggactgcacgtcctcgccttcgtagggctacacgccctcacctttagaggactacacgtcctcgccatcatagggctacatgccctcactttcagaggacttcacgtcctcacctttagaggactgcacgtcctcgccttcagagggctacacgccctcgccatcagaggactacacgtcctcaccttcgtagggctacacaccctcgcctttagaggactacatgtcctcgccttcaaaggactgcacgtcctcgcctttgttgggctacacgtcctcgcctttgtagggcaacacgccctcacccttcagagggctacacgccctcaccttcaaaggactgcacgccgtcgcctttag

SEQ ID NO: 56584 - DNA, 903 bp, Glycine max
  Peptide Sequence Number=SeqID_173362
atggttgcgagagtgtttggcccagagaacatgggtaggctctctattgttcaatcagcatcagcaatttttattttcttcgcaacgctgggattagatcactttgtagtacgtgaatttacacgcaaacctgatgaccatgagctcaaatgtagcctattaattacccaaaccttaggttggcttttctatgtcgccgctgtggtaatttattttgtgatcaaagggaatttgcagcatgaaatttacttgatagctaacgttacgttgagcactttttttctgcgcgttatctatctaaaactctacctgcaagcaataaatcaagccaaagtgatcgctgtggcagcaaccacctccagggtctttgcgcttatttacctgctgataggcacttttatgcatttcagttatgacatcatgattgtatatttgcctattcaagcttttattcaaaccgtaatgatgtggtttggttatcgtaaggtagtgaaatcatctgagcagccctttacgtattcattcaagagaatgttcccgcttcttcgcgaggcatttccagttttaattgcaactgcagtttattatggatatagccaagccgatgtacttattgtctcttactttatgaatgaccatgacgtaggtatatatgctgctgcgatgcgcctaataccccaggctgcgtttgttggccatattgctgctattactttttacagttcgataagtgtttcctttgataaggatttctcgctctttttgttgcaaactaagcgagtgattaaactacaaataatgctcgccatgtgtttagtgattattggaagcttgctatccacactgattatttattgtttgtatggcgaaaaatttatgcaaagtgcacgtgggatcctctag

SEQ ID NO: 56585 - DNA, 120 bp, Glycine max
  Peptide Sequence Number=SeqID_173363
atggttcagctaagcgcacatcgctgcgctaagcccaacatcttcactaaagcgctaagcgtcgctgctgcgctaagccctaaatgcttactggaagttacaacttcaagttgggcttag

SEQ ID NO: 56586 - DNA, 1519 bp, Glycine max
  Peptide Sequence Number=SeqID_173364
atgatgacacacacagccaacccaaacaatcctacccacctcacgatacctcctgccaactcccctacttcttctactcaggacaactcatcttcctcacctccttggacacccagcttacgtcgttctacgagaacgagacatccacccacatacttacaggactttcatcgcgttctcacttcacatgctgatacctcctcgaccaaggttaagtaccctctccactttgtcttatcttattctcatttgtctcattcccataaacacttcatcatgtctataaccgcgatagctaaacccaattcatatgctgaggcttctagctatgactgttggattaaagccatgcaggtcgagttaaaggctcttcaacagaaccacacttggattctaactccacttcccccacacaaaaaggccattggatgtcgctgggaaggtttggattttctcgatactttttcccccgtggccaagctcaccactgttcaaatgcttctagcccttgctgctctttgtaactggcaccttagacaactcgacgtcaacaatgcttttcttcatggggatcttaacgaagaagtttatatgaagcttccaccaggactggttgtggataaccccaacctcatttgtcaccttcaacgttccttatatggacttaaacaagcaagtcggaaatggttcacacggctttcgtcattccttttctcccaaggctttcgtcaatcttcagttgaccactcacttttcttatactctaacaatgataatactgtaacagctattcttgtttatgttgacgacatcatcttggcaggagataacctcaagtctatcactcactttaccaagtttctcgatcaaactttcagcattaaggatctcggtattctgaagttcttcctcggactcgaggttgctcgttcaagtcacggcatacacttatgtcagggtaaatatgccctggatattctatcagattcaggtatgcttggttcccgtcctacctctactcccatggattactctacacgatctcctggttcgggcatattctttgctgctcacagtacactcactctcaaggcattcagtgactccgattggacaggctgtcgcgacacacgatgctccatcactggcttctcagtttatctgggtgattatctcatttcctggcgatccaagaagcaatctacagtctctcgcagctcctctgaggcagagtatcgagccttggcctccactacatgtgaacttcaatggctaagctaccttcttcacgatttttgggtcccttttcttcaacctgccacactctattgtgacaatcaatccgctattcaaatagcttcaaacccagttttccacgaacgtactaaacacatcgagatcgactgccatatcgtgcgagacaaagtgaacgcaggcttgttaaaacttcttccagtttcttcttcaatgcagcttgccgacatcttcacaaagcctctcacccctgctatttttcaag

SEQ ID NO: 56587 - DNA, 316 bp, Glycine max
  Peptide Sequence Number=SeqID_173365
atgggtaaatctcaatttacctgcaaggcctttatgttctttgttttatggtgcaatgagaggaatgatgatgatataggcgttataactaagaagaaggaagaaaagacaggagttgctgtcaaggacaatgaaaatgatggtatgccaaacatcgttcaacacctaaccacaagatgggctcttcccgtgactggtagcaagatgacatctgcacgaatgataagacacgtgtcagttactgattcgtggtcgtaccttacatgtcgatcggacggagactgctgttccagattcagaatcagggttcacgcgg

SEQ ID NO: 56588 - DNA, 246 bp, Glycine max
  Peptide Sequence Number=SeqID_173366
atggctggagtctgtgcaggagtcgaaataggaggtgctggagctgtggaagaagaaggagctgctgtctctagtgggctcaagctctttagggatctagaatctgattggactcccctagcattgcacagagcagtgatcaaggctgtgaatccaagtctagatgaatcatgttgtgcagtaagagagatctggtgggagatgaggtaccccacattcatatccatcttcataatgatgccatag

SEQ ID NO: 56589 - DNA, 2727 bp, Glycine max
  Peptide Sequence Number=SeqID_173367
atgtctttgttcataaaatgttcccgactttggttccctcagaacgaacgacccattcatctagttattgactcctcaatggtggaaagaagagtgactttatcaaaggaagctagaaatgggttagaatttttgaagcgtaaaaggcttcagcgtgcaaaatttgtcactgccacccagacaagtgttgctaacatgatgagcagaagtggaaatgctttaagagcttcagcatcatgtggcccaagatttcatggtaatgctaatgtcttttccaagcgcaaggtggataagtttgatacaaatgacctggattggactgataaaattctagaatgtcctgtgtattctccaacaaaggaggaatttgaggatcctttaatttatttgcaaaagattgctccagaagcttctaaatatgtaaaccgtggcattgacacacttacaagacaaccaggctttctggtgcttgtgtcacttctcaaatccagcttgagtatatgcaagattatttcccctttgagtgcttcagtacctgctggggttgttttaatgaaggagaaagcaggattcaagtttacaactagagtgcagccccttcgccttgctgagtgggatactgaagacaaagtcacattttttatgagtggaagaaattatacatttcgcgattttgagaaaatggcaaacaaggtatttgcacgaagatattgcagtgctggatgtcttcctgccacatatttggaaaaagagttttggcatgaaattggttgtgggaaaatggaaactgttgaatatgcatgtgatgttgatggcagtgccttttcatcttctcccactgaccagcttgggaacagcaaatggaacttgaagaaactttcaaggttgcccaaatcgattttgcggctgttggaaacatcaattccgggagtaacggaacccatgctatacattggaatgctgtttagtatctttgcttggcatgtggaggatcattatttgtacagcattaactatcatcactgtggggcatcaaaaacatggtacggtattccaggtcatgcagctttggattttgaaagggtggtgagagaacatgtgtacactaatgatattttgtcaagtgatggggaagatggagcctttgatgttctcctggggaaaacaacactatttccaccaaatattttgttggagcatgaagtccctgtgtacaaggctgttcaaaagccaggggagtttataataacgttccctagggcatatcacgctggcttcagtcatggtttcaattgtggagaagcagtgaattttgcaattggtgattggtttcctttaggagctgttgctagcagaagatatgcacttcttaacagggtacctttactgccccatgaagaacttctatgcaaagaagcaatgcttcttcgtacatgcttggaacttgaagattctgactttccttctccagacttgttttctcataatagtattaagatttcatttgttaacttgatgcgtttccaacatcgtgctcgatggttccttacgaaatcaagggcgggtataagtgtttcttttcattcccatggcacgattctctgtagcctctgcaaacgtgactgttacatagcttatgttggctgcaactgtcacaagcatcatgtatgcctacgtcatgatgctgattctcttgacttcaactgtgggagcaaacacacactttatttgagggaggatattatggatatggaagctgcagccaagatgtttgagcaggaagatgggatattggatgagataaggaagcaaactaaaagtgaccagaacatgtatgcatatcctttgtcaaatatgtttcagggagccgaggcaaatggatacacgccttattgtgagctaaaacttgattctgttgctgaattttatgcaactccagagcactcaacaaataatcaagaatacagttcacaatatcaatctgtctttgtacattgctctgaaaatcaaaaaccagtggtgtctgaggtttccttttcttctgccacatccactctttgttctctttcagaatctcttgagagcttttccgctcccaaaaatgctgaggagcatattaacatcaatgcaacaagtattattgattttgaagagtttgctgaaagaatatccaacagtgcttgtgaatcttcattatctcctgctgtgtatcatgaaaggtcggttaaaccacggggtgatcttcagagatttgataaaaaacccgttgtaaacgagagtgatgattctgattcagagatatttagggtaaaacgcccttcttctctgaaagcagagaggagaaatatgaatgatgctatgtcttcaaaacatactgcgcagcagggacttaaacgactgaagaaaatccttcctgaaggaaagagcgggcaaccaatggatttcagtagaagcaatgaatcaagttacaaatacggtcaccctgttaaccataaaggtcatgctgaaatttcgtctagggacagatttgcaacgggtaatggtattcccatttctataagatgtaagaagttaggcaacgaggaaataagcatgcaacgagatcacaaccggagagataggttgcagcagacatttagggaaccaccttccatggagcttgagccaaagcaccttaaagtccgaggcccttcatttttaggcttagagagcagcagatcgaattga

SEQ ID NO: 56590 - DNA, 543 bp, Glycine max
  Peptide Sequence Number=SeqID_173368
atgacacgctcgccttccttcaactctagtcaacttgttgctcagaggaaactgtttgcagaatcccaaataggaaggaccagttttaagaggcttttggagccaaaggtccctcaggttcctggaattgctccttatagagttgtccttggatatataaaagataagcttcagagaactcgtagacggttggagcttcttatcgaggatggtccatctgaacatgatcctatggattattatgaaacaacagatcagcttttagaacctcttctcctttgttatgaatctttgcaattatgtggatctggggtgctagctgatggtcgactagctgatctgattcgaagagttgctacttttggcatggtgttaatgaagcttgacttgcgtcaggaatccggcagacatgctgaaacaattgatgcaattacgaggtatttggatatgggtacgtacagtgaatgggatgaagaaaagaaactggacttcttaactagagagttgaaagggaagagaccactggttcctcccagtatagag

SEQ ID NO: 56591 - DNA, 442 bp, Glycine max
  Peptide Sequence Number=SeqID_173369
gggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 56592 - DNA, 201 bp, Glycine max
  Peptide Sequence Number=SeqID_173370
atgggctcaaaaatctaccctaaggttcatgagaaccccagggtcttcattagtagctctagcccaagcctcttggagtcttctatccaatacccttggggggtagaattgcatcatcccctccaccttggaaaggatttgacctcaaatcctgaggttcttcatactctgggttccccccccccccctcgacacctgtaa

SEQ ID NO: 56593 - DNA, 212 bp, Glycine max
  Peptide Sequence Number=SeqID_173371
ggatcgcacccataagacacccagtggacccgaagaagtccaacagggtcctggggtttccagctctgattacagacctttgtcagttctacagagttcccgtcacccccaacaaggtcatcaagccccctattaacaaggctttcattgaaaagtactatgcctcaaggcggacgcagggcgaggcaccacagcagcctggagacgactag

SEQ ID NO: 56594 - DNA, 597 bp, Glycine max
  Peptide Sequence Number=SeqID_173372
atggggaaagcagctactgcgatcatcaaaattgaaacaatgactattgcggccatagaagaaaacatgatggatgttgatgccatcaaaaaaggaaagggaatgattgacactgatgccatcaaaaaggaaatgagaatcatgaatactaacaccattagagtaaaagagaaatcaaaagatgtttctcagcaaaaaggcaagaaaccagtgaagcaagcaccaagaaaattttctcctaatttcttagaggctatcaaagcagagatcgaaaggctactggaggccaagtttattcaaactacaagattaaagaataaggttgaatttcgatgggaaaaggaacaccaagaagcttttgatgacattaagagatatcttgcaaacctaccagttctagtgcctcctgtgaaaggaatagactttagattaatatggaaattgacccttgcattatcttccttaaccggaagtggcgtctacccagacttatcttccttcactggaagtggcgtctacccagacttatcttccttcaccggaagtggcgtcatccaaaagctctacagcctgtatcaagcgatccgcgccccgtaa

SEQ ID NO: 56595 - DNA, 450 bp, Glycine max
  Peptide Sequence Number=SeqID_173373
atggtctcaacaggtgtctctaatgaaacattagcagtgcttagacaacaaatagaccatagagatgctttggccattcctagaaatcaacctgggaatagacataatgttgtgatttggccattgatgcttttacttggttcaccacattaccaccaaattcgatatacacttgcgcaactctcaaaggagtgtttcataaacacttctttagaggagagactaagggcttcaattgggacatcgaaagtgaacacccctttgtctgaaaaggagatcaaccaagccttagaagaattcgagaaagaagaagagccagtttttccacaagcaagtgaatcattggtggattttctatcgaagaaaaagaaagcaaaaaaagagattatgttatgtcctcattgtagggccatgcttgatagatcgacaaccaaagcttttgaagcataa

SEQ ID NO: 56596 - DNA, 240 bp, Glycine max
  Peptide Sequence Number=SeqID_173374
atggggaatgcgagatttcttgaggaagttaagtttggaaaggagggaaacataaggaatgttgtctttgaggaagaacctatcattgatagtgattcaatcctcatacctattattgttcaaggcacaactccagtaatagaaaataatgttcaaataatttttaatgacattattctagaacaagacaacaatagggttctccctcaaaaacctatagagaaacctcaacaaccttaa

SEQ ID NO: 56597 - DNA, 564 bp, Glycine max
  Peptide Sequence Number=SeqID_173375
atgacactagcaagtggagtaaagggatcgaaaaagaccaataaagccaagactgatgatcgagttaggcttctaccaaaaccactcaaatttcaactagcatccaagtctaccacctccaaaccattgaagaccaaagtctcaaagggattgaatgattttgatgaggacgtgctcattagttcctctttcaaagctacttctgttgctacaacaaagcaaaaggctgacaaaatagtggatctttcatcatctcaggatccatctcaaagcggtgataacaggaaccttccagctggggagaagcaagttggggtcgaagttgctactgatacttttgctcgtatgccaattgtcgaaacaaatattgtcgaagaatcacccatggaagttagagaggatcttgaaagggaaacatatccattggatgctgaccttttctcttttattgacatctggtcttctgattcaatgccatcgaaagcctctgaatccagccacaataggaatttcactcatttcgatgcggctgtggctaagtttcgaagactagcgtttgattaa

SEQ ID NO: 56598 - DNA, 471 bp, Glycine max
  Peptide Sequence Number=SeqID_173376
atgaaggcccaagtggagaaggatgaaggcccagaggcagagacactatcaagactattaattgttgctgaaggcccaagtaatccttgtggcgtctacccagacttatcttccttaaccggaagtggcgtctacccagacttatcttccttcactggaagtggcgtctacccagacttatcttccttcactggaagtggcgtctacccagacttatcttccttcacgggaagtggcgtcatccaaaccttcgtagcctgtatcaagcgatccgccccaatatggaaattgacccttgcattaacggagtgttcccttacttttgtgccattaaaagctattaaagatcaagttctagcaaatttcttggttgatcattcaaacattgaaatattggaatgctattcagggattaaaccttggatattatatttggatggatcaaatcatataaatgaggataggaattga

SEQ ID NO: 56599 - DNA, 432 bp, Glycine max
  Peptide Sequence Number=SeqID_173377
atgtcatcaagaaagagggctagaaccgacgacatcccatcatcatccatcccagctcctcacctgcgggagttggctcaaaacaggccaattgtacctctagagtattttcttgagaaagtagcctggcctgaagctcaacttccattggtgagaaccaatgaggctgctccttcgaggcctgcactggcacaggttgaaccaatgccagccgagccacgaactccagtggtgaatccacctctttctcttgagcttgaagtagttcccccatctccacctctgattatcatctctgatgcatcatcagatgaagctgctacccctcctgaagaaacagttgacccccctgcttccccagttggaggaattgatgatctttctgattcgtcatcgggagaagttgttgctctcactgattccccagtgtag

SEQ ID NO: 56600 - DNA, 373 bp, Glycine max
  Peptide Sequence Number=SeqID_173378
atgggatcaagtcaaaagccttcgcttaaaaagaggttttaccaagtcaaggttaaaggcctagataccaccagcatcaaggaattagggcggttgatggaacctctccaaatgcaagccttctacaagacttacggaaagatcttagagttgaccatagcagaggtatccatagaagccattgcatcactcacccaatactatgaccagcctttgagatgcttcacgttcggagacttccaattggtaccaaccattgaagaatttgaggaaattctaggatgtcctctcgggggaagaaaaccatacctttcctccgggtgtctcccctctttgagcagaattgcaactgtggtcaaggattcagcaagag

SEQ ID NO: 56601 - DNA, 390 bp, Glycine max
  Peptide Sequence Number=SeqID_173379
atggacaaggcagaggcaattgtggctctgataccaaatgttaaactaaaccttttaacctgtgatgttgaaaactacaaaagaaacacagtactaattaaaccctatatttctgaaccttatgaactcttaattgcattattgcaatgcacaccatacacaaagactaataagccagaacaagatccaacttttgtcaatactgaggatcaaagctatatgatgttgtcagtcccctcattaaacagcaagctatatgcttgcacaaagaacaggggtgcagatacaaccaaattcaaagaggggcaccacaaagccctcttacctcagagactatgtataagaaagaaagggagaaaggaagatgacctggaagctgacccacgatag

SEQ ID NO: 56602 - DNA, 294 bp, Glycine max
  Peptide Sequence Number=SeqID_173380
atggatgattctaaattactgatttatgagggatcgacgaccatccacaatgtacctttgtgtagtgatcaagtgaaggtcgatgttgaggaagttcgagatgcttatgcttgtgttcctatacccactaaaaaggttcagttagtggggcaaacacttaacacctttcttgcttggccgacacatcttctacaacctttttcagaacaaggacttgagggaccgcgaaaacctgtagataggttggatcttgatgtcgatcccctatacctaatgacattgaccattgcatag

SEQ ID NO: 56603 - DNA, 471 bp, Glycine max
  Peptide Sequence Number=SeqID_173381
atgtttatagatgggttgagaccacaaaccaagcaactgctagatgcttcagcagggggaaaaataaagctaaagacccctgaagcggcaactgagctaattgagaatatgttagccagcgatcatgccattctgcacgacagagttcatcaacccacaaagaaaagcttgttagaactatcatcacatgacactttattggcacagaataagttgctttctaggcaacttgagattttaacagaaacacttggttgtaccatctgtgatgtggctcatgaaacaggccaatgtattcccattgaagaaaacactcaagaagttcactatatgggaaatcaacagagacaaggatatactcaaggaggattctcaggcttcctgcagggtccttataaccacaaggatagtggagatcacaccttggcaatcaattcaacaaggaccagggtggaagataaaattttgtag

SEQ ID NO: 56604 - DNA, 480 bp, Glycine max
  Peptide Sequence Number=SeqID_173382
atgactttacaactagcagactgctccattaccaggccatatagagtaattgaagatgtgttcaccaaagtgaaacattttatcttcccgacagattttgtggtaatggatatctccgaagatactgacattcctgtaatattgagaaggccattcatattgactacaagttgcatagttgatatgggtaggaggaagctagagttgggttttgaagatcagaaaattgattttgatttatttgttgaagacaagcctactccagaacaaaatgtttgcttacaggtaatggaaggaggtcaagaggttctgactcctcgcgctaagcgcatctttgttcatgcgctaagcctcgagtctcaagtgcttagtgcccaacccttgcatctgaggctgatttggtccgctaagttggccaaggctgagctaagccaacttcaattcaatttgaattctactaagctgcagcctgattgctaa

SEQ ID NO: 56605 - DNA, 210 bp, Glycine max
  Peptide Sequence Number=SeqID_173383
atggcaagagctggtgacaatggtggtgtatatcatcaactggacggatctcagtgcttatttctggacgcgatgactacacaaatgcaacgtttgttgaaccgtaacaaagaagagctctacagacgaatagccaaatcttccttgtttactctttgtcataccctaatttcgtccggggattataatttgatgatatacaaccattga

SEQ ID NO: 56606 - DNA, 248 bp, Glycine max
  Peptide Sequence Number=SeqID_173384
aaccctagggctttctcttgcatctctggcccaatctacttggagttttctatccaatgcccttgcggggttgtaccatctgtggtgaggctcatgaaacagggtccctataatcaacaaggacagtggaggacacaccctggtaaccagttcaacaaagaccagagcgggccttcaaacagcactgagtcagcactgaagaaccttgaggtccagtgggacaattgggccaagcagatagctgacaa

SEQ ID NO: 56607 - DNA, 1371 bp, Glycine max
  Peptide Sequence Number=SeqID_173385
atgggcaaaatccctccttcgttccgctccgcaatcgcaaaccctaacctccgtaacccctcttcactcttccgtccccaaccccatcacttcccaaacaaacaccaacaacctcgaaaaccctctaagcaacaacaaaaaccttcttctcttcctctcttcaaatccccaaacctcgaagacgccaaaaaactcttcaactccatcgccaactcttcctccgacccccgcttccccaactccctcctccactcctacgccaaactcgccaccaccccttccgattccatcaaattcttcaaccatatcaccaaaaccctaccttccttctcccccgaccgctccaccttccacatcctcctgtcccacgcctccaacaattccaatttactctccccaatccaccaaaccctaaatttaatgctggccgccgggatcacccccgacactgccaccgccgacgtcgccgtccggtccctctgctcggccggtcgcctcgaccacgccgtcgaattgatcaaagaattcgcctccaaacactgccccccggacacctacaccttcaacttcctcgtcaagcacctctgcaagtccagcaccataaccaccgtctatgccttcatcgacgaaatgcgcgaaaaattcgacgtcaagcctgatctggtcacctacacgatcctcattgacaatgtatgcaatgggaagaacctgaacctgagggaggcgatgaggctggtgagtgtgcttcacgaggaagggtttaagcttgattgctttgtttacaacaccattatgaaagggtattgtgtgttgagtagagggagtgaggcgattgaggtttataacaagatgaaggaggaaggggtggagcctgatcttgttacttacaacactttgatcttcgggctgtcgaagtccgggagggtgaccgaggcgaggaagttgctgcgtgtgatggcggagaaaggctattttcctgatgaggtgacctatacttcactgatgaatgggttgtgtaggaagggggacgcgctaggggccctggccttgttgggggagatggaggccaaggggtgtagtccgaatgcgtgcacgtataacacgctgctgcacgggttgtgtaaggcgaggctggtggagaaggctgtcaagttctaccaggtgatcagggctggcggtctgaagcttgatacagcttcttatgggacttttgtcagggcgctgtgtagggacgggagaattgcagaggcgtatgaggtttttgattatgctgttgagagcaagagcttgacggatgttgctgcttactcgacattggagagcacgcttaaatggctcaggaaggcgaaagaacaagggctcgccatttga

SEQ ID NO: 56608 - DNA, 273 bp, Glycine max
  Peptide Sequence Number=SeqID_173386
atgataattgatcgatcctctgaagtggccggcgatggtgacagtcttaaaacggtggcagagatcatgaccgcagatgagatttatgaaatacgctccctatcttctctgcatcatcccctctgtatcttctctgcacgtttgaaggtggaaatagaagtcacatccataaacgaagacgctgaagggaaccaacgacttcacgtgggagaaggaagcaatgatgtcgtgtgggagaagaaagtagcgacgaacagtgggagagggaagtag

SEQ ID NO: 56609 - DNA, 210 bp, Glycine max
  Peptide Sequence Number=SeqID_173387
atggaaggaagatggatgtgcggacaaggagtggctcccaatggttgtcttcttctccttcctcgagctctagggttctgtattgtttcccacacaggaatatggtatattatgcagagtgtggtcatcacatcccaggatcattatgagctgtggctgatttggagcctcaactctcaagaggaaaaggaatgcttctcgtactcctaa

SEQ ID NO: 56610 - DNA, 237 bp, Glycine max
  Peptide Sequence Number=SeqID_173388
atggaagttgcggccaccagtgaaccggaaagatcgttaaccattatgaaccatcctttgtgctccttccccggcctctcgcgctcactctcgaatgaactcaaccagcttctacaacctcctggttttgattgtaacgatctgaacgaatactttttattaaaacccgtcgtaaatttaattacatataacattctaagacagttttcaattaccgtcttagaatgtgtgtcgtaa

SEQ ID NO: 56611 - DNA, 492 bp, Glycine max
  Peptide Sequence Number=SeqID_173389
atggaggagttaaaagatggttacatttatgagaatggaaaactggttgttcatttcttgcaagccatccatgctgcagagaaaaggcaggctgacttagatgtacatgtttctaatgaacagaagaaattgttaaagaagttgaaagatgtagctgctagagaacttatgctcgctgaggaggctgcaatgttggacagggagctaaaaagagagagagcaaaagcatcccttgctatcaaggcacttcgacaaaagatggaagacaaactgaagacagaactagaacaaaaggaaattgaaactgatttgaagttgaaacaaactcaggaattagcaaaggcatacttaaatacaaccatagcaaatgagaatgcagccatagcaaatgagaatgcagctcaaattcaaaaaatggctgaagcaaatgttaatgtgagatttctactaaaatcaaagatgggtagatgtacccattctaagccattctaa

SEQ ID NO: 56612 - DNA, 135 bp, Glycine max
  Peptide Sequence Number=SeqID_173390
atggagagtatgggacttgcacgtgacatagcgcaaaaggagcttagttttggatacaataataatatcagttgctcagatcctaatatgctgcataatgcatacacacttacccaggatatgggattagaatga

SEQ ID NO: 56613 - DNA, 765 bp, Glycine max
  Peptide Sequence Number=SeqID_173391
atgaccgcgctggaggttttggatcactcgtcgaggcttgtgttggaggtggcacaacatttgggtgaaggcgttgtccgaaccattgttatggatgcctcagaaggtgttgttagaggctggcacgttctcaacactggctcccttattatcagatgtatgcgagagggtaatgacttgtatagaggtggtttctctgtgtttgctggtgttggagaacgaacccgagaaggtaatgacttgtacagagaaatgattgagattggtgtcattaagcttgatgataagcagactgaaaacaagtgtgcttttgtgtatcgtcaaatgaatgagccccctggtgctcgtgcccgtgttggtcttactgggcttactatggctaaacacttccgtgatgctaaagggcaagatgtgcttcttttcatagacaacattttccgttttacccaagctaactcagatgtgtctgctttgcttggtcgtatcccatctgctgttggttaccaaccaaccttgtctactgatcttggagctcttcaagagcgtattacaacaactaagaagggttcaattacctatgtccaagctatctatgtgcctgctgatgacttgacagatcctgctcctgctatcacttttgctcacttggatgccacaacagtgttgtcacgacaggttttgggtctctcgggaaaggagaagattacgatgcgaagggaacttctatcacctctgatggtgagaatgttcggaaatgagttttga

SEQ ID NO: 56614 - DNA, 249 bp, Glycine max
  Peptide Sequence Number=SeqID_173392
atgataatgaacggagtacgaatagctcacgaactccaacgacgttgttctaaccaacttcaagcattgctcgttgttcttcagtcccaccaaaattgcctccatcatcaccaacgatggttgcatgagagagcggctatggttgtgcaagcaagcgaggatggtggcacgagaggggagcgacactggtggcttgagggacaaacgcgattgtgcgaggaagcgacatcgatggctaaggggcagtga

SEQ ID NO: 56615 - DNA, 222 bp, Glycine max
  Peptide Sequence Number=SeqID_173393
atggtctttggacatagtttagctgctcttgttatacatatgctggacaagttaaggctgcaagcccattctgaacaaggtgatcaaagatctcctggaatcataccccttgccgtgaaggatgcttttagcgttatccaagaggtggttaatgacttattaaatccagcaggacagaacctaagaatcagagaggatgctcagttatctttatatcactaa

SEQ ID NO: 56616 - DNA, 162 bp, Glycine max
  Peptide Sequence Number=SeqID_173394
atggtactaaagacgtgttcaacatactatgatgcttctggcattgtgaaagatcttgacaatgataacatgttgaagtttgagtacattattcaagtgcatgattttgtggagtttgacttagctgaacagctcatatggaaatataagataaggccatga

SEQ ID NO: 56617 - DNA, 213 bp, Glycine max
  Peptide Sequence Number=SeqID_173395
atggaagggagcaacaaaatacttacggggaagaaagaagctgctggaagaggggggtgtttgctgcaagggtgtttggcgcaacatcctcacatgtgtacttgcgccactgtgtcctgtgcagcactggcaccttgcaccatgtgcctacctgtgcctatgctgaccaaaagtggttgtgccactgtagctgttgcaacccattacgcatag

SEQ ID NO: 56618 - DNA, 174 bp, Glycine max
  Peptide Sequence Number=SeqID_173396
atggtgattttccactatggagatgcagcggaagacaaaggaaaagagcgagcgtctgctaagcgcaacactctttggctaagcgcgaggaacaatctagaagaagatgagttgtacaggttcgctgagcgcactgtaacgacccgcctcgtcgctacggtatccacactctaa

SEQ ID NO: 56619 - DNA, 408 bp, Glycine max
  Peptide Sequence Number=SeqID_173397
atggaaaatggagtcaaagttgacttcgttcaaggtgctgaggagaaagcgaatctggttggaagagaagttggccatggtgggcaaggaatgaagaagtgtcatcacagggaagctgaaattggaagaagatgccaaatgatcttatgtgatagtgttaagtccttggatcggatgcatgagaccctaggctttgcccactttgagggtgatgccagattttggtgcacccatccaccattcatgcttttcgtacacgaagctcaacctccatttgcgtcgccgctattcttcttctctgcgtttgtgtcgccatgtcattttcattggcctttggagcttcttctcctccattgggtgtcggcattgaggaagtgcattgaacgggctattccaccgtcgaggtaa

SEQ ID NO: 56620 - DNA, 1880 bp, Glycine max
  Peptide Sequence Number=SeqID_173398
atggaggggaggccaaatgttggcatagaagcgctgctgaggtgcgaggctaatggaactcttcatggtctagaggtgggcttggtagaagtgtccaagcaaaaattattggaattggttgttaactttgatacacagaagctgcgctttttggcatttttttatggaggatattatgagattcctaagaaagttccattctcagaggatccacaacacttggggaaatttaggccaatatcccttgttggctgcatgtacaagatattggcgaaagttcttcctaataggatgaaaggagttttcagtaaagtcattgaccaaagacagagtatgtttttgggagaaaaatacttatttcatagtgccttggtggttaatgaggtgattgacgaagctaagaggttgaaaaagggttatttgttcttcaaaattgattatgaaaaagcttatgactcggggtgcttgatgtctactagggtatcaatctttgttaatggaagcccaatgttggaatttatggtatcaaaaggattgagacaaggagatcctttagatcccttcttgttcaatgtggttgtggaaggcttatgtgggttgatgaggaaagcattagacaaaaaattagattctagtttcaatgtggggaacaaaggaagcaaacatgtagtgatggacgaggaggaaggtgtcttggagaggtatgcaaatatgttaaactctaagttgatgcacatttcctttgtgtacttaggcataccaatagcaactaaccctaggaaagttgagacttggaaactaatcaatgataagtttgcaaaaatgttgttggcatgggttgaaaacacaaggttttgtcttttgcggggattgagagatgaggtatcagaaaccctgtctatttggtggagagagatatataagtcgtgtggaggggctaatgatctaaagtggtttgatgagtcggttgagaggtgtatggggaatagggatgacattttgttttggagggatgtgtggttgggccagcaatcaatgtgggtagaccatggttgtttttgggaacaagaattgctccaaaatttgcagagggattgggaagggcactcatcttcattctccctctccgtggagaaattcaaagaagatgtaatagtgtcatcaccaaagggcaaattcactgctgggttttaccctgtaggggataacgcatactgctttgccatatggtacacacaaccacctcacacccttgtttggatggccaaccgggaccagccggtcaacggaaaacgctctaccctttcccttctcactaccggtaacctcgtactaaccgatgccgctcagttcatggtatggtccacaaacaccgccacctcatccaaacaagtccagttacatttctacgataccggtaacctcgttctcctcgacaactccgacaacgttgttgttctgtggcaaagcttcgattacccaacggacacgcttcttcctgatcaaactctcaccaagaactccaaccttatttcctcgagaagcggaaccaactattcttctggtttctacaagctcttcttcgactccgataatgttctccgcctcatgtaccaaggtccacgtgtttcaagcgtttactggccagacccttggcttcttaacaataatttaggtattggtggtacgggtaatggtagaacctcttacaacgatagcagggttgctgtactagatgagtttggccactttgtttcttcggataacttcactttcaaaacaagtgattataggacggtgctccaacgtagattgacgcttgatcccgacggtagcgtgagggtgtacagcaagaacgatggagaagacaagtggtccat

SEQ ID NO: 56621 - DNA, 1041 bp, Glycine max
  Peptide Sequence Number=SeqID_173399
atgtccaaatctgattcttcttcttcttgtttagcaagaagcttcaaaaactctgcatggagcatgagttccctcatgactgctctggaagaatctccctccactatttgcagccactcccgttattcatacacaacaaactactcacaccatgccactgagttctccactccaagagaccaggttcgtatagcatgtttggaacataccatgccactgagttctccactatctgcctgcaatgttgacaacaacaataactcgtccacttgcctctcagatattgatgaatggttggaacattccaataagttctgcaaatcctctatccatcttacagaatctgttcattcggggcaaagtggaagcccagaagaagaagactcgagactctcagcaatatgcagcacctaccttgcagctcaagaacatgaacttcacaacataacattaccctgtgttagagaagacagttctgttttccaaggccagagctgcatttcctgcacatgcaaacccccaaaatttggaggctatgaacgcacaagactgatgggaccttatgatgagtttttggatgatatcagaaggaggaaacaggaagctgaaagagatgcacgtaagaaggccaagcatgttgaacttatactcaagttgagaaggaaggaaaacgctttaaatgattgggaattgcagcaaacaagaaaagctatggacaagatggataaaattcaggcatttatatccttagagaagatagagggaaaagcacaagcctccactgattttacaagattaaaccgcttactttacattggacgtgtacatcacccctcaaatgctgtgaagaatgagctggagagaaaacaatttaaggcttcagccaggacccagaagaaaatatgcctagtgagggaaaaggcagagaagcaaaagcttaagttgaggcgatcagcaatgaaaagatttcaacagattcaaacttctaagactcgttccccttcagaaatttcttggggttcacgcctaccattatgttaa

SEQ ID NO: 56622 - DNA, 891 bp, Glycine max
  Peptide Sequence Number=SeqID_173400
atgactttgaggtttgaatcagtagtgtgggctttaaaccctaagctaagtcaccaccgtttctccatccccaatcttcgtcggaatccccactctctattcgcacctcctcctcctcctcgcattcgcacttccttcctcgcattcgaagaaggaggaggaggagaaatcgaaccggagaaaaacgaaaacaacaacgataaccgtaccggtgccgaagaatcgtggaagcaagctctggacacgttccgagaacaggcctcgaagattcgagatgcttctcaagaagcgtacgagctgtactccgagaaggcgattgcggtgttgaaggacgccacggaggagctgagagtggccgccaaggaaatcggcgacgaaggcaaacagtatctcaccgtagttgccgagaattcgccggaggtcaaggaagtcgttgaatcattcacctctccaagtcgtgacctcagcgagatttctcaattgcgcgatttctacgtcggtgtaccttacggtagcattgcagcactaaggtttgggatagtgttaggtagcgtccttttggctctaggtgtttcaagtctccgggcatacaaaagaggacaaccttcttctttaatgctcaaaggccaaactgcaatagcaagtatattgtttttgcgggagataagattgctagctgcagaggatactaaaacttcctgtggtgtacgaccttcctctgaagtggcgtatcatgaactggttttacctttcattgacctctctagtaccctttccatttgcaaatggttctttagagagaaacccatgcttggtaggttgcaggagggggaatttgcgcttcttttggcgaatgaaggttttgtgagactttcctcttttgaagtctaa

SEQ ID NO: 56623 - DNA, 5220 bp, Glycine max
  Peptide Sequence Number=SeqID_173401
atgattgcaaacttgtttgaggagtatagatttttcccaaagtatcctgaaagacaactcaaaattgctgcagttctctttggttctgtgatcaagcatcagcttgtaactcatctatctttggggattgctcttcgttatgttcttgatgcattgcgcaagcctgcagattctaaaatgtttttgtttggaagtctggcattggagcagtttgtggatcgtcttattgagtggcctcagtattgcaatcatattcttcaaatttcccatttgcgcagtacacattcagaaatagttgctttcattgagcaggctcttgccaggatttcctctggtcattcagatgttgatggggcgagtcatgcttctgttattagtaaccatcattctgcacaggcttcattagggcatgtagaggttgttaatgattattctgtgggacctattgcagtgctcagtggctctagcgtcatacaacctgggcaacaacatttgtcaatgcagcttcaacaacgacgtgaaaatccgttggatgatcgtctcaaagcttctgttggttcatctacggatgtaaaaccattgttatcttctctagggcaatcttcagtactaacacctactgatgcttctagtaccaataagttacatagcacagtcagcacgtcatcaatgctatcttcgtcttctcctggttttgttcgtccttcccgtggaactacttctgccaggtttggatctgccttgaacattgaaactttggttgctgctgctgagaaaagagaaattcctattgaggctccagggtcagaggttcaggacaagatattatttataattaataatgtttctgctgctaatattgaagctaaagcaaaagagttcactgaaattttgaaagagcagtactatccttggtttgcacagtatatggttatgaaaagagcgagcattgagccaaatttccatgacttgtacctgaaattcctggataaagttaattcaaaggctttgaacaaagagattgtccaggcaacttatgaaaattgcaaggttcttttaggatctgagctcataaaatcaagttcagaggaacgttctttgcttaaaaatttggggagctggcttggaaagttaacaattggccggaatcaggttttgagagctcgtgaaatagacccaaagtctttgattatggaggcatatgagaaggggctaatgattgctgttattccatttacgtcaaaggtccttgaaccatgccaaagcagtcttgcatatcaacctcctaatccttggactatgggcattttgggattgcttgctgagatttattcaatgccaaacttgaaaatgaacctcaaatttgacatagaggttttattcaaaaatctgtgtgttgatatgaaggatgtcacaccaacttctctcctgaaggatagaaaaagagaaattgaaggaaatcctgatttctctaataaagatgttggggcatctcaatcacaaataattactgatataaaatctggccttgtacctccggtaaatcaagtggaattaccacttgaagtcaccaatccatccaacacaggggctcatccacatatactgtctcagtatggtggtcctcttcatatttcctcgggagcattgatggaagatgaaaaggttacacctctgggattgtctgatcaacttccctctgctcaaggactgttacaagcaaatcctgccccagcacctttttctattagccagcttccaacacagatacctaatattgggactcacgttattatcaatcaaaagctcagtggttttgggctgcaaatgcattttcagagagcggtacccattgcaatggacagagctatcaaagagatagtgtctagtattgtgcagcgtagtgtttccatagcaacacaaacaaccaaggagcttgttttaaaggactatgccatggaatctgatgagacacgcatattaaatgcggcacacttgatggttgctagtctggctggaagtttggctcatgttacgtgcaaagaaccattacgggcatcaatatctggtcaactgaggacttcacttcagaacttaaatattgctaatgaaattttggaacaagctgtgcaacttgtcaccaatgataatcttgatctaggctgtgcagtcattgaacaggctgctactgacaaggcaataaacaccatcgatacagagattggtcaacaactctctttgagaaggaagcatcgagaaggtatgggttctacattttttgatgcaaatttgtatccacaaggttctatgggtggtgttccagagcctcttcgccccaagcctggtcagttgtctctctcacaacaacgtgtctatgaggacttcgttcggcttccctggcaaaaccagtctagccagagctcacattctatgtctgctggtgtcgctgttcaatctggcaatactggtcttactggcactaatggttctgtatcagggcagattaaccctggataccctgtgaccacaggtgcttcctcgattaacattagagcagctgatagtgtttcccagcacagtatggagaaagactctgttgcctcatttccttcggctgcttccacccctgaattgcatgcagtggattcttctgaagtgaaagaatctggaacttctccacagccactagttacatcaggtgctgtggagcgccttggaagtagttttttggagccttctctcacaacaagagatgccctagataaattccaaattgttgcgcaaaagttggaagctatggtcagcaatgattccagggatggagaaatacagggtgtcatttctgaggttcctgagatcatacttagatgtgttagtcgagatgaggcagctttagctgtggctcaaaaggttttcaggggtttgtatgataatgcatcaaacaatattcatgtctctgctcatcttgctatcctgactgccattcgtgatgtttgcaagcttgctgtcaaggagcttactagttgggtaatttactcggaagaagaaaggaaatataacaaagaaattactgttggcctcatccgtagtgaattgctaaatcttactgagtacaatgttcatatggccaaacttattgatggaggaaggaacaaggctgcaaccgaattttccatttcccttcttcaaaccctggttgtcgaggaacctaaagttatttcagaacttcacaatcttgttgatgctttggcaaagcttgctacaaagcctggatgccctgagtcattaccacagcttcttgacatgatcaagaatcctggtgctctatcttctagtaatgctggaaaggaggataaggcaagacaatcaagagacaataagggttctggtctgttacctgcaaacagggaagagttcaacagcgtcgattctattgaaccagatcctgctgggttccgggagcaggtttccatgttgtttacagaatggatggtcaatttaacctctttcattgattttttcccccaggaactagctgttgcacattgcttatccactgagatgattaattctgggtcactacagtctcaaccgctgcagacaatgtcatttcttgcaattgaaatttatgcaaagcttgtcttctcaatcttgaagggatcaaacaaactctttcttctttccaagattctggcagttactgtcagattcattataaaagatgcagaggagaagaaggcctcttttaatccaaggccacttttcagattattcatcaactggcttctagatcttggttcacttgagcctgttactgatggtgcaaatcttcagattttaactgcttttgccaatgcatttcatgctttgcagcccctcaaagttcctgcattcagttttgcatggcttgagttgattagtcacaggagcttcatgcctaaaatgttgactggtaatggtcaaaaaggttggccttatatccaaaggttgcttgtagatctgttccaatttatggagccttttctgaggcatgctgaacttggagaaccggttcgtgtcctctataaaggaacacttagggtgctcttagtgctacttcatgacttccctgagtttctatgtgactatcactttaccttttgtgatgttattcctccaagttgcatacagatgaggaatatcattctaagtgcatttccacgtagtatgaggctgccagatccatctactcctaatctgaagattgatttgcttcaagaaataacccaatcgcctcgcattctttcggaggttgatgcagcactcaaagcaaagcagatgaaggttgatgtagatgaataccttaagacaaggcaacagagttcgccgtttttatctgaactgaaggataagctgcttctctcacccaatgaagcagcttctgctgggactcgatataatgtgccgttaattaactcacttgtgctatatgttggaatgcaggcaatccatcagcttcagggacgaactccccatactcaaacatcagcaaatgctttccccttagccgtattttctgttggtgctgcattggatattttccagaccctaattgtggacttggatactgaagggcgctaccttttcctaaatgctattgccaaccaactgcgttatcctaatactaatacacactacttttccttcatccttctgtacttgtttgctgaatcaaaccaggaagttatccaagaacaaattactagagtcttgttagaacgcctaattgttaaccgtcctcatccctggggtctcctcattacttttattgagctgatcaagaatcctaggtacaatttctggaaccggagtttcataagatgtgcaccggagattgaaaaactttttgaatcagtgtcaagatcttgtggaggtccaaaaccagtggatgatagcatggtttcgggttggatatttctaactgaaaaaggcccaaagtttatacctgctttattgcaaaatctaaaccttttaccatggccggagaccaagttaaaagttcaaaatataagtgaaaacccagaagagaaaaatctaactcacgaagaacattattcaacccaatttgttaactggagaagcaacagttactattcacaaaaaggtcgaagaagctgtaacagtttccctcgtcctccaacccttgagagtagcatcatcagtttctttgctaaaagctaa

SEQ ID NO: 56624 - DNA, 885 bp, Glycine max
  Peptide Sequence Number=SeqID_173402
atgcagatagaggattatctatatcagaagaagttgtatcagcccttatcaggggttaagccagaagacatgaagcaagaagaatggaacttgctagatcgacaggctcttggcgtgatcagattgacattagccaagaacgtcgcgttcaacatcgtgaacgagaagactactgtaggcttaatgaaggcgctatcagatatgtacgagaagccatcggcagccaacaaagtatacttgatgcgccggttgttcaacctcaagatgggagaaggtatctctgtaactgatcatattaatgaatttcatactattcttgcccagttggaatcagtgcagattaaatttgaggatgaggtgaaggcattgattctattgtcatcactaccggatagttgggctgcaactgttactgcagttagtagttctacaagggagaacgcattaaagcttagtgacatccgtgacttgatcttaagcgaagatgttcgcaagagagattctggagaatcttctagtcatgtttccaattcaacattgaatactgaaggcaggggaaggactacccagaagggtcagaatggtcgaggaagatcaaagtcaagaaggaaaggttttgggttagagtgtggtgtcaagcttccttatgtggtggctcgtggtccacagacgagtatgcaagtaccgcatgtggccagaatggctagcggcacagcgtgccccgcaggagaagcagggtggccagaatggctagtgggcagggcaagtaccgcaggggggaatgtgttgggttacaagtgtgaggtgaagtcccacatcgggcttccttatgtgatggctcgtgatccacaagtgtacccctcgaatctccccaacattggatag

SEQ ID NO: 56625 - DNA, 1233 bp, Glycine max
  Peptide Sequence Number=SeqID_173403
atggatttcaagggatcattcttcctgcgactgcctttgtcccatgaagagtatgagaaccctgtccaaaataacgacaatggcggcttggtttgtgggggagaaggtggaggagcgaaactactggagagacagtacgcggaagaaaaagaaaatggatcggtgaagctcatgttgtggtttgcgagtgccttgggaggaattgaggttgtgtgcatctttctggtgtggtgtttcttgtttaggaacaaaaatcggaaattacactccggtgctgacaaacaaggctatgttattgcaacagctgcagggtttcggaaattcagttactctgagctgaaacaagccaccaaaggcttcagtgaagagattggaaggggtggtggaggtactgtgtataagggtgtcttgtctgataatcgagttgtggcaataaagcgactgcatgaagtagcaaaccaaggagaaagtgagttcctagctgaagtaaggataattggaaggcttaaccacatgaacttaattggcatgttggggtattgtgcagagggtaagcataggttgttggtttatgagcacatggagaatggttctttagctcaaaacctctcatcgagttcaaatgttcttgattggagtaagagatatagcattgctcttggaacggcaaagggtctggcctacttgcatgaagaatgtctggagtggattttgcattgtgatattaagccccaaaatatacttcttgactctgattaccaacccaaggtagcggattttggcttgtctaagctacttaaccggaacagcaacctcaacaattcaagtttctcaaggataagaggaacaagaggttacatggcaccggaatgggttttcaacttgccaatcacttccaaggtggatgtctacagctatggcattgttgtcttggagatgataactggaaggagcccaacagcaggtatccaaatcacagaattagaagcagcatcacatcatcatgagaggttggtgacatgggtgagggacaaaaggagaacaagatcaaaaatgggatcatcatgggtggatcaaatcgttgaccctgctttgggatcaaaaaactatgacaggaatgaaatggagatattggcaacggtggctttggaatgtgtagaggatgagaaagatgcgagacctagcatgagtcaagttgctgagaggctccaaaatcatgaaccctatacgtga

SEQ ID NO: 56626 - DNA, 2427 bp, Glycine max
  Peptide Sequence Number=SeqID_173404
atggcttcttccacatttttactacctcttttcgtttctctaattttccataattttcagcactcatcttcattctccctctccgtggagaaattcaaagaagatgtaatagtgtcatcaccaaagggcaaattcactgcagggttttaccctgtaggggataacgcatactgctttgccatatggtacacacaaccacctcacacccttgtttggatggccaaccgggaccagccggtcaacggaaaacgctctaccctttcccttctcactaccggtaacctcgtactaaccgatgctgctcagttcatggtatggtccacaaacaccgccacctcatctaaacaagtccagttacatttctacgacaccggtaacctcgttctcctcgacaactccgacaacgttgctcttctgtggcaaagcttcgatttcccaacggacacgcttcttcctaatcaacctctccgcaagagcaccaaccttatttcctcgagaagcgggaccaactattcttctggttactacaaactcttcttcgactttgagaatgttctccgccttatgtaccagggccctcaagtttcaagcgtttactggccatatgattggcttcggagcaacaatatcgattatggtattggtaatggtagatacactttcaacgatagtagggtggttgtgctagatgatttcggctacttggtttcttctgataacttcacttccaaaacaagtgattacgggatgataatccaacggagattaacactcgatcacgacggaaatgttcgtgtgtatagcatcaaagacggacaagacaagtggtcggtatcaggaatatttcggcgacaaccttgttttattcatgggatttgtggtcctagcagtatttgcagttatgaaccagcaagtggaagaaagtgttcgtgccttccagggtatcgatggcttgatagcgaagactggtctcaaggttgtgtaccgaagttccaactttggtgccgcaacaacaacactgagcaagattctcgcttcctgcagttacccgaagtggatttttacggatacgactatggcttctttctgaatcacacgtatcaacaatgtgtaaatctgtgcttgcgattgtgcgaatgcaaagggtttcaacacagctcttcggggcaaggcggtgttaatggtcagtgctacctcaagacacagttgttaaatggccatcgtacaccgggttattcgagatcattcatcctgcgactgccttcgtccatgcatgactatgacgagaacaccatcaatattggtttggtttgtgggggaaacagaggagtgcaagtactagagagaccgtatgtggaagagaaagaaaatggatcggtcaagctcatgatgtggtttgcaagtgccttgggaggaattgaggtcgtgtgcatctttatggtgtggtgtttcttgtttaggaaaaataatgctgataaacaaatctatgttcttgcagctgaaacggggtttaggaaattcagttactctgaactgaaacaagccaccaaaaacttcagtgaagagattggaaggggtggtggaggtactgtgtataagggtgtcttgtctgataatcgagtagcggcaataaagagactgcatgaagtagcgaaccaaggagaaagtgagttcctggctgaaacaagcatcattggaaggcttaaccacatgaacttaattggcatgttggggtattgtgcagagggtaagcataggttgttggtttatgactacatggagaatggttctttagctcaaaacctagattcaagttcgaatgtgcttgactggagtaaaaggtataacattgctctaggaacggcaaggggtctggcctacttgcatgaagaatgtctggagtggattttgcattgtgatattaagccccaaaatgtacttcttgattctgattaccaacccaaggtagcggattttggcttgtctaagctacttaaccggaacagcaacctcaacaattcaaacttctcgaggataagaggaacaagaggttacatggcaccggaatgggttttcaacttgcccatcacttccaaggtggatgtctacagctatggaattgttgtcttggagatgataactggaaggagcccaacaacaggtgtccgagtcacagaattagaagcagagtcgcatcatgacgagaggttagtgacttgggtgagggagaaaaagatgaaagcatcagaagtgggatcaacttgggtggatcgaatcgttgaccctgctttgggatcaaactatgacatgaatcaaatggagatattagcaacggtggctttggaatgtgtagacgaagacaaagacgtgaggcccagcatgagtcaagttgctgagaggctccaaaatcacgaaaatgattcttga

SEQ ID NO: 56627 - DNA, 909 bp, Glycine max
  Peptide Sequence Number=SeqID_173405
atggaagaggagacgatggtgacgtggagcacctgggaggagcttctccttggtggagcgatttcccggcacggaacccgagattggaccgtcattgccgccgaactcaagacccgaaccgtttcaccatgcattttcacacccgaggtttgtaaagccaaatatgaagagttgaatttccagtatcctggggggtgcacgtcttggttcgaggagcttaagaagaaaagagtggcagagcttaagagagatttgaagcaatctgaggaagtaattgggtcccttgagatgaagattgaaacccttaaggctggaagggatgagaaaagagatgattgccatgttgacaatggctcggctgaaccagagttaaatgttccttctcataagttggatagagttaacgattctccaaaagagatgtcaaaggatgggttatctgcagggagtttcactcatgaaactaagacaaactggactcatgaatgccagattccggcaacatcttgtgaagatgtggcgaccaagcctgaagcatcagggtccactgagcaggagaaagttttgaatgtagataagttggctaacattgtatatcaagaacatggagggtgtttgaaaaaaccgagagggaagagaaagaggaaggattgtagcagaagtattaacgaagtaagtgtaagagaaagtgatttttcagctgatgtgtgtaaagaaagttctctcagctactgtggcgagattgttaaatcttctggtgtgaatgaggagaatgcaaacttgaaaacggctggaataaaagatttgatggagctcttagattcttttttggtagttcaaggtgcttctgtcttcacttataagcatgataaccagactaatggatttgtggtgttcgttattctttag

SEQ ID NO: 56628 - DNA, 543 bp, Glycine max
  Peptide Sequence Number=SeqID_173406
atggccacaatggtggaggccatgatgagcatgaagaagataatggaagccaatacggttgcagttgccgctaccagcgttgttgctaagtacggacgaccccatgatgtgcaaattcaaaacgagcacgccttcccgccatatggcttgcctcccaactatacgccacccaatgtggcatacactcccaatgcgaatgtcaataactccactcctatacccattgagagccaacaaccccaaactgatcatgcacataggaaaggaggtgaagattatgcctttgctaaactagaagagttgttcctagtacccaatatcattacccctcccaagttcaaggtgctggactttgacaagtacaaggggactacttgccccaagagccatctaaagatgtattgtcggaagatgggggcatacacaaaagatgaggaactactgatacatttcttccaagaaagtcttactgggcatcagtacaattctgatatgacttcggataggatgcaactacagaatatgtgcaaaaagggggcatga

SEQ ID NO: 56629 - DNA, 173 bp, Glycine max
  Peptide Sequence Number=SeqID_173407
atggagaattcgcgaacagcgctaggcagtcaattcgaggggctccagactcgaaggtgtaggacagatgaacagcactatccaatgaattcatggggctccgaatacaagtggagaatggagaattggcgaatagcgctaggcaatcacttcgcggggcgccagactcgaag

SEQ ID NO: 56630 - DNA, 337 bp, Glycine max
  Peptide Sequence Number=SeqID_173408
tgctaaagtttatgtctcgctaagcgagctcaatgtgcttagcgagtgtcatccgctaagcaaggcatcaatgcgcttagcggataggaggaatatggaagggaatttgtcacgtaggcatgtgctcagcgcgtcatcagcttgctcagcgagtcgtttttcaccttccaggcttagagtgagtttggtgttgagcagaaattcacttactcgcgctaagcgtgagagtggcgctaagcgcgacgtccaggctgaaaagagagcgctgaatagccgtaagagcttgaagagtgaaatacacagaggcaaagaacaaagcaaagaagccaagttttga

SEQ ID NO: 56631 - DNA, 345 bp, Glycine max
  Peptide Sequence Number=SeqID_173409
atgcccacaaaccgggcgcagacgtccgcgtgctggaagcggcgctggcgctggtggctgaccgcatcgtgcaggaagcctgatcccgcgagcgggcctggtcaggctggcaggacggagagcgctcgtggaaatattattcgttatcggcttttttatgatgctgctgctgactggcgtatcgctgctgggcgtgatcgccgcgctgctggtggccaccgtggtgatgtttctcggcgggctgtttgcgcttgttataaaattgttgccgtggctggtgctggcggtggtcgccgtgtggctgtatcgcgcatttaccacgccgcagggagaggtgaaacttaa

SEQ ID NO: 56632 - DNA, 612 bp, Glycine max
  Peptide Sequence Number=SeqID_173410
atggatctgagctctaaccagctcaacggcaccatacccaagttcatttcacagatgaagtctcttaagcacctgaatctcgccaacaacaacctccacggggttgtgccttttaacctctctttcattaagcgattagaagtgttcaaggttggtggcaacagtaatctttgctataaccattccatggtgtcttccaagttgaagcttgggatctcgccctgtgataagttcggaatgccggtcactccgccgtcgaaggattcttctgccgatgatagcagcgacgatgattacgatgagggtgatgaggaagggagtaggcacaagaaggagcatcatcatggacctaacaagtttgttcttggtgtcgccattgcgctctcttctattgtctttctcattgttttcttgatcctctgctccaaattagtggttacattactacagggtaggttcaaggaaaggaaacataatgaaaatgtaactgccgaaaaaaaaggaaattgttatttacattttggtggggatgtatggaaaaatgaggaaggagagacattaatcaatagcatgtgcagtgcaatgagtttatcatgggatgctagatgctag

SEQ ID NO: 56633 - DNA, 687 bp, Glycine max
  Peptide Sequence Number=SeqID_173411
atggcgtccgcgcttcgtccgcgcaccacggatatcctgcaacgcgtcacggtgccgctgcagctggtgctgtatatcgccctgttcgttgccagcggtcagctggtgagctggctgcatctgccgttaccggccaacgtcgtgggtatggtgttgctgttactgttgatcgtcagcggtatcgtgccgctgcgctgggtcaaagccggggccaactggctgctggccgaaatgctgctgttttttattccggcggtggtggcggtggtgaattacagcgacctgctgcgcagtgaaggctggcgcatctgtgtggtgatcgccgtcagtacgctgatggtgctggcggccacctcgctgcctgttgtgtctggcgctgacgctgctggtttactacctcaacaaacgcctgtaccggcgcagacccacactgctgctgatgccgttggtgttaacgccgctggtgctggtggcgctgttgctgctgacgcacgtcagctggcaggattacatcgccgaaagccactggctgctgtggctgctggggccggcgacgctggcttttgcggtgccggtttacgaaaacctgcacattatccgtcgccactggctgtcgctgagcgtgggcgtgatcactgccacgctggtggccgtgtgcagttcggtgtggctggcgcggctgctgac

SEQ ID NO: 56634 - DNA, 174 bp, Glycine max
  Peptide Sequence Number=SeqID_173412
atgacgctagaggacttccttcaacgagtcgcctggttaggagaccagccttcacctgatttgggtgttgggggtgagacctttggtgctggagatgcagcagacaccatcgaggcagacatcgattatgttgcgaacctcacgacaacacaaggagagtgtcattatgagtga

SEQ ID NO: 56635 - DNA, 1455 bp, Glycine max
  Peptide Sequence Number=SeqID_173413
atgagattcacccggaatcccattgcgctagggatcgtcgctgcgcaggcggtgttttatttccccggcgtgggggaagcggcaacactgggcgcgtataatccgcgcgataacgaccagcagagcggcgcgctgatcgttaacggcggcagcgcaaccttaaccggtaatcaggcatttgagccgggcattgacggggcggtcaacaccacgctcggccaggtgaccatcgcggcgggcgcacaataccttaatcaggcacgtctcgatcccggtccgcaaaacctcgccatcaccgtgccggatcccactaccggcggcaacaccacttttcaggtgtttgattccgccagcctggtggcgcaggcaccggttaccgccagcacggtggtgccggatctgcaaaacgtgaatgacaatcagtatatcgatgcgcgtatcgccgacgtcagcggcagcggcagttcgctggatgtcagcattggtcaggctaacgccaatagcagcgccagcaccaacgcctggaccatggcggccaaaaacaccacgctgtttcaggtcagtaacggcggcaccctcaactggaacaacaacaaccgcatcacctttaacggttctgcggccaacgtttccggcggccaggtgaccgacagcctggcggtacaaaaccttgcgacctataacggcagctttagcgtgcagacgctggacggcaaaaccaccgccttcaacgtcaccaatgccagccagctgcaaagctacaataactggctggtgagccagctgcaggccggcaatctcgcgccagccagctacctcagcgcgttcaatcaggcggtcactatcaccaacggcgatattgtctataacgtcagcgccactgcgccggatgaagtgacgcagccgataggtagccgcgtggtgatcaatgccgaaggcgccggttcgcaggtcactgtcgccgccggtaaaacgctggaagtggtaggggccagcgatggcgcggtacgcgtggccagcggggccaatgccaccatcgacgggaaactggcgagccgcggcaccgcgctggcgctggatggcgcgacggccaccaacagcagcagcggcgtcatcaacggcggcttcctcaaccgtattgatggcaccggcgtcggcgcggccagcaacaacgccacggcggtaacggtgcaaaatggcggcgatttcacaaacaatggcgtgcttaacctcggtaccaccggcagcaatctgaccaacggcgtggcgggcatccgccttgatgccaatgcgcaggccagcaacagcggcaatatcaatgtgggcgtcaacggctccagcgcgcgcggcaccacttccggcgtgctgctcaccagcgacagcagccgcttcaccaacaacagcggcggcacgatttatctcgggcggggcgcgcagaacagcctcaacgacaac

SEQ ID NO: 56636 - DNA, 237 bp, Glycine max
  Peptide Sequence Number=SeqID_173414
atggaaacttggggtgtcacctatgagatggatgacctcactctccagagaaacaagcccccaaatagccgcaaagtgatgggaaaattctcattaaatgttatctgggacacggaagagtttgtgatgagtggaggttgtaaccgcaagtgggtggagtgtgcaaaagaaggtgagatcaagcaaaccattaaaggtagacatctcatctatgttgacatctcatattgcacctaa

SEQ ID NO: 56637 - DNA, 867 bp, Glycine max
  Peptide Sequence Number=SeqID_173415
atggatcaaaacacaagcgagggaagaggtgaggtattgggtccggtttatgaaggggaagatggaaatttgagtaatttggttgaaggggttgtagttgtaattgatgctgtagatgggaacagcttgggtggaagagttagtataagtgaagaagctggaacttcaggagaggttggcaaggatttcggatctgatatggagctagaggaggggattgaggaagttaaggatcaggacaatcatgatcaagaaaatatcagtgatgataaattgctcgaggttgatcagggaactagttataattcaaaccatttggttaatcaagtagtgattgaaactgtggttgcaattgagtctgttcagactaagtatgtcactgaagataataggaaattggaaacaaaagttgatgaatcggggttgagcatggtatccatgaaagcaccagaaggggtgtctgaaactgataaagattcacgtgtgattgatataaagtgcagcagctgcaaaaaggtttatgaggattctgaaggtgaaagggtttgtaggatttgccatctgacttctgtgcaatcatcggatgaaacaactgttggcaccgctagtagtgctacaagtgcagacttgattcagcttggttgtgcttgtaaagatgagctaggcattgcacatgttcattgtgctgaggcgtggttcaagcttaaggggaacagggaactagttagtgtagcacactgctatttgccttggatcggtacatctctagttggagaacagctagcatcattactgcactcagacatagctgtacagtgcatatcagtagccatcagcctatttggaattcctatagttaaggagtga

SEQ ID NO: 56638 - DNA, 513 bp, Glycine max
  Peptide Sequence Number=SeqID_173416
atgggtgatgcgtgccgccagcggcgactgcagtacctcgcgcgtgagcagcgccagctccagctgggaaaagccgccgagattgttgatcatcaacagcgcctgtttgccgtcgggcagcgcctgcgccagctgatcggtcatgatgctggtaattttgcggctgttttgcttatcgagcgtgaccacccccggctcaccgtgaatgcccatccccagctcgctatgaccagctgccacgcgatcgtcgcgcttttcacccggaatgtgacaggtggcaaacgccaggccgatggaggacgtggcgtcgatggtgcgctgcgccagggttttgacctcgtcgagcgagtgcccctgctccgcggcaaagccggcgattttgtgcaccagcacggtgccggcaatgccgcgcggctgtggattttccgggcagcgcgatatcgtcctgcaccatcaccagctccaccttgtaaccaagatttttcgccttttccgctgcgaggccaaagttga

SEQ ID NO: 56639 - DNA, 1629 bp, Glycine max
  Peptide Sequence Number=SeqID_173417
atggaacatatcaaagttgttgcatggctcatttcactttttctgtggaattgggtgcttgttgttgatggcactgataaccttctctctccaaagggtgtcaactatgaagtggctgctttgatgtccatgaagagtaagacgaatgatgagttccatgtccatgtcatggatggttgggatattaattcggttgacccttgtacttgggacatggtcggttgctctgccgaaggttatgtcatgtccctggaaatggccagtgtgggtttatctggaacgatttcctcaggaattgaaaatttgagccatctcaaaacattgttattgcagaacaatcagttatctggtccaatcccgaccgagatagggaagttgttagagcttcaaacccttgacctttctggtaaccagcttgatggagaaattcctaattctttgggctgtttgactcatcttagttacttggatttgtcattcaataatctcagtggtcccactccaaaaattttagcaaagggttatagatacagggtcatctcaaacgagtggcagtcatcaccaaagggtgcttgttgttgcattggtacagatcacacattctctacacatcttatgaggttctccttctgggaattgcagaccgctactgggaatttcaattcaaaaaatatcctaggacaaggtggatttggtgttgtctacaaaggatgccttgcaaataaaatgttggtggcagtaaagaggctgaaagatcccaattacactggagaagttcagtttcaaacagaagttgagatgattggcttggctgtgcatcggaacctcttgcgtctttatggattttgcatgacaccagatgaaaggttgcttgtttatccttacatgcccaatggcagtgttgctgatcacttgagagattttctcttctcccttgttctcaagcagagacttgttgtgaaaagccatcgttggactagaacaggagaatgcgtgttgcatgaacagtgcaatccaaaaataatccacagggatgttaaggctgcaaacattttgttagatgaaagttttgaagctgtggtgggggattttggtcttgctaagctcttggatcaaagggattcacatgtaactactgcagtgcggggtactgtagggcacattgccccagaatatctctcaactggacagtcttctgaaaaaacagatgtttttggatttggcatattacttttggagctcataacaggacacaaagcactggatgctggaaatggtcaggtccaaaagggaatgatccttgattgggttagaaccttgtttgaggagaagcggctggaagtgctagttgacagggatcttaggggatgttttgatccagtagggttagagaaagcagtggagttgtctttacaatgtactcagtcgcatcccactttgcggccgaagatgtcagaagctttaaagattctagaaggtctggtagggcagtcagtgaggccagaggagtcacaaggggggactaacctatatgatgaaataacttgcagtttctcacaaaattatggtgatgctcatgaagaaccttcctttattattgaagccattgagctttctggacctcggtga

SEQ ID NO: 56640 - DNA, 726 bp, Glycine max
  Peptide Sequence Number=SeqID_173418
atgaaagggttttcgctgacgctgctggcgctggaagaggcgtttttcgaggcgctgcatgcgccggtgcgggtgctgggctggacgccgatgtacgactttgcgcccatcagcctgcagcacgctgaacgcatcggcagcgtgctggatttcgatccttccgataacgctgaagtggcgcaggtggttgagcgcgtgacgcatacgctgatcgatctggagagcgagctgaatgcactggacgccaaagtcggcgatggcgataccggctcgacctttgccgccggcgcgaagaaaatccagcgcggcctgcgtgaacagcagctaccgctggatgagctgcctacgctgctggcgctggtaggcgaacagctggcgacggtgatgggcggatcgagcggcgtgctgatgtcgattctgtttacttcggccggacagcagctggaggagggcagcatgctgccgcaggcgctgatgcacgggctggaacggatgaagcactacggcggcgcgcagccgggacatcgcaccctggtggatgcgctacagccggcactggaggcgttagcggccggagagtcgctggctgcggcggcggccgctgcgcaacagggtgccgacgcgacggcgcagatgcagagtgcgaaggcggggccgttcggcttatctcaatcatcagagtctgtatggcgtgtagcgatcccggcgcgtacgccatcgatgagg

SEQ ID NO: 56641 - DNA, 150 bp, Glycine max
  Peptide Sequence Number=SeqID_173419
atgggcgttcagcaccgcatcaacgctcggcgaggcgaagatatcgccgcacaccgcagcggtcagcatccctttgccgacaaagcccgcgtgcgccggttcgtggccggagccaccgccggaaatcagtgcgactttgcttttatccca

SEQ ID NO: 56642 - DNA, 333 bp, Glycine max
  Peptide Sequence Number=SeqID_173420
atggtgaatggtggcaacaatggtggtgataatgatgatgtcaacaatagcgacattgatagagatatcaataatggtcacggtggtagtggtggtggtgatgatgatggaggtggtattatcgatggtgacaacgatgacgttgtcggtggtgacagtgacagaggtgatattaatagtggtggtaatggtggttgtagcgacattggtggtagttgtggtgacggtgacaaaggtggtagtggtggaggtggtgataatgatgatgaaagtgacactaatgatggtggtgatggtaatgtctatgaagatggtggtgataatcaattatga

SEQ ID NO: 56643 - DNA, 1803 bp, Glycine max
  Peptide Sequence Number=SeqID_173421
atgctgataagtggtattgatcgatctgttactttctgtgggagactgagaaacgatgccaagccagctatggttttcactgccaatgacttacaagaatggaaagattttcccaaaggactcaaggttcttctccacgagagagacaacatttctgctgcagagataagggcaaagcttgaagccatggactataatgtttctacattctgtgatgagaatgacgccttgtcagtgatctcaagtggacttgaaagcttccacattgccatagtggaggtgagttcaagcagtgcccagggaggtttcaaatttcttgagaatgccaaggacttgccaaccattatgacttcaaacaatcattgcctgaacaccatgatgaagtgcatagcgataatacatcgccattctcttctgattgttaatgcatacttcttggctctttgctccattttatttttaaagcttggtgcagttgagttcctcagcaaaccactctctgaggacaagctcagaaatatctggcaacatgtggttcacaaggcattcaatgctggggcaaacatcctgtctgaatcacttaaacctgtcaaagaatcagtagcgtccatgttgcagctccaaacagacaatgaacaacatgaaagtagagtatccattgatatagagaaagtatccagctttgttgataatgatcatgagctgtctcctggaaatgataaatatccagctccttcaaccccacaattgatgcaagggacaagattgttggacgatggtgattgccaagagcaggctaattgctcaacagaaaaagaaagtggggaacatgatggagaatctaaatctgtcgaaactacatgtggtaatttgaatgctgaaattactcctcaacaaaggaaatctgaaattactttggttagggaggaagtggatatagttgatgcttccatgggtgagagtgttgcttctccacatacacaaaaaagaaaagttctaagcaacactgacagaaatacaaaagcttcaaataaagtaggtgttcatagtgattcatgtgagataagaggaaagcggaaaaagataaaagtagactggacacctgagcttcacaaaaagtttgtgaaggcagtggagcaactaggcattgatcaagccattccttctcgaatattggaattaatgaaagtggagagcttgacaaggcataatgtggcaagccatcttcagaagtatagaatgcataagaggcaaatcttgcccaaggaagaagaacgaaaatggtcgaatcaaagagaaaggagctatagtgttcaaagaccaattatggcatttcctccatatcattctaatcacacccatccactgcctcctgtatatcctatgtggggacaatctggcggtccaatggctggcatgcagatttggggatctcctggttatcccttgtggcagcctactgctgaaaattggcgctggaaaccatttccagggatgcatgcagatgcatggggctgtccagtgttaccaataccacctcaagctcctggttttccttactctcagaatatgcctgcattgctcaatgctgatgcagcggatcacacatttaccatgccacaaagttccttcgagcattatctggcagaggaggtagttgacaaggttgttaaagaggcaataaacaaaccatggctacccttgcccttgggtttgaaacctccttccacagaaagtgtgttggctgagctatcaaggcaaggcatttccaacatccctccaaagggttcaaaatcatgctga

SEQ ID NO: 56644 - DNA, 2049 bp, Glycine max
  Peptide Sequence Number=SeqID_173422
atgaagcccttttgcacattcttcattcttctttcgctgcttgttattctcgttgaatcttcatgcaaaaacgaagaccaggagatggtgtccaaggccttccaatctgtgtctggattcaactcttcctggttcgaaacaggttccaactgttcaaatgctgagattaaagggataaatctttcgtccaagaacctaagtgggaacatctcgtggaagtatctgaggaacatatccaagttgaaggttctagatctgtctgggaattttctacaaggccaggtcccaaactggttctggagaagctcaaccttattggtagtgaacctttccagcaacaggttcggagggagcattaaccccacttcccaaaacggttcattttcatcactgcaaaatctcaatctctcacacaacaggttcaccaaccggcttcacctctctggtttctcaaaccttgaaagcctcgacctttcgcacaacaacctcggaaccttgccctccgggttccaaaacctcaccaatctacaccacctcgatctctccaactgcaacatcaaaggaaacgtaaaacccatctcctccctcaccacactctccttcttggatttatcaaataacacgttgaacggtagtttcccctctgatttccctcccctgaacaacatcaaattcttgaacgtctcccacaacaacctcaaagcctccaccaccttagataggttcaaaaagttcggcaaatcagcgtttatccacgccgggcacaacttcaactactacaacgaatccaaaacgccaaaactcgattcaaattcaaccccacagcaccaacagccccaccacattcacgcgaagaagaagcggtcaaaagaaaaacagaagtcaaaacacaaaaccagaaccatgattgtggcctcgtcctgtgcctcggcacttgtcgttgtctcgttgtgcatgtgcttggtgtggtgttgcagaaggaggaggcaattggcgaagaggagcaagtgggcgatctcgaagccggccccactcagcatcaagatgatggagaaatctggaccgttcgcgttcgagaccgagtcagggacatcatgggtcgctgacctcaaagaaccatcttccgcacccgtggtcgtgttcgagaagccactcatgaacctcaccttcgtcgaccttctcgctggcacgtcacacttcggcaaagactcccttctcgctgagggcaggtgtgggcccgtttatcgcgctgtcttacccggagacatccacgtggcaatcaaagtcctcgaaaacgccagagacgtccatgatgatgacgctgtcgctctcttcgttgacctctcccaactcaaacaccccaatctcttgcccctctccggttactgtattgcaggtaaggagaagctggtgttgtatgagtttatgtcgaacggggatttgggtaggtggttgcaggagctaccaacgggggagactaacgtggaggattggagtggtgacacgtgggacattattcaaaacggcgccgcttctcgagcctcgccccccgaaaagatggggtggttagtacggcaccgaattgcggtgggtgtggcgcgtggattagcgtttctgcaccacgcggggtcaaggcccgtcgtgcacggacacctcgtgacgtccaacgtgcttctcggcgacgacttcgagccgcgaattgcggatttcgggtttcggaagttcgggcgagaaagcgcgacggcgaattgttcaaccgagacggacgtttactgtttcggggtggtgctgatggagctgctgacggggagggccggcacggcggagacggtggtttgggtgcggaaggcggtgagggagggtcacgcggtgagggcattggacgagaggctcaaactcggcggtggaagcggcgactcggagagtgagatggtggagagcctccgagtcgcgtatttgtgcacagccgagtcgccggggaagaggcccaccatgcagcaagtgttgggccttctcaaagatattcacccgagtcatgcactcgactga

SEQ ID NO: 56645 - DNA, 1761 bp, Glycine max
  Peptide Sequence Number=SeqID_173423
atggggaaacaagggtcacataaaagtctgcgtccagagtttcagggttggcattccaaaactttgttgcttcatgggctgaaaagtgattcttcaaaatgcagttattgtagggggctcaatgtagggaaaaagcacatcagggccattgttgtcatgtttggattgttgggttgcctgttccttcttgactctcttgtcatctcttattttgagtttacaaatcttcaacccagtgcagcctcaaatagttcaagtgtgtttcagggtagagattcctacatctacagcaaacaatcgccagtatatatgtatgaacggcttctaaacttggcttccagtgctcttgcagagaaggagttcaagcaagagtcatccaatttatgggtggaaccatttcggcaggcatctttatggaaaccttgtgcagaaagaaaagttcaaaccaatcccaggaagcctgtacaaaataatggctacatcttagtcagtgcaaatggaggtcttaatcaacaacgagttgctacttgcaatgctgttgctgtggcatctctccttaatgcaaccctagttattccaaaatttctttacagcaacgtgtggaaggatccaagccagtttggtgacatataccaggaggagtatttcatgaatatcttgaaggatgacatcaagcttgagaaggaacttccacctcatatgaaatctctggatgtagaagcgattggtagccagattacagatgcagatcttggcaaggaggccacacctgctaactatattaaagttgtgcttcctcttcttttgaaaaatggagttgttcacttcctgggatacggaaatcgacttggttttgatccaatgccttctgatattcagaggttaagatgcaaatgtaatttccatgctttgaagttcgtgccaaaaattcaacaaattggctcgttattgatccaaaggattagaaaatatggtgctcgacacagcatgttagacactcaattgctggggaagttcatccacaacaatgaatatcatgaagctaaaaggggctcagaaaaatatcttgctttgcacttgaggtttgaaatagatatggtggcctattccttatgtgaatttggaggtggagaagaggagagaaaggaactacaagcttatagagaacgccattttcctctgtttcttgagcgcttgaagaagaattcaacctatatttctccaaagcatttgagaaaattaggaagatgtccgttgacaccagaagaagcagcacttgttctagcaggtcttggttttaaacgggaaacttacatttacttggctggttctcatatttatgggggaaactcaagaatggaaccctttaccagcctctatcccaatgtgatcacaaaggaaaccctgcttacatacaatgaactggaacctttcaggaatttttcttctcagttggctgctttggatttcattacatgtgcaagtgctgatgtatttgctatgactgactctggtagccaactttcatcattggtatctggattcagaacctactatggtggccatcacgctcctacattgcggccaaacaagacaaggctagccgcaattttgagggagaatgacaccataagatggaacaggtttgaagtcagagtaaagaagatgattcttgaagctcagaaggctggcattaggagttatggccgaagcatttatagaaatcccaggtgccctgagtgtatgagcaaacaccattag

SEQ ID NO: 56646 - DNA, 198 bp, Glycine max
  Peptide Sequence Number=SeqID_173424
atggggagtactgagtatgaaagaaagaaagccaagagagaaaaaagggacagagggtgggctgtagttgttggtgaagtgggacagttcgcggttatagtggtagtgaagtgggaggaacggcgtcatgtgttttttgacggaggtgttaacggcacatttgaaggtgaccgaaagggatgggtcccagttctttaa

SEQ ID NO: 56647 - DNA, 668 bp, Glycine max
  Peptide Sequence Number=SeqID_173425
gaaactagtagtttccatctaccggtagaagaagtcactataaccctcgatgatgtggcatccttgttacattttcccattacaggcgccttccatacctttgatgctcttgatgtagaccaagtcgtggacttgttagttgatttgcttaaaaattttcctacaattgcttccattgttgctgatgaggataatcatgagagaaaatcatgtgcttgtcgatggaagtctgggaaggcattaccaatatcgacgtatcgtaagcgcttggataaattgacgtcagatgttgtctgctggattccttatgtgcgacagtttggttatgtgcagaccattcctccaaaccctgttgctccatcgttatctatagaggagattgaagatatatggcttcagttttcagaataccttgcaccggctgtcgatgcagtagctatgccagaaccacctacacctgcacctgctaatgtagatatgcctcgacatgcagtggacgcttgccaacgaataacagatagtttggaacacatgatcaacatgaggatgattatgactagaaatgaagcatacactcaaaccaagccctacctgagattggctaggggtgtcactgagcaacatcatgtttatgttcagtcgagacgaaggagggatacacaggacaa

SEQ ID NO: 56648 - DNA, 387 bp, Glycine max
  Peptide Sequence Number=SeqID_173426
atgctccccactgggaaggtcaccgccttcaacctctgccacttcttctctaaaactgacccccacgccttctacgatgcgatggattttctatcggtgcactatgacagcaagctggacttggatgcgttgactctaaggggaggacgagtgacggtgatggcaaggcaaagctatagcctcatccttttcaactcagtgttctatgttgtgttgtgtttcactgtgctctctttgttcacactcggtgcttcgctgttgttcttcatttccttgcgctcggttaggttcggtgaaggtgaaggtaccggtgttcagcattgtggtggtcgtcgatggcatacgaggtacgcatttgcgttgggtgtgcgttctggtgtaccgcag

SEQ ID NO: 56649 - DNA, 735 bp, Glycine max
  Peptide Sequence Number=SeqID_173427
atggcttgtaggggatgctgggaatgccttttgaagcttttgaacttcatattgactcttgctggtctggccatggtgggctacgggatttatctgtttgttgaatacaataaagcttgggataatactctcaatttcagtgaggataaaacggaagttcaatttggcagacccatgctagtggttgtgtctctgtccaacagttttttagatgagttgcccaaggcttggtatgaatgctgctcttctcctgccattttttggggcctgggatgtgcagcctttacattttttgacaaaagctggaaagaagaaattcctaaggacaaaactggagattttgatatgatatatgaatttctgagagagaactggaatgttgtgagatgggttgctcttggaattgtcatctttgaggctcttctttttgtattagcccttattgtcagggctgcaaacaggccaccagagtatgatagtgatgaagagtacattaatccaaggcagcaagttcgtcagcctttgctaaacagaccagcaggccctgcatcaggtgcgccagcaactggcacacttgataagcgtccaagcagaaatgatgcatggagtgcacggatgagggagaagtacgggctggatacttcagaatttacttacaacccatcagaatcacataggtaccagcaagtaaaccctcagccaactgaagaaagaagccgctgtgccatcatgtga

SEQ ID NO: 56650 - DNA, 1533 bp, Glycine max
  Peptide Sequence Number=SeqID_173428
atggccgacgtcgtttcgaagaccccaaccagcagcctcatcagcccccacaagaaggaaacatcgaaccttttactcggtcgtttcgagattgggaagctcctcgggcatggaaccttcgcgaaggtgtactacgcccggaacgtcaaaaccggcgaaggcgttgccatcaaggtaatcgacaaggagaaaatcctcaaaggtggtttggtggcgcacatcaagcgcgagatctctatcctgcgccgcgtgcgccaccccaacatcgttcagctcttcgaagtcatggccaccaagagcaagatctatttcgtcatggaatacgttcgcggcggcgagcttttcaacaaggtcgcgaaagggaggctcaaagaagaggttgcgagaaagtactttcagcaattaatctccgcggtggggttctgccacgccagaggggtgtaccacagagatctcaagcctgaaaatttgttgcttgatgagaatggcaatctcaaagtctctgattttgggttgagtgcggtgtctgatcaaatccgacaggatggtctgttccacactttttgtgggacacctgcgtatgttgctcctgaggttttggcgagaaaagggtacgatggtgctaaggtggatctctggtcttgtggggtggtgttgtttgtgttgatggcagggtatttaccctttcatgaccagaatgtgatggctatgtataagaagatttatagaggggagtttcgttgtccgaggtggttttctcctgatttgtcaaggcttctcaccaggcttcttgataccaagcctgaaacccggattgcgattcctgagatcatggagaataagtggttcaagaaagggttcaagcagatcaagttttatgtggaggatgataggctttgcaatgtggtggatgatgatgggcttatggacaatgatgatgatactatttctattgcttctgttgctaccttttcagattactcggtttcggagtctgattctgaggttgagactaggaggaggaatgatgccactttgcctagacctcctagtttgaatgcctttgacattatatcgttctctccgggctttgatctttcggggttgtttgaggagaaaggggatgagacaaggtttgtgactgctgcaccggttaacaggatcatttccaagctggaggagattgctcagttggttagtttttcggtgaggaagaaggactgtagggtgagtttggagggtaccagagagggggttagggggcctttgactattgctgctgagatatttgagttgacaccttctttggttgtagtggaggtgaagaaaaagggaggagatagagctgagtatgagaggttttgtaaaaatgagttgaagcctggactgcagaatttgatggtggaggagtctgctacttcttcagacttgtctacacctactcaaccttccctactacgtggcctttctgaacctgtgccggatatttcttctgatattgaaaccccgctctatatacctactgatgattga

SEQ ID NO: 56651 - DNA, 679 bp, Glycine max
  Peptide Sequence Number=SeqID_173429
cgtagcagggaggcaggtgtggatcatgcgcactagcatgaccactctgactcaaatctggatgatactcctgctcagtaacatccctcccagtgagcataactttgatcttctgctacccaaatgccagctggtctatagcatcatgacccagattagtgttcttgtggcacaacttatcttggatgccatccacctgtttgtaggtattgcacctctgagacacccagtggacccaaacaagtcaaacaaggcattgggatctccagcattgattacaggcctctgccaattctatggggtaccggtcgcgccgacaaagctcattcagcctcctattaacagatccgtcattgagaaatattgcatgccaaggcagggacaacagctggggcaagaccagcagcagcagctggtagccaaccatagaggccagatgaagttgaatgacagcttctatcagtatacattgcaccatcatcgccaggaccctaacccatatctatggcctactctcaaggaattcaaagccactatcgcatggcctagggataggcccaattttcaggaggaggcatgtcctacaggtgctcaaggagctgcccaagggggcaaaggcggagctgaggtggatggagacatggcagatttgcttgatttcttcattggaggagactga

SEQ ID NO: 56652 - DNA, 720 bp, Glycine max
  Peptide Sequence Number=SeqID_173430
atggtgaaagcttatgtagctcctgaggtgataaagaagaaaggatatgatggagccaaggcagatatttggtcttgtgatttgaaaaggcttctttataggatccttgatcccaatccaaagacaagaattgatatttctaagattgtgcaaagccgttggtttagaaaggggtatgcccagattgaagaatttcagctgccaccattgccccctagaaatggtaaggatatctcagaagttcaagctgcatttgcttcttcatctgattcagattcagatggtagtccaatgtcaaataaagaagaaagccccatgaagctatatcggttcaatgcttttgatttgatatcaatctcttcaggttttgatctttctggtctgtttgaggatgatcagaatgaaaggcaattggcaagatttacaactagaaaaccaccttcaaccattgtttcaatgcttgaagaaatagcacaaatagatagtagatttaagatcttgaagaaaaatggagttgttagattggagggatgcaagacagggataaatggccaactcactatagatgcagaaatttttgaagttacatcttcctttcatgttgttgaggtgaagaaaattgctggaaacacattggaatattggaaattcttggaccagtacttgaaacctctgaatgaaatggtttgggtctggcaaagatatgagcagcagcaatag

SEQ ID NO: 56653 - DNA, 1941 bp, Glycine max
  Peptide Sequence Number=SeqID_173431
atggaaaattcaggactggctttgttagcttttcgagccagaataacttatgatccattcaatgctttggtgaattggaatcccaatgattgtgatccttgcaagtggttgggtgtgcattgtgtagatggtaaagtgcaaatgatgaagttaaaagggttatctttggaagggacattggctcctgagcttggaaaacttagtcacctaaattctcttgtgttatgcaagaataacttttttggtgccattcccaaagaacttggagatttacccaagctagagttattggatttaagggagaataatttgttaggaaacatcccaacagaaatgggcaagatgtcattactaaaacactttgtgtggcagagcaactttaaacgttggaacaaaccaaattcattggttattctaactaaagcaacacttatgaaatgtcttaatgcccttgcattgccactgtatgtagataaattttggccccatcttaacctaaatagattcaagctaagaaagtctatctttcatggccatgaaaatgattattgtgaccttctacctagttctaatgtgccagagattgctcagaatgtaccagaacttgttaattctgcacgtcgtatgttacttcagtctagtggtaataaccttgcagctgcatcttttagtggtgaaccaactatagagattagctttgttccaactacctttagtagtggagctttcccagctattccagatgtcaataagaaacaaaatcaaacacctacaccctcgcattcaccttttgattctccacacattgtttccgatgaaaatcaaacaagtcaacaagatgaaactaatggcgcttctagaaatttatggaagtatataattgttgttgttgttgttgtgttggtcattgttatcataattcttttatacgtttcgaggaaacgagcagcaaaagtaataggtccttggaagacaggattaagtggacagttgcaaaaggcatttataacaggggtccctaagttgaatcgagcagaattagagacagcttgtgaagatttcagcaacattgttattcattgttacgaagggtgcaccatctataaaggaacactatctaatgaagttgagatagctgtagtttctactttgattacttcttcccaggattggtcaaaggacatggagatgaaataccgcaaaaagattgatactttgtctcgcataaatcataagaactttatgaatcttattgggtattgtgaggaagaagaaccattcactaggatgttggtgtttgagtattgtccaaatggaaacgtttttgagcatttacatgttgaggaagtggaacgtcttgattggagtagaagggtcaggattatcatgggcattgcatattgtcttcaatacatgcaccatgatctaaatccaccagtgattcatagcaaccttgcttcaaatatgatatttttaacagatgattttgctgctaagactgcagaagttacttttagaaatattgtatcaccaactaagacgacatgtgattcaaagaaatctcaagtgtcatcatggaataatcttgaaactaatgtctttgactttggcaagttattgcttgaaatcatctcagggaaattgccttactctgaagaacaaggcaaccttgtgaattgggttgataagtacttgaatgacaagagcagcataagcaacttgatcgatcccgcccttcagtctttcaaggaaaatgaacttgatgtcatttgtgaggtgatccaagattgtattcaacctgatctaaagttaagaccaacaatgagggacgtgactttcaaattaagggaagtgcttggtgtgtcacctgagcaagcagtcccaagactttctccactctggtgggctgaattagagattttatcagtggagacgacttaa

SEQ ID NO: 56654 - DNA, 204 bp, Glycine max
  Peptide Sequence Number=SeqID_173432
atgttagaggaacttgtacaaagtcttttcccttcttccactaacatattttgtcctattactccctttggaccaaggcatatctgcaagtccatgcaaaggatttggcaaaggatgataggcaagaagcagaacccgcagaaggaggcagctagggagttggagcagggcgttagtctggtcaaaaggttgtcatattactaa

SEQ ID NO: 56655 - DNA, 234 bp, Glycine max
  Peptide Sequence Number=SeqID_173433
atggtactagctagtagtactcttgtagttgcaattttatccggtcatcgagaggaatacaaggggagggagctggagcagaaacaaacaaaatgtcttgagcagcggtgcaaaggtgggtgcatgattcaggggccacgccacgcctacgcaaacagaaacagtcagaaacatgacagaacagaaccaggtggtattggcagtagctatgtaagtgccgataaggaatcctag

SEQ ID NO: 56656 - DNA, 420 bp, Glycine max
  Peptide Sequence Number=SeqID_173434
atgctgcagttcagtcagattagacagttcactcctattccatcactcagccccaggctgagcaggagcacccactcagctcaggaccaaacctccttggcaactctcatccttcttatatcccaagggggttgcctggttccagtgttagtggatggagcccacaccaggactggcaccaccagatccaagcactgcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagagcggtttgcgtattggcgctagcggagtgtatactggcttactatgttggcactga

SEQ ID NO: 56657 - DNA, 249 bp, Glycine max
  Peptide Sequence Number=SeqID_173435
gtagctggtggcagcagctcggctgaaagggtcttagttggagctaagaaagctaacaaagtagatactataccagctgaaagggtctcagctgcagttaagaaagctaacaaagtggattctccaccttcagtggaatccttaagcttcaagaaagcttgtggtggtagaacaagaacggttggacatgaaagtgcagtcaagagaaatgcaacaccaaggaatgataggaaaaggatagcaaagtga

SEQ ID NO: 56658 - DNA, 1331 bp, Glycine max
  Peptide Sequence Number=SeqID_173436
cagcggtgaagagaaggaaagagattcccttcgacaacgtcatccagagggacaagaagctcaaatttgtggtcaaggtaaggaacattctagtgactcaaccagatagggttatgtcacttaagacccttggtaagttcaaaagagatttgggtcttgataaaaagaggagacttattgccgtgttgaagaaattcccagcagtgtttcagattatggaagaaggggtttactccctcaaattcaaaatgacccctgaagccgaaaggctctattttgaggaaatgagggttaggaatgagatggaagagttggtggttgtgaagcttaggaagttgttgatgatgtcactcgaaaaacggattttgttggagaaaattgcacatctcaagaccgatttcggtctcccaccagagtttcgagacaccgtttgtcataggtatcctcagtacttcaaagtggttgcaactcagcgtggtcctgctttggagttaactcattgggaccctgagcttgcagtttcggcggctgagctagcggcagaggagaatcgcattagggaagtggaggagcagaatttgatcatagacaggcctcccaagttcaatagggtgaagcttcccaagggtcttaatctttccaagggggagatgaggaagattatgcagttcagagacttgccttatatttcgccttactcggatttctcaggacttaggcctgggtctagggagaaggagaagcatgcttgtggagttgttcatgagattctgagcctcacacttgagaagcgaacgctggttgatcaccttacgcattttcgagaggagttcagattctctcagcagctgagggggatgctgataaggcatcctgatatgttttatgtctctcttaaaggagatagggattctgtgtttctgagggaaggctaccaagattctcagttggtggagaaggaccggttgttgcttataaaggaaaagcttcgtactctggttaatgttccacggtttcccaagggacctgctcgcaggatagttgaagatagcatgagaggaagtgatagcagagaagatgaaagtggtgaagaggaagaagaatggttagaagatgttgataatttaatgaatgatgatgggtttgatgacattgatgatggtgatgactggagtgatgaagaagatgatgatttgccgccagattttgatgaggatgctgaacttttggagatggggcaaggaaagactattaaacaagactcgagacagaatgatgaaatggtccttcttcctgtactccctgatggtcgtccaagagaacaatggtga

SEQ ID NO: 56659 - DNA, 246 bp, Glycine max
  Peptide Sequence Number=SeqID_173437
atggaggctgacggaacaatggtgaacgaggtggtgatggtggcaaaggcaataatggtggtgatgacaatctatgatgtttgtggagcaatggtgacaaagatggtcatgcatgggatgctgatttcaatggctatggaagaagaggtggtggccaaggtggtcgtggcaaatgtgatggccaagacaatgatcccggtggcgacaataaggcaagccacaacggtgggttacgaattggaataa

SEQ ID NO: 56660 - DNA, 549 bp, Glycine max
  Peptide Sequence Number=SeqID_173438
atgagacaccgtggcgcgccagaggaaccaccgcaaccccaaccttcatttcctcaccggaaaaagaagcgcaagcgcagagccaccgccaccgccaccgtcggttccacttccgtttccttcgaaaccagccacaccgatgcccctgaccagctcaacactcacattcatgacgctgctgttgcgtgcgagcagagtaaagccaccgccgccggcgacggttttcgtttcggtgagctaaggcagagaagcgtgaacggtcgcgatagttttgtagatttggcagttacggcagttggtgacggttacgtgacggagacggtggaatcgttggagctaaagcgtgttttgggaaatgattcgattccaaagaggttgcctgtgtcatcctttttggagaaagtgctccatggaaattctgtctggagcactacaactgttggggatgaaaagggacgagaaagagtgtatgacactatcttccgcttgccatggagatgtgaactgttcactatgtcatctatgggtatactccagtccagtgtttag

SEQ ID NO: 56661 - DNA, 567 bp, Glycine max
  Peptide Sequence Number=SeqID_173439
atgtcttcgcatatcctgtcacgcccgatcgatgtttcaaaatacggggtgatttacggtggggcgcagaaaaacattgggccggcagggttatgcttagtgattgtacgggaagacctgcttgatcaggcttcagcattaacacctgccgtatttcattggaaaacccaggccgataatcagagcatgattaatacgccgccaacctatagcatttacattgctggtttggtatttgaatggctacttgcccagggcggtgtggatgctattgagaaagtaaatattgccaaggccaatctactctatcactacctggatcaaaccgagttttatgacaacctgatccagaaagagtatcgctcacgcatgaatattccgttccgtctgcgggatgaaagtctgaatgatgccttcctaaaagcggcagatacgcagggcttgttgcagttaaaaggtcaccgttctgtcggtggcatgcgcgccagtatctacaatgccatgccgattgaaggggtgcaggcattggttgaattcatgcaagcgtttgaacaaaaaaactcataa

SEQ ID NO: 56662 - DNA, 165 bp, Glycine max
  Peptide Sequence Number=SeqID_173440
atggtcattaacgaacaatttgccactatgttgggctcatctagacaatggggaccgaggcatccgatacctgctcagtggtgtcaacagttgagtgttgaagtcattattggcaattatggaatgccactgtcggatggacaacttcgtcctagccgtatatga

SEQ ID NO: 56663 - DNA, 141 bp, Glycine max
  Peptide Sequence Number=SeqID_173441
atgaaaaaagaacctggcttggaagatgaagttggtccatctcacatgcaaccataccgccctcttatgccaacgatgttgtttaacattgtcaatctgacacccaacttgcgccaaggcaccgggcctgatagtccttag

SEQ ID NO: 56664 - DNA, 3804 bp, Glycine max
  Peptide Sequence Number=SeqID_173442
atgccagtactcgaaacccttggtggtgctctttttggtgctgtccttcaggtgctgtttgacaagctggattctcatcaagttttggattactttcgtggaagaaagctcaatgagaagctgctgaaaaagttgaaggggaagctgaggtctgtcaatactgtggttgatgatgcagaacaaaagcagttcactgatgcaaatgtgaaagcatggcttgatgaggtcagagacgtgttgcttgataccgaggatctgttggaggaaatagactacgaattctccaaaactgagttggaagctgaatcccagaccagtgcaagcaaggtatgcaattttgaatcaatgatcaaagatgtccttgatgaactagattctcttttagaccaaaaggatgatctaggtttgaataatgttagtggtgttggggttggatcaggatcgggtagtaaagtgtcacagaaattgtcatccacatctttggtggttgaaagtgttatttatggcagagatgatgacaaagctacgatccttaattggctgacttctgacactgacaatcataacgagctatcaatactttcgattgtggggatgggtgggatgggtaagaccacgcttgcccaacatgtgtataacaacccaaggatagtggaggctaaatttgacatcaaagtctgggtctgtgtgtcggatgattttgatgttttgatggtaaccaaaaacattcttaacaaaatcactaactcaaaagatgacagtggagacgacctagaaatggttcatggaagattgaaagaaaagttgtcggggaaaaaatatcttctcgttctggatgatgtttggaacgaacatcgagatcaatggaaggctttacaaactcctcttaaatatggggctaagggaagtaaaattcttgtcacgactcgcagtaacaaggttgcttcaatcatgcattcaaacgaagtacgtggactaaagcaattacgagaagatcacagctggcaagttttctctcagcatgcattccaagatgattatcctgagttgaatgctgagctgaaggatattgggataaagatagttgagaagtgccatgggttgcctctagccttagaaacagttggatgtcttttacacaaaaagccatctttttcacaatgggaacgtgtactgaaaagcaagctatgggagttaccgatagaagacagtaaaatcatccctgctttattgttgagctattaccatcttccttctcatctcaagagatgtttcgcacagtgtgccttattccccaaagatcacaagtttcacaaggagagcttaattcagttctgggtgactcaaaattttgtacagtgctctcaacagagtaatcctcaagaagaaattggtgaacaatacttcaatgatctattatcaaggtccttctttcaacgatcaagtagagaaaagtattttgtcatgcatgaccttctcaatgatttggcaaaatatgtttgtggggacatctgtttcaggttagaagttgataaaccaaaaagtatatcaaaagtccgtcatttttcatttgtatctcaatacgatcaatatttggatgggtacgagagtttatatcatgctaaaaggctacggacatttatgcccacatttccaggacaacatatgcgtcgttggggtggtaggaaactagtagataagttgttctccaagtttaagttcttacgcatcctatctttgtctttttgtgaccttcaagagatgcctgactctgtaggcaatcttaagcatcttcgttcgttagacctttccgatactggcataaaaaaactacctgattcaacgtgttttctctgtaacttgcaagtcttgaagctgaatcattgctaccttttggaggagctaccctcaaatttgcataaactcaccaatttgcgctgtcttgaatttatgtacactaaagtgagaaagatgccaatgcatattggaaaactaaagaatcttcaggtgttgagttcgttttatgttggaaagggcagcgacaactgcagtattcaacagttaggggaactcaatcttcatggaaggctaccaatttgggagctgcaaaatattgtgaatcccttggatgcattggcagcagatttgaaaaataaaacccatcttctggatctagagttagaatgggatgcggaccggaaccttgatgattcaataaaagaaagacaagtacttgagaatctgcaaccttcaagacatttgaagaaattgtcaatcaggaactacggtggtgctcaatttcctagttggttatcggataattcatcatgtaatgtggtgtccttaagcttgaaggactgtaaatattgcctatgtttgcctccccttggacttttgccacgtctgaaggagctttcaattgaagggtttgatgggattgtgagtattaatgctgattttttcgggagtcgctcttcttcatttgcatccttggaaacactggagttctgccagatgaaggaatgggaagaatgggaatgtaaaggtgtgacaggtgcttttccacgtcttcaacgtctttttatagtgcgttgtcccaagctgaaaggtttgcctgcccttggacttttgccatttctgaaggagctttcaattaaagggcttgatgggattgtgagtattaatgctgattttttcgggagtagctcttgttcatttacatccttggaatctttgaagttctccgatatgaaggaatgggaagaatgggaatgtaaaggtgtgacaggtgcttttccacgtcttcaacgtctttctatggagtgttgtcccaagctgaaagggcacttgccagagcaactatgtcatttaaattatctaaagatttctgggtgccaacaacttgtaccttctgctctcagtgcccctgatattcatcaattatacctagcagactgtgaagagctgcaaattgatcatccaacaactttgaaagagcttaccattgaaggtcacaacgtggaggcagccttactcgaacagattgggcgcaattactcttgttcaaataacaatattcccatgcacagttgctatgatttccttctaagcttggacatcaatggtggctgcgactctctaacgacctttccgctagatatcttcccaatactcaggaagatttttatcaggaagtgtcctaatctaaagaggatttcacaggggcaggctcataatcatctccagagtcttggtatgagagagtgcccccaattagaatcattgcctgaaggaatgcatgtcctccttccatctcttgatcggctgcacatagaggattgtccaaaagttgaaatgtttcccgaaggaggtttgccatcaaatttaaaaggaatgggtctctttggtggtagttacaaacttatctacttattgaaaagtgcattgggaggcaatcactctctagaaagattatctattggaggagtggatgttgagtgtcttcctgaggaaggtgtactgccacactctcttgttaatctatggataagggagtgtccagatctaaaaagactggactacaaaggtctctgccacctctcctctctcaagacattgcatcttgttaactgccccaggctccaatgcttaccagaggagggtctgcccaaatccatttcaactttgtggacttacaattgtccgttgctcaaacaacgttgccgggaacccgaaggcgaagactggccaaagattgctcacattaaacgcgtgtcgttacacggtaatgatgttgatatttaa

SEQ ID NO: 56665 - DNA, 654 bp, Glycine max
  Peptide Sequence Number=SeqID_173443
atgacacctatgaccaggagtaggactaaactggtagcagtcatatttaacaaggcccaagtggagaaggatgaagaagtggtgtcatccaaaactgatgaggatcctaagactggccaaatacagggacctatgaccaggagtaggaccaaacagttagtggataccctccaacaaatggtagcagacatacttaacaaggtccaagtggagaaggatgaaggcccagaggcagagaaggacttttggcatttgataaaattttgtgagaacttctctttgggttcctcgctgaaccaatctcggacttatcaaggtaatcctgtggcgtttaccctgaattatcttccttcactggaagtggcatcatccaaaaactctgtaacttgtatcaagcgatccgctcctagtaaggatcacatcaaaaactctgtaacctatatcaagcaatctgctcctagaaaggatcacatcatctggtccgtcttttgttatgttatttgcattcttgttcgcattcttgtttacatcttgttgcgttctgttacaaattctgtttggggacaatttggcttactgggagaatttaggggtttagggtttaggaggctcttgaatctattttcctatttgcctattggacgaattgcctga

SEQ ID NO: 56666 - DNA, 587 bp, Glycine max
  Peptide Sequence Number=SeqID_173444
ttgagtatgtgaaaagattgtatgaccaagtgaaggtgcaaattgcaaagaagaatgaaagttatactaagcaagccaacaagaaaaggaaggaagtggtacttgaacctagtgatgatcctggacatttgagggcaaatgttttccaagaaggagggaatgatgagaatcctgaaatttgtcaaatacaggctaaaggcccaagtggagaagggcaaaggcccaagtggagaaggataaagcccccaagtaatccttgtgacgtctacccggacttatcttccttcaccggaagtggcgtctaccctgacttatcttccttcactggaagtggcgccgcggaatccagcacacattcggagtgtttcacggcaagcgacgccggacgtggtggcggtaaggatttgatgagccctagtcaatggaccattgtggaaaggaggagtgtgtggaggcaaagccttgtcgcaagtaatgcatttggaagcgccacggcattggatttgctcttggaggcgttgacggagaggtggccttggtccctcttgcgacggcttgggaacactagagggggagtcgaagagtga

SEQ ID NO: 56667 - DNA, 465 bp, Glycine max
  Peptide Sequence Number=SeqID_173445
atggagatacataattatattatgaagaggtttcacacaaatccaaatgtacatattgaattgaaagatttgttagagattaatgttggggacttaggttctaggcaagaggaattggagtttttgggttattggggtttaattaatttccacccgttactttctatgggctctattgtggctagcattgatgatgacagggtaccagaaaataattccttccttgaaaaattgtatcgctttgaaagtcatcaattctcaccaattgctcagaagattggcctaatgactccaattatgacctctggtttgtttctagatactacagttgctgaagagttagtgaaacatgatgaagggccaaaagttgagtaccattgcaactcttgttctgttgaccgttcttgcaaacgctaccattgccagaagcaggttcttgcctataatttggatgtatttgcataa

SEQ ID NO: 56668 - DNA, 3381 bp, Glycine max
  Peptide Sequence Number=SeqID_173446
atgttgaagaacaacgaccaaatcccagcaaagctaccaatctttgatggaaccaactatgagaggtggacgacgcaaatgaaggtggtattcaaatatcaaggcgtgcttgatatcataagcaccagcgtcacaccattagagacgaaccccacagaggcacacagggcaacccaccgtgaacagatgaagaaagatgataaagcaatcttcctaattcatcaatgcgtggattcaaatatcctggagaaaatcattgactatgaaacagccaaagaagcatgggatgtgttggctacaacttacgccagtgacaagcaaaccaagaaggtgagattgatggcactccgacgtcaactgggtttgcttcaaatgaaatcaaatgaaacgatggcgcaattcgtaaactggttagtgattctagcaaaccaaatgaagagttgtggtgaggtgatgaccgattcgatgaaggtggaaaaggtactcactggcttaacaccaaactttgatcatgttgtctctgcaattgaacaatcaaaggacctagaaatgttgaaattggagcaattactgggttctttggaagcacacgaattaaagatgaagaatagagaaggtatcaagaaagaagagaaggattccaagaaagtcctacttgccaaaaatcaaaagataggtggtggtgattcttggaagaataagaaagggaaaggcaagtggaagtataaaaaacaagaaagcagtggttctaaaagtgagaatcaaaagaaagaaggaggaaacaatagaaagggaaagaagaaatcaaaggagcacattcagtgctacaactgtcaaaagtatggccattatgcagatgactctgatgatgaagaagcagtgatgttaatgaccactgttaaaagtgaaacaggcattgaggaatggtggtatttggacactggctgttcaaaccatatgacaggacataaagattggttctgtgaaattgatgaaacagtgaaaagaagcatcaaatttggtgatggcaggtcagtaatggctaaaggaattggcaaggtggccataagaagagtagatgggagcaaggtgactatcagtgatgtcctatatgttcctaacatggaaagcaatctgctaagcttaggacaattgttagagaaagaattctcaatgcatatggatggtgaacacatggaagtagcatattctaatgggaaatgtgtcttgaaagttactgtgtctaagaacagaacattcaaggtgggggtgagcaccattgagcagaacctaaacaagttgcagaagaagaacatggttgtgggactaccttcaattgaagtaccaaggcaagtgtgtggtagatgctgtgaaggaaaacaactaaggaaggcttacaatgcaacagttccaactagggccaaagagaagcttgtagtgattcactctgatgtgtatggcccatttgaaatcaaatatcatggagttgaaaagcagtctgattgttcaattaagatgcttagaactaatggtggaggaaagtacacttcacttgaatttgataatttttgcaaggaagaaggaataattcatgaggtaatggctccatacactcctcaacacaatggaactgctgggagaaggaatagaacaatgctaaatatggttagatgcatgctgagagagaagcatattccacatgacagtttgacaactgctcacatcttgaataaatgtcctacaaagaggcttgacagtttgacaccagaagaagcttggagtggactcaagcctagtgtgaaacacttcaaggtattcgactcactctattataggcttgtgcctaaacagaatagaagaaaactggactcaagggctcaaaccatgatcttggtagatgtgattggggttgtaccgttgagaaggtcattaagacagatatctccaccagtgaggtttcaagacgactatgatgtcttccctgatgctgctatcaatgttaatggtgagctgatgaacttagtgttgttagtagaagcagaaccaatttcacttgaagaggcactagctagtccacattggagaaaggccacggaagaggaattgagatcaattcagaaaaacaaaacttgggcattggtgaatttaccaagtaataagaaagccatagaagtgaagtgggttttcaaaactaaagtcaagccatttggtgaaattgccaagtataaggcaaggctagttgcaaaaggtttcttgcaaaagcctggtcctgatttcaatgaagtatatgcccctatagctagaattgaaactatgagactcatagttgcaattgctagcatgaggaaatggacagtgagtcagctagatgtgaagtctgcttttctcaatggtccattagaagaagaagtatacacaaggcaaccacctggctatgagaagataggcatggaagatagggtaatgaagcagaacaaagccatatatggcttaaagcaagctccacgagcctggaataagaggactgatggatttctgcagaagcataagtttctgaaatgcaccactgaacatggagtgtacttgaaggactatggagtaactagtgtagtgatgctatgcttgtatgtggatgatcttcttgtcactggtgatagcaaacaggagattgacaggttcaatatgcttgattgcaattctgctaccactccttgtgaaccaggaataaaactgtttactggtgaagacacaaacttggttgattcaacactatataggcaactcattggctcattgagatatttgtgtaactctaggccagatatcacctatggagttggcttggttagtaaattcatggagaaaccttgcaaggatcatctactggcagctaagagaatccttaaatatgtaaagggcacactggaatgtggaattctgtttcctgcagcaaaagaaaattctgaaatagaaattgttggctacacagatgcagattggagtggagatgctagtgataaaaagagaacatccggttgtgaagctgagtatatcttagctacttttggtgcaagccaagccctctggctaggaatgttagtggaagagcttaacatcaagtgtagtaatgtaatgaagctcaggattgataacaaatcagccatagaccttgctaagcatccaacagctcatggacgcaataagcatatagaggtaaaatatcattttcttcgtgaccaagttaacaagaacaaactagcacttgagtattacagaactgaggagcagtgtgcagatatgctaaccaaagctttgaagcctaagagacttgaagaaatgaagaaaaaaattggaatgcacaaattgacagatttgaattaa

SEQ ID NO: 56669 - DNA, 1332 bp, Glycine max
  Peptide Sequence Number=SeqID_173447
atggtgttatttgcacgttacaacatcgtttttggaacaccgttgttgaactacattattcaaagacacggtggtaatatttccccggcctccacctttcgcgccttctccgacgccaaggaggacgaagaagacgatgaagaagaagaccaagaccaagacaaggtttctaccgacgaatacgatgacatttcgggtgaggcttccgacgaggctgacgtgttcgctcggcatggtggattcaagtggcagagagtcgacaagctatgcaacgaagtcagggagtttggcgccgatctcatcgacgtcgatgagctcgcctccgtctacgacttccgcatcgacaagtttcagcggcaagcgatactggcttttttgagaggcttctcggtggtggtttccgctccgacgagcagcaggaagacgctgattgctgaggccgcaacagaatgtgagtacttattgactactgcttttcatgcagtgttggacgtatgctttactatagatgtaaacggccttctatctgtttctgtgaaagaaacaaccactggttataggaatgagattaccataaccaatgaccaaaaaaagctttcagctgaggagattataagaataattcatgaagctgagaattatcaagttgatgataggaagttcatgaagaaggctaatacaatgaatgctttggatgactatgtttacaagatgaggaatgcattgaataataagaatatcagttcaaagctttgtttacaagaaagggagaaaatcaaatctgtaatttcgaaggtgacaaatttgcttgagggtgataatcagccgtatgaaatagaggtgtttgaggatcatctgaatgagcttgtgaacctctttgatcgtgtcattggcaagatttttgacaatgaaatattgaagaatgactggagttccaggaagaaggttcagataatccattatgtgatgcttaagtggggatttgctcttcttattggattaggtactggattggttggcttctttaacagttttgcagttgagaacatagctggtttcaagctgtttatgaccaccagtctcatgtctaaacacagatatcttgatgctttcttagcatatgctggtgcgaatatgtgtttagctgcagctactgctgcactttgtgctttcatcgctccagcagctgcaggctctggcattccagaggtaaaagcatatctcaatggcgtggatgctcaacatatattggctccaagcaccctttttgtaaaggtgaataatactacaatactaggagcaagtctaccctttttgcataaacacagataa

SEQ ID NO: 56670 - DNA, 480 bp, Glycine max
  Peptide Sequence Number=SeqID_173448
atgaaaagacaaaaacatgcctcctatagtagtcatgactcttgcaagagttcaaatgaagaacttagcaactattatggagggcggcataggtcacatactaaacatcactcccaaagaagagaaaaggatagaaggcctcaagaggttaacaatagcctctcctattttcatggaaaagataatgttgaggcctacctagattgggaaatgaaggttgaacaactctttgcttgccatcatattagtgaagagagaaaagttccattggtcacccttagctttcaagggtatgccctttattggtggacttcccttgttagggaaagaaggattcatggggatcctccagtagagtattgcaatgatcttaaaagtgcccttaggaaaaggcacattgcctcctactataaaagggagcttatggacaatctccaaaggcttagacaagggagtaagggaaagaacaagcgtagctag

SEQ ID NO: 56671 - DNA, 375 bp, Glycine max
  Peptide Sequence Number=SeqID_173449
atggggataggagtagaagagattcaagatttttctactcttgcagctagaccagcaaaacttgtgaaagattgtcagatgagtgccccctgtaacaccacagttctttatccaagcaagggtggcaacattcattgtttcaaagccttaaccccttgcgctctctttgacgttctttcccctccttactcatcagaagatggaagacactgctcatatttcaggaagtcaactaggaaagatcttccaggtgttgagcttgatcagctgagtggtgtaaagccatctgaaataacctggctagaagagatccaagcacctgaaaacctggtggttagaagaggtgtttacaaaggccctactataagacgatga

SEQ ID NO: 56672 - DNA, 1080 bp, Glycine max
  Peptide Sequence Number=SeqID_173450
atgggttgtcaactgaaaactcatttgtttcttcttttcattgtctggggatcatggtcatttctctgttatgatctcccaagtgagtactccatattagcccttgaaattgacaagtttccttcggaggaaggggtggttgagctgtttcaacgatggaaggaggaaaacaagaagatttacaggaacccagaagaagaaaagttaaggttcgagaatttcaagaggaacttgaaatacattgtagagaagaactcgaagcgaatttctccttacgggcagagcctcggattgaaccagtttgctgacatgagcaatgaggagttcaagagtaagtttatgtcaaaggtgaagaaaccatttagcaaaaggaatggcgtgtctagtaaggatcactcttgcgaagatgaaccttactccttggattggaggaagaagggtgttgtgactgctagccgtgaaggatcaaggctattgtggaacttgtggactgtgatagtactaatgatggatgtgatggaggctagatggattatgcttttgaatgggttatgtacaatggagaaaacaaaggttattggcattgatggctactacgatgtggggcaatctgatagttctctattgtgtgctacagtgaagcaacccatcagtgccggtatagatggcacttcatgggattttcaactatacattggcggaatctacgatggcgattgctcaagtgatccagatgatattgatcatgcaattttagttgtgggttatggctcagagggtgatgatgattactggattgtgaagaattcatggagaacctcatggggaatggaagggtgcatttatcttagaaagaatactaatttaaaatatgagcctactacaccatccccaagtagtcctccatcaccgccgccaccaatctatggttgctgtgaatctgagaatgctgtgtgttgcattgggaccgagttagagatggactttgtctccaggtatgagatatcatacgcatggagatttagtgggagaggctgcaaagtaaagaaagatgggaaggcaacagttaccatggactaa

SEQ ID NO: 56673 - DNA, 715 bp, Glycine max
  Peptide Sequence Number=SeqID_173451
atggacttgggcttcaagaaggagtttgaagcatcatcatggcttcggtggaccccgagatcgcgaagacgcgggaagagcagaagcgaatggagcagcaactggcttcgctcacctccgtcacgtttgacaccgatctctacggcggaagcgactagggctcctacctcacttccatccctgccaacaaagatgacgagaatctcgacgccatggacaacgaggtcgcacacaagctggcttcttacaccgccccctaagtcgcttctcaagtacatgccctccgcccccgactctgacaacgacatcggcttccgcaagccgcagcgcatcatcgatcgcgacgacgactatcgccgccgtcgcctcaaccagatcatctcgccggcgagaagaccccggacccttcgggagaaggaggagactctgaaggccatcgctatgaagaagaaggaggaggaggaggccgccaagggcgcgccgcctcaacagcagcagaaaaggaggaaccgctgggaccaatctcaggatgacggtgggattgacccgggctccaagcatgcaactgaacaaagtgagggactggaacatgagataaagcaagtgagagaatctctcatctctgcttatgagaagaatatagctacaaggctgaaagttgaggtttgcaggctggaagctaacaactacaatatcacaaaagatgcttgtgcaa

SEQ ID NO: 56674 - DNA, 2124 bp, Glycine max
  Peptide Sequence Number=SeqID_173452
atggctgaaaggagattgaatattaatgcccctctcatgtctgtgagacgctctgctgctacaccaccatccttgactgaagcaaagaagaagattctagagaaacgccacactcttccatactacaaatcagacacattctcggatcaggttacagaacctgttgcagtacctttcaattgggagcatatccctggaagacgcaagggtaatggtggatctgagcctcaacctcctaaggcaacttcaatcactccaagcccaagacttcccccaggaaaatctatcaatgctaccaaacaaccattggaaaaggaaagtaaggctgcaaataaatcaaagtctttcaatgttagtgtggttaaggtagactctgacaaagagagaaaagtcgaaaaaatagttgagagcagaaggtccaatgtgaagtatgatgatgatgacgacaatgatgataatgatgcttattctgatgcccttgaaaatctgtcacctacagaatcattctccatgaactgtagtgtgagtggtgtaagtggattggaaaatctgggtgcaaacaagtctggatcattctccacagatcaacaaactagagacttcatgatgagccgattcttgcctgctgcaaaggctatgactctactgcctcctcaatattcttcaaaaaagcaatctgcactagtagagcaacagcctagagatgttagcaaattggttcgcgatgataagaagcaattgcctattaagcataacactgctattataccatacactggccaaaatcaagaggaagaaagtgaagatgaagttgatgataatgagtatgacaactcttctaatatcgcagctaaaggctgtgggttgttacctcaattacatatcaggaattcattgtgcttattgaatcctgttgctgtgatgaaaatgaagaaccaggctcccttgcctccagccagtgaggttgtgaaacctaacaaaagttctcatattagatcttttagcccagttcctgctgtaaagaaggcttgggaggcaattcacaagaacaaatcaagctctagggctgcatcacctgacaaacaagagggtaaaaagaaatggactagtgaatcaaacagatttacctactctggtgagttgctgccaggtagactctcccccttccgtcgttcaagagctgctgctgctggtatatctccctgtcgaagtaaacctcaatctccctttcgtggtgctaagttgcctggggatactaaagaggctgagaattataagtttggcaaggtgaaattccacagcggtgtgcttggaaatgttcatgacgtgccatcccaaggagccaaaagaacttcatattcagggaatctcacaattgaaaagacattgtacatagatactgccagtacagccaaattatcatcttcaaatataagttctttagataacaatcggagggtagatactgttgttgcagatttagacagaagaagggggaaaattggatcttctcaagagataaaacaagtacgtgctgtggaagaaaaggtcacatttgatactgatgtgttaagtgcttttgattcaattccaccaagtctgtatagaattttgaatctcacagccaaagaagaaagagatgaaggattgacaactgatcaaaatattagccaagaacctgtgtccttgcaatctgtgcaagggacatttgctgaagatccaaagaccaacacccagcaaattgtgttagctaatgattcaggaaaaggtagtgctgtatctgctgtgtctcctcttcccccacctttgccaaaatcaccttccgaatcctggctttggcgtgccctgcctttagtttctgtgaagaattctttcctgcactcaagtcaaggtactcaatcccaagctaaaaggcatgattctaatacaacatctggtaatctcaagtgggaaacaatagtgaaaacttcaaatttgcatcaagatcatgttcgctattctcagaggaatgatcctttaggttgcctcacctggtgctacttaatcttcagagaaaagaatcctttaaatattttagtttggctttcctcagcactttcagaagctttttgtccaagtatgtaa

SEQ ID NO: 56675 - DNA, 234 bp, Glycine max
  Peptide Sequence Number=SeqID_173453
atggtggaggatgcacgaacaacactaggcaatcaattcgtggggctccggactcgatggatgcacgaacagtgcttggcaatcaattcgtggggttccggactcgatggtggaggatgcatgaatgacaatcaattcatggggctccgaacaagatttgaaggtggaggatgcacgaacaacgctaggcaatcaattcgtggggctccggactcgatggtggaggatacatga

SEQ ID NO: 56676 - DNA, 237 bp, Glycine max
  Peptide Sequence Number=SeqID_173454
atgtcatctattgtttgtagggatcacgcccgcaagacactcagtggacccgaagaagtccaacaggcctctgtcagttctacggagtgcctgtcgcccccagcaaggtcctcaggccccctactaatcgagctttcatcaagaagtactgcgcccccaggcaggcgtagggcgaaacaccatagcagcctagggatggccggcagcgagcaacaggcgcgccgccaccacctctag

SEQ ID NO: 56677 - DNA, 153 bp, Glycine max
  Peptide Sequence Number=SeqID_173455
atggagattataattcaacaggctcaaggttcacttcaatcaatcatatttaagcttaaaatgggtgcaagggattcatcattcatgaacaaggatcatcctgaggtatggagggggcatcctgtgttagacaagtggcctcagatatattaa

SEQ ID NO: 56678 - DNA, 964 bp, Glycine max
  Peptide Sequence Number=SeqID_173456
atgctcttccacgcccacttcggttcggtctacccggaccgcctcctgaaccgcgtccgatcctgcgattcaatcctaccctccgacctaccggaccagactcgattcgggttcggactcgcggtcggggtcggcggtgagattctcccggagacactggaaaaaatgctatctatctgcgaccacgtgttcgtcgacatccaggctctgattcgcaggttcgacaacatcaacggtcgcgtgagccacgtagcgctgagagacagcgggttcttccacctcttgccgcgcgtcgcgtttctgaaggcttccgcggatgaagccgtttttattgacgtggaggaggtgaggaagttgtgttgcgtggtcgtcacgcacgggaaggatggctgcgaggttttttgtccaaacggtgcgtttaaggtggcgccgttcgtggctgatcaggttgatcccaccggcgccggggactgctttctcggcgggtttgcggcggggattgtcaggggtttggccgtgcccgatgctgctctgttggggaacttctttgggtccattgctgtggcgcaattgggaccgcccaagcttgacttcaacttgattcagtctgttgacaatctaaaaacggaccagaatatctccccaattgaaaaaaatggtttggagaatggatatgatcaacaacaacaaactcttatcccattaggtgaggatgagatgcacaaaaggaagctgcagggtattcccttcttagaaagaagagatgagtctccagggtttcggaagccacctgaacaagatcaattctatgcatctcttgttactgccaaagccataattatgtgccagattcaagaatctggacggaatctactaagctctcctaaagtgttggagcaaaacaacgctaagacgatactttcactgacttctgtgcacgaggaaccaattccaagcgttgatg

SEQ ID NO: 56679 - DNA, 375 bp, Glycine max
  Peptide Sequence Number=SeqID_173457
atggttggaagtggcggcggcgtaggcgaagtcggggcccaccctggagacggtgtggaaggggagggtgagggcgtcgaggatgacggagatgaaggaggcagcgccgccgagggtctcggcgacggcctcgccgtcgcggtggaggacgtcatggcagtagttgccgacgacgaggccgcggcggggaatgatgggtttggagtctgtgaccatgaccatgtaaaaagattaagagtattttgtcatttcactttaagtgttggatgcatcagaataatgttgagtgcacctaacaacacccttatgttaaaccaaattctaatcaatagagatgacaaaatgggttatttggcccactgcgagcccatgtga

SEQ ID NO: 56680 - DNA, 1122 bp, Glycine max
  Peptide Sequence Number=SeqID_173458
atggcagattcgatttgcagaacactgagggatggagcgttagagggagagcttgtgcctactctcacaatcaaggactctctcgcttcacctttcgcctttcatgtattctctcacattctacttcaactctcatcacatgtcatagcacaaaaatctcagtcacagggtatagtaattgttgcactttctcggagtccatcgtcttacacttctttgttaaagatgaatggagtggattttgcttcttctaataacaaatggattcacattttggactgttatactgatcctcttggttggaaggacaagacaaggaaaactgtaaatgctacgaatccgtctcagcaaatttcgcttgctactagttcttataaatccgtaaaggatgtggataagttgttttcggtaattactgaacttggcagaggattggttggagaaaataaagcccgcttctgtgttgccatagactcgctaagtgaactgttgagacatgcatctttgcaatcagttgcaggccttctaagcaacctgcgtagccatgatcaaatttcaagtatttttggactattgcattcagaccttcatgaagagaaggctgtggctgttcttgagtacatgtcttccatggtggccagtgtagacccatatcatcattctgcagatggtcagaaagaatgtttagagaattccgtatctgagcaaaactttaccaagggaaaatttaatgccaggttcaaacgcagaaatgggcgagttagagtaacgtgtgaagaatttaatgttgagtctggaggaatcaacttcgtatctgtttcatcagtagacggaaccgccattgcaggcctagtgccaaaggtgcaattcaatctccagctgtcagagaaagagcgaattgataggtcaaatgttgtgcttccttttgaacaccagggaaatggcaaaccaatacaaatttatgatggtagaagatcccttgaagagagcaacagtgaggcaaatcccatttcaagtggtaaaaaggaggattctgccatgggtgagattatatattttcgtgattcagatgatgagatgccagattctgatgaggacccggatgatgatttagatatatga

SEQ ID NO: 56681 - DNA, 594 bp, Glycine max
  Peptide Sequence Number=SeqID_173459
atggccaccacatctagacacctctctcatattaaaatgcctaaacagcacttcaaagtgtgtttttgtttcaggagaatgtttaggctcaaagttgctgatgaacctcctgatgaaatcgacattctttttaaagagtattcacagcatggcatcatgagcatggatgacctgtgcgatttcttagttcaatttcaaggagaagaggaaggtgttgccatcaaaaaacatgctcaaaccatttttgacagtctcaggcatctcaacatatttcataggagaggccttcatgttgaagccttctttcgttatctcttaagtgaccttaatgttccccttgctgaggtgcaccatgacatgaattttcccttggctcattatttcttatacacaggccacaactcctacttaactggaaatcaagttagcagtgctagcagtacttccgcgataataaaggcattgaagaaaggagtaagggtaattgagctagatttatggccaaattccagaggcgatgatgtgctggttcatcatggagggtatggatttatagttttcaatagtatattaggtgaagagatagatacttaa

SEQ ID NO: 56682 - DNA, 354 bp, Glycine max
  Peptide Sequence Number=SeqID_173460
atgaatatagatgatgaattacaaactcttctactcctcagttctttccctgagagttgggacacattagttgtcactcttagcaactttgcaccacatggaaagcttagcatagatcatgtcacagatagtttactaaatgaagagtccaaacgaaaggagagaggtttgagtagtcactctgaagcaaatgttgttgaaaatagaggaaggagcgagcaccgtggccataagaagtctgagtgcagattcttgaagagagatcagaaggctggaaatgtccatgccaaccaaattgacccaaagaagaagaatgaaggtggaatcattattgctatggcatcaaacgattaa

SEQ ID NO: 56683 - DNA, 705 bp, Glycine max
  Peptide Sequence Number=SeqID_173461
atggagcagagtcatacaaagcatccaactcagacgatggaagaatcaacaatggagactgtccagacgaaagatgaatctcaagaagccatcgagatagatgataaggagaaatggatgcaagccatgaaagaagaaatacttaagaatgaagagaaaaacccaaacccgaggtacaaagctcgcattgtggtgaaaggatgtaaccagaagaaagacatagattttgaagaaatcgtctcactggtggtgaagatgacatccattagagcaatttttggtctagctgcaaaacaaggcttggaggttgagcaacttgatgtcaaaacaacattcttacatggagacttagaggaagaaatttatatggagcaaccagaaggttttgtagaaccagggaaagaatatgtagcgtgtcgcttgaagaaaagtctccctagtttaaaacaagctccaagagaatgcaaaaataaaatgaacattgatgctctcaagaaggcattgagaaaatcttttgccatgaaagatctgggtccagactacattgagaaagttcttgaaaggtgcaacatgcataatgccaaaccaatacatgttcctctttgtggacatttcaaattaagcatgatgcaatgtccaaagaatgaagaagaaaaaaaagagatgagcaaggtgccctattcgtctgttgtggcctgtgggtag

SEQ ID NO: 56684 - DNA, 3282 bp, Glycine max
  Peptide Sequence Number=SeqID_173462
atgccgacgccggtcagcatagcgaggcaatgcttaaccgacgaggccgcgcgtgcactcgacgacgcggtcgccgtcgcgcgccgccgcagccacgcacagacgacgtcgctccacgccatctccgcccttttagcgctcccctcctccgccctgcgcgacgcgtgcggccgcgcgcgctccggcgccgccagattctccgccacgtactcgccgcgcctccagttccgcgcgctggaactctccgtcggagtctccctcgaccggctcccgtcgtcgaagtccactgccggcggcagcgacgaggagccaccggtgtcgaactctctgatggcggcgattaagcggtctcaggcgaaccagcggcggcacccggagagcttccacatgttccagcagagccagcagggaacgacaacgacgtcgtttttgaaagttgaactaaagcacttcgttttgtcgatcctcgatgaccctatcgtgagtcgcgttttcgccgaagcagggtttcgaagctgcgatataaaactcgcgttgctccaaccgcctctacctccggttcagcaccggttcaaccggtcgcctccggtttttctctgtaacctcgacccggcccggcctgacgaaaatattcgcaggatcttggaagttctcgcgagaaaaaacaagagaaaccctttacttatgggtgtttacgcaaagaatgctctgaggggtttcgttgagatggttcggaacggaagaggaggttcggtgttaggttcggagttgagggttgtctgtttggagagggagattggggagtttgtgaaaaagggtggtagtggggaagagaaatttggtgtgaggttgaaggagttggaacaatgtgagagttctggttctggggttgttgttagtttcggggagattgaggtttttttaggggatgatgtggatgttgatgctgttaggttcgttttttcgggtttaacgaggttgttggagattcgtggtgagaaggtttcgttgctgggggtggcggaaacttctcatgcttattcgaagttgttgggtttgtttcctaatgtggagaacgattgggatcttcatttgcttactgttacttccgccactccttcaatggaaggactctactctaaatccagggaaaatgggaatttgtgtactgttcaggttcttgcacgtatccctgagaaatgtactaaccaagacctggtagttcttgttctgctgactgcttgtgttagccaatatggacgggcagctatgagcagtattttgatgaatgatcttctgaaggtaggtccttcatctagtaactcaacgagctcaccctggttacaaaaggttgttaatgtggagacgcatagagggtcggatgcggcaaagactaatgaagaaaacacaagtttgaatgataagatcttgggatttcaaaagaaatggaatgatatttgtcagcgtcttcatcacacaagttcactacctcaatttgatatttctcaaacaaggtcccaatctccaacacttgaggtttcacgctttggtccggattttaaggaaagcagcagtaaagacccatcacacaatgaattccaatattctagtcaaatttcctacatgcccaaagagttgcatggtatttttccatcaaagcagttatctgttccattaccttctgatacagtcagcattaatactggaactgatcatgttctaaaagtttcagagacactgcaaattcacatgaagaccccttgggctgccccttcccttatggccaataagagtgtgcttgaccacagatcatcttcatcccctactcgtgtgaccacagatttaggattgggaacgttatatacatcaactgctcaggatccagataccccaaaactgcaagatcaaagaaagcatcttcagcgcttgtcagattctgtttcaactgattgtgatggtacgaatgaaaatacttctcaccgaactgctagatcttcctgctctggttcaaatttggaaggaaaatttgatttagcagatttcaagtctcttaatcgacttctcaatgaaaaggttggctggcaggatcaggccatacgtgctatcagtcaaactttgtccctttgtaaatctggtgcaggaaagcgtagaggctcacatggtagagcagacatatggttggctttccttggaccagatagacttggaaaaaggaaaattgcttcagctcttgcagagactatatttggaaaccctgaaagcctaatctctgtggatctgggcttccaggatggcttttacccattgaactcggtttttgaataccaaaaatcacgttgttatgatgtgcttaggaggaagacaattttggattatattgctggggagttgagtaaaaaaccccattctgttgtctttcttgaaaatgtagataaagctgatgttttggtgcagaatagtttgttgcaggcattaagaacaggaaaattttcatattcgcatggaagggcgattagcatcaataacactatctttgttgtaacctcaactgtctgtaaaggtaatgactcttttgttttggaagagtctaagatgttttctgaggaaagaatgcttgaagccaaaagatgccaaatgcaattattaattggacgtgcttctgaggatgccaaaagaattggtggcacaaatgttaaggttgtacccagaaaagggttttccaaatcatcatctctgaacaaaagaaagcaggctgatattagtgactccaaggagggagcaacaagcaagatgcagaaacaagacagcgaggcatctcgatcctttctagatctaaatatgcctgtagaggagggtgaagagggtgtcaatgacaatgaccatgaaagtgaatccatgtcagaaaacacagacgcctggttgagtgatttctttgatcaaattgacgagaaagtggtttttaagccattcaatttcaatgagcttgctgagcaagtattgaaaagaattggcatgctatttcaaaggacattcggctcagagcttcagctggaaattgatcatgaggtaatagcatacatactcgcagctgcttggttatcagacaagaaaaatgcagtggaggattggattgaacatgttcttggcaaaggcttcgttgaagctcagcagaagtaccatcctgcagctcaatatgtagtgaaactggttaattgtgaatccatttttgtggaagagcaagcccctgatgtatgccttccagctagaattaacatggactaa

SEQ ID NO: 56685 - DNA, 342 bp, Glycine max
  Peptide Sequence Number=SeqID_173463
atggttcaactgatttctgacaccatctattgtttgcagggatcgcacccacaaagacacccagtggacctgaagaagtccaacagggccctggggttttcagctctgggtcttggagttgccagctctaaatacgggtctctatccgttcaagggagtgcctgttgcccccagcagggtcatcagaccccctaccaatcgagctttcatcaagaagtgctgcgcccccaggcaggcgcagggcgaaacaccatagcagcattgggatggccggtcagtgaccgacaagtcataaggcgtccagctcaagacgttaaagaagggctactaggaggcaaccta

SEQ ID NO: 56686 - DNA, 222 bp, Glycine max
  Peptide Sequence Number=SeqID_173464
atgtttattgatggtctacgacctcattcaaagcaactccttgatatctccgacaatggaaaaatcaagttgaagactcttaatgaagccatggagcttatagagaacatggaagctagtgatcatgtcatcctccatgataggacgcatattccttccaagaagagtcttctagaactcacctctcaagacgaacaagcttcttgcaaaacaccgaattga

SEQ ID NO: 56687 - DNA, 150 bp, Glycine max
  Peptide Sequence Number=SeqID_173465
atggggaagagaggaatgcaaactcagcttatcctggaaactcacaattcaagagacaaacagtctcttgatctcaataagtctttaaagaaagtgcaaatgtttttctctctttcaaagaagaagatacaagatgaagctagttcttag

SEQ ID NO: 56688 - DNA, 603 bp, Glycine max
  Peptide Sequence Number=SeqID_173466
atggtcacccaggtaggctatgcggtgggcttattctttctgatacccctaggcgattatattgaacgtcagcggcttatcctgcgtcaagcgcaggtgcttttcctggcaatgatcggcatgatgttatccccaacggcgacagtgttggtgttctactccttccttaccgggatggctgcaacagtagctcaacagatagtgccgcttgccgcctcgctctcaagaacttctgcacgaggtaaaaccgttggtacggtgatgagcggtgtcctggcaggtatccttgctggccgggctatcggaggccttattggtcagtatgtcggctggcgtggcgtctttttatccggagcgatcatgacattgctggctatatttttcatcttacgcattttgcctactcagtcgttgtcaacgccaaagtttaactatctggcggtattacgttcattaggactgctgtggaaaaacgagccgcaggtgcgtggtgcaactcttacacaagtaatgctgtttgcctccttcagcgtgctgtggaccgtgctccctttctggttagctcatcgctacgattacggtgcagggataacggcaccctag

SEQ ID NO: 56689 - DNA, 1422 bp, Glycine max
  Peptide Sequence Number=SeqID_173467
atgcgccagttcgcatgcgataaactcaggcaacagggtgaatatactgttcttgaggcccgttttgccgactattataaagttatggtaaaagaggcccaagatgattggtttatgctgccaacaggacaatggcgtgaacgttatagccatatacttaatgatttgcggagtgtattacagcaaacgttgattgagggagctgctccctctaaagggcttgagatcttacaagctatgacccctttttggattgaatattcactatacgatgaatgtcagcgccatatttatcctctgctttatgaaaatacttcgcaggtagtattaacgctacgccagagaatgaatctcagcgctgtagcaggtaaggcgtcaacctgggcaaaaggccccacgcctgaaacacattcagcctggaaaaccgcgctgacaattgcagaaaagctcgacgacaaagaaatacgtttacaggcacactacggattatggttgtattatctgcgtactggcgagttggataaagcgcttgagcatgcgcaatctatgtgcgagctagcacggtccattaccgacgaggaggcgatggcaaccgggctgcgtattctcggtgtatccctgcattttttgggccgtcatgatgtagggcgtgattatctccagcaatctcttgattggtatgaacatggtgaattaagccactctttccgttttggtcttgatcaagagagcgccggtcaggcctttctgtctcggttactctggttacagggtgagtataaggccgcgaaacagatggcatggcgcggtgttaaaaaagccgctcgtttgcagcatgtctgttctctttgctgtgcactggctgaaggcgcttgtatgacagcagcactggatcgtaatccgcgttgggttataaaggccgcaaactggctgattcatctggcaaaaaggcatgatttatatttctggaagacatacggcgagctgtttcttgtttgggccaaacagttcagtcataccgatgttagtcaaaccacactgtttagctcgttgcgggcgatgggattagactggcaatattcccccttgttgtcagaaattgataccggggtatcactgagagccacccgccaggatcatgaaaactggtgcacgcctgagctgatgcgtctttctgccactcaattacctcctcagaaacaacgcctgctgttggagaaggccctggacaaagcgcgccagcaacaggctcatggctgggccctccgtattgcttattcattggcgacattgcaggctgaagctggggaaaaatgggctgctaagcaattgatacaggacgctttacatgatgttgaagactcagacaatgcgacggatgtaagaagtgctattgcgctatgtgcccgaataggggcctga

SEQ ID NO: 56690 - DNA, 261 bp, Glycine max
  Peptide Sequence Number=SeqID_173468
atgggccagccacaaggaccgcaagtgaaggggattcccttatgtcacatcaacaaaagctttgtcagcacaagttggatgtgtgaagggcgggtcgccatgatccacgatgaagtcccccaagagcagccaaattgggtgcggtcgtgccctcccaaattcgaattagggaactggcaagttgtcgagcaacccagaatttccatggcgaacataatggtgttccccggtcaagcaaaagctgcgaaggatgaagcctga

SEQ ID NO: 56691 - DNA, 310 bp, Glycine max
  Peptide Sequence Number=SeqID_173469
ggatcgcgcccacaaggcaccagtggacccgaagaagtccaatagggccctggggtttctagctctggttataggcctctgtcagtcctacagggtgcccgccccccagcaagggatcgcacccgcaagacacccagtggacccagagaagtccaacaggttcctagggtttccagctctaattacgagcctttgtcagttctacagagtacccgtcgcccccaacaaggtcataaggctccttattaatcaggttttcatcaagaagtattgcgcccctaggcatgtgcagggcgaggcaccatggtag

SEQ ID NO: 56692 - DNA, 897 bp, Glycine max
  Peptide Sequence Number=SeqID_173470
atggccccgagaaagcttccatcaaagaggtataggaaggacactgccgaagaaggctccagtgctgccccacaggctgacactgactttgataggcatcgatttcggagcacagagcatcatcaatgctttgaggccatcaagggatggtcatttgtcagagagaggcgggtacagttgagggacgatgagttccctgactttcaagaggagatagcccgcaggcactgggcactgcttgtgacacccatggctaaattcgacccgaagatagtcatggagttttatgccaatgcttggcctaccgaggagggagtccgagatatgcgctcttgggtgaggggccagtggatccctttctatgcggacaccctcagtcagttcttaggctacccactgatcttggcagagggtcagcaatgcaaggaaatgggtgtggatcatgcgcaccagcatgaccacccttacctagatatggatgactttgctgctcagcaacattctgcccaggatggtgcctacgagacaccctatagacctggagaggtccaacagggccctggggtttctcgtgttgattacgggcctctgttagtctacgaagtgcctgtcacccccaacaaggtcattcggccgcccattttcagtgccttcatcgagaagtactgcacccccaggcagacgcagggcgaggcaccacagcagcctggagacgaccagccgcatgcagccgatgcaccatcgtcacccccggagtccacctcggcccacttatggaggttggagcgctgcatacgacacatggatgaccaagcagttcgaggctgcagtagcacggcctggggattgggacccgtggggacctctgaaggtggggacgaagcccaggatgattag

SEQ ID NO: 56693 - DNA, 511 bp, Glycine max
  Peptide Sequence Number=SeqID_173471
aaggaaggaagaatcaggattctatcttcatgcgaaggatgtcccatgagaggagtaccatcagacgaaagcatcacgcctttcatcgcacgtggtttcagtgaccacaatgctagggtactccaaggagttcgcaaggcatgggatgcggcggcagcaatagtgagctcaagctccgaagaggtgaaaggaatcatcacgggtcaaaggcatgatcttgaaggacgagctaaagggaatatgtgggccatcatcgataagtgcaaagagaagctaaatctagtggcgactcacgagcaaaggctagaggatgagtacgccaagatatcagcagaaagggaagcaagggaaagggtaattgattcattgcaccaagaggcaacaatgtggacggaccgatttgctcttactttgaacaagagtcaagaacttcccccattgctagccaaggccaaagcagtggcggacacctactccgcccccgaggagatccatggacttctcagctatt

SEQ ID NO: 56694 - DNA, 1129 bp, Glycine max
  Peptide Sequence Number=SeqID_173472
aggaccacacgtcctcgccttcagagggctgcacgcactcttctttagagggctacacgtcgtcgcctttagaggactacatgtcgtcgccttcagaggactgcacgtcctcgcctttagagggctgcatgccctcgcctttagaggactacacgtcctcaccttcagagggcagcacgccctcgccttcagagggccaaatgccctcacctttagaggaccaaacgcccttgccttcagaggactacacgtcctcgccttcagacgactacacgtcatcgccttcagatggctaccctcccatgccttcagaggactacgcgtcctcgccttaagagggctacacgccctcgccttcaaagggctacacgtcctcgccttcagaggactacatgtcttcgccttcagaggacaacacgtcctccccttcagagggctacacgccctcaccttcaaaggactacacatcctcaccttcagaggactacacgtcctcaccttcgaagggctatacgcccttgccttcagaggactgcacgacctcgccttcagagaactacacatccccgccttaagagggctacacgtcctcgttttcagagggctgctagccctcgccttaagaggactccatgtcttcgccatcagagggctacacgtcctcaccttcagagggcaacaccacctcgcgttaagagaactacacatcctaaccttcagaggggccctcgccttcagagggttgcacgccctcgccttcagagggctacatgccctcgccttcagaggactccgcgtcctcgccttcagagggctgcatggcctcgcgttcagaggactacacgtcctcgccttcagaagtcttcacgtcctcaccttcagagggctgcacgccctcaccttcaggggccacacgccctcgccttcagagaactacacttcctcgccttcagaggactacatgtcatcgccttcagagggctacacgccttctccttcagagggctacacgccctcgctttcagagggctacatgccctcgccttcagtggactgcacgtcctcaccctcagagggctacacgtccttgccatcaaaggactccacgtcctcgctttcagagggctag

SEQ ID NO: 56695 - DNA, 255 bp, Glycine max
  Peptide Sequence Number=SeqID_173473
atgagaaaagatttgaataccgtttctgctgttcttcgaaagaaaacaatgcggaagaggataaggagggtggaattgatttcaatcggtgaaatcaaaagaaaattgaaaaagaagaagattgcaagttacgagagtcgatttgatgaagaaatgagtaagataggaaggtttgaaggtttgagaatggaggagcgtcgcaagggggaagaggctgtgcaggggtttctgaaaaacgtggtatttatagactag

SEQ ID NO: 56696 - DNA, 261 bp, Glycine max
  Peptide Sequence Number=SeqID_173474
atgccccatgggttgtttccttacaaaggtcacgcgttaatgccattgaggcatttcaccgaacacttggtgggcgcgcgtttaggtatcaatagcaagagaacggggacaatgtggcatagcaccaaaaggagatcaaaatacaccaatgaaaagctagaaagcttagggatggaatacttacttgttggtgatgaacaaaagcgcgaaacggaatcaaaaaatgcgaaaaatgatgaccctagggctgcaaactcgtaa

SEQ ID NO: 56697 - DNA, 678 bp, Glycine max
  Peptide Sequence Number=SeqID_173475
atgcggcggccaggcccagggccagcaggctgggggaaagcagtgagcggctcattcttcgatcctcacttcgcgcatcatgcccgcttccatgtggtacagcagatggcagtggtaggcccagcggccgagcgcatcggcgcgcacgcgatagctgcggcgcgtgcccggcggcatgtcgatggtgtgcttgcgcagctggaattcgccctgtgcgttttccagatcgctccacacgccgtgcaggtggatcgggtgctgcatcatggtgtcgttgaccagcacgatgcgcatgcgctcgccgtagttcagccgcagcggctcggcgctggcgaacgggatgccgtcgaacgaccaggagaatttctccatgtggccggtcaggtgcagctcgatctcgcggctcggctcgcggccatcaggatcctcgaacaggctgcgcatcgcgccgtaggtcagcacctggcggccgttgtcgcgcaggccgatgccggggtcgtccagcttcggttcggtggccgaactctgcatgtccaccagcgggttgttgcgttggctggccggaagattcggtgccttgctgggggtatcgcccccgtgggcgccatggaccatgctggcgccgcagctgcattccatgcccttcatcgcggccatgtcgtggccaccgtggccacc

SEQ ID NO: 56698 - DNA, 501 bp, Glycine max
  Peptide Sequence Number=SeqID_173476
atggccccgaggaagcttgcctcaaagaggtccaggaaggataaggcagccaaaggaactagttccgctcctgagtatgacagagtagatagggcgtcggcggtcgacatcactggttacccccatggtcagtggatcccgtttgatgccgacgctatcggccagctcctgggatatccgttggtgttggaagagggccaggaatgcgagtatggccagaggaggaaccagtctgatgggttcgatgaggaggccatcgcccagttactatgtataccggggcaggattttgcccggacttctgcagggaggcgagtgcgaatcatgcgcaccaacatgaccaccctgactcagatatggatgactctactgctcagcaacatcctgcccaccgatcataattccgacctccccatgccgaagtgtcagctggtatggcgcctactaggcaccctttcgacccagataagtccaacagggccctgggatttccctcgctga

SEQ ID NO: 56699 - DNA, 159 bp, Glycine max
  Peptide Sequence Number=SeqID_173477
atgcatattgttgtggtaaaacagggacaggatcatcttgagctaccatctggggtggggacaaaacatggacagcagaaaccaatcaaggtacttaggaacggatgcaagtggggatggggtcacgaccgactgatcgttgccctttctctgcgctag

SEQ ID NO: 56700 - DNA, 207 bp, Glycine max
  Peptide Sequence Number=SeqID_173478
atggacgaagcacttgaagatgtacatgctaatatagaccagccttgccatgcagggttggaaaggttgctcaacctaaggatagtgattgagggaatagaagtatgcattttcaccaaagaatgcctcaggattgcaagagttgtcactgcgcaacggaatgtctacgttcgatccagacgtaggcaacatatggaagatggatga

SEQ ID NO: 56701 - DNA, 261 bp, Glycine max
  Peptide Sequence Number=SeqID_173479
atgtctcctccacctctagaaacctcacaatctctcaaaatctcatccaaagttctgcaagatggcttcctcttcaacttagcgccagtcacactcgcccagcctgaaggtgaagacagtgcgcttagcgagttggccttcgctcagcgcctctatacagctcatctttcttccagaattgtccatgcgcttggccatcagatggggtgcttagcggataatgtgcttagccagaagatgagtggctttgcgagttcatga

SEQ ID NO: 56702 - DNA, 771 bp, Glycine max
  Peptide Sequence Number=SeqID_173480
tttttaaagttcttagatgattatgaaggtgatggcccaattacagttctattgacccatggtagaataaaggaagctcagggatcttgtctcccatcggtcaacaattcttttaaggcttcaaagttaattattaacaaaccggtgatggagattcaagaattcaatgaacggcttgcagagttgggcattgaggctcggtcaggttttaaatcccatagtgaagggtgtacacagctttcaggttctatccaattatcatcaaaggaatcattctttggaaaggctgaggcaaagactattgctgacattaacaccatctctaaagaaattgtttgtgtaacggttggcacaattactaggattgttctggacaatgattcatggtgttatacaacttgcattcagtgtcataaaaaaagtgatgcagagatggcgcccttcacatgtgcatgcggcaaatacaataaagaagctatgcttaggtataggcttgaggtgatgatcaaccagggagatgaaaacacaaaattcctgctttgggaccgtgaatgcagtgaattaattggtcaatcagctgatgcagttaataagcttaaaattgaagatggtgatgttgatttgaatgcttcaccccaagcacttgataagctgttgggttatgaacttgctttcaagataaaggtgcaacccaagttcaggaattatgctattttgaagtgttcagctgactcaagcttaataaaatgttgtgatggatatgctagttga

SEQ ID NO: 56703 - DNA, 1438 bp, Glycine max
  Peptide Sequence Number=SeqID_173481
gttgacctgatcaacacccgcgatcgcctgctggcgttcctcgatcaggagatgtctgattcgctctcttatcacttctggaacagcggcgtggtgattcgtcacaacgaagagtttgagaagattgaaggtgtcagcgatggcgtcatcatgcacctcaagtccggcaaaaaggtcaaagccgattgcctgctgtacgctaacggccgtaccggtaataccgattcactggcgctggaaaacgtcgggctggaagccgatggccgtggactgctgaaagtgaacagtatgtatcagaccgcacagccgcatatctatgcggtgggcgacgtgattggctacccgagcctggcctctgccgcttacgatcagggccgcattgccgcgcaggcgatcatcaaaggggaagccaccgcgcacctgattgaagatatcccgaccgggatttacaccattccggaaatcagctccgtcggcaaaaccgaacagcagctgacggcgatgaaagtgccgtatgaagtgggccgtgcacagtttaagcatctggcgcgcgcgcagattgtcggcatgcacgtcggcagcctgaagatcctgttccaccgcgaaaccaaagagattctgggtattcactgctttggcgagcgtgcggcggagatcattcacatcggccaggccatcatggagcagaagaacggcggtaacacgattgagtatttcgtgaacaccaccttcaactaccccaccatggccgaagcctaccgcgtggcggccggctgcgcagaggcgatcccggacgatacaccagcgcgatggtgcgctgcggcaccggtttgtaacacggcagatagcacacgccatcacgctggtcgcgcggaaatgggtatcttcatcagcgccggcttcgaagcagaagcccatcgcctgatcgcgcagacagtgaccatcttccagcatcagcagtttttcaccggccagatccgacatcggcacgcgatcgcgatcgtgccacgggtgatcctgatagatcgccagcttcattggctcatcaaacagcggcacttcaataaaagcttcgctctcttttaccagcgccagaatcgcgcagtcgagcttaccgctgtcgagctgcgccagcagctgctgcgtttgcgcctcgtgcagatacatctcgagtttcgggaaggtctgatgcagcatcggaataatatgcggcagcagatagggaccggtggtcggaatcagaccaatgtgcagcggcccggacatggtttcgccctgctggctggccatctccttcagtaccttcacttcacgcagcacggttcgcgcctgatccaccagcagcagtccagcctgagtaaacagcaccttacggctggtccgttccagcaggatcacacccagttcatcttccagcttgcgaatctgcccgctcagg

SEQ ID NO: 56704 - DNA, 333 bp, Glycine max
  Peptide Sequence Number=SeqID_173482
attttaagtggaaagagaaacagaggattttatcttgaaaaccaatctgcaaaccttgtcactcatgcatggaatctgtggaaagggggcagggctatagaaatggttgactcaaacatagaggactcttgtgttctatcagagcaacacgcagaggataggcctcttatgccttccgtggttctaatgttggggagtgaaagtgaattggctgagccaaaagaacctggtttctacataaagaatgatgaaggtgaaaaaatttccatctcaggtcaaagtgatttattttcaaccaatgaaataactatcacactattagaagccagatga

SEQ ID NO: 56705 - DNA, 174 bp, Glycine max
  Peptide Sequence Number=SeqID_173483
atgagtgttgcgcttagcggacgctcgctaagccagcagattggcttagcgagaagggtcgacaaggatgttgcctttgctcctacatatcctcaggcttttgaaagattcattttaactaacaagaaccaaaagaggtcgttaaggcgttggaccttgaacgatcttaagtga

SEQ ID NO: 56706 - DNA, 201 bp, Glycine max
  Peptide Sequence Number=SeqID_173484
atgcccgtcgccggcggcgacttcaactacctccgcgtcacctttggtgcatgctttccaatgccatggtcgctagagatcggaatctcctccgccaaatggcgcctcacggtgccgtctcttcccaaaggcttcaacgaaatagacttcgtcgttgtcgccgtcattttgctcatcactctcgtcatcgctacagtataa

SEQ ID NO: 56707 - DNA, 321 bp, Glycine max
  Peptide Sequence Number=SeqID_173485
atggattgtgcggaaattagtgttaagcagctcaattcgactggcaagaatccaaatgttggcaaacaatcatccctggacaaaattagggttccgaaatgttcattttacattgaggcaggcttcttctatggtgatctctactgcctctctcacaggcaggcttcttctatctctgaatttacttttcttcagaagttcatagtctcagctaagcctcctaagccgattcagattaagcaagtgacatggtctccccctgcttgtggtttcaacaaatgtaacactgacgatgcagctagaggttcccctggcatgtag

SEQ ID NO: 56708 - DNA, 210 bp, Glycine max
  Peptide Sequence Number=SeqID_173486
atgcttggaggatcaaggagtgagataggaggtggtggcaatgttggcgcggacaacgttgtcatcataggggagggtagaggatcagtggaggcgaaggaggtggtgcacgggtgtctagtgagaggtatttgtgtacattcacgcttttgggatgcaagaagcaaaagcatgggtgcaagaagtaaaagcctaatgtctttcatctga

SEQ ID NO: 56709 - DNA, 180 bp, Glycine max
  Peptide Sequence Number=SeqID_173487
atgatgatttggaaacaacgtgcaaaattagtcatggccacagccaggtgggcactcaagcatctcgtttatggcattgtgatactacggttgggaacttacacaaacagacccaaagacgacgttcctaaaggaaaactctacaagattccggaacaaacattattgacaaataacaaa

SEQ ID NO: 56710 - DNA, 360 bp, Glycine max
  Peptide Sequence Number=SeqID_173488
atggctagaaataaggttcactatacctacataaataatcccatgaaggggaaggcaacgttcaagaaaaggaaaaatggttatctcaaagaggttgatgaaatcactaccctttgtgacattcaagcatgtgttatcatttatactctagatgaacccgagcctgagattacaaagaaaaatgaaaatttccaagttcaagaggtgacactagctattgaaaatggaggagaaaccatgacagaaggagagcaagcacttgtggccaatgtggctgccatatcaaatatgaattggtctaatgacaacaacaatgaggatgatggggatgtgatccatgtgaacattggaagatgttaa

SEQ ID NO: 56711 - DNA, 306 bp, Glycine max
  Peptide Sequence Number=SeqID_173489
atggggtgtagaaggcaaatgctcaccttccccttaggaaggtgccctaaaatacaaaggctgaaaaatcctacattactagggtaccctacctacactatggagccatacatgcaagcactagctcttgggaaagctgcagttggttttagggtggcttattcacctagctggagctcatactcttccctcgccagcaaaataggggaggagcttgccacccagctcgcccaggcgagccaggttgcttcccaaagaagcaacagccttctggaggaagaatctggaaggcccaagtgggcctga

SEQ ID NO: 56712 - DNA, 264 bp, Glycine max
  Peptide Sequence Number=SeqID_173490
atgtgcttgcctcccaactttgcaccacccaatgtggcgcacactcccgatgaaaatgtcaataactccactcccatactcattgagagccaacaacctcaatctaatcatgcacatgtctctcaacccattagggagacatatgaggtaccctaccacaatctagccgacttcgagccttgcctcggatacgccactgagggccaaacagttggtggtatacccctgccaaacactttggatgaccctcaatttcgcccataa

SEQ ID NO: 56713 - DNA, 180 bp, Glycine max
  Peptide Sequence Number=SeqID_173491
atggccctttgcgatggtgcagacgtccttggcaagacaggagctaagctggaagagtttccggtgcaggccgaaaaactcagctgctccgatccttctattgtttgtgccagcgggggagacatgagcaaacttccctctcttcaagcccacttcaatcctctcgcccgcgaacactaa

SEQ ID NO: 56714 - DNA, 360 bp, Glycine max
  Peptide Sequence Number=SeqID_173492
atgcgtgccaaagctagagtgaagagtgaaatagcggaggtgcaaaagcagatgaaggctgacatggaggccatgaaagagcaaatgaccacaatgatggatgccatgatgagtatgagaaaaatgatggaggtcaacacggctatagtcgttgccgcaagtaccgccactgaggtggatctgactcacccatctggccacaaccaagtaattcgcccagcctcagatatgggccagagcaagcattccttcccatcatatggcttgctttccaactatacaccaccaaatgttgcacacgctcccgatgagaatgtcgataactccactcccatactcattgagagccaacaaccctaa

SEQ ID NO: 56715 - DNA, 1113 bp, Glycine max
  Peptide Sequence Number=SeqID_173493
atgttttttctatacggatttggaggcacaggaaaaacattcatatggagaacattagcaagttcattgagagcaaaaaatcaaattgtaattattgttgcttctagcggaatagcctctctattattaccaggatgcagaactgcatattccagatttaaaattcctataccaatttttgaagactcaacatgtaatatccatcaaggcatcaaattagcagaattattgaaccagacaagcctaataatttgggatgaagcaccaatggcccagaaattctattttgaagtgtttgatcaaagtttaagagatattatcacagataaatcaaagtcaaatcaaatatttggaggcaaagttatagtatttggtggagatttttgccaaatactaccagtcatcccaagaggaacgcgctcaaacattgtaaatgcagcaatcaattcatcctatctatgggattcgtgtgaaatattgaccttgacaaaaaacatgcgcttacacagcaatctagaatcagttgatgaacaagaaactgccacatttgctaaatggattctagacattggagatggaattatagatgatgaaaatgatggttatgctacaattcaaattcctgctcatctactcattactcaatatgatgattcaatcagtgctatagtcaaatcaacattcccagacttagatcagcaccacaataatcctgaattctttaaatcgaaggcaatactagctttaacaaatgaaacggtagaacaaatcaatgattacgtgctatccttcattccaggtgaccacatggaatatctaagctctgattccattgataaatcagaaaccagtaaaaacattggcctcactgtttatattccaagaatgtcaatgtctccttcacaatcaccctggccgtttaaactattaagaagacaatttccgattatgctatcttatgcaatgacaataaacaagtcacagggacaatcactatccatggttggactttatttgccgacaccggtattcactcatggccaattatatgttgcattgtcaagggtcaactcagcaaaaggattaaaaattctgattcatgatgatgagtag

SEQ ID NO: 56716 - DNA, 177 bp, Glycine max
  Peptide Sequence Number=SeqID_173494
atgagcggtggaggtatgaatgtgcagtcgacgccgagaagctcaggatacgctaatgttgtgattgcatttgtatttgtgcttgtgtatgttccagagacatttgatgaagtggaagtaatatggagggagagagcttggggcaagaaccccaacacacagaaccttcttgagtag

SEQ ID NO: 56717 - DNA, 591 bp, Glycine max
  Peptide Sequence Number=SeqID_173495
atggggccgttttcaaactttttccgctatgggtctattttacacgtgaatgcatgcatgcacaaagcaaaccgccagtggaactggcgagtttgcagtgccgtgaaggacttgccatccccattggcgattttgccatgcatggggaactgccagtcaaactggcgagttccaacaggtaggtgcaggctcagtagggctaggtgcaggttcagcagggcggagggaggtcaggccatgcaggagggacgcagagcagtagtaactcgccatccctattggcggtttgctttgggggagggaatcgccagcctggctggcgatttgtggacagaatggactcgcaagttgcactggcgagttgctttaattaaaaattctggcgttataaaagaagaagctccatcactccacagctgcgttccctgcattgctttcttcttcttcatacgttcctccactacattgtgttcttctttttttgttcctactaggtgctttttcttcttggacagtgcttccttcctcttcctattacgtggtttctctcttcttggtttattgatgttaggtggtacttttaaattttaa

SEQ ID NO: 56718 - DNA, 360 bp, Glycine max
  Peptide Sequence Number=SeqID_173496
atgaatagccctcacttttttctcagcaatggagcccaaatagagagacctgagatggttgcatcgggtgcagatggaggacaagagtctaccattgaaatcagcgccattgtagagagaaaggtggtgcgaggagggtttgagcaaaaaaccaattgcggaatcgtcgaggtgaccgcaatcaagcttgagagtggtcaagttaaggaagaaaatagattgataggacttacaaggaggtggaaagaggggaggaaggtggatgagaaggaagatggagaaaccctagcgcagaaacacgagaggttggcacaaagagcgagagggagagggagaatagagggaggcgcgagagagtag

SEQ ID NO: 56719 - DNA, 309 bp, Glycine max
  Peptide Sequence Number=SeqID_173497
atggcggcgcagctaatccgtgatcgagtagagatggagtgcctagagggagcttgggagaccctcgaaggcaacacgaggtgccgatttcggggcaccattggattcacggctacttctttggtgcatccagatgaacctgcacggacgcttcagcgcacggtggagtggacagctccttggattagttttgtgtattttttagggtgggtgtatctaggactgacgcaaaatagtttagagattatgagcagtgagaaagaaatgactccgaacagagttgtgaactggccattcaggactctgtag

SEQ ID NO: 56720 - DNA, 276 bp, Glycine max
  Peptide Sequence Number=SeqID_173498
atggccaacaaaaacatatcatccaatgaaacataccccccctcacgccattccgaaaacaattccaaagctcctaaattccttaagggtagggtgaaatcatggctcatttggctagaggcttataagaacaaaatgcctaaatcatctcccaacatgcatgtgaagcaagaagtatcaacaagagtcaagccaaggctattgtgcaagcaatcaatggggcaaaacacaccgaataaaatagatgatgatggctcaaattctcaccaagggtaa

SEQ ID NO: 56721 - DNA, 336 bp, Glycine max
  Peptide Sequence Number=SeqID_173499
atgactcatagccgaactatggaggagttgataaacaaaatacaactctctcccaaaataatgccaacatcgtcacgtcgactcagcggctcctcaccagaatcttactccctgcaccctgctgctgtcattctgctcccacgaacaaggttcgtgatcatcacagttaggaaaccatgcagagttcatcaagaccacccggttgtgcatgtaactgccccctccataggtgatcagcttggggcccaaaggagttccctaccaggtgacaagccccctcagtacaaagtacactctgccacagttattctatttcctatgtcgtatgaggtatga

SEQ ID NO: 56722 - DNA, 222 bp, Glycine max
  Peptide Sequence Number=SeqID_173500
atgacgtttttccaaaactacttggactacaaggcccaaaacgtacaagtgactaacgctctcgaaaacggaagcttcgcacacactccagacgtcttctcgaagatcccaacgggacaacttcatgtggcttccttgagaagcttcattaagaggcttctcgagaagcttcctcgtggcttctttgagaagctttctcaagaggcttctttgagaagctaa

SEQ ID NO: 56723 - DNA, 669 bp, Glycine max
  Peptide Sequence Number=SeqID_173501
atggtatattatacaaggtgcagtcacttgcaactcagagtgcagtttttctttacagtttacatttcatctccatcaaagaaagaactagttgctttcttgaaaaaaatctcctctcgggaaccacgtcttaatgttgttgatgttgatgtcccactaaacatcctctgccaaaatgatgagaagctcgaacaagttaccttaggaagagaatttcacataagtttgggaagaactgtcccaatacgagtacaccagattgactcagtggtctcaatgctcagacagaagcttcaaattcaacaccagtattggatcgactttaacaagtgggaggtttttgttaatgatgatcacacacgctcctttctctcagcagaagttgttcaaggagggttagtagagataacgaagcaaattgaagtagtcaatgcaatttacaggcttcataatcttcctgagttttacaaggatccacgtcctcacatatccttagcatgggccctgggtgacatcgcgcactctctaaagaaaattgtcgacgaggaaatgaagtgtgctgttggtaaatctttaaagaagtgtatttttagctgtaaattcaaaagtattgaatgtaagattggcaagaaagcatatacaatatgcaaaatttctgatggacaataa

SEQ ID NO: 56724 - DNA, 1020 bp, Glycine max
  Peptide Sequence Number=SeqID_173502
atgcgtaaggtgaccgcattagttatggcatcactgctggcaattggttcgaccgctgccttcgctgccgacactataccggacacagcccaacctcccggcaacgacgcgatgacccgaatacccggccaacaccatatgttcgacggtgtcagcctcagcgaacagcagcgccagcaaatgcgcgatttgatgcgccaggcccggcacgatctgcctggtgtcaatgtagctgaaatggaagccatgcataaactggtgaccgcagagaaatttgacgaagccgccgtgtatgcccaggcggaaaagatggcccaacagcaggtcaagcgccaggtcgaaatggcccgggtgcgcaaccaaatgtataacctgctgacgccagagcaaaaaagtgttttagaccagaaacatcagcagcgtatgcagcagatggagcaacaaatttctgcgctatgcacgcctggtaaagtccgctgcgttggccgctaccgcgctggcgtcgtcactgctgttgatcaaaatcgtcgcctggtaccacaccggttcggtcagcctgctggcggcgctggtagattcgctggtcgatatcgccgcctcgctgaccaaccttctggtggtgcgttattcgctgcagccggccgatgccgagcacacctttggccacggcaaagcggaatcgctggcggcgctggcgcaaagcatgtttatttccggctccgccctgtttctgttcctcaccggcttccagcatttgtatgcgccgcaaacgctgcgcgatcccggcgtcgggatcgtcgtgacggtgatcgcgttgatcagcaccctgattctggtcacctatcaacgttgggtggtcagaaaaacgcgcagccaggcggtgcgcgcagatatgctgcattatcagtcagatgtcatgatgaatggtgctattcttatcgctcttgggctaagctggtacggcttccagcgggcggacgcgctgttcgcgctgggcatcggcgtttacatcctgtatag

SEQ ID NO: 56725 - DNA, 120 bp, Glycine max
  Peptide Sequence Number=SeqID_173503
atgcggggttaccttatggttacccacacctttcgtcaaccaagggcaaacgagtccgttgacgcgcagagagttttatactcttgtcatccggaaacattcaagcccaacgacgcatga

SEQ ID NO: 56726 - DNA, 675 bp, Glycine max
  Peptide Sequence Number=SeqID_173504
atgtcgtcagaagagttggaacaggtctggaacagcattaaatcagaagcgcgagcactggctgattgtgaaccgatgctggccagctttttccatgcgacgttgctcaagcacgagaacctgggcagcgcgctcagctatatgctggccaacaagctggcgacgccgatcatgcccgccatcgcggtgcgcgaggtggtggaagaggcctacaagtccgacaaccagatgatcgtgtcggcggcgcgcgatatcctcgcggtacggctgcgcgacccggcggtcgataaatactccacgccgctgctttacctgaaagggttccatgcgctgcaggcttaccgcatcggtcactggctgtggcagcaagggcggcaagcgctggctatctacctgcaaaatcaaatttccgtcgccttcggcgtggacatccacccggcggcgaccatcggctgcggcatcatgctcgaccacgccaccggcatcgtgatcggtgagacggcggtggtggagaacaatgtctctatcctgcagtcggtcaccctgggcggtaccggtaaaaccagcggcgaccgtcacccgaaaatccgcgaaggggtgatgattggcgccggcgccaaaattctcggcaatatcgaagtgggcaagggcgcgaagatcggcgcgggctcggtg

SEQ ID NO: 56727 - DNA, 291 bp, Glycine max
  Peptide Sequence Number=SeqID_173505
ttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacaggtactggtcaactaaatggtattcctgtagctattggaattatggattttcagttttatggggggcagtatgggatccgcagtaggagcgcgtatgcaagaaggaagtttgagcttgatccaaatgg

SEQ ID NO: 56728 - DNA, 723 bp, Glycine max
  Peptide Sequence Number=SeqID_173506
atgaatgtaggagctctcatctctggacagatcacatctatggcccaatctaactcctctagacttgggttccttgctcttatcacaactctatgtaggtctagagggattgcttttgacagcctagtcttcgaacgcttgagcccggtcattaacttagcctatatcaggaaaaactattggaaccttaatgatctgatagtttctattagaggggctaggagagcgagggcaaggccagctgagcttccttccacatctacagctcctcctccagcacgtacctcagcagctccttctaccccttcttctgcagactttcaacatcttgaagccatgtttaatgaatgggtagcctggcctgggactcagcctccccttcacagggaagacgaaggtctcactgctcaagtaccacagcagagggaggatgagtcatccgagacttccacttcatatcccctgatcagaaggaagagggtagttgaaacacaagaagttgcagccacgtctgagaaatctcttgatgccacttctgagccttcagaaccaatggcggatatggcttcaattcagcaggcagcagacccctccactcatgaggatcaaaccacatcagtcctatctccgaacacctctcctccaactacccctgtgcttcgcttaatagatgaggaggatggtcagatacaggacaatcaggacaagtcacaggaattttaa

SEQ ID NO: 56729 - DNA, 228 bp, Glycine max
  Peptide Sequence Number=SeqID_173507
atgtcggcttggtggctctacaaaagaatctcacttcacgtactctactgctactcttctgctcccatgaacaaaggttcacgatcatcacaggcagttagtgtcgaggtcatcctgtcatgcataggcaactcccgcccccatggtgatcagcctgagtctcaagggagttccaaacttagtagcatgtacccaagtacaagtattccctctcatgagaaaatataa

SEQ ID NO: 56730 - DNA, 411 bp, Glycine max
  Peptide Sequence Number=SeqID_173508
atggaagtctacacacgaagttttctccctaaatgtaaacaaaggaatcccaaaagaggttgtgtggtgttctcctacctcacctttcttcaaattaaatcttgtggtcacacaacgaatattcatgcgaaacacttgggcatttatcatggacttcagcgttcttggagcttaaatcatagacatttcattgtggaatcagattctctcacatcgatggcgctcatcaagcaacgttctcctccctttcacgctcatgcagctcttataaacagcataagatccttcatgtcttatccatgggagaagttgaagtttcaacacacttatagagaaggaaacatgtgtgcgggaaataataggagtgtatgtggattgatttggattaatttaaccatactcatgatctaa

SEQ ID NO: 56731 - DNA, 204 bp, Glycine max
  Peptide Sequence Number=SeqID_173509
atgggggtggtactaagggcatggagttgtttgagtatagcgccaacctcatggcaagagaaccgcttccttgaggtgctcggtggctgtcttggagcaggtattgtgttcagacatggtggaagaaagggcaagttggaccaattgatagaggagagaacgtttccccttgaatttgaggtcaagggagcctatgagaaataa

SEQ ID NO: 56732 - DNA, 447 bp, Glycine max
  Peptide Sequence Number=SeqID_173510
atgggatggatcttcaagatctcccagtttttttactatcagaacaccccggacgaggaacgcattactatcacgtccttctacatggatggtccaactttaagttggtaccaatgggtgtttcggaacgagtttatcaactcatggccagctatgttacaagcattgaaaacaagggttgccccttcattttatgatgacccaaagggagctttgttcaaacttgcccaaagaggcatagttaatgaatatttgacaaaatttaaatgcttgacaaatcacattgttggcttagctccaccattcattttgagtcactttatttttgacttatccccagaaatacgcgtgaagtctaggctttacagcccatttcacttcctcaagcggtttctttggccaagcttcaaaaagacaagattgaggatcaccgtcgccattactgtg

SEQ ID NO: 56733 - DNA, 348 bp, Glycine max
  Peptide Sequence Number=SeqID_173511
atggtggattggccggtgcccaccacagtcaagtctctctgtggttttctaggtttaacgggtttctatcgcaaatttattcagtgcacaatcaccctatctctttctttagcaaaaatttctgcccacgattacaacgtgcctccatgtcatgaccaacatgtagaagcaaagcttcatggagaatcaaaggtgattcaaaggtgttttgatgataacaatgatgatgacaaaggtgatgacaaaaagctcaaagatcaatcaaagaacaactcaagtgaatcaagaacaattcaagagttcaagataagaatcaagaagaattcaagactcaagaagaaagtttag

SEQ ID NO: 56734 - DNA, 480 bp, Glycine max
  Peptide Sequence Number=SeqID_173512
atggcaccagcatcagcgcgtgcatcacaccggtcaagtgcagcttctggaagtgaagtggctttgagacatcacatgtttgctatgaagtatgctgcagaaaaggttgttgctcatgttcgtaagctttcaaatgagagtgttggaagtaatggaagctcaatacgaggtagtgacatgtctaattttgggattccaaattcatctggtaatagctctcatgaccttcctggatctgctatggtttcaagagagacaaatattatgggccacacaaagttgaagtctactggtgatactcaattagtccttccactagatcaacacaataaattgaataggtttctttcaaccatgcagcgaaggctaggcactgcaaaaactgatatggaggaccttatagttagattaaatcaagaaatagctgcaaaggattttcttgcaacaaaggtacatgactgggcatgcatttccttgtaa

SEQ ID NO: 56735 - DNA, 471 bp, Glycine max
  Peptide Sequence Number=SeqID_173513
atgaggaggaacagtcgccgtcgaagatcacgtggtcgacgcggcacttgctctttcgagagtgagggagtgaaagcggcgcttgctctttggagactgaaggagcgtgaagaagagcatcctagaaataagaaggaattgcaaagtttaattggaaaaatcattttccttcgaaggttttacattaattcggtagggaaggtgagagatttttctcctttattgaagctgaaagattcttacgagtttgtgtggcatgttgaacaacaagaggtctttgatcaaattaaagatgtggctaatcctcctatattgatgttgtctatacaaggaaggcctttaaagctttatatatcaactgctgaagaatctagtgggtgtcttttagctcaagataccaaagacgacactgaaagggcagtttattatttaagtatgctattaaatgatgtcaaaacaatatatacataa

SEQ ID NO: 56736 - DNA, 307 bp, Glycine max
  Peptide Sequence Number=SeqID_173514
ttcattgcgacgtccgaggttgagctcacgccgtgcgatcgaagcagcaagtgacaacgccgcggaaggaaccgaaccagatctggtatttatttattggatctggttttttgtcggagacgttgcgaacaccgacaaccactccatcacctgcgacacccctcctcgacttcctcgccacctccttcgacctcctccgtgcttggcgcatttccaatcgaacgttgaatcctccctgcgcgtcaaactcaaaagcctctacaacggcaacaagaacaagtattgcgacccaaaaacatgttcttga

SEQ ID NO: 56737 - DNA, 396 bp, Glycine max
  Peptide Sequence Number=SeqID_173515
atgatgagccagaagaaccagcttatcgccattgacaacgtgtccctgccagcgaggaggaagtttagtgcgatttgtcgcagtgcagcgacactcagtggttttctggcaccatcacgcttctttatgaaggagagaatggtggcattggagggggagtacaacgcgagggagtggatcgagatgaagccaaattgggagtcgcaggtgaggttcacagagtcagttgttggtgcttgccggaagggggggcagggcacgaaggtcagaccaggagagaaattagaggaggatgtgctagcgaagaacgttggcgagggcagctggggagaggtggtcgttgaaggtgtggtaggcgttggggacggcgagaatggagagggaggagcggtctga

SEQ ID NO: 56738 - DNA, 321 bp, Glycine max
  Peptide Sequence Number=SeqID_173516
atgtatttgttagcggagtgggaagatgaaaaatcaaaaaaaatattatttgacaaatatgcttttatgcaggcaattagagatgacttatttcagttagctagtgctacgattgtggaggaagctggaggccgaaaaatccctatgaaatatggaagagtggatgtatttgaacctaaacaatgccctaaagaagggagacttctagatgcaagaaatgtgaggttatttaactcacagatggtcactttcaactgctgtttaagacatcttggatgtgcagacctgattatcctgtcctatttccatagatacaagtaa

SEQ ID NO: 56739 - DNA, 261 bp, Glycine max
  Peptide Sequence Number=SeqID_173517
gggctactacttcctgggaaacctttggctaggatcctagcagcaacttcgctcctaaccgtcaacaccgtctcacagcggagcagcaagaacaaagggaagagaggggcattgggagtgcctgctttggtcacatctggtcgcgaaggtgaatctctttctcacttactccgcatccttgctcgtcgaaagaggaagaatagcggatttagtgacggaaaggcattcggaaactattcaagtgcgaggaactctccttaa

SEQ ID NO: 56740 - DNA, 1800 bp, Glycine max
  Peptide Sequence Number=SeqID_173518
atggttatccaatcaggtcctccccttgatgaaatgtcaattgcttgcattctacgtgacttgctgcatgctgttgattatctacacagtgaaggaaaaattcatagagacattaaagctgcaaacattttattgtctgagaatggtgatgtaaaggttgcagattttggtgtttctgctcaattaacaaggactatatcaaggagaaagacatttgtaggaacaccattctggatggcacctgaggttattcagaatacagatggatataatgagaaggcagatatctggtctctgggaatcactgcaattgagatggcaaagggggagccgccacttgctgatcttcacccaatgagagtgcttttcattataccccgagagaatcctccacagctagatgatcatttttctcgtccattgaaagaatttgtgtcattgtgcttaaagaagaggccaagtgctaaggaacttctcaaagaccgttttatccggaatgctaggaagagttcaaagctttcagaaagaataagggagcgtccaaagtaccaaataaaggaagatgaggagacacccagaaatggtccaagtgggatgggggaggcatcaggtactgtaaaggtggcaagagatttaagaggtgaagaaaataatcgacccagtgatcagggtaaaaccctgaaaagtgctggatgggacttcagcattggtggatcacagggtactggaacctttcgtaatgtttctcgaccacctcagtttagagataagataactgaagtttcacataatcagcttactcagcgaaaagctccacagagtggctatcaagggggatctgtcaatagaagtgcacttaatgagtcacttgaaagttcctttggaagagatcttagagttccccaccatgatgagcatctggataatcaccttgaagatgatgaattatctgggaatggatcaggaactgttgttattcgatctccaaaaggatcaaggtcatctgcgtttcgtgaccagagctctcagtctagcagcagctatgcttcttttgaagatgcttcttcaagtggaactgttgttttacgtggccagcatgatgagtctgattctccacagacaccaaggtctcgactgggacttaatgacagaaattcaaatgcctcaatggaagatagtgcagcaaatcttgctgaggcaaaggctgctatcctgaggaaatcaaatgctcgagagaaacttgcccgaggaaaaatcaacaatgatagacaggaaagcaaaagagatcaaaaggctagtagctctgattcttcaagaccacatggtgaatatgatgcacacaagggcatgttaagatcacatcatgctagtgatggcgaagaaagtgctaaaataatgtcatcatcggtgccattatctgttttacttattccttcattaaaagagggggaatggggtggcagaaaagctattgctgatgatccagaactcgtgagggcagttatcaattctttaataaacatggagggtacaaaacctaaatcctgtgatgtttttgtcaaaaagttgcttcagcgattggcaagttcaaaggaagattcattgaaggacctgcagggactggcagaccaactattcagcaagaccaagtcagctcaagaaacccgaaatgcagaggctgataacaggaagaaacaacaaaacaaggaacataattcaaatagcaatttaagcccactagcaagatttcttctctcaagatggcaaggccaaacctcacgggatctaaacccatcttga

SEQ ID NO: 56741 - DNA, 228 bp, Glycine max
  Peptide Sequence Number=SeqID_173519
atgtattatatcattgttagaattttgatgccttgttcttcaactcttgctcaagcctctggggaggacttgattctgatgtgggctttcttgaccggtcatccaatcgactgggcccatctggttcattactgcatgcataaggcattgcggtctagtgcacctctcccttaccctcagcttgtgactttatttcttcgacattttgaaattccttttggattctga

SEQ ID NO: 56742 - DNA, 464 bp, Glycine max
  Peptide Sequence Number=SeqID_173520
cttgcttctacaagagcaacaacttaaaaggaagtctacctcaaaatcttatggctctcactcttatccaaagaaagaccaaggtcaaggcatcttaggggtggcaccttctaagctcaaagatgataaggggaagacaatagaaatacaaccccctaaggctagtatgcaagaaaagactagctctataaatgaagaagcaaaaggggaagaatctaatgaagaaatctacccccatgaagaagcacaacctttaatggctgaggaggagtgtaaggaggtaaatgtctcctccaagaggttagctaagaaggaaagtcattttgcaataaagagaaacattaaagaaacttcccttcttagacaacctccacattttctcctttgtaaaaagacacttgttagcactgccacacctcttggccttgaggttattcctttagtaaaagagttgttggatgagg

SEQ ID NO: 56743 - DNA, 963 bp, Glycine max
  Peptide Sequence Number=SeqID_173521
atggaaccccagaaaagtctattaatggatgaaagcttatgtgatattttcaaagacacagaatttggggacacacactttggtggaggggatctcttttccattttggagagcatagatgacttgaaagattttcctcccaccaacaacaatgaagctgttattggccgaacttcaaaagaaaatgagcaaaattcaagaatggtgtcccaaaaggttttaatatcttcaagtgccccacaagattctgaaactgagcatgaaatctcacccaaaagcaagagacaaaagcttcgttccacatcgccagaggaactacagaaggtgtctcacataaccgtggagcgcaaccgaagaaagcaaatgaatgagaacctgttggtcttgaggtctcttatgccttccttttatgtcaaacggggagaccaagcatcaataattggaggcgtggttgattacatcaacgaaatgcagcagctgctgcagtgcctagaggccaagaaacaaagaaaagtttacattgaagtcctaagccctaggctagtttcaagcccaaggccctcaccactgagccctagaaaaccacccttgagccctagaataagcctccccattagtccaaggactccacaacaacctagtagcccttacaagcccaggttgcagccaggatacctttccccaaccatagccaactctcctacttcttcagcttcttcttccatcaatgataatattaatgagcttgttgctaattcaaagtccattatagctgatgttgaggtcaagttttcaggtccacatgtgcttctgaagactgtgtcaccaccaattcctggccaggccatgagaataatatcagctcttgaagacctagcactagaaatcctccatgtgaacattagcactgctgatgaaaccatgctaaactcattcactattaagaaaactgataagaagtaa

SEQ ID NO: 56744 - DNA, 1728 bp, Glycine max
  Peptide Sequence Number=SeqID_173522
atggctacttcacctgtgtcgcctcctccccctcctccttcttcttctcctcctcctcctcctccttcacaagcatcaacatctccgtctaccgtgaagcagacacacaaagcgacacgaagtgggcccttgcagtcgattaggacagtgtggctgacactgtctgtgaaaaatacggcattagcaaggataaatggagccagttttgatgtgcgaaaaaaggcacaggccatccagaagcaaaacactgccctccacgtgttgtcttgtgggggttatgaatatttagaagaaaaactcataagtgagaaaacaaaaaagaaactggaggaagttgctagaggcaaggatgtcgtcatcgacccttcttctcccatcagacaccacgtgaagtggaagatggcccgcacgaagaaaactgggcagatgacgtctgagtcagcaaaggaaatcgctcaaaagattataagtcattttcaattaacaattgcaactatcattgtttattatgtgaatgccttcaacaaatatatgtcttttgtacaggattctttggaggagcaggcgtcacaaggatcgttcgtccctcatggacgtcaggatgtcctgactgctgccattggacctagagcaactgacccaacaaatcagggaccagccggaggagtcgatcacaaaaaagtgactcagcagctcttggcatccttcagccagatgcagtcccagcttcaatcacatatgcaatcacagggacttgtactgcctccaaagcctgaggttggtccctcaaggcctcatgtcagcacaaagagaagttatgttgatccctcagggaacgatcctaagacgggtgactcagacaagtgcgggttgtacatcgaagcaaatcatccccgcccggttgccctaggaagactttatgagggatcaacagttcacaacattcctttattgcctggccaagtgaaggttggttttgaggaggttaaagttgcacaggttgccattcctgtacccactgatgaggttaccttatcagaacacatctctgtggggcaggcagctgtttctgcaacaaaacctccaccaaggccggatcctgaggttgatgatccgctatatctgatgatgttgaccatcccagagcttttcttgaagcctttccaagttaactgggattctaccgtgttcgaagtgtttaatccaaacttccccctgtacatcaagcaagaagatctctccgaaatcgcacacggtggtcaatgtctaaacatatatgtcatacagttgtggattctgcatttgactgagacaactatgcgagcggggaattccgatgtgtatggattccttgagccacagtctattcagagatctgggcaatcgcagtttgacttagaaagttacatcgagagttggatgcagagttcaaaacatgatgtctaccttggagcctacttaaatggtgctttgaaaggacttgatgatactccacagcctaaatccaaggttgctgcaaggtggattgtcgttaagtgtaatagacaaaaaggaagcactgagtgcagctattacgtcatgcactggatgtccaccatcatcttaggaagtttcagaaataactgggaaacatattttaacgatgctagaccattgcagccagagagattaaaggcactttacatccagtgggcacaatattatcttcgacttagacatcaaacttag

SEQ ID NO: 56745 - DNA, 468 bp, Glycine max
  Peptide Sequence Number=SeqID_173523
ggatcgtgcccacaaggcacccagtggacccgaaggagtccaacagggccctggggtttccagctctggttacgggcctctcttagtcctatagggtgcatgttccccccaacaagatcgcgccatcatgacataaggatcgcgcccgcaagacacccagtggacccgaagaagtccaacagggtcttggagttgccagctctgattacgggcctctgtcagttctacggagtgcctgttacccccagcaaggtcaccaagccccctactaaccgagctttcatcatgaagtattgcgcccccaggcatccacagggcgagacaccacaacagcctggggatagtcagcagcaggcaacagatgcactgccgccacctccaaagcccctcaactcatctacaaaagcaggagcgtttcctacgacctgtggtcgactagcaggcgaccaagtccaaagtcaaagataa

SEQ ID NO: 56746 - DNA, 279 bp, Glycine max
  Peptide Sequence Number=SeqID_173524
atggattcttatcctgggtcaaggtttatggccgatgagttgagattttggctcgaaaggcttgtagaaatgccgaacatgataaaaattcacagcatttgcccttcagggaccattgttgatcacttcagaaggcttaacactcatcgtggtggaatccgtaaagttttgggatgtttcagaaagaaaacaaccaaaaacacaaaagcggtggtgaacttatcaaacacggggggtgcactcaggaaacttcacccaaaacatctagaaggggggtga

SEQ ID NO: 56747 - DNA, 144 bp, Glycine max
  Peptide Sequence Number=SeqID_173525
atggagccagagtactgggataagaacccttttaaggcaaccgccaaaccacgacattacggcgccaatttaaaccaacccaagaagttttctgcgccttttgacccggcaggatacacttattgggattacattgacgcctag

SEQ ID NO: 56748 - DNA, 144 bp, Glycine max
  Peptide Sequence Number=SeqID_173526
ggcaaggtttatggtgagttgggactttggctcaaggcttgtagaacggatggacatgatatatgtcagggtgttggtctggccagtggttcagggataaaggggatgtcccacattatttccatgacacacatgcaacaatga

SEQ ID NO: 56749 - DNA, 189 bp, Glycine max
  Peptide Sequence Number=SeqID_173527
atggctatttatagaaaaaatccatttggtgcaagggaagctcgcccaggcaagctagagctcacccaggcgatccagttgcttaggcttaaaggtatcagcttgcccaagtctgataatcaaacatcaaccttgagcgacctctcagccttgcactacaaccgatgccaaatactacaattcgattag

SEQ ID NO: 56750 - DNA, 165 bp, Glycine max
  Peptide Sequence Number=SeqID_173528
atggccgttattggctctgtgttgattggatgggccatggtcgtggttcattggccatggtcattatggagccctatggtgattgccttggtcgtggtaaatccaccatggtcatggtatgtagcaggaataaataaaatgcaagggaaaatgaaagacaactaa

SEQ ID NO: 56751 - DNA, 642 bp, Glycine max
  Peptide Sequence Number=SeqID_173529
atgggctcaaaggtggggtgggaagtcaaggtacacttcccttcacttaacacaaacagtgttattaatgcatcacatgtggaccttcaaagaagcggtcctacagttggtgtaagcaattcatttgagccgcatagttgtctgacaccatctggtgatgctactcaaatatcaagtcatgagcatacatgcaactcaaaaccattgcctgatgtgtatcgaggcatgtctccaactgatcaagatggtgcacaaaagagtgcatgccgaatgtctgaccatgctgcttcagttgtggtgactgctctcttaatggtggaagaggagagtggagcgatcgaggggtctagctggaataccactagcagtggatgcagggtcgaagctaaagtgggttgcaatcctagtgatgaaggcgcctaccgagatgtagccaaccatgttggctacaagatgaatgtcaatgctcatgcagtggcaaatgaattggatccctacattgcaccgcatgccgggacacatccaccaaatcgggaagaggccaagttctcagagaattcgatcctcgaggtggtgatggctggggatgtgatgtgcggaggcacttgccgtgagcgtaggagcttcttgtgcctaacatag

SEQ ID NO: 56752 - DNA, 381 bp, Glycine max
  Peptide Sequence Number=SeqID_173530
atggagcattacctcttgggaccagtgctcattagcattcttgatgaagttattcctagtggaaaaatcatgcctagatgttgtagtacggggaacctcatgcacaaactgacagatgcaacattggagatcattgaggctatggcttctaatgcttataatggcattagagaaatggatcaaaaaaggatcttagagaaaactttgaatgagttggatgagtttaagctcagtgcttatgagaataccaaactctataacgagaaaaccaaaaaatggcatgaccaaagcatcaagagacataagtttcacgaaggagaaaaagttctagtttacaactcacacctccacctcttcccaagaaaattgcactcgaggtga

SEQ ID NO: 56753 - DNA, 207 bp, Glycine max
  Peptide Sequence Number=SeqID_173531
atgaaaaacctatgttcgagcagcattccctcaactaattttgggcatttgaaaacgtataatcctgcatctcctccactagatagatattttatccatagcaacattatggaaagctccttgaggttgagcagtccagcaaaattgtttccacttaaatctaggctttctaagcaacacaaatttccgatagcatcagggatttga

SEQ ID NO: 56754 - DNA, 456 bp, Glycine max
  Peptide Sequence Number=SeqID_173532
atgaaggaagaaatcaaggaaaaagaagcaaaggaagaatctcagctggacgaagaaaggatgctgccaaaccctccctggaaaactcaatcaagttgcagcaaaatcaatttgcaaatctggacctatgtttttaagccaccaactgcaatatatcatcagaaattatgcaagctacaagcaaaggagaaatgcacaaaaagaactattctcctgtcctctaacatcaaggatgtttattctataagaaaaagaacagaaaaaaaggatgtgacaacaccgaatactctcccttatgttgctagagaggctgatctctacccatgtttacagcatgaactccgcatagcccctcttcagtcactaggaagtttctttaacaacacagaggaactggtagaggagaaatggggcaattacaagcctgagcaattgtactattctggtttttcttga

SEQ ID NO: 56755 - DNA, 423 bp, Glycine max
  Peptide Sequence Number=SeqID_173533
atgtcaaggtttaaagtcaagcttctacaagaagagatgaccgagaggatcaaggatggactactcatcaaaagcaaggaaggagaaaattacaaggagttgaattggagcactttgatgattgttgaacaagggtacatctacttgagttataatactgagaacaagagagggtacatctcttgtggatcagttcaagtggagggtacatccacttgcttgttcaaagagaacaagggagggtacatcccttgtggatctttgcttgtaaaggattttacaaggttattggaaatctcaaaaaccggtggttgcttggggactgaacgaaggtcaaaaatggtggttcttgaatttgcatccagaatgatccaaaccaagtgttcatggcttggattgcatcaggtggcaatcagagcttga

SEQ ID NO: 56756 - DNA, 232 bp, Glycine max
  Peptide Sequence Number=SeqID_173534
ttatgagaagctcagagagaatactaaacctcttagtacctctcaggccacttttagaagacctgtagatgggcttgtgaccacaaccttcaagagactagatgaagccagtagcagtaactctgtagaggatgttgctcctgaaatgtgtgatttggactgctcttgcgatgaccatgacgaagacacaaatgatgagacagatgatgaagatgaaggtgaaggcaaatga

SEQ ID NO: 56757 - DNA, 138 bp, Glycine max
  Peptide Sequence Number=SeqID_173535
atgtctaatcaaggtgcacctcggtgggttgaacccatgtggttttctgatggctcatcgttagacgtggaggtcatcacaacagttcgacagaaatgggcaacttactttttatcttttaggaaaagcagttgctaa

SEQ ID NO: 56758 - DNA, 576 bp, Glycine max
  Peptide Sequence Number=SeqID_173536
tgctgcgcttttgcgcggcctggaaggccacgtgggcgatgctctccatttcgggcttggagtagcgcatggtgtcgaaggcttcctcggcgccggggaagtggccgtcagtggccacgcggcggccgcgcggctggtcgaagtagatgtcgccggtcagctcgcggatgatgaggatgtccaggcctgcgaccagttcgggcttgaggctggaggcatgggtcagctccgcatagcagatggccgggcggaagttggcaaacagacccatgtgcttgcgcaggcccaggatggcctgctcggggcgcagcgggcggtccagcgtgtcgtacttccagtcgcccacggcgccgaacagcacggcgtcggactccatggccagcttcagcgtggattcgggcagcgggtggccggcagcttcgtaggcagcgccgcccacgggggcggtctgcatgtcgaagtccaggcccagggcgcccagcaccttcacggcttccgcaacgatttcggggccgatgccatcaccgggcaagactgcgattttcatggtgttccttttgagagactgttcggatg

SEQ ID NO: 56759 - DNA, 387 bp, Glycine max
  Peptide Sequence Number=SeqID_173537
atggaagctgattataagcctataagacagccacaaagaagattgaatctggttatgaaggaagaagtacggaaggaagtggttcccaagaaaggaggcatgaccgtaatcaggaatgagaagaatgatttgattcccactagaacagtcatagggtggaggatgtgtattgattatagaaaattgaacgatgccactagaaaggatcactacccacttcccgtcatggatcaaatgcttgaaagatggatattctggctacaatctgtagaagcaaagcttcatggtgaatcaaagatgatgacaaaggtggtgacaaaaagctcaaagatcaatcaaagaacaactcaagtgaatcaaagatcaatcaaagaacaactcaagtga

SEQ ID NO: 56760 - DNA, 186 bp, Glycine max
  Peptide Sequence Number=SeqID_173538
atgactcatcaagattttcaagtgcaagccattggtcagtttgctcaagcgacctgtgctcctgagtttggacttccaagaccgttcaatcagagattactcgtcttgcacgttggtggggttgccgtaaaacaacaaacgttcatgtggcctcattttatcatgccggaaagtttgtcttcttag

SEQ ID NO: 56761 - DNA, 273 bp, Glycine max
  Peptide Sequence Number=SeqID_173539
atggtggtgggtttgaccataacccttttgactctttttggatggcatgtctaccttatccttcataacatgacaaccatagagtattatgaaggaaagcgtgcaaaatggttggctatgaagtctgggcaaagctatcggcatccattcaacattggcgcatacaaaaatattactttggtctctccctattttgtggtctttgctggcactaatttgcagatatgtactgatagtgtttcttacctaaggatatgttcgtctgtctcttga

SEQ ID NO: 56762 - DNA, 746 bp, Glycine max
  Peptide Sequence Number=SeqID_173540
gttctgaaatgcagactcctcactacggggtcggatgaagggattcgaaagacagcatggatcggggagaggagggagaaaggtgaatccgctcatgatgcgtggaaagtaggggaagagtctgattcaaaaccgtctgcgatagatcacgctcatcaaatgcaaacatggctcttgttggccttggcccggccgtcaactgcttcaactgcagatgcggctgacctagatctagatgtcccatcaatagcgaaggaagtggctgaactcgttctttgggacttggactctgactttccgtactcgtccctgaacccaatagggaatccgtccctttcagcccctgaacctaatgaatctgtttggtacgctgaggcttctccttcccctgaggccgaagtagaaagaaaggaagtcgcttgtgcttggcgtgctctaagctccgaagctgataccttctgctcgattgtttgttgcctcagttgggaagaaggctggaatctctctctccctagccctaggatagaatgtgatctctttctctccactccccctccccgactggaattgaaacccgctcacgataatgcgaatgaaacggcagataagcctattactggttacggcgagaagatcctaacaaacggccggctaaaggactcctattcttttttcacaatcgccgatcagatgttaggaatcgattgcagcgagaagcctctcttggccaagaagcaagagttccg

SEQ ID NO: 56763 - DNA, 300 bp, Glycine max
  Peptide Sequence Number=SeqID_173541
caaaaaagaaggagtagagacgagaatcgtcatcacggaaagggcaggatggacgaaatcagtgtcttatctttgctttcctcttatctccgatgagagatatttggcaccctttgttgcaccatatgtgaagtcccgagacatgccaaaaatgaaaaggaagcaggcttacgcgatccgtgaaaattccgtgatgggggtacaaatagcaatcaggcccacttgggccttccagattcttcctccagaaggctgttgcttctggaggaagcaaccttgctcgcctgggcgagctgggtt

SEQ ID NO: 56764 - DNA, 141 bp, Glycine max
  Peptide Sequence Number=SeqID_173542
atggccattgtctttgaagaggagctaaaagcattcatggtggtaggaatcattgtaacagtttggcttcaagcaatcatggtgaaactttcctgggtgatgatggtactgagaacttcagcctacaaccctcccggttag

SEQ ID NO: 56765 - DNA, 171 bp, Glycine max
  Peptide Sequence Number=SeqID_173543
atgaagggagtcgttaagacccttaaacccttcccctgctggagctcgcctaggcaagctggttgtttaaagttgaaggtatcagctcgcccaggcgagctagagcttaaccaagcgagtggctttcttagagctgaagaaatttcatggcctaggggagccaaatggtag

SEQ ID NO: 56766 - DNA, 183 bp, Glycine max
  Peptide Sequence Number=SeqID_173544
atgagaaggtgcaaaggtttgcgcttagtgccaccctcacgcttagtgcggcatgcgaccttgatgctgatgccctgccagattctgcttcgcactaagtgcgttgaagttgcacttagcagtggatgcacgcttagcccaactgctgagctaagctcaactatcacttttggcacttcatga

SEQ ID NO: 56767 - DNA, 852 bp, Glycine max
  Peptide Sequence Number=SeqID_173545
atggagagtcggtgttggacctcagcccaagatccactgccagtggcagcgttgaggacatctacagcgaggatcgtgccactaaggattaacttgttaccctatggactttctcggttgtcagaacttttcatgggctgtggttttaagtatgataggaagcaacaagaagcccaacagaaactagaactcattattttgggcgtaccattctccatggggtgcaaaagtatgtttcttgttatcattttgtttttggtgggaagaaattgcattatattgagtattaattatgtgcaacacaataggcttgaggtggcattgcttcttatagtttatatcacatatagatggttcattgtcatttcttggctttttgctccttacattttcaacccctctggtttcaagtggcaaaagactgtggaagattttgaagattggacaagttggcttctacacaaaggaggagtaggagtaaaagaagataatagttgggagtcttggtgggacaaagaacagatgcatatccaaactttaaggggtcgtatttttggagataattttgagtgcaagttgcatcttaccggagatgatacatcacttgcggtaaaaagaatcgtcttcatccgtgaattagattatgatcatatctttacctacaacccaaaaaagtctgttgattttcaactagtgttgcgattttcacaaggagttgcatctataggccttgttgcagttgtgtgtcttgttgttgcctttactccagtatcgatagctgacctttttgcaagcatccttgcatttatccctactggatggggaatattatccgtgagttctgattcatag

SEQ ID NO: 56768 - DNA, 180 bp, Glycine max
  Peptide Sequence Number=SeqID_173546
atgaaggtttttaccttcctcaaaaacaatgacttgattgcgaaggggcataagagtaggagagtgaaagagcttcaagtggagacattgacggcgtatgagatagcttcgacggtgacaacagataaaaggagagtgcgagagatgattgtaaagacacggcagaaggagagtgaatag

SEQ ID NO: 56769 - DNA, 1854 bp, Glycine max
  Peptide Sequence Number=SeqID_173547
atgtctccgccactgctggttactgaagaagacgaaggacagagcaatgcctcgatggtagcatctgcatcttcaccctcctcggagtgtttcaccctaaatgaggctagattgaaagaacgcaattacctgggattgtcagattgctcttcggtggacagttctattgtcccgagtttgtctgatgagaaaaaggagaatctgaatttgaaggctactgagttgaggcttggacttcctggatcccagtcacctgaaagggatccggatcttttctcgttgagctcaacgaaactcgatgagaagccactgttctctttgcttcctacaaaggatggaatctgctcactgtcccaaaaaactgtggtctcaggcaacaaaagaggttttgctgacacaattgacccagagtttcctggcaatgcagggataaacatgatgctatcacctaaaccttctggagttaagcctaccacagtgaaagaaataccaagcaaggtattacaagaacatccttctgcagcaaatggaactggtcataaccatacgggagcttctatcagtagcagtgcaccggctgctaaggcgcaagttgttggttggcctcctataagatcatttaggaaaaactcattggccaccacttcaaagaacaatgatgaagtagatggaaaaccaggtgcagctgcaatctttgtgaaggtcagcatggatggggctccctatctgaggaaggtagatctaacaaattatacaacgtaccgggaactgtcttctgcacttgagaaaatgttcagctgtttcactctaggtcaatgtggttcccatggagctccaggaagagaaatgttgagtgagagcaagctgaaggacctcctgcacggttcggaatatgtactcacttatgaagataaagatggtgactggatgcttgttggagatgtaccatgggatatgttcatcgacacatgcaaacgactgaaaatcatgaagggttctgatgctattggcttaggtagtttatcttttcttcgcagctcccagggccatggaaaaatccaggagcaggtgctagttggtattggaactgttgacttcgttttgtttactaagagcccagtgtcgtttcggcctatgctggtgagtaacttgggttacctattggttggcctatgctgggaagattgggattgccaagttgctggcaaatggcaaatgtttatttactttaggattataattagcatagcatgttggcaaaatttactgtttgacaatggtggttgtggtctagcaattgagaacgtatgtagtgatagaactattagtggtgctcgtggtggtggtgcaagtggcattggtggtggtgataatgcagtagcaatgatgatggtttggtgtggtggtggtggtgacatgagtggtattagtggtggtggtagctataatgatagtaatgttagtggtgataaggatgacaatgataatggtggggtgatggtgtgtggttgtggtggtagttgtggtgacggtcacaatggtgatatttttggtaatgatggtggtgacagtagcgaggacattaatggtggtggaagtggtagcaatgttggtggtgatgtcaatggcgacgattgtgacaatgatagtagtgttagtggtagcgccaagtggtgggagagtggtggttgcaatgacattgataatggttgtggtgacattgacaaaggtgttggtggtaacagcaacactaatggtggtggtgatgtcgatgacaatggtggtagtggtagcgatactagcggtcatggtggtgataatgatggtgatggtgacaatgttgtggcagaatga

SEQ ID NO: 56770 - DNA, 131 bp, Glycine max
  Peptide Sequence Number=SeqID_173548
atggcggaaccatcgaagaagcgcaagggttcttcaagtagaagccaacggcactccgaggctcatgatactccaattccttcctccatttcctcatcctcattgttctcatcggaagaacaacgtatacg

SEQ ID NO: 56771 - DNA, 1041 bp, Glycine max
  Peptide Sequence Number=SeqID_173549
atgtatggtaagagcagtaagatgctcgagcatgaaattcatcttgttgttcatggtgactgcttcctcaagacgttcgatggttgtttgtttggtattgtggtctggcatggtggctggctgagacaggccagcaatgacttccaagattattttgatgatgccaaagaatcaagagttaagcaagttccaaagaatcaggcttcaagaatcaagtctcaaagaatcaagattcaagaacaattaagtttcaagattcaagaacaatcgatcaagattcaagactcaagattcaagattcaagagaagttgatttcaagattcaagagaagaaatcgagaagcaacagtcaagacttcacaagggaaagggtacatctacttgggttgttatactgagaacaagagagggtacatttcttgtggatcagttcaagtggagggtacatccacttggttgttcaaagagaacaagggagggtacatcccttgtggatctttgacttgtaaaggattttacaaggttgaaagaaatcttaagaaccgttggttgcttggggactggatgccacttgatccaacaagtggtatcagagcagatatcttaagaaaagtttcacaacttcaagattcatggcctcctcaaattctctgtttcccgagggaaattccatccataggccacctatctttaatggaacatgaaatggaacttcaacgtctcaatcaaaatgaagagaccgacaaaaggaaaagaagcatagcactcaaagcctcctcctcaatggaagaagaagaagaagaagaagaagaagaagaagaagaagaatttgatgatgaagaggacttctcactctttgcaaactgcccctcaaatgagttatggcccgagaagaatgacaagaaaagctataaagaaagaagatccaagaagtcgtatattgcttgggatgacaatgactcatccgatggttcggagaaggagatcaaccttctatccaaggactatgaaagtgatgaaaacatctctcaagaagtttaa

SEQ ID NO: 56772 - DNA, 462 bp, Glycine max
  Peptide Sequence Number=SeqID_173550
atggcagcccctgaagagagtataaagtccacaacttccattttggaggagcctggaaggtacagtggaagagacgatggtggtttgccatatgtaacttcaaacagagagaaacacgtgccagactatgtttgtgacttcagtttggtcatcggtctgtggatggtaggccgtactcaagcaaagcttagtgccactcatgcggaacaattctctccagaatgcactgataaaaatggggtcgtgatcggataccaagctttggggaaacccatggagcttacaaactatataaatcttcccaaagagcggaaggaacaggcaaaggttgcaacaggcccactggcttacgagtctcatatttcacttattgacagattatgcattgagcaacatggtggcagatatcttgacgcatgtgcggccagaagaagtgctgctggatgcgacaaagtgttttag

SEQ ID NO: 56773 - DNA, 1758 bp, Glycine max
  Peptide Sequence Number=SeqID_173551
atggccaagaccccgtcggctgaatttttaaaatctgccaattctttgattatagtggcatccttttacatggatggaccaacattgtcgtggtaccaatggatgacccgcaatgggttcatcacgtcatggccagccttgttacaggctctggaatcgcgctttgctcccaccttctatgacgatccacatggggcacttttcaaactccaacataagggctcaatgaatgagtatcttagtgagtttgaaagacttgctaatcgaagtgttggccttgctccgctggcattattgagtttcttcatttcaggtttatactctgaactccgcaaggaagtccaagctcttcaacctatctctctcctgcaggcggtgacactggcgaagctgcaagaagagaaatttcaggacaaatgtcgtcactcccgacctcctccgtccccttctcttcagtctcagacaggccctccgcattaccttcaccttcgcgtccacctgtcaaatgactgttcgcggaagaattggcccttcgtcgtgacaagggtttgtgttaccactgtgacaagaaacttcaatacgagcgatacccttcaccacgaggacaatttaggtgtgccccaaatcagtctcaatgcattatcagggatgcccgcacctaagacctttcgcatttatggcactgtcgcccaccaccaggttgtgattctcgttgatggcgacaatactcacaatttcatccaggcaaggctcgctgccttccttcatttggatacttcctccatagccacgatacgcgtcatgattggtaatggtagcaccctagactgcgacaccaagtgctcctcgataccaatcaccatccagggccaccctttctctgttgatctgtacactttacccatagggggcgccgatatcgtcctcggcgtacagtggttgaagttgctagtgcctgtcaccactgattactcgtcattgacgatgactttcaattatatgggccaacatatttcattacacgcagatccgtctctttgcccaagccaagcttcagcccaacaacttaaatgtctcacccaaacttatagcatttctgccttatttcagctgacccatgagccacaacaacttccccctcaccgcacaattacccatcgcattcaccttttaccaaactcgagccccgtgaatgtcaaaccttaccgctacccatactctcaaaagaatgaattggagaggcaagttgtcgtaatgcttgatgctgataggatacgcccaagccatagcccattttcctcacctatgctccttgttaaaaagaaagatggaagctggcattgttttgttgattaccgagcctttaacgctatcacgatcgaagaccgtttccctatacctacgatcaatgagctgctcaaaaaaattgtccgcaagtcatggttctccaagcttaaccttcgtcaaggttttcatcaaattcgaatgcatgatgatgatattcagaaaacggggtttcgcacacaccatggtcattacgagttcaagaaatttgtggctgtctttttcgatgacatactagtatacaacccctctttcctttcacacctcgagcatatggaaatagtcttctccacacttttgcgcgaagctttcttcctccgtcgaactaagtgtatcctagccaaacaacagctgagttatcttggccatatcgtctccccccatggagtggcccctgacctgcagaagatatag

SEQ ID NO: 56774 - DNA, 465 bp, Glycine max
  Peptide Sequence Number=SeqID_173552
atggaagttgtggactttatactctcttcaggggctgccatgcatactgtcctccaacgacgattgcagaaatatcaagcttcgatgaagagcaggcctgatgcccatcgacgggatatcatattcgctgtcggcgactgggtttatgttaaactccgtccatacaggcaaacctcaatccaacccacatactccaagttgtccaagagatattatggttcattcatggtacaagcccgtgtaggagcagtcgcatactgcctacaattaccccccaacttccaaaatacaccctattttccatatccatcaacccttcccccttctagtatcgataaccacccccttgtacagcctctccaactcttggattggaagatggacctcaacacagaaccacccacccaacaggtcttggtgcagtggaatggtttagccccggaggacacctcgtgggaaccatga

SEQ ID NO: 56775 - DNA, 834 bp, Glycine max
  Peptide Sequence Number=SeqID_173553
atgaagccccccagcggcgaagctacacttgttgctaaggatgtggagcatgtggatcatgcaactgacaaggtccatgaacagcctgaagaggaagctactgatgttgagggttttctaggcgggccccacgaggcatcaattttgatggactatgttcatcatatggcaatggaacatcctgagttgaagttgtcctcctatggaaggaagatagagaaatttggcaagcctactccagagattgaaagcttagtggttgccacaagattaagtcctctgatcgcatgttccttgggcactgagaggtggcataaggaaactagtagtttccatctttcggtaggagaagtgactatcaccatgcatgatgtggcatcattgctacatctacctattacaggagccttccatagcattgaggctcttcatgtggacaaagttgtcttcctattagttgaattgcttgaagttagttcaaaagaagtaagagatgagacagtacaatatcatggggcatatgtccagctattgtggctgcgagacatttatcgtagcaaatgttgcacactctttgctaacaagagtgccacatacatgcatatggtattcttggatgcatttcatgacctcatccagactggaagctatgcatggggagctattgcactgtgttggatctacgagaattttccttctgttgcttcttttattgttgctaaagattatcaagagaggaaaccacgtgcttgccgctggaagtctgggaaggcattaccaatgtcaacgtatcataagcgtttggatagatttatttctgatgttgtgtgctag

SEQ ID NO: 56776 - DNA, 390 bp, Glycine max
  Peptide Sequence Number=SeqID_173554
atgacgacatcaagcgcctgggagagtcaacaagttggtaacaaatgtccaccaaagggggaaattgaagatatattgttcttaaaagaagtagtagcaaatgatcataagaaagaaaatagcaagagaaggaaggatgatcataatttaactcggaaaagtaaagataaaaagtttttgaatagacaaaatattgaaagggtttttgatcctgcagtaaagccatctaacttcactgctcgatccaatgtgtccccatatgctcccccaatgattacaatggacaatgatgatgacatctcttatacagctttggatgctgtggtctgcaaacatggcaatgcaggcttctatgtctcaatgtctcttaggcacttttttcacctttaa

SEQ ID NO: 56777 - DNA, 924 bp, Glycine max
  Peptide Sequence Number=SeqID_173555
atggccctaacatctaaaaacaagatgggttttttaaatggcacaatacctgtcctagctaccactgatcccatttatctgtcgtgggaatgctataacacccttatcatctcttggttgttaaactctttgtcaccatcaattgtgcagagtgttatttttcttgaccgtgccgtagacatatacatagaccttcaagaacgattttcccaaagtgatttttacggtatccgacaaggctcccgatcggtctctgattactatacagcgctaaagtcattgtgggaggagctcgacaattttcgtcccttccatgtttccacatgctccacaaaactttatcatcaacaagacttcataatacgtattttgaaaggcttagatgatcatttctctgttgttcactctcaaatacttctgatggacccattaccgtctagtaatcgtgttttctccatggtagctcaacaagagcgtcaacattcttcatcatccaccattgatgaaccaaatgccttcatcaatgttggacagtcgacatatggaaagggacacggcataagaggacctagcggaccagcaggagtcaatgcccgaaccaatggttctaacaaaaagtgtatctactgtggctgtaccgaacacacagtggacgtctgttactccaagcacgggtatcctcttggtcacccgcattaccccggacgaccaaggtttcacaaccgggacaactctccttcctctgttgtcgtcaatagcgctacacaagaagtagattcacacattcattcctcgattagtcaagacaatgattccaacgagttgggctttagcctaactagagcccaatatcaaggacttcaaggtctccttcagcaacaaaaaccaaatacaaatgctagtccatccacggcttctccttag

SEQ ID NO: 56778 - DNA, 432 bp, Glycine max
  Peptide Sequence Number=SeqID_173556
atgaagaaccatcactttgttggtttggggaattttcaccatgagctttggagggaataccgaaaagcgctccaccatgaggaacttttttgggtaagggaagcttttatttaccctaagtctatttcaactcttaatgagacttttatagttcttatcccaaagtcggataagcctacacatgtgagggagtataggctgggagactacttaacattatcatcatattatttagagatcccaacaacgcttatcatcttggaaggcttcccagcatgctctggttgggagagtaacccttactcagtcgatgatccaagccatgtcagcctacaccatcaaatcaattatggtgcccaaagggtgtgtgaagaattagagaagctacaacgtcattttgtttggaatgataatcaagatgggagaggttag

SEQ ID NO: 56779 - DNA, 312 bp, Glycine max
  Peptide Sequence Number=SeqID_173557
atggttaccttgaagaaaaccacgaaagaaaagttgagagcttcatcctctaccgaatccttgaggtggattatggagatcccactccgattaaagtgttcctctccatacggtggtctggtggcaagcaacgatggcttgtggcggccaccggtggttgtcggtggtggaggaggaggaggagcgaatttccctctcgggttgggaattgagcttatcgcgcttgtttcactaagggaattttcctcttggttcaagtttgaaggtgattcaacaattaacgagtctgggattgtggttttaccgaaacag

SEQ ID NO: 56780 - DNA, 1096 bp, Glycine max
  Peptide Sequence Number=SeqID_173558
gaatggtaaggatttccctaggaacgagacattgggtcttgaaacattgtgtgtgggcggtgaaggtggtgtggtttcaagaaagggcagaaattgggggagagtggtatgggaagggtttgaaatagaggaggaattacttctcaccaccaacggcgatgatgacatggtcatcgtgcttagatttcccttaaccgccttcaagaagtgggtgttgaggaagttgaatgtcgcgctggccatcgatggacaagggatattgacgttgtatacaacgtcatacaagaatcttaaaggtaggtttttcaaagccttatcggtcattgacccagaggatattgaattcaagaaacaattaactttgtttgctacaatgttcaaatattcatgtatcatcgagttggagtatcgatcggtgaatctaagggtgttcatcaaaaagtcgtccaagaaaagtatggcaccttcaagaaaggccgccgcagttactgctactgctgagacaactctagttcaaggcatcttggaagattcgttcacagttgccgtggagaaaccctggtctctagaaaaaagtgcgattctttacgtagttaaggatcgaggtcgagatctgatgaaggcgaaggaggctctcaatgtccaaaagtcgcgtctggcagcggaggtcaaaaggcttaggaagaaagcgatggatgctaaggccaagcacattattttttaccaagctaaggttaatttagaaaaagaaaaacagctgctcactgagaaggagaatgagatcctcggcagcctcgcggtggtgaagaaggagaatgaggggatggaggttaaggtaaatccttggaagtggaatccaaggctactgttgatgagggagaaaaccagtggagtcgccaccaacgtttattcgaggaaaacattagaaaaaccaaaaagaggggtcgacaagggtgttgcccttgctcctatatatcctcaggcaaaaggccaccttggggcagttgcagcacacccaggcgagctgaaacctaaccctgaagcagtgagcttgcccaggcgagctggagctcgcccaagcaagctagtcacttag

SEQ ID NO: 56781 - DNA, 435 bp, Glycine max
  Peptide Sequence Number=SeqID_173559
atggaaactgaacaacatcctccacaacaaagttcatcaatggctgctagcatgcatgatgaaggactaccaccacatgctcaatcatatgaattcacaccacaattcatgccacaacctcatcatcatcaacaagattataagtacaatctgaagttcttcagtgcaaatggagaagactttatgagcaatctcatgggtacagatcttcgcacactggagtcattagtggaagaacagttggtcataccttcgcttgcatcctttcaccaaagtatgaccaacagttcttccactaatgacttcgtacaagaagaaccagttgttgttcctagtgaacaagtcgaaccacaacaacatggtcgagtacatcgacaatcgacaagaaataggcaaccacccagatgtggatctggtggacccaaacggtattaa

SEQ ID NO: 56782 - DNA, 783 bp, Glycine max
  Peptide Sequence Number=SeqID_173560
atgaagaactcagtccctttagtgaggacgaagacaaagttattcacaattaaccccaagaggaagatgatgaggaagaaccccgacctgtttcaccaatcacaattgcatagcttggatcgagaagaagtccaacatctggtggggactctcttcgaagggatgcgtttcttagcaaaacaagacgtacgaaatgctttgcaacaatatcatttgatcgaaaacgatctatcaacttcagtgccaaccttgatagcacacatcaaaagcattgaaggatacaccaccacgtaccgcaaagcatggttggaaaagcaaaatgttgttgaagacgtctatgacaactgggaaagatcataccacgatctactgagattgttacaagttatgcaaaaatttcttcctggtatggtggtggagaaggaaacattgctaatgccaccacaaggaggtcaacctgtagagagtttcatcatgttccatcgtcttttttggagtttcagaccgtgtatcgatgggtttcaatattgcaagcccataattcatgtcaatgggacatggttgtacagtaagtacagggtgaccctctttgtggcagttgctaaagatggcaacaataaaatccttttgatagcctttgctattgtcgagagtgaatcaacgaaccctacattcaattaccaatacaatatgctgagggaggaaacaaatgttgatcgagcaattaattggctcagcgagatttcgcaagaaaaatggactctcgcatgggatggtggatga

SEQ ID NO: 56783 - DNA, 237 bp, Glycine max
  Peptide Sequence Number=SeqID_173561
atgaacaacaatccatgggagcttctcgacattgatgacttcgacctcccatcctttgttcgcccaactattcagtcatcctctagttcaacaagacttattcttggtccagctagggtcgtacaagctgccatgatgaatcgacaatctagggaaccactccgaactcaagaattcataatgcgcgcccaccaaatgttgatgcacacctcacaggacaccattagggttcattga

SEQ ID NO: 56784 - DNA, 441 bp, Glycine max
  Peptide Sequence Number=SeqID_173562
atgccttctccagaccccataattgaacctttattggttcaagctgaattttcagatgttgcaaagcttggacaagttaaaatcgacaacgctttggtaattgctttggttgaaaggtggagacctgcatcacacacatttcatcttcctgttggagaatgcacaatcaccttgaaagatgttgatctacaactaggtttaagcattgatgatagaccaattactggcccaacatattctaattgggaacaaacatgcacaaaatatataggtgttgttccaacaaataatgctctaaagggattaacacttaaactaaagtggttaaaagaacacatgttgactgttccagtaaaacccacacaacaacaactagcaggtcattgtagggcatacattttaaggttgattggtggggtggtgatgccaaacaagttataa

SEQ ID NO: 56785 - DNA, 390 bp, Glycine max
  Peptide Sequence Number=SeqID_173563
atgaagaattcaaaatatttaacctgttttaacccaacaccagaaaacatcgtcacctacgtcgtttacacgctcaagctcgctcgtctcaacctcgaggaccagaaggagctccgccacgccgtgtttggaataacggcgtgctgcggctcagacgaagaaaatgaatacccacagaggaagtcgcagtcctcattgtcgacagacaccagatttgaaacgacaagcaccagatctaaaaccacagtgatggctccgacgatttgttacgaggagagatccacggtggttcgcggtgggtttgagcatgacgatggctggagggggcagcgttattgctgtcacggtgctgaggaagaaagaggtggtgacgacgaggatgggtcttag

SEQ ID NO: 56786 - DNA, 874 bp, Glycine max
  Peptide Sequence Number=SeqID_173564
atggatatccaagccgcatacagttgccttttgggtaggccgtggatccatgaagctggggccgtgacatccactttgcatcaaaagctgaagtttgtcagaaatgggagtttgatcactgtgagcggagaggaagccttgttggttagtcatttgtcagctttttcctttattggtgctgatgaaacagaaggaacctctttccaaggcctgactgtagagggtaaaaagccagagaagaatgaagtatcttttgctacttggaagagcgcgcagaaagtggtgcaggaaggaacaggtgtaggatggggaaaagttgtgcagttgttagagagtaaaaaccgcgaaggactgggatttgcttcttctgcaggatccgcaacgaacagtgttggatcaagctccattactagcaccttttgtagcgccgggttcatcaacaactcgccagaagccaatgccgtcttggaagatgttcctgaagagatagtgcttgcatttgtcacacctggaaaacttgttcgcaactgggacgcggttgacatccctgcagtgccctttgaacataataaccatgcactctctcccaacttcgaatctcctgtctacgaggctgaggaggaggaggatgacgaaatcccggaggaacttgctcggttattggaatatgaaaagaaagccattcggcctcatgaggaggtagtagaggtgattaacttgggaaccaaggaagataagaaggaagtcaagattggggcatcgcttgaggcaactgtcaaacgaagggtgattgaattactcaaagaatacgtcgatgtgttcgcatggtcgtaccaagatatgcccggcttggatccccgtattgtggagcacc

SEQ ID NO: 56787 - DNA, 612 bp, Glycine max
  Peptide Sequence Number=SeqID_173565
atggataggttgacgaccatgatgagtgcactcctgtcagcccagaactctcaagctgccgccgctactgtagagcagcccttggtgagcacaaccccgctatctacggtgacttctccacccctctttttgcctccaggttgtacatggggaatgccacctccagtctgtggaagcccccagcccgctgtatctgaagttccaccgccttttgctcagcagtcagcaccagttccgcaacccagtacctctttccctcaagctgcaatgacttattcagctccactgattcacactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaagggaactcttgtccccgcagtcacttggtgatgtacgcgcggaaaatgtccatgtatactgacaatcataagctgcttattcatttctttcagacagcctaa

SEQ ID NO: 56788 - DNA, 336 bp, Glycine max
  Peptide Sequence Number=SeqID_173566
atgtctcctccacctctaggacctcacgatcactcacaaactcatatcaagctctcaggatggcttcctctcgtagctctggtctctatgaatcttcacacaacaaattctctcaaactctctagaacttggacctttctctctctagaactctctgattatgcagaagcttcaagaaaagggtacatcccttgtggtacaagtagagggtacatctacttgggtttgactgagaacaagagagggtacatctcttgtggattagttctagtggagggtacatccactaggttcaaagagaacaagggagggtacatcccttgtggatctttgctt

SEQ ID NO: 56789 - DNA, 390 bp, Glycine max
  Peptide Sequence Number=SeqID_173567
atgaagaacaaggaacgatacttcaaacgtttcttgaaaatattcaaagggctggagatcactatgccattcggggaagccttacagcagatgcccctatactccaaatttatgaaggacatcctcaccaagaaggggaagtacattgacaatgagaacattgtggtaggtggtgatgccaccttctcttcttcttctatccttccttctggtgtctctatcctttcttcctctggccggtcttcttcttcaaccttaccttcctcctatgctttcttctgccctcgagtcagcacggccttgcattcttcctttgggttcttatccgtgttagccccgaaagttctagtgggtcgttcggctttgtcttgtgccaattggcccatttga

SEQ ID NO: 56790 - DNA, 618 bp, Glycine max
  Peptide Sequence Number=SeqID_173568
atggaggtcaacacggctacaatcgttgctacaagtaccgccactaaggtggacccgactcaccaatttggtctcaaccaagtaaattgcccagcctcggatatggtaggtcaggaaggtgaagcattaggaaatatgggcggcccccattttgtgcaagttttgaacaagcattccttcctaccatatggcttgcctcccaactatacatcacccaatgttgcacacgctcccaatgagaatgtcgataactccgctcccaaaccattgggagccaataaccctaatctgatcatgcacatactacctcctaccgtagtggaaagggagaaatttgatcatatagagaaaaggctgagggctattgaaggagacgaagattatgcctttgctaacatggtagaactgtgcctagttcctgacgtcaatatccctccgaagttcaaggtgccggatttcaataagtacaaggggactacttaccccaagaatcacctgaagatgtacaacaggaaaatgggggcatactcaaaaaatgaaaaattgttgatgcatttcttccaggaaagtattattgggtcagctatcacctggtatactaatttggaaccttcctga

SEQ ID NO: 56791 - DNA, 105 bp, Glycine max
  Peptide Sequence Number=SeqID_173569
atgcttgtttctgcaatgcattgttccatacggaggcactgtatagactttgagatggccaatgtgcaaaggaagaactccgatgagaattcaaatatcggtctg

SEQ ID NO: 56792 - DNA, 306 bp, Glycine max
  Peptide Sequence Number=SeqID_173570
atgtaccctcccttgttctctttgaacaacctagtggatgtaccctccactagaactgatccacaagagatgtaccctctcttgttctcagtcacaacaacccaagtagatgtaccctctacttgtaccacaaaggatgtaccctccaatgtgttaagacaaagttctcaggcgggagaagggagaaacaaaagaattcaagcggttagtcctttgttctttcggaaaagggagaaaagagacacaaaaagaattcaggcggttaatccttggagaattctttttggcaaagggagaagggaatga

SEQ ID NO: 56793 - DNA, 183 bp, Glycine max
  Peptide Sequence Number=SeqID_173571
atggagaattggcgaacagcgctacgcaataacttcgcggggctccagactccgctaggcaataacattcatggggctccgaaaaaaagtggagaatggagaattggcgaacaccgctacgcaataacttcgcggggctccagactcgttggtggaggatgcatgaacagcgctaggcaataa

SEQ ID NO: 56794 - DNA, 882 bp, Glycine max
  Peptide Sequence Number=SeqID_173572
atggaacttcgccacctgcgttatttcgttgccgttgctgaaacgcagcactttacccgcgccgccgagttgctgggcatgtcgcagccaccgctgagccagcaaatccagcgactggagcacgagatcggcacgccgttgctaaagcgcctgacgcgcggcgtggaactgaccgatgcgggccgcgcgtttctgcccgatgcgatagcgattgtgcagctggccgatatggcgctggaaaaggcgcgcggcgtggcgcgcggcatgagcggccagatgtcactgggttttgccagctcggtggcgtttggcgcgccggtgtttgatctgattcgcgccttcaaaacgcgctacccggcgatggagctcatcacccgggaagagaacatggcgctgctgatgcaggacttaggggaaggtttgctggatgcggcgttcattcgtctgccgtgtgagagcagtaaggcgtttaacctgaaagtgatcgctaccgaggagatgaaagtggcgctgccggccagccatgcgctcagccagcagcaaagtgttgcgctaacgcagctggccgaagaatcactgattattttcccgcgcgaggttgcgcccagcctgtacgaattaatcgtcagtgcctgtctgcgcgccggctttgatgcaacccgctttcagcaggctccgcagattacctcctcgctcggcatggtgggcgcaggctgcgggattgcgctggtgccggcttcgctgtgctgtgtcaacaatccacagctggtatttcgtgacattgaaaacaatacgctgttcaccgacattgcttttgcctggcggcgtaatcatccggccaaaacggttttacacctgctgagtttgattaacggggaataa

SEQ ID NO: 56795 - DNA, 231 bp, Glycine max
  Peptide Sequence Number=SeqID_173573
atgtgtaactttgtatctgattgttcatgcgaagatcagctaaaggcatccgtcactcaactgggacagcaatcaccagaaaaggttatctatcagacctccctgatgagtgcgctgctcaacggcgtctatgacggttcaaccaccgtcgcgcagctgttacagaagggcgattttggcctcggcccgttcaatcagctggatggagaactggtggcatttgaccggcag

SEQ ID NO: 56796 - DNA, 1734 bp, Glycine max
  Peptide Sequence Number=SeqID_173574
atgacagatgccggtgttaagcctaccatgagaaagaccattataatatttacgcttattaaccacgccagcggcagggccggcgcggaggaaattatgctgatgaatttcaacggtgacgacgatcgccgcgcacgggcattgaaggcgctgcgcagtcgcgacgaaagccgtgacgacgtattgcaaaactttgtccggctgaccagtcaggcactgggtattccaggtagctttgtctccgttctggatgatgaacatcagcatatctgcgccgcccataattttgcgctggagcactcgtcccgcgaggactcgctgtgccgccacgccgttgacagtgacggcgcggtagttatctccgacaccctgctggatgcgcgttttgcccgccatccgctgatcatcggtgccccttttatccgcttttacgccggtgtgccgctcagacatcgcgatggctatgtgctgggcacgctgtgcgtcacggacgtggcaccacacgcgttcagcgctgatcaggtgaaggtattacagctgctggccgatctggtgatgtccttcctcgaagcgtggcactgcgccggcttcaccgatccggtcacggcactgcctaaccgccagcgcctgattcgcgacctgcagcggctggcctccatcggggaccgaacgccgcagcggctgatcctgatcgactgcattgatatgccgcgcgcctatgagctggcgcgctccatgggcatggggccggtggaaagcctgctgaagcacgtcaccacgttactgcctttgcgcctgcagcctggtgcggacgacatcatttataccgtcgccaccgggcgttttgcgattctcaccatggataacagcccgctgaccgccgcatcggtggcggaaaacctggcagggatcagcgcggatttggacgcgggcatctctgtcgccctcacctgctttaccggcgattggcaaccgggtgcccgccatgagcttcagcctggtggccgatcagcgccgcactcaggactttctgctgatgaacgatctggctgcggcactgcaacaggatcagggcctgtggctggcgttccagccgaagatctgcctgaacagtggccggcccattggactggaggcactggtgcgctggcggcatccgcagcgcggcgaactcgctcccgatctgtttatcccgctggcggaacagaccgagctgctcagcgccttaaccagctgggtgaccgacaaggcgatcgccaggttaaaacgcctgcagcacagccccctccagctgccagtgaccatcaatatcagcagccgcgacttctcagatcccgtcccgcggcgctacaggggctggagatgctgaagctgcgtgggtttggcatctcgctggatgactttggcaccggctacagcaatatcggctacctgcgacggatgccgctggatgtgatcaagcttgatcgtgcgctgatcagcgaaattgcctcagacaccgcgtcgcggattatcgcgcgcagcatcattaccatgctgaaacagctggattacaccgttctggctgaaggcgtagagaatgtcgacaccgttgccgcgctggcggagtacggctgcgatcaggcgcaggtgtacgccggggagcgtctggagcagagtccgtggcaatacgatgactctgttagcttaaagcagaatgatacttcaaaggtgaaacagaaatacccggcttag

SEQ ID NO: 56797 - DNA, 384 bp, Glycine max
  Peptide Sequence Number=SeqID_173575
gtggtggtacctccaggatctattccttcagttgagcagttcagggagatggtagcctggcccgggacccaaccttctcttcatagggaagatgaaggtcccacagctcaggccaccatcccagagccatttgttataggagaagaggcagaggagacacaggtagctgctgccactcctgaccgatcccttgaggctacttcagagccttttgcaccagtggtgagcctaccctcacctcagcctgcagcaaacccctccactcctcttctagagatgccagaggacccgactacaccagtcctggctatggacccttctcctctagctactccagtattccatctgacagatgatgaggatgttcagacacatgacacctag

SEQ ID NO: 56798 - DNA, 816 bp, Glycine max
  Peptide Sequence Number=SeqID_173576
atggggggaatttcccgaaggaatgggatgcctctgcaaaacattatggaagttgaagtttttgattgttggggtattgatttcatgggtccatttccttcatttgcaggaaatgaatacattttggtagttgttgattatgtgtctaaatgggtggaagctatggccacttcaagaaatgatgctaagactgtggtgaagtttatcaagaagaatatttttgctcgatttggggtacctcaaatcttaatcagtgatggtggttcgcatttttgtaatactcaacttcaaaaggtgttgagtcaatatcatgtaaatcatagagtggcatccccctgccaccctcaaactaatgggcaagtcaaagtatccaacagagaattaaagaaaatactagagaaaacagtagcgtcaaccagaaaagattggtcatccaaattggaagatgcactgtgggcttacagaactgcatacaaaactccaattggtctgtctccttttcaactggtgtatggaaaatcatgttatttaccagttgaaatggaacacaaggcatattgggctctgaaacttttgaactttgataagaaggcatccagggagcacagaaagatccatttgttggagctggaaaaaatacgattaatagcttatgaatctttaagactttacaaagaaaaagtcatgacctatcatgacaaaaaactattgaagacttcaaaccgggacaatagaaagtttcgatcttacggtgcaatagagctatatgacccacaatctcagaatcctgacagaacatgggtagtaaatggctag

SEQ ID NO: 56799 - DNA, 168 bp, Glycine max
  Peptide Sequence Number=SeqID_173577
atggatggtctccggacgaaattaggggcacagaatgaccataatttgtctctgcgtagctttttgacacgatcgagcctaggcggcaaggcgcagaatgaccataatttgtctctgcgtgccaccggacacgatcgcctctggatggtgaaaaggtgcacggaatga

SEQ ID NO: 56800 - DNA, 317 bp, Glycine max
  Peptide Sequence Number=SeqID_173578
gggttgagaatggagaattgcacaaagcaatcactacgcatggctccaaactcgaaaatggaggacacatgaacgaaaacgcaattcatggggctccgaaaaatgggttgagaatggagaattgcactaagcaatcactacgcatggctcgaaactcgaaggttgagaatggagaattgcacaaagcaatcactatgcatggctcgaaactcgaagatggaggacacatgaacgaaaacgcaattcatggggctccgaaaagattgagagtggagaattgcactaatcaatacgcatgggtacgatctagaaggtag

SEQ ID NO: 56801 - DNA, 329 bp, Glycine max
  Peptide Sequence Number=SeqID_173579
tggtacctggagatatgtcgcgggggtcaggagaccttggggacgtcaggcgagctcctggcagtcaacagataaaaggaacaaagaccacaaagcaaggaggcttgtggtggctggccagctgtgaatcttgtgtgatatatgggtttttgcctctggtaatcgattaccaagggcttgaaaacgaggttgtagaggcctctggtaatcgattaccagtctgtgtaatcgattacacagaggaatgggtcactggtaatcgattaccaggtatgtgtaatcgattacacagtgcctttttcaggttttcatgtcctgaagctgtgtga

SEQ ID NO: 56802 - DNA, 267 bp, Glycine max
  Peptide Sequence Number=SeqID_173580
atgctacttgactttcaggaagcatccaaactgttggaagcagaaccaaaatctggtgatgactacaagtcactaccgagtggtccaactgagtcactatttgaggaggcccctttactaaaaaatatttattggaaagaattatcactccttgcgtatgtttgggtggcttttttcattgttcagattgttaaggtaaggttacttctagacatatttggatactacatgtcagatgaatttcagcaatcaattctagttgtttga

SEQ ID NO: 56803 - DNA, 552 bp, Glycine max
  Peptide Sequence Number=SeqID_173581
atggaaaacacaattttctctacaggtatctccaatggagttgagaacgggaaagagtcatcggacaacggtgggaagagtgattcaatttcgtttaaggatatcgtgatgaagaataaggagaagatggaaactaggccaaggaaggatctcttcaaggagaatttggctcgatgcacaagtgatcaaaatcctagggaaaactattgggtcaccatgaagaagcgtctcacgagaacttggaaacttgttgcaagtttcacttttctagatattggccacggtttttacatgactaaatttgacaatgaagaggacaacaagaaagtcataaaggagggaccacggcttattttttatcactacgtaacggagcaagcctggtcaccctctttattctcgtcagaagcaaagatcaacaaaacctttatgtgggtgagatttccaagtcttaatctcatagtttatgatgaaagtattttgttggctatggctgcaacaattggcactcctataaaagtggactctaataagctaaatgtgcgtagatga

SEQ ID NO: 56804 - DNA, 489 bp, Glycine max
  Peptide Sequence Number=SeqID_173582
atgaaaccagtagttacagatgagaagtttcatacgcctaatcacggaggttttgatggagtcataaaaacaaaaaatgcaaagcctgtttccaatatccaagtggcgacgaagacaaacctagggaaatcagtggaggacatgtcaaagcaatcattaaatgggtcccacgttgatgattcattgaatggggaatggttaatggttaggaagaaaaaatggaataacgttggttaccaaaataagagaggtttggctttgattgataataaatcaaaactgaaatttgatggcaggaataaggggaagaatacagtggttgtgtatggggccaaaatagtggataatgagccaaaatttgaagtagggttatccaatatttctcatgaggggaaatacttgtactcgagggcatgtcacttggcttggaactcctttaagactcaggctgatcaccatggggggagttatctgtgcacgataggatga

SEQ ID NO: 56805 - DNA, 438 bp, Glycine max
  Peptide Sequence Number=SeqID_173583
atgtatatcgcgaaaaatttactttcgtttttcataagtcgttacatcctagaaaatgctagatttgggggtattattcatgactcctttggcaattggcatgttggtttctatggctcttgtggtatggctatgtcactagaggctgaactactagctattcttcatggtttgaatttatcttgggataaaggctttaggaatattcaatgtgagttaaacttcacattggctttacaattgattttagagggaaggaattcacttcatccttatgctttaaccatacaaaagattcaagactttaagctcctcgattgggaccttcacttcaatcatacctttcgcaaaggaaacatgtgtggagatgaacttgctaaaagaggttccttattccaatgtaatctccaagtgtttgatgactgccccccttcataa

SEQ ID NO: 56806 - DNA, 1266 bp, Glycine max
  Peptide Sequence Number=SeqID_173584
atgggcctttctttcagaaacgaccttactcaatgcttcagagatgagtcaaagtcaacaaacacttacgctcaccacacagggtttgaaatggaggcgaaggacaaagtgaagaacgaggattctgcagcggagtctccaacttcggtccttgaagacgaggatgtctgtgccctgaaagaggaagttaagttggaggaaatggtgactgcagacgttaaagatgacgggtcctctcttatatcgaaaacaatggtggaggaggaagagaagctacttgaagctaggataaaggaagaggaggtgcagtatgaggaggcagtagaccttaatgacatacagtttaacaaattggatgagcttttgactcaaaccagactgtactctgagtttctgctcgaaaaaatggatgacatcacacttgctgtgggtgaacaagagaacagggaagagcaagagagcaatccttctgcgaagaagggccgtggatcaaaaagaaaagttgcttcccagtacaatactaggaaggctaaaaaggcagttgctgccatgctgacaagatctaaagaaagtgagaagactgaagatatgaacatgactgaggaagaaagagttgagaaagagcagaaagagctcatgcctttactcacaggtggaaaattgaagaattatcaactgaaaggtgtaaagtggttgatttccttgtggcaaaatggattgaatgggattcttgctgatcaaatgggtcttgggaagacaatccaaacgattggatttctctcacatctaaaagcaaaaggtctggatgggccgtacatgataattgctcctttatcaaccctctcaaactgggtgaacgagatttctaggtttgcaccatcactccctgccgttatctaccatggtgacaagaaacagagagatgatatccggaggaaacatatgcccactagaacaattggcccgcaatttcctatagtcataacttcttacgagattgctttaaatgatgccaagaaatatttcaggtcatacaattggaaatatcttgttgttgatgagggacacagactcaaaaactcacaatgcaaattagtgaaggcattgaaattcataaatgttgaaaacaagcttcttttaactggaactcctcttcagaataacttggctgaactatggtctctgctgaacttcattttgcctgatatttttgcatcccttgaagaatttgagtcatgtcatcatcagatgatgtgccaactctga

SEQ ID NO: 56807 - DNA, 231 bp, Glycine max
  Peptide Sequence Number=SeqID_173585
atgataacccgctctaaaattgtggagcagctccgagattaccagattcgtcacaagcgcaactactctgctcttacttacttctcgccgaagccccatatccaaaccagagcttgcagtatggtgtggagtggggatattgccaagcccgttagagtgattgatctcaaaaatttgggcagaaggggcaaggcaatttctctaattttagatgagaacaaaataatatga

SEQ ID NO: 56808 - DNA, 137 bp, Glycine max
  Peptide Sequence Number=SeqID_173586
ggttgatgttgctgtggcgattggttttgctttactgttcctcatgcttgcaaacattagcgaggaacagggaaagaagactgccattgtccatatgagagttcattctggtgcggtggtatcttgcttgtacactg

SEQ ID NO: 56809 - DNA, 405 bp, Glycine max
  Peptide Sequence Number=SeqID_173587
ggcacgcaaaacagccgctccgccgcggccgtgagactctccgactccaccaccatgcaaaaggcggctaactgggcacatatccagtttcattaccgaccgaggaaatcaatcatgattacgctcaacgtcttttttcaggtcaatccggccaagcggcaagcgtttctgagcctgctcaacaccatggtgcaggaatccaataaagaaaccggctgctctttttaccagctttggcaatgccagagcgatgagaacagctacgcgctgatcgaaaactgggacgataaggcggcgctttcagcacaccagaaaacgcctcattggatcgcctttaacgatgtcgttaacagttatttgacccatgattacgatgagcatcattacacggaaatcgctcgttaa

SEQ ID NO: 56810 - DNA, 198 bp, Glycine max
  Peptide Sequence Number=SeqID_173588
atgaccactcttacacagatgtggatgacgttactacttaacaacattctgtccagcgatcgcaataccgatctcccactgcggaaggatcgtgcccacaaggcacctagtggacccggaggagtccaacagggccctggggtttccagctcgggttacgggcctccgttagtcctacaaggtgtccgttccccctaa

SEQ ID NO: 56811 - DNA, 288 bp, Glycine max
  Peptide Sequence Number=SeqID_173589
atgcatgagacttcgaactccacgctaagtcaactccataaggcttcctcgtccaatctgaggatcgtaagtcgttatgtgtatccggtcgtggtcgatcataatcgtctatttaaggatatcaaatatagccatgatcgggagtttggcacacgtgtcaggataaatcggattctcaaagctaaccatgattggtattttgaaatacagaccaagatagatcagattctcaaagctaacttgctagggcccgactcaaagggtacacttataaatttaaaaatataa

SEQ ID NO: 56812 - DNA, 168 bp, Glycine max
  Peptide Sequence Number=SeqID_173590
atgattcgggggctccatgctcacttgaccattattgagttaccgtttagatcgttactagtactatgggttagtcatattgagagggcatttccctacttatggctaagtcatgggctggagcttagtctgaagacaaagacaatctggagaccaacaaatctttag

SEQ ID NO: 56813 - DNA, 408 bp, Glycine max
  Peptide Sequence Number=SeqID_173591
atgtttgggtttggctatgatccgtcaattgttggaaaaaaccttaaaggttttcctgttctttggactttacctaaagttggtggagtgtatctgagtggaacccttaattgggttgttattatgggaaaagaaaccattcattctgaaatcgtaattgtttctgttgacctggagaaggagacttgcagatcactgtttcttcccgacgatttttgcttttttgatacaaatattggagtttttagagactcgctgtgcgtttggcaagatagcaacacccatcttggcttgtggcagatgaggaagtttggagatgacaagtcttggattcaattaataaattaccagaaaaatcgaagattttaccattgtgcatgtctaacaatggagatttcttcatgctga

SEQ ID NO: 56814 - DNA, 705 bp, Glycine max
  Peptide Sequence Number=SeqID_173592
atggcaacgctggcaatgaatgcttatgcggcagagaaaattcgctttgctgcctcagccacctatcccccgttcgaatcactcgatcaaaataaccggattgtcggttttgatatcgacctcgctaaagcgctgtgtcagcagatgcaggccgagtgcactttcaccaacaatgcctttgatagcctgattccttcgctgaaattccgtcgctatgacgcggtcatttccggcatggatatcaccgccgagcgcagtaagcaggtcgatttcacccagccctactacgccaattcggcaatcgtcatcgcccaccaaggtgaatatagcgattttagccagctgaaaggcaaacgcatcggcgtggaaaacggcaccacccatcagaaatacctgctggagaagcatcctgaagtaattgcggtggcctacgacagctaccagaacgcgattcttgacctgaaaaatggccggctcaacggcgtatttggtgacagcgcagtcgtcaatcagtggctgaaggccaatacggatttgagcacggtcggcgagcacattaccgacagcgactacttcggcaccgggctcggcattgcggtgcgcaagggcaacagcgcgctgctgcaacagctgaacagcgcgctggcggcgctgaaagccaacggtcgctggcagcagatcaatcagaaatggttcccggaataa

SEQ ID NO: 56815 - DNA, 608 bp, Glycine max
  Peptide Sequence Number=SeqID_173593
ctgtagtttacttcctctatggatatggtggaactggcaaaacatttgtttggacaaccttatcatctgctatacgctccaatggtagaattgtttgtacagttgcttcaagtggaattgcttcattactattgcctggtggtcggacagcgcattccaaatttgctataccagtccctgcaacacaaaattcgacatgcaatattcatcaaggcagtgagttagctgaattattaaaggttacaaaactaatagtctgggatgaagctccaatgtgtcacagatttgcatttgaggcactagataaaagccttaaagacatcatgccgaacaatctgccttttggaggaaaaattgtagtttttggtggagatttccgacagatcttgcctattgttccaaaaggtaatcgctcagacattgttcatgcaactataaatgcatcatacatttgggaccatttccaaattcttaaactcacaaaaaacatgagattgttatcaagtgctcccgaacagcccgacaatcaagagctcaaacaattttcagaatggctacttgacataggagatggaaaaattggacaagataatgacggattttcataa

SEQ ID NO: 56816 - DNA, 495 bp, Glycine max
  Peptide Sequence Number=SeqID_173594
atggggctgctcgatcaatgggctgaacgtcatatccttgatgcccaggataaaggcgagtttgacaatctgcccggccagggccaaccgttggcgctggaagatgacagcgcggtgccggctgaactgcgcgccggttaccgtttgctgaaaaatgccggttacctgccgccggcgctggaagatcgcaaagaggcgttgaccgttgctcgtttgctgcaagggattaacacgtgcattggacggcaaattcacccgggaggagaagtaatgttcaagataggtcagttggccaagcttgccgaagtgacgccggataccgtgcgttactatgaaaagcagggcatgatggatcacaatgtccgcaccgaaggtggttatcggctctacaccgagcaggatctgcagcggctgcgcttcattcgctatgccaagcagctgggatttactctggaaacgatcgctgagctgctgtcgatcccgcgtcgatcctga

SEQ ID NO: 56817 - DNA, 147 bp, Glycine max
  Peptide Sequence Number=SeqID_173595
atgacaccaggacacgcatcagatcctctgcctgatggtcatgccccacagccccgagtcgtccctcaggccccgcaaacggatatccctcatgtgccggagccaggagcatcgtcgacatctgtggaggagcttagacatgcagtg

SEQ ID NO: 56818 - DNA, 872 bp, Glycine max
  Peptide Sequence Number=SeqID_173596
ggctattgagttgggctgctgaatacaaatatcgactcgatggtaaacagctgttgcataactactctatggaacagcaggcttcaatcatcgctgattattggttcctgaagaagatgaaccgcattattttggctggaatgctgactttgctgctcgccggctgtatgcacatgaacgatccgaggccaaagaactacgcggccagcgtcactgtggttgataaccacgtttgcgtgcgggttcaaccggaaggggacgagcggttggccggcgtcattatcgaagaaatcggcaacgccaacgctatcttcggcaagaacttcgcggataacgagatgcctgcggtcaccgcggctacgtgtattcccgacgataactataaattcgaagacgggaagtcttacggggtatcggtgacgctgttgtcgcgggataaacgaagtaaaggtattgagcctgctgcccggctatttggggcagggtgggtttgtcgaaccgccttatgcccttggccgatgatttatttcgccttgcggaagctttttgcctcggccggtcagaaacgccttcgaacgcccttcgccgagggtatatttctccaccacttccacctcgcgcttcagctccagcccgtaccagcgcggctggcggttgtccggtttgacgtcgcactggtgcgccatggtgacgttggccagcagcgtgcgggtctcgtcgcggctttcgaagcgcgggatggccggcggcagcgcctgcaggtatttggcgtcggtggagtagacgcggatgcggttcaggctgtcggtgctttccagcgtcgccagcagcgcccggccaaactgcgccggatcggcgtccggggatttgat

SEQ ID NO: 56819 - DNA, 378 bp, Glycine max
  Peptide Sequence Number=SeqID_173597
atgttgagattcttgatacttctaccccccctccaaccttcaccctttatggtccttccacctcatacttctaaaccctcaccaagaagaagaagagaagaagaagaagaagaagaagaagacatcattgcctcaatggaagctctgtctattgaggagcataagaagaaaattgttgaagatgctaggctggttgccctgacagggaagaggaaaacatctaaggaagccaccatggtaaagacagatggtgatattattgaaacaaacttaggagttgaaacagttaaaccaaggccaatgtttgaagctaatgcacaagcaccagatgttgaatcaagtggcctcggaataattaagaagggggggttgaattaa

SEQ ID NO: 56820 - DNA, 261 bp, Glycine max
  Peptide Sequence Number=SeqID_173598
atggttggtgcttttgacggagggtttgaaggtttgggatcatatgaaggttgtttcttgggtttcttggttgtgtctgaaggtgggtcagatggtggtgaaggtggttcttttgttatagtagtgtgcctaaaagcaagagactcactatggtacttggataatggctgcactaggcacatgactggtgacaagtccagacttactaatcctgttgatggaagcttgcttgtggggcttctatggaggctgaatctttga

SEQ ID NO: 56821 - DNA, 572 bp, Glycine max
  Peptide Sequence Number=SeqID_173599
gaaaccatacctcttctaagggttctacccctcattggccagaatttctaaaaagtccaaatctcggcgcaggaattagaccgccaaaggcaagtcgaaaatggggtggtcggaataccgagaaaatatttggagtcctctttccaaatgtggatgggttggtggacctggcagcgatcgacgtttttctcgcctatcataaccacaaggaaagtccggttgtcgctatgctagccgacctatatgacaccttcgaccgaagatgcccgtctatccgctacaaggttaccactcgtgcttcgaaaaaggaaaggcgaattgggaccaactcttggctagcatgggggggcgacagagagcttaggggaagcagtaatgggatcatcggcggctatcataagtggctgagagtccgaacacaaggactggattggctcccaaatctaaagactgtgagagacgatgaggttaaagcttcggaagaaagtgatgaggtacaacccctaaaggcagagcttgaaagagcctgggtagtcgaagagaagttcaagtccatagccatcaaagtctga

SEQ ID NO: 56822 - DNA, 153 bp, Glycine max
  Peptide Sequence Number=SeqID_173600
atgaaagctaaaaatgaatcgctttttttggacgatggagaccccagccggcctactggccggctgccacggcgtaggaaatttttttctaccccaaatgcatatataataattgcgattctgataaccggagcaaaagttatggccgtttga

SEQ ID NO: 56823 - DNA, 252 bp, Glycine max
  Peptide Sequence Number=SeqID_173601
atggataaagttgatatctttgtccctcatcctctcacaaacgcatgtttgcttattcaactttcaccggaatgtgggtgtaagccattggtctgtttgctcaagcaacctgcgctcctgagtgttgacttccaagaccgttcaatcagagattactcatcttgcacgttggtggggagaagtgagttatcaagaataggatgttggacaaatggcctcagttaccttgagaagaagaggggattgaattaa

SEQ ID NO: 56824 - DNA, 177 bp, Glycine max
  Peptide Sequence Number=SeqID_173602
accccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 56825 - DNA, 318 bp, Glycine max
  Peptide Sequence Number=SeqID_173603
atgagattcttcatagtcatccacctattcatatgctcccatgaacaaaaagttccagatcatcacaggatccaaacacaaacaacacacaggaagtcagggaaaaaccacgtcggacgcctaggagtacatgacaagacaaaccacacactaggagaccagtcaaggtcacagtgttttacgagaatgctccaaccatatgggatcaacataggcttaaaggagcactcaaaccgggtgacccccaaggcctacactccgaagagtccgtcagggcctctccctcctgattcaggtccaacccagaaaacattttag

SEQ ID NO: 56826 - DNA, 273 bp, Glycine max
  Peptide Sequence Number=SeqID_173604
atgtctaaggtacctgggcttagcgagacaacactcgctaagccacagcgcacacagatgctgcttagccgcaatgttcataaagaagatgaacattcaacaacatggatgaactcgcttagcgcaggcatgctggctaagcgagtttgtcttgaaatgcatatattcaaggcttacttgatgagctcgcttagcgcatcagacgtgcttagcgagatcatcgcgttttccagaaaaacacagatgaagaagtttttcgacttcctcttttag

SEQ ID NO: 56827 - DNA, 135 bp, Glycine max
  Peptide Sequence Number=SeqID_173605
gctgaagatggtgctgttgggatggagttgaccttgaagattactgcagctaagaaagaggaagaagaagaagaagctaagatgaagtatgggagtagaagccagaaaagaatgttattgatattcatcctttaa

SEQ ID NO: 56828 - DNA, 453 bp, Glycine max
  Peptide Sequence Number=SeqID_173606
accgctgatccctctgctatcggtagtcgccaaccgtggttggcgccgccgctcgcggcggtcaaagaaaaaccccgctgcgtgagcagcggggttttgggtgtaaaccctggcgatgacctactctcgcatggcttgagccacactaccatcggcgcagctgcgtttcacttccgagttcgggatgggatcgggtggttccacagcgctaatttcaccagggagacggttgcagcagcgcttgcagcgccagcttcgcgatcttgcccttggggcggaagcggggttttgggtgtaaaccctggcgatgacctactctcgcatggcttgagccacactaccatcggcgcagctgcgtttcacttccgagttcgggatgggatcgggtggttccacagcgctaatttcaccagggaggcggttggagcgtcgccatccgatacagccggataa

SEQ ID NO: 56829 - DNA, 453 bp, Glycine max
  Peptide Sequence Number=SeqID_173607
atgaacatcggtgctctcattttagcacatatgacttccattgcccagtctaactcttgtagacttggcctcacatttgagtgcctgagcccggccattaacttggccaacatcaggaagaactgttggaacattgatgatctaacaatttctttccgaggggctaggagggcaagggcaaggctggctaatattccatctacttctgcagctctagcacctactccagcatctacttttgcagctccttcaattccagctcatgttgactcactgcgctttgaaaccatgcttcaaagtatccctcagggacagattctattgctgcagagtctacaggtggtagctcctctaggaaccatcctatcagtggagcagttcttagagagggtagcctggcctggggcccaaccttctcttgatagggaaggtgaaggtcctgttagtcggtga

SEQ ID NO: 56830 - DNA, 168 bp, Glycine max
  Peptide Sequence Number=SeqID_173608
atgaaacaccgctccaaactcgaaagcggaggacacatgaacgccctacgcaagatcattcatgtggttccggaaatcatggaacacagctccaaactcgaaaacggaggacacatgaatgacaatgcaattcactcacgtggctccggaacaggaggattgccttga

SEQ ID NO: 56831 - DNA, 519 bp, Glycine max
  Peptide Sequence Number=SeqID_173609
atggctgccttccatggctgccactcgctgtacagagcttccatggacgccttccatagctgccactcgccaaaggaagcttccatggctgccgaggaccgccttgaggccgccttggccaaccttgctgcccgctcaacgccgcctcgaatcctcactggatgcctttctcctaagattgcctcggcgactcggccaccactacccttcttcctccctgcaatcaccaccgtcgctgcccttgctgttcaagccaactccgtcacccacgcttaccgcacccacgaccatgccaactccgccgctacccccgctgctcacgaaagccccgtcctcctccgcacaaccacacccacgtcagctccgcctcccttggctgttttccgccatcccaaactcaaaacagtcgcacccatagctccgctgccgcttcctcgctttcatttgaacaaccgccacatccggctcaatcatccattgcctttatcactccgcaccgcccaccgttgttaccgtcac

SEQ ID NO: 56832 - DNA, 444 bp, Glycine max
  Peptide Sequence Number=SeqID_173610
atgaagactacaccagtcattgggcttgcctaccaacatacattcactgtccccatttctaaaaccgttccagccctctatccggaagccgctgagttccaggtcatgcctgtcgtatttgccactggttttatggtcggcttgcttgagtgggcgtgcatcaaggcgatccatccatacctggattggcctgacgaacaaacggtaggcacacacatcaatgtgtgccaccaggcgcctacgccgccgggaatgactgtcacagtgtcggtagcgctacttgcgatagagggccgtaagctggtattttcagtagaggcgcacgacggcatagacttgattgcacgtggtacacacgagcgctttatcattcagcgtgatcgctttgatgccaagctctccgccaagttagcggctcatcaacctccgttgcctcacggataa

SEQ ID NO: 56833 - DNA, 534 bp, Glycine max
  Peptide Sequence Number=SeqID_173611
atggcacctattaagaaaaaaagatgggaaactcatacctcaaatgatttggaattggttttgcctgatgttgtaattgacctccgtcgcaacttacccttcgacgggagggcgacacagggctcacaggttcgtcttccaagggaggaaggcgcgcaaagtcgccaccaacatttattcgaggaaaacgttggaaaaaccagaatgtgtggtctacgaactttaatcgtgaaaggtttgggagttatttttacgcacggggaaggtattagcaccctacgcgtccgacacaagggacggcagctgtcgcaacctacccttttgcgggcgagcgaggcgaggttcgcgggtgcattttccaaaggaggaaaatgcgcggagtcgccactgtcgcaacctacccttcggcgggagggcgacgcacgactcacgggatgcgtgttccacgaaaggaatacgcgcggagtcgccaccaacgtttatttgaggaaaacgtcggaaaaaccggaaaagacgcgatctacgaacttttaa

SEQ ID NO: 56834 - DNA, 276 bp, Glycine max
  Peptide Sequence Number=SeqID_173612
atgtctagcgaaagtaaagcctctgagtgtgatacaaccattcgtaaaatcttcaccacaattgtgatcattgattatgagcccattgattttcggagaaactctgagtttcaagacagggagaacaactccagagttcttgggaagaaagtcattctgtctatgaagacaattgctcaaatcactggttttatgaggaaaggtaagaagtatcacagtgattgtgagaagacttatgagaaacatcacttggccgataagttgaagctaacatga

SEQ ID NO: 56835 - DNA, 192 bp, Glycine max
  Peptide Sequence Number=SeqID_173613
atgacaaaggatgtgatccatagtcataactctgcagcgcctggctccattttctcacactttcttccttactgcgagcttccaatgccaatctgccgactcagcgagccatccactgagcgcaacaatcctttggctaagcgcgaggaagaatatggaagaaggatgagctgtgcatgtttgctgagcgag

SEQ ID NO: 56836 - DNA, 372 bp, Glycine max
  Peptide Sequence Number=SeqID_173614
atgtctggacacttttcccaatttgagaacaaaagcatccttggaacaagatgggtattcaaaaataagctagatgaacaaggtaaggtggtaaggaacaaagctaggttagtagctaaaggctataaccataaagaaggtatagacttcacaaaaacctttgctcctgttgatagacttgaagctatgagaatcatggtttcctttgttgctcataaaaatataaagctatttgaaatggatgttaaaagtgctttcataaatggctatattgaagagaaagtatatgtcagacaactgcctaggtttgaagatcatactcttccaaaccatgttttcaaaattaaaaaggctatgtatggttcgaaatag

SEQ ID NO: 56837 - DNA, 408 bp, Glycine max
  Peptide Sequence Number=SeqID_173615
caagatggtgatcttgatttgaatgcttcccctcaagcacttgacagactgttgggtcatgtgcttgcttttaaggtcaggattcaatcaaaattcaagaatgtcgttgttcttagatactcaaatgaactagatttgatcaatgttgttctcaagatgttggctgatagtgaggcatgttccaaaatagatccttcgaacgttgattgcaataatgctacccatgctgaatgtcaatctctatctgtgacagccgaccatgatccatttgcaggattccctttaacgcccaaaaagcggatgccatctgatgaagttgatgatgagttaggaagctcgcaaatttccctagcccaactatcatctaacaaattaacaagacattctgataaaagtcaatttagctga

SEQ ID NO: 56838 - DNA, 345 bp, Glycine max
  Peptide Sequence Number=SeqID_173616
atgatgattgaaatagaggaggtgcaagagcagatgaaggtcgacatagaggccaagaaagagcaaatgaccacaatgatggaagccatgatgagtatgagaaaaatgatggaggtcagcatggctacagtcgttgccgcaagtaccgccactgaggtggacccacctcacccatctagcctcaaacaagtaaatcatctagtctcggatatggtagggcaaggaggcaaagcgttaggaagtacgggcagcccccattttgtgcaagttcagaacaagcattcatttctaccatatggcttgcctcccaactatacaccacccaatgttgtcacacaaaattag

SEQ ID NO: 56839 - DNA, 1416 bp, Glycine max
  Peptide Sequence Number=SeqID_173617
atgcaacttgaaaatgctcagctaaaagaagagcatgagaaagtgtctagccttcttgcaaggtacttggagaaacaaatgtcaccacctgagctccaacaacaggcttttaatattcctatcataggatcaagttcacatgctccagaacttgaaaattcatcaataaactatgagattggtggaagttcatcaagtcatggtccaagtcgttatggtatgcaaattatggttagtgatgaccataacttattgagaagtgaaggtatagaaaaggcccttatgtttaaggttgccgctgccgcaatgaacgaattggttaggcttattcggattaatgagcccttatggaccaagtcttcaactcaagatgggaagccaattcttcagcatgaaaattatgagaaaatatttccaaggaccaatagtttcaaaggtgccaatctgcgtgtagaagcaacaaaagaatcaggaatagtgagcattaatagcattcaactaattgacatgtttctggatccgaaatacatctacactcataagagaatggtgaatccatctttacaggacaaatgggttaatctgttcccaacaattgttacaaaggcagaaacaatgaaagtaattgaaaatggtttggtaggaagtcgaagtggagccttgcagctgatgtttgaacaaatgcatgttctttcacctttggtgcaacctcgcgagtttcaattccttcgctattgtcagcaaattgaagaaggtgtatgggtgatagcagatgtgtcatttgattcctttcgacaaaaaacctctttttttcactcttggagacatccctctggatgcatgattcaagaaatgcctaatggctgttccatggttacttgggttgaacatgtggaagtggacgataagatccaaacccatcagctatacaaagaccttattgctacaggaattgcatacggagcagaaagatggattatggaacttcaaagaatttgcgagagatttgcttgcttttatgttgaaaggatacctagtcaagactctggaggagtgatcaattctcttgaaggaaggaggagtgtaatgaatttttcgcatcgtatgatcaaagtcttttgtgagagtttaaccatgtcaggtaacttggacttcccacatatgaatatggagaacaatagcggtttgagggtttctattcgcaaaaacagaaaccaccttggtcaaccaaagggcatgattgttgtagctgctacctccatttggcttcctctccattacatgaaagtttttgagttcttcactgatgatagaagacgtgctcagtgggatgttctttgctttggaaatgatgcgaacaaggttgcacacatctcaaatgaaattcatcctggcaattgtatatctatttatcgg

SEQ ID NO: 56840 - DNA, 294 bp, Glycine max
  Peptide Sequence Number=SeqID_173618
atggcaacacaattaacagttgcatatcggatttttgccattaacgttttaatggttgagaatccgaaacgtttgctttcatcagatgcaaccacaaccagtaccccaaaagaagaaaggaatcccaattatttggcaagtaggctttccatttattgtcatgcatcccaactgcagaataacaacaaaacttgtgtttctaatcgatggccgtataatatacataaaactgccctacagctaaccgtctacgatatttctgcagtaagaaattgtgacattaactcgatataa

SEQ ID NO: 56841 - DNA, 654 bp, Glycine max
  Peptide Sequence Number=SeqID_173619
atggctaatctctcgttgttggtggcagttttagctctttcactttcatcagttgctttagcagctgataatagtgctctccaagatttctgtgtggcagacccaaaagggcaagtgttagtgaacggtttggcatgcaaggatccaaaacttgttgaagcaaacgacttcttcttcagcggtcttcacacagcaggcaacaccacaaaccctaatggctcaaaagtgacaccagtcttcgcaactcagcttccagggttgaacactctcggcatctccatggctcgcattgactacgctccatggggaattaaccctcctcacatgcaccctcgcgccaccgagattttaaccgttctcgatggcgccttagaggttggattcgtcacttccaaccccgaaaaccgccacttcagggtggttctacagaagggtgatgcgtttgtgttccccatagggctcgtccattaccagagaaatgttgggtatggcaatgctgtggccattgcagcacttagcagccagaatccaggactcataaccgttgctaatgcggtgtttggggctacgccggatatagatagtgatgttcttgttaaggctttccatttggacaaggctatcgtcaattatctacagtccaacaagttctag

SEQ ID NO: 56842 - DNA, 147 bp, Glycine max
  Peptide Sequence Number=SeqID_173620
atggacaagtctttgaagctaggtgtttgtttcagtgtgagactaaagaagattcagatgcagagatcaatctacatataccttgctggggtagctatgattgctcagactgtccttgcattcagggtcagtgtcaatgtagtttga

SEQ ID NO: 56843 - DNA, 1380 bp, Glycine max
  Peptide Sequence Number=SeqID_173621
atgttggtaaagaggtccggaagggttgatgaggagatcgccatgctttgtcacaagttgaagcaaattgaagatggcttgacctttgtgggaaggactacaaaacaagcgagatctcaaggaaagaagattcaaataacggccgagcaagagatatcgaggatattggggaacttggcctgggcatacttgcaaaaaggagactataaaactgctgaagaacattataggaaagcattgtcctttgaggttgataggaacaaacagtgcaatttggctatatgtttaattcatatgaacaagatcaaagaagcaaagtttctactccaggcagtacgtaccgctacaaaaaatagaaagatggatgattcatttgccaaatcattcgaacgcgcttctcagatgctaattgagatagagacatcatcatcacagaatgcagcattttcaatgacaacacagtgccctccacaaagctttgagaactcgattagaatgagctctgatagtgttcagagtaggtcagaaaaccggtctgagatatctgagggggatgcacctcatgctaggaggagattgtaccagtcccctgatcctagtagaagagatctcagtgttccttgcacaaaaccaaaaagatgttcatggggattcaataatggacatcgaagggaagcttggggagatgccaattcagattataaacctacatttgggactcctcctaatgataagcatgtcacaaggatgctaaactcaagagaaaatggtttctcttcacctgccaatgggaatgggaaggcagcaacattggaagatcctgctatactaaagcatgaagctacaaaagtaacaagttctgattcgttacacactttgaacaccgaatcagctacggagtttactgagaaggagaaatctgctgcagatgacagtagctatggatcaatactgtcagaatcacatgtcacagttgtgaatggtgtcaatgaatttgcttcaggaaaaagaaaacctgagaagaaaagttgggctgacatagtagaagaagagcaaaatgaagaaaatgacttcttcagtggattcacaaattttgatgataagaatggtgcagaagtgtttaatgatgaaaatgaagactccaacataatctatccaagtccctggccacagaaccagcctgatgaatggtcaagcaaaaagcttgaatcattggacaagaaagatggacactatgcatctgagagtgccattctgtcaaggaatccaacagcaaggcgttctttgtgtttcaacccggaactgattggggagaagaggctaactaggagaagtaggttacaggatcatggatctcatttactgaaggaattctattaa

SEQ ID NO: 56844 - DNA, 213 bp, Glycine max
  Peptide Sequence Number=SeqID_173622
atgcctccccctactcttatggtaaaatactacgaattcaaaggatactgggctgccttgcaacgatgttctccgctggcccagcgctgggaaggggtgacgattggtcggtcgcgatcctatcctccattcgcctccctccctaagtacctgcaagtaggagacaaacaatatgcggccaatcgtgaccggtcatcgtcttaccttggttga

SEQ ID NO: 56845 - DNA, 447 bp, Glycine max
  Peptide Sequence Number=SeqID_173623
atgggtagattgtctttttcagttgtgattatgtgcttttctgtccatgggggaactgctgtattaccttcaacagctttgatgcttgcagttcctgcacaaattgcaggatgtaaaactattgttcttgcaaatcctccaactcgggatggcactacatgcaaggaggtactgtattgtgcaaagaaggctggggtgactcacattctcaaagctggaggagcacaggccatatctgccatggcttggggaacagaaacttgtccaaaggttgaaaagatttttggccctggaaaccaatatgtcactgctgcaaaaatgatacttcaaaacagtgaagccatgatttcgattgacatgccggccggtccatccgaagttttggtcattgcagacaagcatgcaattccttcccatgtagctgctgatttgctttcccaggtttaa

SEQ ID NO: 56846 - DNA, 648 bp, Glycine max
  Peptide Sequence Number=SeqID_173624
atgggtgaagtagaggaggtgcaagaacagatgaatgccgacatggagaccatgaaagagcaaatagccacaatgatggaggccatgatgagcatgaagaagataatggaagccaatgcggttgtagttgccgctaccagcgttgttgctaaggtgaacccgatgcccccatctgacctcaaccaaatgaatcatccaacctcagatatggtagccaaagatttgggaagtacggacgaccccatgatgtgcaaattccaaacgggcatgccttcccgccatatggcttgcctcccaactatacaccacccaatgtggcgtacactcccaatgaggatgtcaataactctgctcccatacttattgagagccgacaacctcatagtgtacatgtctctcaacccatgggggagacaccatgaaattccccaccacaatctagccgacttcaagccttgcctcagatatgccactgaagggcaagtagttggtggtatacccctgcaaaacactttggaggggcctcaatttcgccccccaaccacaacccttctatggaaaaatggtgggttacacaccttcaagctttgcagatttggtcttcgccagcgaaaggatcaaagtgggtttggaaaaaggcaaatctga

SEQ ID NO: 56847 - DNA, 558 bp, Glycine max
  Peptide Sequence Number=SeqID_173625
atgattatgaggagccaagacatttatagtagccaagatgaggctactacgtcaccttcctctagtgaaagtgaagaagcaaaagggggagaatctagtgaagaaatctacccccaagaagaaggacaacctttaatggttaaggaggagtgtaaggaggtaagtgtctcctccaagaggttagttaagaaggaaagtcattttgaaataaagacaaatattaaagaaacttcccctcttagacaacctccacatcttctcctttgtaaaaagacacttgttagcactaccacacctcttgggcttgaggttattcctcaagtaaaggagttgttggatgagggtttggttcgtaagagcttaaatccttgtgctttgttggttcccaaaatagatattattaggaataatcaacataaaaatacagagaaagtgatcaaggggttcccacggaccctaaggtttgtcaaggaggtgagcttagtttttagatgggtgtgtgtagctaagctccagcttctcaaggaagcttctcaaggaggtgagcttagtttctag

SEQ ID NO: 56848 - DNA, 1254 bp, Glycine max
  Peptide Sequence Number=SeqID_173626
attcagctgtatgccagcctgctgctgcagctgttcttctttgttgccaacgtgtacggctggtacgcgtggagccggcagaccagcagccatgaagcggcgctgaaaatccgctggctgccgctgccgaaagccatcggctggggcgccgcctgcgtgatcgccattgcgctgatgacgcgctatatcgacccggtattcgctttcctcacgcgcaccgcggtgggtctgatgcagtcgctcggccttaacgtggcgatgccgcagctgcagccagatgccttcccgttctgggattcctgcatgatggtgctgtcgattgtggcgatgatcctgatgacgcgcaaatacgtcgagaactggctgctgtgggtggtgatcaacgttatcagcgtgatgatctttgcgcgtcagggcgtgtatgccatggcgctggagtacgccattctgacgctgatcgcgctgaaacggcacgcgcctgtggatgcagagcgcacgggaacagggttcgcgcgcgctgtccccattagtggtgatgatgcgcgtggccttccagcgctgcgtgctcgtgctgcgtgccgctctcctcgcataactcgcagtccgggccgacgcagggctgatactccatctgcaccgtggcatgggcaatctgataatgctggtgcagatactgatgaatgcgtcgcagcaggccgtcgtgatcgtacggcggaatcacctgcacgtgcagcgtcagcaccggcttttcgcccacctgccacacatgcacatgatgcacattacgcacttcatcaatgtgacctcgtgcaggctctcgcgcagcagcgcccagccgctgcgcaccaccagcagcgccaccagcagcgacagaatcggatcgatcggcgtccagccggtcagcatgatgatcaccgctgccacgatcgcgcccaccgaacccagcagatcgcccagcacgtgcagcgcggcggcacgcacgttgagattcttctcttcgctgccgcgatgcaacagccagaacgacagcagattcgccagcaggccggcaatggcgatgccgagcatcaggccgccttcaatcggctcgggctggtaaaaacggcgcagcgcttcccagacgatcaggacggtaatcaccagcagcgcgatggcgttaacgaacgctgccagcgtggtaagacgcagcaagccaaaagtgtgacgcgcattcggtttgcgccgggcgaactgcacggccagcagcgccattag

SEQ ID NO: 56849 - DNA, 309 bp, Glycine max
  Peptide Sequence Number=SeqID_173627
atgtataaagagaagctaagcttagctattagccatgggcagagactagaggatgagcatgtgaaggtatcaactctgcaagtggaaagggaagcaagggagagggtgatagaatcatttcacgaggaagctgtgaaatggatagatagaatcgctctcactctaaatgggagtcaagagattccaaggttgttagctagagccaatgcaatggcggacgtatactcagctcccgaggaagttcataggctctttgattattgtcaacacatggtcgagttgatgtcccacataattaggaaccgctga

SEQ ID NO: 56850 - DNA, 632 bp, Glycine max
  Peptide Sequence Number=SeqID_173628
ggtaccggccccttgggtacttgttaccctcaccgttgagaggactacacgtcctcaccttcagagggctacacgccctcaccatcagagggctgcacgccctcgcctcgagagggctacatgtcctcaccacgagagggctgcacgccctcacctccagaggactacacaccctcactgtgagaggactacacgtcctcaccatcagagggctgcacgcccttacctccagaggactacatgtcctcgccttgagagggctacacgccctcaccttgggtactagttaccctcaccgtcagaggactacacgtcctcgccttgagaggactacacgtcctcaccatcagagggctgcacgccctcaccttcagaggactacatgtcctcgccttgagagggctacacgccctcatcttggaggactacacgtcctcaccatcagagggctgcacgccctcaccatcagaggactacacgtcctcgccttgagagggctacacgccctcatcttgggactacacgtcctcgccatcagagggctgcacgccctcaccatcagaggactacatgtcctctccttgagagggctacacgccctcaccttgggtactagttaccctcaccgttga

SEQ ID NO: 56851 - DNA, 327 bp, Glycine max
  Peptide Sequence Number=SeqID_173629
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctattccaaagtgtcgtgctgctaggcgaagcagcagagaatgctgcaccctag

SEQ ID NO: 56852 - DNA, 639 bp, Glycine max
  Peptide Sequence Number=SeqID_173630
atgaccggctctctcgatgagtcgatctcttgctttctcataaggttggacccttgggtactagtacctatcgccatcagaggactacacgtcctcgccttcagaggatttcacgtcctcaccttcagagggctacacaccctcatcttcagaggactatacgtcctccccttgagagggctacacgtcctcgccttcggagggctacacgccctcgccttcaaagggtcatgtaccttcacctttagaggactacacgtcctcacctctagaggactacatgtcctcgtcttcagaggactacacgtcctcgccatcagaggactccacgtcctcgcctttagaggactgcacgtcctcgccttcagaggactgcacatcctcgccttcagagggctgcacgccctcacctttagaggacttcacgtcctcaccttcagagggctgcacgtcctcaccttcaaaggactacacgtcctcaccatcagagggctgcaagccctcgccttcagaggactagaagtcctcgccttcagagggctacacgccttcgcttttagagtactacacgtcctcgcctttgagggctacgcatcctcactttcagtgggctccatatccacatctaagagaatttaa

SEQ ID NO: 56853 - DNA, 293 bp, Glycine max
  Peptide Sequence Number=SeqID_173631
atgaccgacaaggccagcggtccctacaagaagaaattaagaacatatttggggattgtcgcttgtgataaggtacttcagactgtcagcgagcggtggagacagtttaaatcaaatttgaccaggaaatgggcacttgcagccgacaaggacgaacaccctggtcgtgtgcgtgctgctggagctggtgtcaccattaagcaatactttggactggctgaacggacctctcacacttcttcttccatcactccagaaggactagagcaactgactcaacaaattagggacca

SEQ ID NO: 56854 - DNA, 360 bp, Glycine max
  Peptide Sequence Number=SeqID_173632
atgagatttaaagagatgcaagagaaaggattaattccggatgtcgtgacttatagtacacttattgagtgttttggcaagacggataaagttgagatggcctgtaggttgtttgatgaaatgcttgctgaagaatgcactcctaacttgatcacatataatattttgcttgactgtcttgaaaagagtggaagaactgctgaggcagtggacctctatgcaaaactcgagcagcaaggtttgacaccagattcaattacgtatgcagtgcttgagcggttgcaaagtggtggacaccggaagttgagatttcgacagcagaacccgatcacaggctgggttgttagccctttaagatga

SEQ ID NO: 56855 - DNA, 303 bp, Glycine max
  Peptide Sequence Number=SeqID_173633
atgtctactcttccagccctgccaaagctggagatcaaaatattgtatgtaaatatgtctgaacccgacgaggatgttgacggtggagatggagccgcgaaaggcgcggcggtccatgtcgcggaggagctcgcgcgcctggtcgaatcgagcagggttggtggacttggagaggatgaggaagtggcggttgtagaattggaagaatcggagggcgagggaggggtgtttgagggccttgaggatttcagaggcttcgagaggggtgagggagagggagagggaggagaggtagtcggaaag

SEQ ID NO: 56856 - DNA, 147 bp, Glycine max
  Peptide Sequence Number=SeqID_173634
atggattttgccatgggagctgctggtgggtctggtgatgatcaacacaatcagagcttaaacaaaggaaaaaagacgaccacctaccgtcgtcataaagaggatcaaagaactaggcttgaagagcatgagaaccatacgagttga

SEQ ID NO: 56857 - DNA, 132 bp, Glycine max
  Peptide Sequence Number=SeqID_173635
atggattcttcaatggcaagtcctggagggtctggtgatgaaggttctcaccagggaagaagaccctcctacaaacgtctttcttctgctcaaacagccagacttgaaagtgaccatgttgatagaatctaa

SEQ ID NO: 56858 - DNA, 993 bp, Glycine max
  Peptide Sequence Number=SeqID_173636
atgcacaacgaaaacctcgtactgagagaggcattaaagactataatttgcccttcttgtgggggtccacacaatgaagaagaaaggcgtgaactttgtctagaacaacttcgtcttgaaaatgctcgtctaaaagcacagcatgagaagttgtctaagtttcttgtacagcacatggataaaccaattttggaacaaaacttggattcccctatcagaggatcttcgtcacatggtccattactaggaagttctctaagactaagagctggaagatctcgtatgaatcttggtgcttcaacaagtcatgattcatttcaagatgaagaagataccatgtcaagccaagctgggagcaaaataataacacagatggaaaagacaatgatggcacatattgcagtggctgctaaggatgaattgctcaagcttttgcgcacaaatgagcccttatgggtcaagtcttcaactgatcagagatatgttcttcatcttgaatgctatgaaacgatctttccaaggattaaccacttcaagaattccaaagcgcgcgtagagtcatcaaaagattcgcgaattgtcagaattaaggcgaaggaattagttgacatgcttttaaattcggaaatttgggaaaatcttttctcaagaattgttacaaaagcgcgcacaatccaagtacttgaaaatggttcattggaaaatcgaagtggagttttgttgctgatgcgtgaagagatgcacgttctttcacctttagtgccatctcgggaattctacttccttcgctattgtcaccaagttgaagctaatgtatgggttatagcagatgtttcagttgactgcatgaaagagaacaaccatgatcctaactgttggaggtttccctctggatgcatgattcagggaatttctaatggcatgtgccagagacacaaaaaaggtaaaaagggtaagcagaggacaggaaggataagcatggagcaggggtga

SEQ ID NO: 56859 - DNA, 646 bp, Glycine max
  Peptide Sequence Number=SeqID_173637
actccctcaacacttcttgaagactctagtggtcttggagcaaggggagagcttaccttcttactctaggttctgcaggttgaggccagaccctcaagagctggcagctcgactgtgtatccctggaaggggatttgttcttaacaccgagggcttgccgtgtaagctcttgaggaaggatcttacaactctggcgcagacctggagtgttttatcttattctaacctagccataatttcacatacctctgatcttaatcttgacagggcttggttagtttatgggctagtaatgaagatggacatgaacataagagcacttatatctgaacagatctcgctcattgctcagtccaactcctcgaggcttggatttcaagccctcatcactgccttgtgcaaggcccgaggagtcacctcatattctctcacttatgagtcactcagcccagccattaatttggcttatattaagaagaattgttggaatctgaatgacccttcggtcacttttccagggacccaaaaatccagggctagaagatctgaggccccatctccttcagttgaccatgctccccctacttctgctccctctacctttgctctcccttcagctccagttcttccagttccctccacttag

SEQ ID NO: 56860 - DNA, 333 bp, Glycine max
  Peptide Sequence Number=SeqID_173638
atggatccaccactggagatggtggctcagctggtactggcactggcccaggataagcaacttcatcgaatcttgtctctaatcttcctttcgcaaaatcaacaactcgagggatggtggttgcagaggattgattgttttctggctctggcttctgctgctgaaggcctgggctatagagcttccattatccctcacaaaagaaggttcatgatgcaatcctaccccacaagggcattggatacaaaactccaagtacattgggccagagatgcaagagaaggccctagggttcttatgagccttagggtagattttgggcccatgggctaa

SEQ ID NO: 56861 - DNA, 313 bp, Glycine max
  Peptide Sequence Number=SeqID_173639
atggcatgcccatgccctgtatatgaaggattgcaaagtgactcaaagaagcctttgtatccggggtgcaagaaatccttgacgtcgttgtcaacggtgttaagtctagttaatgtcaaggctagatatgggtggagtgacaaaagctttacttcactgcttgaagtagtgcacaatctgcttccagaggaaaacactttgcctaaaagctactatcaggccaagaagatactgtgcccaatgggtatagagtatcagaagattcatgtttgccctaatgattgcatactgtacaagcatgaatatgaagaat

SEQ ID NO: 56862 - DNA, 189 bp, Glycine max
  Peptide Sequence Number=SeqID_173640
atcgcgtcttttccagttttccgacgttttcctcaaataaacgttggtggcgactccgcgcgtattcctttcatggaacacgcatcccgcgagtctcgcgtcgccctcccgccgaagggtaggagagcatcatccaccgaagatggttcaaggcaaatttgtcccaaatttgggggaggtattatcaag

SEQ ID NO: 56863 - DNA, 559 bp, Glycine max
  Peptide Sequence Number=SeqID_173641
atgggtcagcagcgttttcaggcggttgcgcttcatgccgcgcaccgccggcgcctcgtttttccagaaatagccgtggtgcacgataatcgcgtcggcctgatgcaccaccgcggcgtccagcagcgcctgacaggcggtgacgccggtcacgatgcgctgcacgtgcgggcggccttctacctgcaatccgttgggggcgtagtcctgaaacgccgcggcgttcagttccgttcaaaatgtctgccggtcgccctgcgccatcaggatgaatttcacccccagatcgttgccctgtgccagctgttgcgcaatggcggcgcgcgtgtcttcgccctgcttcaggctgggcttgatgtggctgatcaccaccggcaaaccgttcagcgagccatcgccgccgctgtactgcgtcaggttcttcagctccttcagcagccaggccggcgtcaaatggccgtacagatgtttatcctccaccccgttagggtaagaggtttcgataatcatgcccttgagcttcttctgctcgacaagcggccccagcgcgcgccagacg

SEQ ID NO: 56864 - DNA, 204 bp, Glycine max
  Peptide Sequence Number=SeqID_173642
atggcatttgcgcatgatattgtggaacttagtttgcgaaacaaattgtgcgcattgtgcatgagtattagaatatgttcgaggagttttctgactaaaattcaaagcttgctgcctcatgaggaatgccttgcggttaagtggtggctggacagaaatatagaaatggcaataactgaagctacagggctccaaatgaggtga

SEQ ID NO: 56865 - DNA, 408 bp, Glycine max
  Peptide Sequence Number=SeqID_173643
atggctggtacgttctttcttttgaaaaagcaaaatagtttagagattatgagcagtgagaaagaaatgactccgaacagagttgtgaactggccattcaggactctgtactttcgaagaagttacgaaaactcacggattgcgaaaaacacctcctttcgatttccgtcacattacggaattttcacggatcgcgtaagcctgcttccttttgattttcggcacgtctcgggacttcacatattgtgcaccaaagggtgccaagacatgggtatgagcccggaatggggatggaacagtaatggcatggcaagtttggtagagttcacggggaactgtggaaggtttggactgggatataagcctacgcgcaccaacatgaggaggagtgccctagaaaggaggtga

SEQ ID NO: 56866 - DNA, 114 bp, Glycine max
  Peptide Sequence Number=SeqID_173644
atgttacgtgataagtggtggaatgacacgatctgtattgaaatggttaggctgatgactatggagaaccttatgctagaggatgctggaatgcaatgctctgaaaggatatga

SEQ ID NO: 56867 - DNA, 957 bp, Glycine max
  Peptide Sequence Number=SeqID_173645
atggaatatttaagtttcgaacttcctataaaagaattaatggaccaataccaaacatgttctttagtaggagaagaaagtggtgttgatgtaaaattagcatgtagtcaaattgaggataagatcatagagaagaaaaaagagatctatggaaaccttactccttggcaaagagtacaactatcccgtcaccctgatcgtccttatgcattggatcatatcaatggtattgcagacaagggtagttttctggagcttcacggagacagaaattttgcagatgatccggcattggttggaggcttagctactctggatggtcacaaagtaatgatcatcggaacccaaaaagggagaacaaccaaagaaagacagcacagaagatttgggatgccaaatcctgaaggatatagaaaagctcttagactaatgaaattagctgaaaaattccgcatcccggttgtaactttagtggacacacctggagcatatcctggattagaagcagaagaacgtggacaaggtgaagctattgcccgaaacatttttgaaatggttcagcttaaaactcccatattcacttacattattggtgaaggagctagcggtggagcattaggaataggtgttggaaataaagtatatatgctggaaaacacatggtatactgtaattgcacctgaaagctgttcttctatattgtggagaaactgggaccacaaggaagatgcagcaaatgcattaaatcttaccccacaagatgccttaagagaaaaattcattgatgggattatcgaagaacctctgggaggagcacactacgatcctgaaacagcatatttgaatttgaaaagttcaattttgcaaaacataaaagctttctctaagtttacaggacaggaacttgaaactcaacgtcaagaaaaattcattgccatggggcaatttaaaggataa

SEQ ID NO: 56868 - DNA, 903 bp, Glycine max
  Peptide Sequence Number=SeqID_173646
atggatgatgatttgagtgatagctttcagttatggagtttatcaggtgagtcatgtcctgaaggaacgattccaattagaagaacaacggaagaagacatgttgagagcaaactctgttcgcagatttggaaggaaaaaagtaataaaccgtgtcagaagggacaccagcggcaatggacatgaggggatcagtactacggagcaaaggctagcattaacgtgtgggcaccccttgtggaaaacccatatgaattcagcttgtctcaaatgtgggtcatttctggttcatttggggatgatctcaacaccattgaagctggtgagtccggagctatacggggacagctaccctagattctttacttattggacgactgatgcatatcaagcaactgggtgttacaatttactctgctcaggctttgttcaaacaaacagtaaaattgcaattggagcagcaatctctccaacttcttcatatagtggtggacaatttgatattagcttactcatttggaagcaggatccaaagcatgggaattggtggcttgaatttggatcagggatcctagttgggtactggccatccttcttgttcacccacttaggggatcatgcaagcatgattcaatttggtggagaaatagtgaattcaggttcatcagggtctcacacttccacccaaatgggtagtggacattttgctgaagagggttttgcaaaagcttcatattttaggaacatgcaagttgtggattgggacaacaacttgattcccttgtcaaatttaaaggtcctagcagatcacccgaattgctatgacatacaaggaggggttaataacgcgtgggggaattatttttactacggtggacctggcagaaatgtaaagtgtccctaa

SEQ ID NO: 56869 - DNA, 1783 bp, Glycine max
  Peptide Sequence Number=SeqID_173647
atgggaagctgtccggtaacaactccaatttataaggttttgacgtgtatgaaaaatacaacaaccagtataaatatatgtgccactaaaattataaccccaaccttttcaagctctacgcaaacacctgttccgagtactgtatcaattttaacagcacctattcacggaacagcaatcctaaatccttctacaggaataattacttacaatcctgcgccgggatattttggaccagatgtaatcgtttatactttctgtggaaatgctccggaattcatcgactgcgaaacagtaactataaatctgacagttgtcccttttatcgtaaaagatgccacccttgaagcttgtcaatatgaagacaaagcttattttgatttaacaacagcaaacgttattgacttcaatttagtaacgaaaaaatactaccccactttagctgacctgaacgctaataccaatcagatcacaaatccacaaaattacgaatccacaggaggagttgtgtatgttaacattacaagtaatgaaggatgtacaggaattgcaaaaattacactaattgcaaaacctattaagaaatctcctactctgcttgataaatatatttgtattgattctagaaccaatcttgatgcaggccctggttacgattcatatcaatggagcacgggtgccactacacaatccatagagggagtaggagttggtgaatataccgttattcttggaaaagacggatgctttgttacacagattgtaaaggttatcaaaactcaggatcctgtaattactcagattgaaatctctaacaatacggcaactgttattgtaactggtggtacaccaccttacaaatattccgtagatggaacatcaaactggcaggattcaaatgtatttaccaacctttccagaggtcaacatacattctatgtaaaagatgccaataattgcacacctatttctgttgaaattactgttcctaacctaatcaacgcaataactccaaacggcgacaatatcaacgattatattgattacagtgaactgggttataaagagaatcttagctttgtcatctatgacaggtacggaaataaaatattcaccggcgacaaattcaacaattacaaatgggatggaagacatttcgataaaaagatagtgacaggaacttactggtatcacattaactggaatgaatccaacaaagaaaaaacacctataaaatatacgggttggattttaagggatacagaccactggatagcgccttattacagtactattgaaggatatactaatgccttatacctatcaacagattcagtaatcccatttgaagttaaaatctataacaacaattctataattggaacagctataatcagcaaaggaaatccacaaacattcactctaaataacaatgtaatacttgcaactaatatagctgatggatttaaagtaattaataaaggattatatcttaaaggtgataaacgcttttactgcagcttaagaatggcacaaagcgcacatggtgaaattatcaccagtaaagggaaagcaggtattggcaaagaatttttcatagcatccagtccaaatagcgcaataagtgcaatttataattttacagcaggaattcttgctacagaagataacacaaccgtaactgtctcatggaatagcacaggcgttactttttatggaggaacacctacaggaaattcacatactttcacattaaacaaaggacaatcatttatatttgcag

SEQ ID NO: 56870 - DNA, 234 bp, Glycine max
  Peptide Sequence Number=SeqID_173648
atgattagcaaaggggagggctctgattttgtggcaaaagctgtggatttagcagccagagaattaataacaagtgcatcactaggacaagatgagatcagcaaacaaggggcaaactactttctacacatgtaccgactgtggtcatcagtctcaggagaattagtggtttactttaaggttatgcttagtttgggagagaaaagtggaaggaaaaagaaagataaagagtga

SEQ ID NO: 56871 - DNA, 261 bp, Glycine max
  Peptide Sequence Number=SeqID_173649
atggggtcctatggtggtcacagctcgaccggagagggtggtacgacggtttggttacatccaaagcatccctccgtcgcctatgattacgacggatatgaggcgattgcacagaggttggagcgtgtgctcaaccttaggatggtcactgcaggcacagagttatatgagattatgcatgactgcctgacgatcgccagagggggagccagtgctgatggaagtgtcagggctggtcagagacgccgcatgaaccattga

SEQ ID NO: 56872 - DNA, 552 bp, Glycine max
  Peptide Sequence Number=SeqID_173650
atggttggaggatgcctgccagaactaatggcagagcctacaaatgtgaggtcaatgtcctttgtaggaacacatgagtatcttgcaccagagattattcgtggcgaaggacatggtagtgcagtggattggtggacatttggaatattcttgtatgaacttttgcatgggataacaccctttaaaggtgaaggaaataaagccacactctttaatgttgtaggtcagcccttaaggttcccaaaaaaacctcatgttagtaatgttgcaagagaccttataaaaggattgttggtgaaagagccccagaaacgatttgcttataagagaggtgccacagaaataaaacaacaccctttttttaacggagtaaattgggctctagttagaagtgctacacctcctattataccaaagcctttagatttttctaagtatgctaacaaatcaaatattcccccaatagacaagaagattgcagatattgttgcaagcgataaaagtaggcatacacaacctaattcttcttatgaagattttgagtatttttag

SEQ ID NO: 56873 - DNA, 345 bp, Glycine max
  Peptide Sequence Number=SeqID_173651
atggaaaaccacatctacgcctcctcttacagcccttccaccaactacagatccttccgtgaccatcccgccgccgacgccatgttcctctcccaccacctccaccaccgtaccgacgcctccgacgccgccgcctttcgcttcccttcctccgccctctccgccgtcgaagccgccgacattgcccctcccggcgtcacctcccgaatcgcctcctccgccgcctccgcgaatttcctctcctcctggccccctgtcgccgccgccgccgccgtgccttccgcccttgacctcaaacgctcctccgacggttataaagtgtgtgttagggtggagtgtttttaa

SEQ ID NO: 56874 - DNA, 661 bp, Glycine max
  Peptide Sequence Number=SeqID_173652
ggtgatagaatcattgcatgcagaagccatgaaatggatggataggttcgctttcactctgaatgggagtcaagagcttccgaggttgttagccagagccaaggcaatggcggatgtatattcagctcccgatgaagttcatgggcttttcgattattgccaacacatggaggtgcaagagcagatgaaggccgacatggaggccatgaaggaccaaatgacctccatgatggaggccatgataagtatgagaaggatgatggaggacaacgcagccgcagttgccaccaccagtgctgctgctgaagcggatccgactcacccatccggcataaaccaaacaagtcgtccagtcccagacgtggtaggtcagggaggagaagtgttgggaagtaaagttatcgagaacaccaaccactctgttcctgttctcctcgaaagccagcaaccccaattggggcatgcaccctttgctcaacctatgggagagacccgtgaagagccttgggaccatgctctgggtgagtttgagccttaccctgcatatgccactgagggaccaacgtttggtggcatgcctcaacccaaatcgcccgctacaacccttacatttctcggtggggagactacctcccgccatggaagaaagagagaaatttga

SEQ ID NO: 56875 - DNA, 561 bp, Glycine max
  Peptide Sequence Number=SeqID_173653
atgccttcaaattctaacccttcaaccacatcatcaagagtagtagcagaaactacaagagaattttctataattacaaaaagcaccaatcaaggtcagagaagtggtgttagttctcgtaatgatagtttagagagcactagtggtgcacatattaagccacatacaggaggtgatgtgaggtgggatgcaattaacatggtttctagaggtaatggtcttaatcttagtcatttcaagcttctacagcgtgttggttatggagatattggtagtgtgtaccttgtggaacttaaaggaagtaaggcattctttgccatgaaagtaatggataaagcatcacttgcaaagattttgttagctttagaatacttgcacatgctaggcattgtgtatagagacttaaaaccagagaatgttctagttcgagatgaaggtcacataatgttatcagattttgacttatcccttcgttgctctgttaatcctacacttgtgaagtcatcatctgcacatgaaagtaataatggtccatctgggagcattttggatgatgagcaa

SEQ ID NO: 56876 - DNA, 741 bp, Glycine max
  Peptide Sequence Number=SeqID_173654
gactacacgtctcaccttcagaggactgcacgtctcaccttcagaggactagacgccttcaccttcagaggactagaagtcctcgccttcagagggatgcacgccctcggctttagaggactagacgtcctcgccttcagagggctgcacgcctttgccttcagaggactagatgtccttgtctttagaggactagatgtcctcgccttcaaagggctacacgtcttcaccttcagggtgctatacgttctcaccttcagaggactagacgtcctcgccttcagagggctacacgcccttgcctttaaaggactacgcgcccccacctttagagggcttcgcgccctcacctttagaggacttcatgttctcacctttagaggattgcatgtcctcacctttagagggctacatgccctcgccttcagaggactacacgtcctcgccatcagaggacaacacgtcctcgccttcagaggactgcacatcctcaccttcataggactacacgtcctcacctttagagagttgctcgtcctcaccttcagagggctacgcgccctcacctttaaagggctgcacgtgctcgccttaagagggttgcacgccttcaccttcaaagggcgatacgtcctcgacttcagagggctgcacgccttcgcctttagacggctatgcgtcctcactttcaatgggctccacatccgcactttaagagaatttaaggtcctctgcccttaa

SEQ ID NO: 56877 - DNA, 258 bp, Glycine max
  Peptide Sequence Number=SeqID_173655
atggctggatggaatgattgtgcgatagctgatgctctccaagccttggctcaggctttggggaatcagaataagggagaagctgttggagctgctgagtaccaagggttgaaccacttccaacaaaacaatccccctggtttcaatggaggatacaaccctgatagtgctcagaattggataagggagatcgagaaaatcttccaagtgatgacctgtccagaggggcaaaaagttgcttttcctacatatactctg

SEQ ID NO: 56878 - DNA, 345 bp, Glycine max
  Peptide Sequence Number=SeqID_173656
atggcgtcggaggacatggagaagactatgttcgtcaccctgtggggaacattttgctacaaggtgatgtcctttgggctcaaaaatgttggggcaacctatcaacgagctatggtagcattattccatgatatgatgcacaaagagattgaagtctatatggatgacatgattgccaagtctagaaccgaggaggaacatcttgtcaacttacggaagttgttcgagagactgtggaagtaccagttaagattgaatctcgccaaatgcaccttcagggtcatgtcgggaaagttgctcggcttcatcataagccagaaagggatagaggtggatcccgacaag

SEQ ID NO: 56879 - DNA, 714 bp, Glycine max
  Peptide Sequence Number=SeqID_173657
gcaaatttccagaagattgctcatgcaaagacagcaaaggaggcatggtgcatcttggaaaaggcatactcaggagatgcaaagttaaagaaggtgaaattgcagaccctaaggagacagtatgagatgattcaaatggagccaactgagaaagtagttgattatttcacaagaattctcagcactaccaatttgatgaaggattgtggagagaagcttgatgatcatatggttgtggagaaaatcttgaggtcactctcacctcggtttgattacattgtgtgcgccatagaagaatccaagaatcttgaggatttgaagatagaggagcttcaaggttcattgggggtacacaagcaaaggttgaatgatagagacacagagagatccacgcaagctttacaagctcattcctcaaaaggcaaaggaagaggggagtggagcattgataaaggaaagggaagtcacaaaactcacagtaagaattctaaagaaactcaatcagaaactggagaatcttcaggacaacacaagaatggagtgaagagttggaagaaggagggaaagaaatttgataaaagaaaggtaaagtgtttcaattgtaataagtatgaacactttgcctcagaatgtactcacaaacagaaagaagggaggaacaaggttggtgatgaggcaaatttggcagaagaagctgatagtgactctgagtag

SEQ ID NO: 56880 - DNA, 2043 bp, Glycine max
  Peptide Sequence Number=SeqID_173658
atgactggaaacaagcattggctggtgaatcttgatacttcacaaggtagcaaagtgaggtttgctgatagttcttcaatctgctgtgaaggtgtaggaaatgtggtgatcaagagaaaggatgggagcaatgctataattgagaatgtgatgtactgtccaacaatggatagtaatctgctgagtctgggacagctgcttgagaagggatataagatgaggatggaggacttgatgttgaaagtatatgataaaaaacaaagcttcatcttgaaagccaagatgtccaataatagaacattcaaggtaaatttcaatgtagtagatgtccactgtatgactgctgaaggaaatgatgtcaattggctttggcactttaggtatggacatctaaacttccatggtttaagtagattagttgctaaacacatggtcagtggtatgcctcaaatcaaagcaccaacagaagtatgtgaaggttgtgttgcaggaaaacaacctaggaattctttcaatgtgtctttacctcctagagctaaagaaccattggaagtagtttgttctgatgtatgtggtccaattgaaccttgtacatatggtggaaatttatattttgtaatctttataaatgagttcacaagaatgttgtgggtttatccaatcaaaagaaagagtgaggtgtttgctgtttttcaaaaatttaaggcatatgcagaaaagcaaagtggagcaaccttgaagatcttgaggacagatgggggaggagaatacacctctaaggaattcgaagtcttttgtgaaagcaaaggtatagtacatgaagttacagcaccatatactcctcaacacaatggtttggctgaaagaaggaacgaaactttgctaaacatggtgaggagtatgctaaaattgaaagggctgccaaaggaactttggggagaagcagtcaccacagctacctatatactcaatagatcacctacaaagaagctagaaaagatcacaccagaagaagcatggacaggaaagaagccaagggtgagtcacttcagaatttttggctcaccttgttggaaacatgtcctagatgagaaaagaaagaaactagatgacaagaccattgagatgatcatggttggttatcatcccactggagcatataaattgtatgatccaattgagaagaaagttcaatcaaaaggcatgtcagtgctcaatgaacttggtgaaaccagtggagaagaagcaattggcaatagcataggtggggcatcacctgcaatagctcaaagacctcaaagaatatcaaagctttcgacaagactaagtgatttcgaggtgtacactgaagatgcaatcataagtgaaggagagctagttcactatgctcttctagttgatgcagaaccagtaggatatgtggaagcactgaaggaagaagtatggaagaaggctatgctggaagaactagcagcaattgaaagaaaccacacttggaaactggtcaagctgccaaaaggaaagaaacctatcagtttgaggtgggtgttcgaggttaaaaggaaacctgatggaactattgaaaagcataaagcaaggctggtagtaagaggtttcatgcagagggaaggccttgattatactgaagtgtttgctccagttgctagaatcgaaacagtcaggattgtagtggtcttagctcattcaagaggttggaatatgtggcatttggatgcaaaatcagccttcctcaatggattacttgaggaagaagtctatgtaacacaaccacctgggtttgagagcaaggaaagtggaaacttgaaactgaataaggttttgtatggtcttaaacaggcaccaagagcttggaacaaaagaattgatgggttctttctaaaaattggttttgagaaatgtaaggtggagtatgaagtgtatgtcaaggaggagaatggagacgtaatcatattatgcctatacgtggatgatcttttaatcataggcggtaatgaagttgtgattcaaattgtcaagaagtag

SEQ ID NO: 56881 - DNA, 318 bp, Glycine max
  Peptide Sequence Number=SeqID_173659
atggtgggagcaggtttgaaaaaggatcttagagtgtctagggttgtgccaggagggtctcttaatgccttcctttttcttctcatcggagttatttcacaaagacttgccatgggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgcattcggcatccaggggtcgcggaccgaccatag

SEQ ID NO: 56882 - DNA, 912 bp, Glycine max
  Peptide Sequence Number=SeqID_173660
atgtgcagttccatgaccaaggtgactgtaggcatagaagcagccacagctacctctctggtagccagaatcaacggccggccggtccttcaaccgacttgtaaccgatttcctaaccttgagaggagaaattcaatcaagaaactgtcaccaaaatcaccatgtcctccatcaccaccacttccaagcaaaacctcattggcacctctagtttctccaaagtctaagtccccaaggcctccacctataaagagaggcaatgagagtactggacttaactcaagttctgaaaagattgtgacaccaagaaacaccataaaaactccaactctagagaggaaaaagtccaagagttttaaggaaaggtcatatgatgctttaggcctttctgcctccacagaggcatcattaagttactcttccaatttgatcactgaatcccctgggagcatagctgcagtgaggagagaacagatggcactgcagcatgcgcagagaaaaatgaagattgctcattatggaagatcaaagtctgcaaagtttgaaagagttgttcctcttgatccttcatccaatcttacttcaaagacaagtgaggaggagaagagatgcagctttatcacagccaattcagatcccatctatattgcttatcatgatgaagaatggggagttccagttcatgatgacaagatgttgtttgaacttctagttttaagtggtgctcaagtaggatcagattggacctcaatcttgaagaaacgccaggatttcagggctgcattttctgaatttgatgtagcaactttggccaacttgactgataagcaaatggtgtcgattagtttggaatatgggattgatataagccaagttcgaggtgttgttgacaatgctaaccgaattttagag

SEQ ID NO: 56883 - DNA, 270 bp, Glycine max
  Peptide Sequence Number=SeqID_173661
atggcagcttcttctcaattcaatatctccgcggaccaagacgcttctactaaaattgagaaaagcacaccacgaccaacacccatagtgacaacaacgacatcaaacaaaggccttgagtttattcttattccagggcatgaaaaacaatgtaagaaggtgtgggaaaacccagaatcaaagtttgcatgccttagagcttccctgcagtccagttactttaaccttaatggacataactactatcgccgacctcaaaccactaggtaa

SEQ ID NO: 56884 - DNA, 1878 bp, Glycine max
  Peptide Sequence Number=SeqID_173662
atgaagtacgtgttggtgacaggtggagttgtgagtggacttgggaaaggagtcactgcaagcagtattggagtgctccttcaggcttgcggctttcgggttacttctatcaagattgatccctatctgaacactgatgcagggacaatgtccccttttgagcatggggaagtgtttgttttagatgatggcggtgaggttgaccttgatcttggaaactatgaacgtttcttggacctcaaattaactcgtgacaataatatcacaactgggaaaatatatcagtctgttattgaaaaggagagaagaggagattatcttggcaagactgtgcaggttgttccacacattactgatgccatccaagaatggatagagtgtgtggcacagataccagttgatggaaaagaaggcccagctgatgtttgtgttattgagttgggtggaactattggagatattgagtctatgccttttattgaagcacttggccaattttcataccgtgtaggccctggcaacttctgtttagttcatgtcagcctggtgcctgttctcaatgttgttggtgaacagaaaacaaagccaactcaacacagtgtccgccaacttagagggttagggttgaccccaaatcttcttgcttgtcgcagttcaaaggaacttgatgacaatgttaaggaaaaactttctcaattttgtcatgttccgtcatcaagcatactaactctctatgatgttccaaatatttggcacattcctttgctattaagagaccaaaaggcgcatgaggcaatcctgaaaacattaaacctgcgaggtgttgctacagagcctaattttaaggagtggattgcgacaacaaaagtatatgacaaatttcatgaaatggttagaattgcaatggtgggaaaatatactaacctctcagatgcatatctttctgtactgaaggcacttttgcatgcttctactgcttgcaatcataagcttgttgtggatttggttcccgctgaacatctcgaagatgatacctctaaagaggatcctgatgcatataaagctgcttggggtcttttgaagggtgctaatgggattctagttccaggaggttttggtgacagaggagtggaaggaaaaattcttgctgccaagtatgctcgagaaaataacattccatatctgggcatttgcttggggatgcaaattgctgtcattgagttttcaagatctgttctgggtcttcatgatgctaatagcacagaatttgatcccaaaaccgaaaacccttgtgtcatatttatgccagaaggttcaaagactcatatggggggaactatgcgtcttggttcaaggagaacttactttcatgttgctgactgcaaatcagccaagttgtatggtaatgcaagctttgttgatgagcgacatcggcatagatacgaggttaatcctgatatgatatcacaacttgagagtgctggtctatcttttgttggcaaagatgaaactgggaagcgcatggagatagttgaatgtcccagtcatcctttcttcattggtgctcagtttcatcctgagttcaagtccagaccagggaaaccttctccattattcttagtttatctatggtgcattttgtccgagcgagagaaattcaatacactgaacgaatgcctcattgtgacaggattaatatcagcagcatgtgagaggacaattgtgcctgcaagcaatggctatagcaagttaacaaatgggatacactcaccattgttgaaagcagcagcagcacataatggaaataatgggttcaaatcttccaatagttccttaaatggtgtatatacaagtacaactaccaatggggtgtgttga

SEQ ID NO: 56885 - DNA, 557 bp, Glycine max
  Peptide Sequence Number=SeqID_173663
gttccaatcagcagctcttaaaatccgaaaggagaatgccgaactgagagatataaatatagctaccaccaaggctttggaacaagagaccaagagggctcgtagggaagagcacggccggaacaagttccgaggggctctgtggggttgtaacaacgagcttaaactccggagggaggaaagggaccaatcgcgagtagacagtttgatcttgaaagatgaattgaaggcttgctcgaggtccaaaagaagtttgtctcagcggttatgcgagacagagaccaacatgttagctatcatcaccaagtaccaagaggaactaagtctagccacgacccacgagcatagagtggcggacgagtatgcccaagtgtacgcggaaaaggaggctagaggaagggtgatcgactcgttacatcaagaggcaacaatgtggacggaccgatttgctcttactttgaacggaaaccaagaactttcccgattgctagccaaggccaaagcagtggcggacacctactccgcccccgaggagatccacggacttctcagctatt

SEQ ID NO: 56886 - DNA, 429 bp, Glycine max
  Peptide Sequence Number=SeqID_173664
atgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgagtcaggaacaacgaatccctttatgataaacagattcattttgcaagttcgttattacgggtagttcctacaaaggatcggactaatgacgtatacaatactttgaattctcgatgtagatgctacatagttggttctcatccttcagatactacaagtataataggagcatccgtcaacaaaaggatcaccctaagatga

SEQ ID NO: 56887 - DNA, 1032 bp, Glycine max
  Peptide Sequence Number=SeqID_173665
atggaaacaaccatccaattaagaataaaggctcaaagccagtttgaagagattttcaatcccgaattgatagagtttctgattgaacttcaccagaactttaatgctaaaaggcttgatcttttagaagaaagaaaagaaactcagcttgattttgatcgcagaaatcttcccaggtttttacctcagacagaagaaataagaaatggagattgggtatgttcgccattgcctgaagatttacttgaccggagagttgaaattacgggtccggtagatcgtaaaatgatcatcaatgcacttaattctggagcgtccacatttatggcagatttcgaggacagcaatgctcctacatggaaaaactgtatggaagggcagattaatctttcagatgccattaacggaagtatagattttacaacccgagaagggaaagcgtatcaattgcaggaaaagaccgccgtattactggttcgtccgagaggattgcatcttcatgaaaagcatatcgagatcaacggtgaagaggcttccggttcattggttgattttgggatttattttttcaggaatgcacaaaggcttcttgaaaaggggagtggtccttacttttatcttcccaaactggaacactataaagaagccagatggtggaatgaagtttttgattttgcccagaattatcttcagattccaagaggtacgattaaggctacggttttaatagagacgatcaccgcatcgtttcagatcgatgaaattttatatgagctaaaagaacacagcgcaggattgaactgcggacgatgggattatattttctcatttgttaaaaaattcagaaaccttcctgaatttataataccggatcgtgatcaggtaactatgacctcaccgtttatgactgcctattccaaaagggtgattgaaatttgccacaaaagaaatgtacatgccatcggaggaatggctgctcagattcctataaaaaatgatgatcaggcgaatcatattgccttgaaaaagtaa

SEQ ID NO: 56888 - DNA, 828 bp, Glycine max
  Peptide Sequence Number=SeqID_173666
atgggttgctgcttcagcacacccaccaagcaaacccaaaacaaaaaccaaaacaaccaaaccactaagaaaaaccaccaccatgaaccaccaccacccttggaagcggaatctgtgaaagaggtcctctcagagaccccaattacgaaacctcaacaagttccaattttgacgccagaaacgaagacccttttgcctctccttcaagacccacctccgaatttcgaaacaaagtcaaaggctcctcccacagaagaagtctctgaggttgtttctcagctttcagaaacatgcagcatcagcgagagcttctccgccgccacaaccgcaaccaccgccaccgccgtcactgctacaaccaccactgtcacggttgcggataagagagaagaagacgaagcaaccagcaaaattcacaagtgggaccgatctccctccaggaagaggccctacgccgccgacggcaacctcgccggcgtgagataccgtaggctcaaatcgccagcgaggaggcaggagccgtcgccggagaagaaaatcaagggcggtccgaggccaattcgggggagggaaattttggattccggcacggcggcgaatcgaaagcgcaatgtgggccccgccgcacttcggcgggattccggcgagggttccggcaggcggtcgaggtccccggcgtgtgctagaaatggaaaggtgggtgccgggggtggtcggaaagaggttgctccggcgaaggaggtggaaaaggagacgaaaagtgagtgtgaggaagttggggagaaaaacgacgtcgtttcgaaggaggagtgcctcgagaacccgcat

SEQ ID NO: 56889 - DNA, 132 bp, Glycine max
  Peptide Sequence Number=SeqID_173667
atggagaaaagcaaagaagaaaaagcgtatacgatggtcaaatcctactctacatccctaaacaaatgctgctgcatccctaaacaatggagagcagaagcctacaagcctgaaaagttgaacttcacgtga

SEQ ID NO: 56890 - DNA, 303 bp, Glycine max
  Peptide Sequence Number=SeqID_173668
atggctggagatgacgcagatgaggatgacaaccaaaatctaaatattgagccaccattgggtattgagcttgcctacagtacgacaatacacatgagtgacataggcaataacagaccttgggaagatcacgagtttggtcacttgatagaccacccaaaagaactcgtctatgaactgagaatgctctttcgaggaatgcgatttcccaacaaagctaatgtcaaatatgcagtgaatatttatcgtataaagaacaacagatcttacaaggtcacaaaatcggggactgacttaggctaa

SEQ ID NO: 56891 - DNA, 156 bp, Glycine max
  Peptide Sequence Number=SeqID_173669
atgagagatttgggaagcaatatccccttcaaagttagaatcacacaagttgacatgcttgttagagagaaacttgttgagctttatgaatctgagaaacaatggtcaaaagcatctcaaatgcttagtggtattgaccttgattcaggaatctaa

SEQ ID NO: 56892 - DNA, 315 bp, Glycine max
  Peptide Sequence Number=SeqID_173670
atggggtgggggtgtctcgccagtcctgtggacgagacccaggctgactcaggctgtctcgccagccttgtgggcgagtcccaagtggactataccgccagtcgtgatggcggctccagctgggggtgtgtcgccattcccattggcgacaccctcctctctccctcctacgtggcctatatcgccactggtagtgacgatacacccctctctccagctttgctgccactggcaatggcgggttcagccatgccgccagtggcaatggcggtttcccccgaaaatagaccccctccgttatttcttttgaaatag

SEQ ID NO: 56893 - DNA, 1656 bp, Glycine max
  Peptide Sequence Number=SeqID_173671
atggattttgcgcgagtcgctgtgactgcggcgcacgatgagccagtggtccctgcgccagatgttcaggctaacatatttccagatgacccgatggcaccagctgatgtaaaggacattgtggcagacattcctgtgaacacaggcgtagaggctgttaaggataagcatgagggatttctgggtggtccaagcgacccatccgtgttgacccagtatgcggatcacgttgcttgcagcgtatggacaggagaggagcgtcctaagttgaagttatcctctcatgggaggaaggttcatagtttaggcaggcatgtccctggcattgagggacttgttgctgggacaggactaagtcctctgatcgcgtgttcggtagaccttggcgatcgaggacttttgtcctcgtttgtggagcggtggcactgggagacgtctagtttccatctcccggtgggagagctcaccatcatgttggacaacgtctcctcgcttctccatctgcctgtggttggcgacttgcacgcctttcagcccttgcatgtggacgatgcggttcagatgttggtggacttattgatggtctctgcagaatctgttggggctgagacagcccagtgtcatggaccgtacgtacgcctgcaatgggtacgtgacatatacgagcgtcgatgccagacaagtcattggacagttgcggctcgtgcatatcttcttcatcttctgggttgcactctgtttgctaacaaaagtgcaaccaatgttcatgttgtgtacttggaggcccttcgtgacctcagtatgacggagaggtatgcttggggagtggctgctctggtgcatatgtacgaccagctgaacgatacatctatcagccacagccgacagcttggcggttacatcatactactgcagtgttggatttacgagcacttttcatccgtcgcggactccactgctgatcaggaatacgacgaggattccccgcgtgcgtgtaggtggattgcgatgaagaagatcgtgaagagcatacgtacaccgatgtacagggagcgcctggaccgactccggattccagatgtctgttggatcccgtatggggagcatcgatcggtccgggacttccatgtcatatcatgctattccggtctcttgggctgggggcctattgttgtttattaccgacctgagagggtcgtgcggcagtttggatacatgcagaccattcatgctcctcctgtcgattcatgggtgtcgtataatgatatacacgacaggtggatgcactactcggatcatatcgttccagcaggtgaggtgtgcgctgtgccaggtcagtgtgctagtgactacatggactggttcttccgcatctcgcatcctttcatgacaccaggccatgcatcagatcctctgcctcatgatcacgccccgcagccccgagtcgtccctcaggccccgcagacagatatccctcacgtgccagagccaggagcatcatccacatctatggaggagcctagacatgcagtggaagtttgtaatgacattgctgagaggttggagtgtcatctgagtctaggggtggtcacgccaggctcattaacacatgaggtgatcgaagaatgcctcaggttggccaggagtgtgacatag

SEQ ID NO: 56894 - DNA, 348 bp, Glycine max
  Peptide Sequence Number=SeqID_173672
atggagattgctcaaattaaggaatttgggttggctaaggtgagcactcctcaaggatgcttggtgggagaagtgactaaagagacttgtgagggttataaccgaatctttataaccaaaaagggtgtcctaagacaacctttaggtgccctaggctattggaacatcgaggtctacattgatgatgtggttgtcaggttgcctaactttgacaagcatttgtcagacatggaacaagcaatcaagaggataagagctcatgaactaaaaaaggaatccaaaggaatgcatttttcgaataatgacaagtcatttcctaggattcttagtccatcaaaaaggggttga

SEQ ID NO: 56895 - DNA, 435 bp, Glycine max
  Peptide Sequence Number=SeqID_173673
atgtggatccagaagcttacggatcaacttgatccggaactttccctgttgcaagcgatgccgacgaactcagcacggaggattcttacctcgacaatgccgacgcgcggaggcagcaacaccaccgtcaacttggttgggatacccacggcggcacggtcgatgatgacgaagaagacgaagatgaagaacgaatgcgctgcggtgatgacgaccgtgctcaagctttttcgagaggaagaagacgaacgaaggttaggaagaagaagaacgcgggagggaggggaccaaaagctcaaaagaagcaaaaatggagaggaagaagcagaagcaggaatgtgggattggaagggagaaaggagaatgaacaattttttttttaaattaattaagccagaggccgacttcggttacacatttttcgcccaacgataa

SEQ ID NO: 56896 - DNA, 576 bp, Glycine max
  Peptide Sequence Number=SeqID_173674
atggtggttgatgaagaggaggattcatctaaggatgatttggcagttgaacaaatggaagccaaattgttgaaaggaaaaccatacccctaccatgctttgagaccttctaaaggcaaagaaacagttaaagatcagcaaaccagacaccctaatggccaagagattccttcccctgaggaattgaagaacgggatatttctatacattggaccaaagatagggagcaacctcgccaataatgaaggccaaaaggaaaagatgtcaccacctaggagaaagacgtcacttggagaaaggcatgcggctgaggtgaatgtcagggaaggtgtcacaaccttgaaaatcatcatgggtatccatgagaggccagtcgtgacatcggcaagaccaatgttgtctctccttctaggatggacggactttgagtttgatgggttgttgtcaaatgatgtcctcattccaatggttgtcgtaggattgtttcctatggaatttgctaggcaaggtcctcaatcgatgaacttggaaagagatgctctaatccatgaagggggaataagcgagtctagctga

SEQ ID NO: 56897 - DNA, 264 bp, Glycine max
  Peptide Sequence Number=SeqID_173675
atgcaggtggagaagaagaacaagaacgcaacgacgtggaggaggcggcaacgcaacgaagaaaatgggcacaaatggccaagggagaagaagaagaacgcattacatgatccgtatattttatacggatcatgcaatcctgaggagcatcctcagcaacagtggcagcttcccattgcctatgtgcggatgttgtgggccttcgccgctagggaacatcatctgaatcacgattatcccttctcccgaaggctcttcctgtaa

SEQ ID NO: 56898 - DNA, 240 bp, Glycine max
  Peptide Sequence Number=SeqID_173676
atgaaggtagagacgaaaaataaatctcgaagtaattcgttacgaggaaatatcatgaatccaattatttctgctgcttctgttattgctgctgggttggccgtagggcttgcttctattggacctggggttggtcaaggcactgctgcagggcaagctgtagaagggattgcacgacaaccggaggcagagggaaaaatacgagcattagcacttttatttgctaatccttttgtttaa

SEQ ID NO: 56899 - DNA, 875 bp, Glycine max
  Peptide Sequence Number=SeqID_173677
atggccttggtgagtccaaaaagttgtcttatgaatgtcttcctctgccatgtgtatttgatgaaagcccttgcgcaaatccagtttagaaaaacacgacgcagctccaagctcgtcgaggagttcatcaatggcgggcataggaaatcggtgtttgatggggctatggttgagcttgatgagaccagaatcaagcatagattgaacctatttctcgagttctatcttttggctatggggataccgatatggtttaactgtgatgggtttggagtcgaagaaaggtgtatgtggtgggagatgggacgaacaggtgaggtgggtggtgctatatggaagagggtcgaaacggcctgggtgtgcatcatgcgtttaagctggtggactgaagcagtgggtggcctgaggggaatgtttgcaaccagccattgggcgcctaatactatgtcagcgccactcaagggtaaaccaaaaagggtctattggtgtggacggaagaccgagaaacttgggaatgcgcaattgcgcaaaattgtgcgtactgccaccaacaagaatggtgagcttgtggtggtggatggtgccataggcggcgtctggcgacataggaagatcaacatcctcgtccgtgatgaggaagtggatacggggatagcagtgatgccccgtagaccacttatcgtcgcaataataatagagacccttgctctcttgatggggaggggtttggtgggctgggttgtggtgtataatggtgagaagggcggtggctatggtggcggtcaagcaacttgtcctcttgaagtttggccagagccacggcctgaggcaagcacatcgactgcaaagcctacacctcacgacgaagttcatag

SEQ ID NO: 56900 - DNA, 522 bp, Glycine max
  Peptide Sequence Number=SeqID_173678
atggagcataatggggacaaaggaaacttcctcatctgggatgcaacatgtatcaagctgtttggtaaaactgctggagaatgtcgagatgagttgatattggttggggaagatattaaggtatttccaacgtgtgttgatgaaatcctgttgaaaacttgggctgtcagatttaagttccgttcacaattacgccaatcatctgtgttggatgtgagtgaagaactccatcatattcaatcattgatagccacccttgggttgaaggaacaatcaagtaagggaaaaggaatagctattgagccagaaagttcaccaccaatttttgttcaccacggtgggtcttttgtttcaatattgcatcatccatcattgtcacagtcttctgattacgatcctggaaactctacctgtttaactccaaccaaaatgattagttgtcaacaaaccaattctgatttcgattctgatgagcacgcacagtatcagttatcaactaacaaacatatcaaggctgagtaa

SEQ ID NO: 56901 - DNA, 1101 bp, Glycine max
  Peptide Sequence Number=SeqID_173679
atgaggtgtaaggttgttagttgcatcaaagaccacctgctgcaacaccgcgaacccaatcagggcaaaccgggcgcgcggctggtgtacgatctggcggataacctgctgggcgagcgcagcccgcagagcgacatcgacgcgcacctgccgctggcgccgattgtcgataaccgcctgacgcactggcaaaaactgttttaccgttacgacgcttggggcaacctgatcagccggcgcaacggcctgtatgaacagcactaccgctacgacgccgacaatcggctggtgcaggcgcagggcgagtttgacgcgcagtgtcattacgatgcgctgggccgccgcagccgcaaggcggttcgctacaagggcaaaaccgaacagacgacccgtttcctgtggcagggctaccggttgctgcaggagcagcgcgacgacggcagccgccgcagctggagctacgatccggccagcccgtggagcccgctggcggcgctggagcaggcgggtgacagccactcggcagatatttactggtatcacaccgatctgaacagcgcgccgctggaagtgaccgacgcagcgggcaacctgtgctggtccgggcaatacgacatttgttttcccgatccgaaatcaagattgtccagcttttttatttggaatgaaggtgatggtaagttcctatcctactcactgccaaaagggaaaatgccaagcgcttcgagtagcgatatttttaatttgcatgactattttcctgccagtctcggaattccaattttttcaaaaagagctaaggctgtatttgaacgcaaggtttcgtctgagatgttattctatgaatgtgcggtagaaaacgtaactgaaacgatgtttctgtgtaaagtgaataattatttttcaattattgatgaggaagcctcgacgttcagagaacttgaagatggaagcaagctcattgatgtgcctgcttacaagtgtgacagggagttctttattgctagggatagcatctattgtgaaagaataattgtctctcagcagtttgttgacctatgtaatgaagaacagctaaacataggctttgagcgttgctaa

SEQ ID NO: 56902 - DNA, 216 bp, Glycine max
  Peptide Sequence Number=SeqID_173680
atgcgggggtaccgtatggttatccgcacctttcgtcaaccaggggcaaacgagcccattgaagctcagagactaacatcgtcttttgcaccttttgtcatccagggacagcgagtcaggtggcaggtggagataccttatggtcatccgcacctttcatcaaccgaggcaaacgaattcgacggtatcaggatgatgttggtcgttcgcttctga

SEQ ID NO: 56903 - DNA, 1052 bp, Glycine max
  Peptide Sequence Number=SeqID_173681
ataagtatttcacgttcggggacaggcgctggctgttcagcgcagcgaccccggagggtaaaacactgcatctcacccgggcgatggatacgccaatcaaacgccatatcaagatcagaggcgatgcaaccccttattcgcccggcatggaaatctacttcgaacgccgtctggacctgatctggaccgggaaactgaagaagatgaaaaccgtggcggcattgtggaagcgtcaggcgacgatatgtctaatcttgagctgctacatcccaactgccaccgtcagttacacagcagggaaaccggtgcccatagcgggcatctataaaggcttgagcggtatgcggggaaacctgcacgtaccgttcttagggggcggcggcgcagctgaaacagctgaacagagaactgacgactctgaatccattaaacgcgtgaagggtatcagcggcctggcggggatggccggtgcgccagcaccggcttttcccggcccgcagggtgtcggtgttgctgttcagatgctggcagaaaatccaaaaaaaaccgcgccaggtggcgcggtctgcggtcatcagttgccgggattatttgcccggtcgttcctctgcaggagcagccagcacgcccgggtgcaggcggcctgcatggataaccagaggcgcgcagcaataccgagccccgcctccagccgcaccgccatttccggactgacagaagccttaccgctggcgactttgctcagcgccgaagcggacacgcccagctctttcgccagcacgcgcaggccaatattattgtcttcaatatactcgattaagaatataagcatcaccgtccgtgaattcgaaagtgatgcgccagttagccctgaccgtgatggaaaaaaggtttttcctgtcgcctttcaggggatgaaaacgaaagcccgggtagtttttgaattcatcggtagaaatagcctcatcaatgaccagcaggcgaagccggatgcgttcagcgtccttagcctgcacgccgctgatatcgcctttttcaaacagcttctgtaa

SEQ ID NO: 56904 - DNA, 279 bp, Glycine max
  Peptide Sequence Number=SeqID_173682
atgagagcagcggatctggaatccaatggcatacacggcagatctggatgccaccgagaggagatagttaagagaaagaagaagaagaataaggaaacagaaaaagataggaaaagaaaactgagagagaagaagggagagtcgctgccgccggaagtcatctccggcaacggtgagcggtggcacatcgaaaaacagaggtggttaccgtttgtaattggccggattggaggaaagagaaagaagaaaaaagtatggtgcaacaggtccaccatataa

SEQ ID NO: 56905 - DNA, 1011 bp, Glycine max
  Peptide Sequence Number=SeqID_173683
atggcaagaagagcattgcgtgcgttgagaggtttggtgaggttgaaaacattacaagggcagtctgttaaacggcaagctgctagcaccctacgaagcatgcaaactctagcaagattacaatctcagattcgtgaaagcagaattagaatgtctgaagagaaccaagctcttcagcaccaactaccgcagaaacatgaaaaagaactcgagaagttgcgagctgctgttggagaagaatgggatgataggtcgcagttaaaggagcaaattgaagcaaaattgttgcacaggcaagaagctgctttgagaagagagagagctttggcctattcattctcacatcagcaaacatggaagggctcttcaaagtcattaaatcccacatttatggatccaaacaatcccaaatgggggtggagttggctagagagatggatggctactcggccaagggatggccacagcactgtggtggatcacaatgatcatgcatctgtgaagagtgcagcgagccgtgccatgtctgtaggggaaattaccaaattgtgctctctccaagataaaagaccttccccttttggccaaaaaccaagaagacctgcccctcagagttccccttcaaagacaccatctactaatggaaaggcaaggccatctagctcaaagggtagtagtgtctggggtggagatgagggctcaagaagcatgtttagtgttcagtcggagcgctatcgccgacacagcattgcagggtcctcagtgagagatgatgagagccttgcaagctcacctgccattccaagttacatggcacccacaagctctgcaaaggccaggtccaaaatcataaggccatcacctgaaaaaggaggtgattctgtttttgcaaggaagcgcctttcattctctccttcttctgcttcaagaaggcattctgatcctcctaaggtggaaatggtttccaataatgatgctgctgccgcagttagcaatggaaggggaaggtag

SEQ ID NO: 56906 - DNA, 387 bp, Glycine max
  Peptide Sequence Number=SeqID_173684
atggcagcgcagttgatccatgatcgtgttgtgatggagtgcctagagggtgtttgggagaccctcaaaggcaatgagaggtgccgattccgtggcacaattcaactcactgctacttcattagtacatccggaggaacccgcacgcacacttcagcagcctgtggagtggatactacctacacctactccatatcgactagttgagccggacccagaggagttatctcctgaacctgctgtggatgaccttgacttacctgaggatgatgaagacccactccctgatgttgattctccagaggatattatgtcagcatctaaggcagactctacaaaggagagtggccctagagggacagcgaatagtgacgactcttcatcatag

SEQ ID NO: 56907 - DNA, 972 bp, Glycine max
  Peptide Sequence Number=SeqID_173685
atgtgtcacattgttgtgttttctttattatttatagcttgcacctttcagtgtaggtgggaagttgccaaagtactcatatcagggaaggaagacctggaggcacctctttctcctgcaatggatgctgtaataagggtttttaaacgtgtctctgggttttctgaaattgatgccaagaataaagcatcagcggttgcattttgttccgtccgtttattggtggcctcaacgcaggctatcaatttgattggaaagcagggttcattaattaaatctatacaggaaaatactggtgcttctgttagagtactgtctggagatgaggttcccttttatgctgctgcggatgagaggattgtggaacttcagggagaagccatgaaggtccttaaggctttggaagcagtagttgggcacctgaggaagtttttggttgataatagtgttcttcccttatttgagaaaacttacaatgcaacaatctcccaagagcgccaggcagatactacctgggttgacaaaccatcactgcatagcgcttcacaacctagcattgtaactgatattcctctttcaacaaaaagggattctctctttgcagaccgtgaaagtcagttggactcattgctccctccttccacaatgtcaatgtatgggcaagattcttcactttctggtcttcgttcttcggctctcagtcgacccagtgcccctcctattgttacaacggtaatacaaactatgcaaataccattgtcctatgcagaggacatcattggtatacaagggactaatattgaatacattcgtcgtactagcggagccatattgactgtacaggagagccgggtgcctgatgaaatcattgtggaaataaaaggcacctcatctcaggttcaaacggcacaacagttgattcagttagatttgcataggcatatgtgtatgctagggcagttgagatcctaa

SEQ ID NO: 56908 - DNA, 270 bp, Glycine max
  Peptide Sequence Number=SeqID_173686
atggcttctactgatcaacaaaaaaaagataccgacacagttggatcttcaactggaatgttcaagcctacgggtgatagtgttgatgaagttataagtaatcacacagaacctgtagctagtaattacagcaggttagatacaggtctgaggtcttcttaccctcagttgggcagttcatcgtattcctcatcttccttgtcctcgcaaccctatagtggtgggtatggatcttctgctcttggaggctatagtactttcagactttga

SEQ ID NO: 56909 - DNA, 420 bp, Glycine max
  Peptide Sequence Number=SeqID_173687
atgcccactttgaatctcttcacaaacgttcctgtcgacaccgtcgttgcttctgacattctcagagatgccaccaaagctgttgcaaaaatcatcggaaaacccgaatccgttaagtcctcttttacccttttactcactctctttcgacattgttcaccatatgtgatgattttgttgaatgggggagtgcctattgcatttgctggaactgaagagccagctgcttatggagaactgatctcgattgggggccttggtccgagtgtcaatggaaaactgagttctacaattgcagaaattcttgaaactaagctatacattgacagttcccgtttctatatcaagttttatgatgttcagggaattggttgctacttgctaataacagaagttattttagtagatgttgatttctga

SEQ ID NO: 56910 - DNA, 282 bp, Glycine max
  Peptide Sequence Number=SeqID_173688
atgaaaaagaaaagaaagccatctctgagaagagaagaaacgaaaactgggaaaaaaacagaaacaaacagtcaccagagaagacacgaagcatgccggagattgacgcacaccggagagggaacagaaagggagggcattattggaatttccattgattttgaagttgcggacccaaaattctacaaagcccgcgatagagtcatcccgcgacagccactacttcactccgcaccacaacagaggtccgtgtcgcagcaaggggcctctctagcgcgatag

SEQ ID NO: 56911 - DNA, 1518 bp, Glycine max
  Peptide Sequence Number=SeqID_173689
atggattctctactggcgaactatgcctcttcagatgaagaagaagatcaacagccatccccaccaaaaacgacgacgttttcctcccttcctcaacccaaactttctctgtttcaatcccttcctcaacccaaatcttctctgtttcaatcccttcctccacccaaacaaccttccaccgaaagctcttccctccctaaccctaaccctaaccctgaccctaaaccccaaatcgaaaagacacaacccaaacgcgtcgtgcaattcaggcccccaatcatccctctcccacacccttcacaacacgacgatgacgacgatgacgacgacgacgacgaagaagaagaacgaaacagaagaaagaaaaagttagagtcctccacgcaaacctcatcggtcaagtccttcctcgccagcattccagcacccaggaacaccgccactctcggcgttcaagcaagttccggttcaggccggaaatccatcctcgaaaccgaaacaccgccaccggcatcgaattccggtggtttcagcaatgttcccgtcgatcaaagtacaggggattatgaaaattttgatgattaccaatatgccactgaccagtatgctagttattatggcaattttggttcgggtgccgagccagggagttcgggtactgaaccaaaggctggggttgctgcttatggaactgaacagtatgggaattatggtgatgcctatgcttcctatggggattatggacagtatgggaataattggggtgacgtgtcggcgccaccggtgctggaagcttctgggattgatgtcagtgtggtaaggattcctgggaagagagggaggcatgagattccgacggaagtgattgaggtgaagcaagaagagttgattaagaatcggccaagagaggatcaggtcaagctaactgggattgcattcggacccacttatcaggatgaataccagtctagaatagcccttgaagatgctttgtgcttgttctttagttctaaatacacagcgccatttgttgatgattttgatttgggggtgacctcttttgatgctccttggttattcctggaagcagctgagtgtcagatactaaattttggctcagttcaagggctatgtgttttggtaattgaaagaagagcagaccttagaaattttggtatgtggaaggataatttaatttcattagcctggaactggaagaaacccaatactcagatatccaagttgtggataatatatattgagaatgctacacttggtaggaggcagaccaatttagtcactaaggcaaattttatgtgttttattttgtatgcttgtataacaaaggatactttccaacctgcttcgacaaaggggaagcctacaaagctgcacaagaggaaacatcaaattggttcattgtactttgatatgaaacaaaatgaaatgaaacttgctgagcggcgtgtaaagggcatgcttaccaaagctgaaacacaagcgaaatatggatggtga

SEQ ID NO: 56912 - DNA, 528 bp, Glycine max
  Peptide Sequence Number=SeqID_173690
atggatgacataaacaataaatttaatcaaattttcaccgacaagcttgtccttgtcgacacaaacgccgacaagttctgcgacgagatgctcgacctccaacacgtcgccgccttcctcccccgcactaagatcaacgcctctgctgattcctttgtcactgttggcacccgccagatcgctggagagtcacgcctcaacctcctccaaaggaacctctcgctcttcggcgccatcattccgcctctcatccgttactcccccaacaccattctcctcatcatttccaaccccattgacattctcacctacgcgcatgcaagaaatggaggaaaaagaactcaagtatgcaaatttggagaaaaggtcgatgaaggagagggcttgggaggagtggccatgggaggcgaggcggcgcttgatggagtcgacgatggcggtggtggtggcgttaggggtgacaaagggggtgaaacggatggagaggatgcggagggagttgcagaatttgggagagttagggtatag

SEQ ID NO: 56913 - DNA, 279 bp, Glycine max
  Peptide Sequence Number=SeqID_173691
atgagtgttgagatcaaaagtgagtccatagataagagcttcgaggtcaatggacaccggctgaaaccattcctcacaaatccctccttaatggatgtagtggtggaggagaattccaaattctacaaggaaaagaccaagaagttccatgacagcttgatagctaatatggacttcgtggttggacaaaaagttttattgtataactctaggctcggactcatgagtgaagtgattttgtcacaacataaattcatccaacaacacgccattacttaa

SEQ ID NO: 56914 - DNA, 549 bp, Glycine max
  Peptide Sequence Number=SeqID_173692
atgtggcctttccacggaatctttggcgccggaccgacgctcgacgaaacctttggtctgattgataccgctgagaagtcatcgcaggtggtggtcatggcgctgtcgatgggcggcattcgtcagagcatcaccaccgaacagctgattgcgctgggcgagcgctttaacgtgaagccgtggccggcggcgctgcaggcggagcgcagtgatcgccgtcacacgccgatctggccagagctggaacggacgctgaaagcgcatggcgcgcacaactacgcgatctggctggatgctgaacgcaacctgctgtttgccagcgtcgaggttgagtccgaagcgcgctggcaggctgtagcgcaaactgaggtgtgtcagcgctggtgggcatcaatgcgtgacctgatgccatcaaatcccgacaacagcccgctgcggataacggcggaaaatggcgatgcaccagaacagtcccgccaggccaatgattgcgcccacgttgcccacgtctgccatctgcagatgcagactgacctggttaccgagtag

SEQ ID NO: 56915 - DNA, 183 bp, Glycine max
  Peptide Sequence Number=SeqID_173693
atgccttcaatcgaccaaaatcttccgtacgtaagtgtaaagggagtgaaagagtggcacctctatgtccatggaaactcacctggcatcaacgaggatttcaatggtgttgcatgtagaagtagaaattccagatccaattctggtcacggagacagaattcctcaaatttatcttcaataa

SEQ ID NO: 56916 - DNA, 1182 bp, Glycine max
  Peptide Sequence Number=SeqID_173694
atgtcttcttcgtgtttgagtggagccgggggaagaacctatggattcgatttcgaattcgttaaatctccatcttcatctactttcacatcgcacacatcttcttcaccttcctcaacaatctccgaatcgagcaattcgccgctagcaatctcaactaagaaacccagaacaccgcggaagcgacccaaccaaacctacaacgaagccgcggcgcttctctccaccgcgtacccgaatttgttctccacgaagaacctcaagacgcagggcaaaggcaaattctcgaggcccacatcggagaatttcgattacgagtcttcggagccgttattgccgttcagagtcttcgacggaacggcgtcgtgttttcttttggaccaaacgggcccgaagcccatcatggagaggcccaaagtggtgagcgtgcaggagaaggagaataataataacaaggcgtgtgagagccccggcgagataagctccatcgtgaatttcaattcagttgaattgaacgatgacggcgaagagagcctcgacgcggaatcgattctcgatgaggaaatcgaagaagggatcgatagcatcatggggagcagtatccaagaggtctcaaacgacgccgttagtaacttgccctggattatgccttttgacgggaaattggagttcccgagaccccgtgttagggctctccgccacgtcgaagacggaaactggtggaattttccggccgtcgatattctttcaatatcgcccaaaattaacaccaagcctccgcccgtggccgccgagaagaagatgaagaagaagaagaaggtggccacgccggcggagaaaacggtcgtcgtggagttgaagaacgcggaattgcccaaaccgaaacagggtttgatgttgaaattgaattacgacgacgttcggaacgcttggtctgaccgcggaacaccgttctccgacgacagtcccctagccgacgtgccgggaaatgacgtcactgcgcggctgtcgcaaattgatttgttgtgggacaatggaggagtgagagaagctagcgtgctgcgctacaaggagaagcggcgaacgcgcctcttctcgaagaagatcaggtaccaggtcaggaaagtcaacgcagatcgacggcccagaatgaaggtacgagtcagttcacagttgagttga

SEQ ID NO: 56917 - DNA, 525 bp, Glycine max
  Peptide Sequence Number=SeqID_173695
atgttggataagaacaataaatttaatttatatcttggggaggctatctatctaggatgggttttaaataataacaaggcgtgcattgaaaaggaagaagcgcatctggtttggtcccatatgatggccaggttcatctccaacaagacgaagacccacttactccgtcactccgaatcggcgaagggggtgatagtgtgccatcgccaccaatcctcggaagcaacgaaggcgaagtgggtggagatcgatggagtgaagctgttggaggagcacgtccagcgtgttatggtgaagaaggccacacccgattggcttcccttcctccccggttcctccttctgggtcccacctcctccttccccctttcttcacaaattctccatcccctctcatcccttcttccttcaagatgacgaatctgggaattctattgccacccctcgagggacagaggttactgtgcaactcaaggttatgacacccgctgaacacgtgtctctctctgaagatgaggaaggatga

SEQ ID NO: 56918 - DNA, 2088 bp, Glycine max
  Peptide Sequence Number=SeqID_173696
atgcatgaattacttgctccggtgctttatgttctccaatttgatgttgagtgtcttttggaagttcgaaagctttatgaagatcacttcacagacagatttgatggcctcttttgtcaagagaatgatctttcttacagctttgattttagaaaatcttcagacttgatggaggatgaaattgactcctatgaaaatctaacgaaaatcaagagtcttgatgagcttgatcctaagatacagaacattgtattgctaagtgacgcttatggggctgaaggtgaactgggtgttgttttatctgagaaattcatcgaacatgatgcttactgtatgtttgatgctttaatgaatggggcacgtggttcaattgcaatggctgatttcttctcttattcccctttgcctgggtcccatactggcttgcctcctgtaattgaagcttctgctgcgttgtatcatttgttgtctcatgtggattcatttttgcatggccatctcgttgatctcggggttgaaccccagtactttgctctccgctggttgcgagttttatttggacgggaattttcactcagcaacctcttgataatctgggatgaaatcttttcatcagataatagtaaagtggaaaaacatgcccaggacaatgcagactcaggttttaggatcttcaattcgtctcgcggagcatttatctcagctatggctgtagcaatgatgcttcatataagatcttcgctgcttgcagctgaaaatcctacaacctgtctccagagattattaaacttccctgagaacactaacgttgaaaaactaatagagaaagctaaatccttgcaggctcttgcattaagtactgagattttatcctcaatgccttcatttgtcgagtgtcataccaagggtaaatcagctattgcaagatctcgcaccctttcatctgaatcaatttcaccaaaaactcctctgactttggtacctgatagctactgggaagaaaagtggagagttgtccacaaggctgaagaactcaaacaagatggagtagaaaaacaggttcctacttggaagaagggatggacagaaaaggtaaagctcagtttgaaaagaacagaatctgacccctcttcatcaaggactaagagtggtaaaaaggaatccaagttgccggttaggcgatgtttgttagtagatctttctaaggaacttggctttgaggaagatactgaaaaactctgttgtcatgataatctgtctgcaacggttgaagaggagcaacgggaagatggctccgaaggcagcaacaactattctcctgaagatagatgtctaagtcaaaacacaagtagtgaggaaaactcacctgttatttcttgcccagctagtcctcctaatgaggccaatgatcacaaagatgactcccagaaaagtagtgttgggtctaatttatcccttgatataataaatgaaacttcacttagtagtagtcccattgattcacctcttccaatctctgatcatcctgagaacggacctcagacaccagggagaaataatattaataattccgctggaaattcaaccacaaattctgagagaaaattgaacaaattccagtggctatggaagtttggccggaataatggcgagtttatgtcagagaaaggaggtgatacttctgaggctgcaaaacctgccaacaattgtaacaatcaaagtaacacaacaccctcttctacagccaacaattgtaataatcatagtaacacaataccctcttctacagccaaaaattgtaataatcaaagtaacataataccctcttctacagccaacggacaccgtagatctgttagttgccaaggggaatctactgaccagaatgtgatgggcactatcaggaatattggacagtcaatgcttgagcatatccgggtgattgagtgtgctttccaacaagaccggggccaaggagcatcattagataacatgtctaaaaatgctgtggttggtaaagggcaggttaatgccgtgtcagctctcaaggagctccgcaaaattagcaatcttttgtctgagatgtga

SEQ ID NO: 56919 - DNA, 387 bp, Glycine max
  Peptide Sequence Number=SeqID_173697
atgccgtcggctctgatggatcctccattgccgcaatcctcgtcggtgccgtctttaagctccgacgccacttctccgggatcggcgccggatagtcggcgattcggggatcttagaggtttgcagtggcgtataaatcttggggtgttaccatcttcttcttcttcttctttcattgatgatcttcgccgtgccaccgctaattctagaaggaggtatgcgagtttgagagtgcgcctcctggttgatcctcatatgccaaaggatggaagtagttcacccaatcttgtcatggacaacccactttcacaaaatccagtgaagggagaagggaggaggaagaggtcatgggttgaaatcccctcactaacaaaaaccaacaactaa

SEQ ID NO: 56920 - DNA, 557 bp, Glycine max
  Peptide Sequence Number=SeqID_173698
atgacacaatgcacgatagacctcctgattaatataaatgtgacggttgagggcgatatgaaggtaaccaaagggaaggaaactaaaattgttctgacaaaacccttccaattggaaggtgaatcagatttagaaccgtcttatagagctcccaatctcctacatcgcttgttaagtttactcaagaacgtgcggccaggatcagatctcacacacttccaactgccagctgtgtttaacttcccaaaatctcaacttcaatgctatggtgaatcagtgtactgcacatcttcaaacttgctgagcaaatgcaacaatgggcagagtccactggacaggttcacatcagtagtagcatggagcatatctaccacacgccccacatcttttggtgttgctccttataatcccactcttggagagacccaccatgtttccaagggcaatctcaacgtcctagttgagcaggtatcagtcaaccctccagtatctgccctccatgcaacagatgagaaggaaaacattgagatgatatggtcccagcaacctgttccaaa

SEQ ID NO: 56921 - DNA, 204 bp, Glycine max
  Peptide Sequence Number=SeqID_173699
atgggtgacgagcagacaggtccacctggtcataaaggagaaaagggtcgtcgcaaagcgaaagtaagtcgccagaataaatgtgacgaccataaaggtcccccagaaagcggaaacataggaaagaagtttgccagaaaaaggtgtggtgagtataaagatccaccagagacagcaggtcccccgatgggctgtcccctgtga

SEQ ID NO: 56922 - DNA, 726 bp, Glycine max
  Peptide Sequence Number=SeqID_173700
atgattccgttatacaagtatataaaggaagggaagagaatgagaggaagtgggagaaagagacatttgagaggaagggaaaagggtggggtttcacaccaccctccggtatctgcccttcatgccaccgatgacaaggaaaacatagaaatgacatggtgccactctccggtttcaaagttcactggtacttcagtagagactaaggtgcatggcaaacggcagttgaagctccacaatcatggagagacttatgaaatggattctcctaatctggttatcagaattcttccaatctctgggactgattgggttggcaatgtcagcatccggtgcctagaaacaggccttgtggcagaattaaactacataggccaatctttctttggattcagggcagatcgaagactgattaaagggaaaatctttgactcatggtttatgaagattctatatagacttgaaggtcattgggatagtgtgtggccaacagaaacagcccttgtttggggtgaattgagccaagccattttgagcaaagactgggaaaaagcaagagaaacaaagaaaagtgtggaggaaagacagagggaggtcttgagagaaagagagtcaagggggaaaaattgggttccaaaacacttggtgtcttatagcaaagaagagggttgggaatgttcaccaattcataagtcagtcccaaacgctccaattgccaccttgtaa

SEQ ID NO: 56923 - DNA, 557 bp, Glycine max
  Peptide Sequence Number=SeqID_173701
atgtccaaatcttttgaatttgggatgatcggccctctcgatgagtcaatctcttgcattctcataagggtggacccttgggtacacgccctcaccttcagagggctgcacgccctcaccttcagagggctacacgtcctcgccttcagaggactacatgtcctcacctttagagggctgcacaccctcaccttcagaggactacacgtcctcgccatcaaagggctgcacgccctcaccttcagaggactacacgtcctcgccatcaaaggactacacgttctcaccatcaaagggttgtgcgccctcgccttcagagttctacacgtccttagagagctgcatgccctcaccttcagagggctgcacgtcctcgcctttagagggctacgcatccttactttcagagggctccacatctgcgccttaagagaatttaagggattgcgcccgcaagacacccagcgaacccggagaagcccaacagggccctggggtttccagctctggttacgggcctctgttagtcctacagggtgcccgttccccccagcaag

SEQ ID NO: 56924 - DNA, 204 bp, Glycine max
  Peptide Sequence Number=SeqID_173702
atgatgacagaaagggagccatctccacctgagccctttatttttgagactgatctagttattgttcaggaagatgttgcaataccagagccatctcctcagcctgagccacaaccatttgcaccagtgttggacctgcctatttctcaagatccaccatctgcaccagcactggatctgaatgacgttgcacaagatgattga

SEQ ID NO: 56925 - DNA, 408 bp, Glycine max
  Peptide Sequence Number=SeqID_173703
atggaaattgggcatgcaaaacagagtttaattttcttgactttatgggtccatttcttgtttctcatgatttttgatatatcttgcttgttatttgattattccagggggattgaagttaagggtaccataactaatgattctaaaattgttgtggattttgtgagaactaacatttttttaggtttggtgtgtctaaagccattatcagtgatcaggggagccatttctataacagctcatcaggggagtgatcaggggagccacttctataacaactcatcaggggagtcattatcagtgatcagagagatcaagcaagtgttgcagaaggtagtgcaacccattaggaaggattggagcaagaaacttgaggatgctatatgggcccacaggatcgcttactaa

SEQ ID NO: 56926 - DNA, 930 bp, Glycine max
  Peptide Sequence Number=SeqID_173704
atggttcttccaaatttggagcaagggaaaagaaagtcgagtgttgatgaaggcattggaggccatgttcttggctctgattacaaaatagaaacacaaagcatattgggaggtgatgaagcgattagggcaatttacatgcaaggcaaaggcaacgaagatgataaaagtgacaatactgcaacctgccaagggcatcacgtccgtgctcctgtgttaggactgacatggagagttgacgtgtgtatcaaagtgtcacatagcttgatgcgtgtattgtgtggaccttggacaatacctaatcccccaagctctgagatagcttgcgggcaaaagaggttgtctagtgttgagggagattatctcgtgtcgaggagtgataaccttgacaagtgtaagagttgtaggtctatgaggcttgtcaaaccccccaacctagacaagtgttgttcggactgcttttgtcaagttgtccggggtggacatacttttggttttgcaagggaaattagacgtgtcaggctagtacagtgcatgcgcgttgctcttgcatacatgtcacttgtggagtgggcacctactgaagacgcggtaagtggcaacccctggtggactgagaggtcatctccaatgacaattcctcatcagtggagactcatcgtggggcttctgatagcgagtcctcttcctcggagaggttcacggtctcatgccacgttgttggagacaccttgcctccgtagaagggcacaaccttttgcttcttctttgggggaacccattccaggcaccatgattcttttttcttctatttctgggagagcaaagaggagtggtggtggggacgttatgatgcaatcctaccccgcaagggcattggatagaagactccaagaagattgggccaaagatgcaagagaaggccctagg

SEQ ID NO: 56927 - DNA, 285 bp, Glycine max
  Peptide Sequence Number=SeqID_173705
atgggtaaagtagaggaggcgcaagagcagatgaaggccgacatggaggccatgaaagtgcaaatggccacaatgatggaggccatgatgagcatgaagaagataatggaagccaatgcggttgcagttgccgctactagggctgttgctaaggtgaacctgatgcccccatctgatctcaatcaaatgaatcatccaaccttagatatggtggggaaagatttggaaagtacggacgaccccatgatgtgcaaattcaaaatgagcacgccttcccgccatatg

SEQ ID NO: 56928 - DNA, 943 bp, Glycine max
  Peptide Sequence Number=SeqID_173706
gaaaaagccgcgggatcggtgaaccgcgcccataggcctggcctgccgacggcatgcggccccggcaacatcaaccggtgcgaaaacgagagtgtggggatagcgtctgcgttcgagggcataggcaacgcaacagggataagcgcagcgttgagaaatgacatcggggcaagaaacttgccccaacgcaaggaaagtgtggatgcccttaagtctcgtccccagggtgatgtagcgcagcggctggcatcgaacaggacgaatagcatccgtaagtatccaggattgatgaacccttcatcacagttggatacaggcgcccagctgcttacgggcgttgcggaacatgcgcatccacgggctgtcctcgccccactcttccgggtgccaggagttgctgacggtgcggaacacacgttccgggtgcggcatcatcaccgtggcgcgcccgttggcgctggtcacggcggtaatgccgttcggcgaaccgttcgggttggccgggtaagtttccgtcacctgaccggcgttgttgacgaaacgcagcgccaccaggccgtggctttccagcgcggccagatgcgccgcatcgcgcacttcaacatgcccctcgccgtgggaaacggcgatcggcatgcgcgaaccggtcatgccctgcaggaacagcgacgggctggccgccacttccaccaggctgaaacgcgcctcgaagcgatccgacaggttgcgcacaaagcgcggccagtgttcggcgcccgggatcagctcgcgcaggttggacatcatctggcagccgttgcacacgcccagcgccagcgtctgcggacggtggaagaacgcttcgaactcgtcgcgcacccgctcgttgaacaggatggacttcgcccagccttcgccggcgcccagtacgtcgccgtaagagaagccaccgcaggccaccagc

SEQ ID NO: 56929 - DNA, 1465 bp, Glycine max
  Peptide Sequence Number=SeqID_173707
gtgccggtgggtgcgctgctggtgctggacaatcaggtcatcggcgagggctggaaccgcccgatcggccgacacgatcctaccgcacacgccgagatcatggcgctgcgccagggcggcgcggtgctgcaaaactaccgtttgctgaatgccacgctgtacgtcacgctggagccctgcgtgatgtgcgccggtgcgatggtgcatagccgtatccgccggctggtgtatggcgccgccgacgagaaaaccggcgcggccggttcattggtggacattctgcgccatccgggcatgaaccatcaggtggagatcgtctcgggcgtgctggcggaggagtgcgccgccaccctgagcaatttcttccgtctgcgccgcttcacgcccgcgcgcatagccgtaggtcagctgcgggtagtagcgcttctggctgagcatcggcaggcgctgtttgacgtcgacccagctgtccggattgcctttttgcgtcttggtcagcttgcgagcgtccagcatgtggccccagcccatgttgtaggccgccagcgagaaccagatgcgctcgtcttccggcacgctgtccggcaccttggccatcagccgctgcaggtaaagggcgccgccctgaatgctctcttccggatcgaggcggtcgttgaccccgaggccgtcggcggtggcgcgggtcagcatcatcaggccgcgcacgccggcgatggccgccagcagcttccagtcgatctcgttggcgtgcttctcgaacagcgggcggaagttgggcagcaccgagtcgatggccgacaggaaggttttggtgtccacatagtcgaagctgccaacgtggccgaggtatttctcttcgagccgcgccagggtgccgtcgtccaccatctggctgtagaagtccagcatcgccgcgtacaggcagtcgtcgccgtcgcgtttcagataccaggtaaccggctcttcgtcggtgacgtcgaacgccaccgccagctgcggatggatgcgctgcagcagcgcgatggtcaccgaatcgccgagggtgtagtccagcttgccgtcggccactcgctccagcagctctttggaggtgagatcgctggaggactcccaggcgagatccgggtatttatcctgtttgagctgcttgagggtgctgacgtgcgcggaaccggaagcgaccgccagcttgcctttaatgtcggcgaaacttttcggccgcggggtgcccagccggtacaccagctgttgggaaacggagtagtaggccgggccggtacgcgcgcggctgaggcgctcctggttgtagatcaggcccgccgccagcaggtcggcgtcgtcgtcgtccagatcgtcgaacaggtcattgatgttctgatgggggatcaccaccagcttcaccccgaggtagttggcgaagcgcttcgccagttcgtagtcgagcccacccggcccttgcttg

SEQ ID NO: 56930 - DNA, 381 bp, Glycine max
  Peptide Sequence Number=SeqID_173708
atgcgagtggggaattctgatatctatggattcctcgagccacagtccattcagaggtttgggcaatcgcagtttgagactaaaagttacataaagagttggatgcagagttcaaaatgcgatgtctaccttggagcctacctgaatggtggacactggcagatggtggtcatcttgcccaaggaacacctagttgtctggttttgttcattgcataacaggccaaacaactaccttaaggggatcaataacagacaaaaaggaagtactgagtgcggcttttatgtcatgcactggatgtccatcatcattttaggaagtttcaggaataactggaagcgtattttaacgatcctagaccattggagtcagagagattaa

SEQ ID NO: 56931 - DNA, 2127 bp, Glycine max
  Peptide Sequence Number=SeqID_173709
atgaagagagtgaataagtcacagttgatcgacaaaattgctgcagacgctgacatttctaaagcggcagcgggacgtgtgttagatgcattcatgggctccgtttctgacgcgctgaaaggcggtgacgaagtggcactggtcggtttcggtaccttctctgtacgcgagcgtgctgcccgcaccggccgtaacccacaaaccggtaaagaaatcaccatcccggctggtaaagtaccgggcttccgtgcagccgctggcttcagtctccgcatggttgccagctgccagcctgaaccgcagctgcacgatgatgacatcgtgtcagagctttacatccacactacagcggagtgttgtcataccatgatggacaatttacgcgcggcgtcgaaccatgtcgtgctcaagatcattctgggattgatcatcctgtcattcgtactgaccggggtgggcaactacctgattggcggtaacagcgattacgctgccaaagtgaacggccatgaaattagccgcggtgagctggaacaggcgtttaacaacgagcgcaaccgtcagcagcagatgctgggcgaccagttctcgcagctggccagcaacgacggctacatgcagcagatgcgccagcaggcgctgtcacagctgatcgatcaggcgctgctcgatcagtacatcaaagatctgcacattggcatcagcgacgatcaggtgaagcaggctattttcaatcagcaggctttccagaccaacggtaagttcgacaacgcgaaatacaacggcctgatcgccagcatgggtttcagtgccgatcagtacgccgaagcgctgcgcaagcagctggcgacgcagcagctgattaacgccatcgccaataccgactttatgctgaagggtgaaaccagcaagctggtggatctggtctcgcagcagcgtgagattcgtcaggcggtgattgacgttaatgcgctggccgcgaaacaaaccgccagcgacgacgaaatcaatcagtactaccagcagcatcagagcagctttatggcacctgagcagttccgcgtcagctacatcaaaatggatgcggccagcctgcaggagaacgccagcgaagcggatattcagagctggtacgatcagcacaaagccgattattcacagccgcagcgcaaccgttacagcatcattcagatcaaaaccgaagccgatgccaacgcagtgctggatgcgctgaaaaagggcgaggatttcgccacgctggcgaagagcatatccatcgacccaatctctgcgcgtaaaggcggcgacatgggctggctggagccgaacaccacgccggatgagctgaaaaacgccaacctgacgcagaaaggccagctgtctggcgtgatcaagtcctcagtcggtttcctggtggtgcgtctggacgatatccagccggagcaggttaaaccgctagcggaggtgcacgatgcggtggcggataaagtgaagcaggaaaaagccgtcgacgccttctataagatgcagcagaaggtgagcgaagccgccagtaacgacaacgagtccctggcgggcgccgcacaggcatctggcctgaaagtagtggaaacgggctggatcacccgcgataacgtgccggccgatctcgatttcgatgcggttaaacaggcgatcttcaacggtggcctgaccggtcagaacggcgcgccgggcaacaactctgacatcatcagcgtcgatggcgatcgggcgtttgtgttgcgcatcagcgagcacaaaccggaagcggttaaaccgctggatcaggtcaaggcgcagattgccgacagcctgaagcatgacaaagcgacgcagcaggccaaagcgcaggcagacaaactgctgaccgagctgaaagcgggcaaacaggacgcgctgcaggcggctggactgacgctgagcgccagcaaaaccgtcgatcgcaacgcgcaggatccggtggcacaggccgcattcaacctgccacagccagcggataaccagccgtcgtggggtgtcagcgaagatatgcagggcaacgtggtgctggtcgcgctggataaggtcagcgcgggcaacatgccgcaggcgcagatcgacgaaatg

SEQ ID NO: 56932 - DNA, 237 bp, Glycine max
  Peptide Sequence Number=SeqID_173710
atggttgcctcctttggttaccgcaaagagtgtgatggctcttgggtaattaagggtgctcaaccaaatgatgatgaaggacacttaccggttgaaggggattcttctctccttcagagtattttggacagtgacacacgattcgaggagatgaactcaaggattgcaaaggttgaagaagatgtcaccattattcgcgactactttgatttacctccaccaccaccatcagtttag

SEQ ID NO: 56933 - DNA, 342 bp, Glycine max
  Peptide Sequence Number=SeqID_173711
atggccatttccatcattggtttcatgtacttccctgtatataagagccaccttctgttcattacctcattcattcacaactcaaaaatcttacttgagtacaacactacggaattagagcatggagtggtggaggccttgaaagaccagggcatatgcaggtggaaccatgctttaagatcagctcaacaccatctcaaaacccattttggctcattctctcaggctaacaggctttctgcttctgctatgctctccacaacactaaaacatgagaagccaaagcaatcagaggagtccttcagaaatgtcatgtacttcagctgctggggtcccaactag

SEQ ID NO: 56934 - DNA, 804 bp, Glycine max
  Peptide Sequence Number=SeqID_173712
atgtctcctccacctctaggacctcacaatcactcacaaactcatctcaagctctcaggacggcttcctcttccagctctggtctctgcggatcttcacacaacaaattctcaaatggggaagacctgctcacctgtcaacgatatcggtggactgccttatgagtttgttgacaaccttaatgaatttgttgacaaccttaatgaggatcatgagccaaactatgagcttcttccattggctagaggagctttttctttggatcaagagcctaagattccaattaaggcattggtaggactcaaggaatttgatggacatgaagggcttgattcagaatttaatggtgatgatgataggcaatatttgattgatcatcatgcggccacacctataactactattgagcctttggagaatgtcatattgatcaggtggaacctcaggggtgtgccccaggttccatgggaggctaagggtgaatttcagggtacatctcgatacaaattggaccgaaatgggaaaatttatgaacacaaagtagataatttagcattcaactttccacagatcctcaaaccaattttagttttcgatttggttactgcttgccctgcaagtccaaatctaacattttcatggggtcctttggattccaactcttcttcatggttagagttttatcaggctgttaaggacacagtggatcaagaagaaagggatgcagaagagtgcaagtttcccattctgatattggaggaaatgaaggtttttatgtatggtgagtttacacagatgagatag

SEQ ID NO: 56935 - DNA, 168 bp, Glycine max
  Peptide Sequence Number=SeqID_173713
atggctgatcctgagcttgcatttgtcttgattttgtggtggaagcatgaaggaatacacatggagatgaaaaaagactttctacatcggtttttaaccaatgttgaaagtaccgatgttgaaagtattatcgttaacatcggttttacaaaaccaatgttaacgtaa

SEQ ID NO: 56936 - DNA, 369 bp, Glycine max
  Peptide Sequence Number=SeqID_173714
atgaaggattataaatatttcttggttagtttttatctttgctcagtagaggctattgacatggaattaatccgagaccgtgtgcttagcaagtatgatccgctaagcgaggcagcatctcgcttagcgagtaagaggaatcttgaagggaatacaccacgccatcacgcgctcagcgcgtcatcagctcgcccagcgagaagtttgtctcttctggcgcttagcgtgcctgtttcgctgagccaaaatccacttacttgcgctaagtgcgaaaatgaccctaattgctccttcgagtataaaggtgatatcttgccatggaagactaagctccttcagttggggaatcctgctgagaacttaatgtaa

SEQ ID NO: 56937 - DNA, 192 bp, Glycine max
  Peptide Sequence Number=SeqID_173715
tttccatgtttggagctgaacgagatgtggcggcaatttttggatgagttgcaaactgtgttagacaaatttttgaatttgctcggtaccaattcatgtagtgatgtgatccttactaggagcggatcgcttgatgcaagtcatagagtttggatgacgccacttctagatagggaagataagtcaggatag

SEQ ID NO: 56938 - DNA, 972 bp, Glycine max
  Peptide Sequence Number=SeqID_173716
atgggaagagttccttgctgtgacaagaatggactcaagaagggtccatggacaccagaggaagatcttaaactcaccaactacattcagtttcatggaccaggcaattggcgatccctccctaaaaatgctggcctaaaaaggtgtggcaagagttgccgccttcgatggacaaattaccttagacccgatataaagagaggaagattctccttagaagaagaagatatcatcattcagttgcacagtatcttgggtaacaaatggtcagctatagcatcaaggttaccaggaagaaccgacaacgaaataaaaaactattggaacacccacattaggaagaggctacttcgaatgggaattgacccagtcacacacaccccacgccttgacctacttgacatgtcctctattttaaggtcagtgttcgggaaaccctcccttttgaacatgcaaggcttattacgtgcccaagctttgatgaaccaagggttactaaagctggcttccactgcctctcttctatcaacaatcaacaatgatgagaacccaaatttggcttcacacaattatgtacaaaaccaagttaccaccccaccatcattagactcagcacagtttcaatttcaaatgcctactactcagacaaacaatgtggaagtcttctcgggcaccgtggcaaacttgagctgttcaagttctccttcgggtgatgagaaccttgttttgcaacaaaaccaagttggtttgtcagggaaccatgatgctttggtgcactctctgaacaatgcaaaccaaaacatggagtgtgattcggttctgcctacgcctgtgtcaagtccaaaccggttgaattcatcatccaactatgtaagaagtggcacggacgaagagagggatagcttttttagtgacttgttcgagtttgaaattccagagagtttggatgacattgctgatatttttttgtaa

SEQ ID NO: 56939 - DNA, 525 bp, Glycine max
  Peptide Sequence Number=SeqID_173717
atgagggtggagtggtggcagggcgggaagtggtgtgtcttggaggaggagactattattcatcttcttcatgattgcaacagtgcaaaaattgtttggagagttcttgatattgatggtgccaacaacttcttcatttctgccgtcaaacaatggatttccgaacaactttctacatctaatggaagcttatttgcttgtgcttgttggtggatttggagagctaggaattcaggcaatcctggtgattatggttttggaggtatccttcgtgattctggaggtcaatggcttgtggtttactcgggtttttgtggtcacactaccaatgttctggtagaaataatgacaacttatcaaggtttgttcttagcttggaactctgggtataggcatgtcatttgtgaatcagactccatgaatgctttgaatttgatcaacaatcagaattctgctttgcatcctcatgcgcccctcatcaatcgtattcgctctttcttggataagccttggactctctcttag

SEQ ID NO: 56940 - DNA, 1587 bp, Glycine max
  Peptide Sequence Number=SeqID_173718
atggaactatatttacaggaagtcagtgaaaatgtgaagcaacaagctgatatactaaaagaggaggtgaaaatgatgtttcaatcgtcaaatcaaaatatcatgcaaaaattaaacttcattgactcaatccaacgtttcgggatatcctatcatttccaagaagagattaacgaaacattggaacaaattcacaacacttttaccaaaaataacaccattatcatcagtgaagatagcaatcatcactttctcgctctactctttcgtttgctcaggcaacaaggatatcaaatttcatcaaatgtatttaacaaattcaaaaatgatcaaggaaagttcaatgaaacacttgccaatgatattcaagggttgtgcagtttgtatgaagctgcacatttaagaactcacaaagatgctatactagaagaagcatgtgactttgcaaatactcaacttaagtccttggcggacaaactgagcccatctattgctacacaaatcaatcattgcttaagacaaccttttaacaagagtttacctaagttcgaggcaaggtatcacatgactctctatgaagaagatccttctcataacaaaactctgctaacctttgcgagagtagatttaaatattcttcaaaaaatgcatcaaaaagagattggcattataaccaagtggtggaaaaaattaaatattgtgaaaaaggtgccttatgctagagataggttagttgagggctatctttgggcattagcattttccagccagcctgaatacaacaaagcaagaatgtttgttggaaaattgatggctcttgccgctattctagatgatacttacgatgcttatggcactattcaagaacttgaactcttcacagaagcaattcaaagatgggatattagtcccattgaatcccttccacaatgcatgaaagtagttttcgaaacaattctagagctgtgtgaagaaataaagttggagacatctgagagtggaaaatcaagctttgtggttccgcgttttacacaagctatttgtgaattagtaaaaggttacatggttgaagcaaaatggtgccaagagggtttcgttccaacatatgatgagtataaagttaatggcatcttaactgctgctttcattcctttaatgatatccttaattggactcggagaatttacaacaaaggatgtgtttgattggtttttcaatgatctaaagatcgttgaagctgtatcaattattggcaggctcttgaatgacacatcatcgcataagtttgagcagcaacgagttcatgttgcctcagctgtggaatgttgcatgaagcaatacaatatttcgcaatcagaggcttataacttcattcgcaaggacgttgaagattattggaaggttataaatgaagagtgcctcaaattaaatgatatcccaaagtctgtgcttgaaattgtagttaattatgcacgtgtagcagaagttacatatgaaaatcatcaggataaattcacaaatgcggatttactgaaggattacatctcttcactgcttttggatcccgtgcgcatcaatgaacattaa

SEQ ID NO: 56941 - DNA, 498 bp, Glycine max
  Peptide Sequence Number=SeqID_173719
atgggatcaactcttatggccaccacttccattctcctctctgcaggcttggcagctgtgataagcagcacttacagtgtgaagaagcctctgaatgacgctgtatatggggcccacagtgaatttatggtagcacttaaatacgtgacactcctaaccatattcttattctcatttttctgtcacactctgtcgattaggtttttcaatcaagtgagcatcctcatttgcacaccacaacaagatgtgatcatgtcctcagcagtgacccctcagtatttgactgagcttttggagaagggaactattctgagcactgttggcaacaggcttttctactcagcactccctcttctgctttggatctttgggcctgtgttggttttcatgtcttctgtggcaatgttaccggtgctttataacctagactttgtttgtgggaataataatgggaagggaaagatcatgaagaatgacaaaggggaggactatgtttga

SEQ ID NO: 56942 - DNA, 783 bp, Glycine max
  Peptide Sequence Number=SeqID_173720
atgggcaaccctgtcgatcaaccgacctcaccaccagcacaacctgccatcgaggtacaacaaaatgtttctgtagaagaaataccctcacatgctcgaacatctcccgctcctgagacggatgcagtgaatgttgaggaacaaggtgaaggtcaaggcatgggacccagcagccctcatggatcgagtcagaaaagttcatctgaagaaaacttctccgatgaagaggccatacaagaggctgaagctggaggttcggacattttcccggcgtcttcgacatctaagctttccgctagcatagggatcgcagaggatacattcattcaaatgcaagacgaagaccctgctgcagcccttcgactcctgctgaacaccagtcaagccaacacctcaagtgaaaagattcctggtgcttcgtcctcctctgatgctgacataacctcttcagtacgccaagattgcctgctcttgaagttatcaatggaatacgcacgggaagacgtacttaaatccattgaagagaacccctctgccgcttttggccacctgaattttttgaagaaattgcataacccccttacctctgatgagattctaggcaaagttatccaaatcgaggccatcatcgaccagtttgcaagtaccgtgcagaaaaaacgcgaaaatagcgccagactggatgcccagaaacaggcacatatccttctgctcgagaaagcccaagctgctcaacgtgaagtcgaacgtcttaccaaagaggcgaaagaaggatcttctgag

SEQ ID NO: 56943 - DNA, 159 bp, Glycine max
  Peptide Sequence Number=SeqID_173721
atggaaatagatcgttggaagaaacagaaccggtcgggtgctaacgtacgctgcttgtcgtctgagagtggtgggaattgggtggatcagctaatcaatacggtggttcctctcatcattgatggtgaacctgctgttcctgctaaaatgcgcttctga

SEQ ID NO: 56944 - DNA, 237 bp, Glycine max
  Peptide Sequence Number=SeqID_173722
atggacaagagttatctggtgttgagagtggtaacctcgacaagtgagaaagttataggcgtgtgtgacgcacccacagtactcttgcatgcgtaccacttgtggagtgggcacgtactgaagaagtggtgcatggatgagtggggttgcgtcatggtgcgaaatattagggcaccatttcagctcccaccaattgctgaagagtctacctccactttaaatggaatggatgtttga

SEQ ID NO: 56945 - DNA, 264 bp, Glycine max
  Peptide Sequence Number=SeqID_173723
atgcagagccttaaaggtggaggtcgagtgcacgtaggagatgtcgtgtgtggtggcataatgatggtggagagggattgtgtgtgcggagccttgaaggtggaggtcacgcgcgtgcacgagctctgtgcgatagttatggtggggactgtgcatggaggagatgggataaggtggtggcgcaatgcagaggtggccagtagtgatgatggttgtgtgactatgatgtggggaaggtggagctgcgattctagatttggttag

SEQ ID NO: 56946 - DNA, 456 bp, Glycine max
  Peptide Sequence Number=SeqID_173724
atgtcgccacaattcgccgaagccaaagtcgtcgccgtttccgtcgactaccggctagccccggagctccctattccggcggcgtacgaggattcatgggctgcactacagtgggtggcgtcacaccgtaataaagatggacaagagccttggttgaatgagcatgcagactttggtagggacattgaagtggaaatcctcggagtggttcttgtccacccgtatttctggggctcggttagaggaggcggtggtggacaggctgtggcggtttggtggctttactataatgctttgagtaggagtgggtggattggggtggtggtggtggaagttgaagagactcttggcgagggtcaagcgtttcatcttcatgatttggtgagggataaggctcagagtttgatcaaacgcttgggtcttttcttcaatagagaccagcctcctgcaatttga

SEQ ID NO: 56947 - DNA, 1145 bp, Glycine max
  Peptide Sequence Number=SeqID_173725
ttgtggtgtataggccagatcagattcggaagatggaagagtctaaccgaatccggaaggcttacaaaccagtggagttgatgaaattggtgaaggaatttgaaggggagttttcaggagaaactgtggtggttgagttgccgcggcatttgaaacagaaaataattgatgaggtcttgcagagactagggagcttgaatggaagtagcaaaaacatctctcactcccaggtcatggccaaggagcgaggtgagcgtgttcttgttggaagtcaacgtatgaggctttatgatgtccagttgaagcttttatctggacctgtggattgtttggatctatcatttctttttggggaagcaattgaaaattggcgcaaggaaaaattggaggaggttaagttggctgttgtcagagggacttccaactcaaccattccccatgaagaggcaggaatgctagtaagagctttggagtctgattgggctgtgctttctgaagaaattggcctttggatacctattgaggttgctaatgaagaacataatgacaaacctgagggtgcatcagagatagaggaggaagtgcttcccggcagaccccttccacctgaatgcaatcctgaacttcatacggactatgatggcactgcagtaagatggggtcttactcatcacaaagatagtgcagctgattgctgtcaggcttgcttggaccaggctaaacgtgccaaagaagatgatgtaatgggacgtttaaccaccacaaaaggctgtgttggttacgcctttgggaagccaagttcctgttgggaagatgaattcttcaatcctcctgaacctctccacctggatcttctccctgagtggtccaatctctgccttaagtttggcatcctggttttgagcttctccatggccttgcaactaaaagccgaacttgggtctccacctatgttcgcttcgaccacccataaaaactacaaagagatgagcatttctcaacttgtttcagttctgcgggttgcatttcaaaccaatgattttcacaaagttgaagaagatttggtgaacatggacaccaaacttaaggtagagattgggccacttcgggagaagatcgaggtggagagggctcaagaggattga

SEQ ID NO: 56948 - DNA, 1383 bp, Glycine max
  Peptide Sequence Number=SeqID_173726
acgaaccttgggttagacaagcctttggagaaacgagactcaccaagggcggaccttgggtatgacgagcctatgagactcaccaaggacataccttgggagcatgtttgccctgtgttttcttcgttttgttgttcttgggaaaaaagcctcgttgtcgatggttccctgacttcgacggggatcaaggcgtttgtgccatatggccttgaggataactttgttggctgcctctacctaacgattagtctgaggatgttaacagaggaagtcttcgtaagactgagctttgaattgggtgttgttgttggtgacaatggtgtaagggaggccatacctacatatgaggtgtttctagcgactaataaatatttgacagctcttggggcctttggcagtggtcctacatcgcttggtgaagtcaggggtgtttgccctgagtgttggccagtagtagctgtcacacaccactttggtggcaagggagtgtcccctggtgtgaaggctgcacatctcttcatgaagctctcttatgacatagtctgctattggctattcaagcattttaacaagggtattgtcaaacctcttttgaatagtttgccatcaaggatgacgggttatccggtctggttccacctcttctccaattataacttcctcggtgtctatggtaggggttgggagcgtctcctggatgataatctagaggtgctcggtctttttggtgatgaccagtttggagagcaagtctactctagtgttgctttccctagtatctactggcaacttgcccctggacaagctatgggtgacattgttaaagccttcaaggatgattcctgccttacttcccttcatgttggatgcaccgtcaacatagaggctccaccagtctccggtgcgcttctcggtgccatgaagtatgcagctggtgaagtagatgggaagttggtgtttcccttcctcttaagtaagggtactcctgacctaggactagtgaacagctttgcttttttggcgagcttggtgaggaacttggacatggatgctagtgtgccattcagcttctggacttcttggatgttggtaggattgtgcatctccaatatggctattcatttgtcagggttggcttttattccccgatgtgtgatcatgaagcctgggaacttgtctccgccgacctcgaaaattggtgtagttggtgcaaatccgccatttgttgttggcctttttgaccaagacgacattggcgagctaggtggaatacttgacttctctgatgaagttggctttgaggagcttgtccactattctctaaccattttgcgtcattcttctcccatcttcctcttcttctatgataccggtttggcctag

SEQ ID NO: 56949 - DNA, 285 bp, Glycine max
  Peptide Sequence Number=SeqID_173727
atggcagccaaatgggggttattggattggctaacccaaagtggcagtactcccttaattaatgttttcactcaatccagtgcagatatggatgacacattgactggaacggattcttcggttgacattgctacaaaggagaacttggagaaacttagccaaattagagaaaatctgttaaagaaaccagtctctggggtcaatttagagaatggtctctttcaaccactgaaaaatggacaaaccaatgaacatgctctcaaaaggtttgcaaaagtactttaa

SEQ ID NO: 56950 - DNA, 387 bp, Glycine max
  Peptide Sequence Number=SeqID_173728
atgatcaactgcgaagttcaatccgaagaagttcacaaggaaaaaatgatttggaatctagagattgaaaatgaaggcattgcttgttatgtagaggcattgggtggagacaaagttttcctaaacaaagtgtctaaagtagagaagaaaacaataatggaaaaagcacacgacgtcatcatcttgaatcttggagatcgagtaatatggcagttggaaaaactgttaaagaaaccagtctctaggatcaatttagagaatggtctctttgagccactaaaaaacagggaaaccaatgaagatgctcttgaaaggtttgcaaaaatactttcacaagaaaggagactccgtgaaatgagatccccacacactaaaaagacattctag

SEQ ID NO: 56951 - DNA, 720 bp, Glycine max
  Peptide Sequence Number=SeqID_173729
atgtggttaacagcgaaacccattcgacaactatgcttcccactcccaatctcagtcccaaacaagttctgcaattgcagcttatccataacagcaacaaccaacaccaacaccaacgccgaaattactactactctcactcaaactcctaagccaaagccgaaccctaagtcgacgttgaagaagcgaaagaggtaccggaagctatatcccggagagaccaccggcatcaccgaagagatgaggttcgtcgccatgagactccgcaccaacgacaccgtttctcaacaagaacaccaatcgcattccgacgcgtggcaggcctccatggaaggcttcctctcttacctcgtcgacagccacctcatcttcgccaccctccaacgcatcgtcgacgaatccgacaacgtttcctatgcatacatgaggaaaactgggttggaaagatcagaagggctgttgaaggatctgaaatggttggaggaagaaggaaatatgattccgactcctggttctccagggcttacatatgccaaatatttggaggaactcgcagagataagcgcacccttgtttctctcccatttctacaatatctatttttctcatatagctgctggtcaggtcattggaaagaaggtaggtcatgtaagagagatctactgcaaaatagatcggtatcaaaccataactcaaattttagatgctgaagtcatatag

SEQ ID NO: 56952 - DNA, 3415 bp, Glycine max
  Peptide Sequence Number=SeqID_173730
tctctccgccgtctccatctccgccgtcgtcgcctccgccgcgctcctctccgattccgatcgcggcggaggaacgaatccactgtacgagggcgcggagcgcgccgcgcgcaaggcggcggactcctgcgaccggatcttccaacacgcgaagcgcaccggcgtcgccgccgcggtactctggaagtcactgcggtcggtgctgtcctcggcgaaccacgaggtccgctccggcttcgagattcgcgtcgcggcgctgctcgcggacatctccgccgcgaactccggccgcagagccgcgatcgtcggggcaggcagcggcgccgtcgtggactggctgctggattcggtggcggttgcgaaggacggcggcgccacgcaggcggagtccgcgagggcgctggcttatctgattgcggaccctaacgtgtctgcggcggttcttgggagacctcacgcggttccgagtcttctgaggttcatcttctcgtgccagcctcggcgttctaagaataacaagaagcattcaagacatagtgcatttgatatttctgattctttgaaaggcaggagcatgcttgttgctgccattatggatatcgttacatccagttgtgacaatgctgaagaggtatcttttaagccatcattgcctggaaatgctgaaatcagagacattgctgcagccctagaagttattgaggacgggggtttgcacttggatgagccacctgaaggtgaagatgatggtggtgggtcgggaaggaaagggattggaatcaagatacttgaaggtacccctgttttagggctttcaaggaccaatagtgatgcttgtcacgaagaactgaagcatcaaactcctaaaactctcatatatccaaataagtatgacaattcaccggaacaaaagaatgtgtcttctgctgttgttcctggtctctgggatgatttgcactgtgaacatgttgctgttccttttgccacctgggcattggcaaattgggcaacagcatcacagttgaatagatctcgtattcaggaactggatcgagatggaaatgctatcatgtctgctttaatggcaccggagaggtctgttaaatggcatgcaagtttggtggtgtggttgctattagaagatcgcaatacacctttgaatgaatctgtttctgattgggcttccagtcttctttctactatatctcaagcatgcaagcatgaagacgtttctttggctcaggtagcttcatctgcctttctcttatctgttgagaggagccctggagtgcagaaggtagtgatggagaagggtgttaatccaatgagagacatcgccaagcagatgacaaagcataagcaggttcaagaaccaatggcaaaggcattggagctagtttgtactggggagctgcgtttgtctcttgaagagagtcaaaaatggtcaggcattcttcttccttgggtttttggaaaattttcctctgatactatacgatcttcagccataaagattctttctcagatcttggaagactatggaccaacatgtgtaccactttctcaaggatggttagccatgatgctgtctgaagtacaaagttctataaagaaatcaaatgataaaggaaccaaccaacctaagagtgataatgtaaagacgttaatcaataatgcaaatattgcttctgctgcacaagttgccaatcaactatctagtgccgttgttaatctggcagctaaacagttgggaaatgcatctaattctggggatgcatccccactggcagattttctgtctctggaacctttagcaggaccatttagaagtttaaaaaaagataatcttcctaaattagatgctgcagattctgccttggcaaccctgaaaggaattaaagctttgactgaagtttgtgctgaagattctgtgtgtcaggacatgatagttgattttgggattttatgtttgctgaggcgctttttattgagtgatgattatgagaaactggctgctattgaggcttatgatgcatcatctagagcacatgaggggaaggagcggatatcaaatgtagatggggaaccggctatatcagatgtaaatgatccagctagtgtccgagttcctcctacagctcatatccgcaagcatgcagctcggttattgaccatcctctcactgcttcccagagtcaagaaggttatcacagttgatgaaacttggtgcaaatggcttgatgattgtgctaatgggcggattccaggttgcagtgaccttaaaatgcaaagctatgccagggcagcacttttaaatatgttttgcaatgaccagcctaatggaaaatctgaaagtggaagaggaggcccttctgatggtggtgtaaaaaattataggaactcgtgtcctcgttatgatgacatgatattcttgataaattctcatcttccccactggaaatgtcccaaagaaacagatcaacaagaagctttctcaaaggagatatctctgtttacttctactgaaatgggggatgtaatagaatccgtgaatggcagcaactgttctatttctaatgattcaactaaaaacaacccagatgcagattgccctccactagacatagtttttgtccatggtctacgtggtgggccttacaaaacttggcgtatagctgaggagaaatcctcaacttcatcacctttggtggagaagattgatgaggaagcaggaaagcttggaaccttttggcctggtgaatggctttccagtgattttcctgaggctcggatgtttaccctaaaatacaagactaatctcacacaatggtctggagctagcttgcctcttcaggaagttagttctatgctattggagaagcttgttgctgcaggaattgggaatcgacctgttgtttttgttactcacagtatgggtggcctggttgtgaagcagattcttcataaagcaaaggaagaaagatttgataatctcatgaaaaatacaataggaattgttttttatagctgcccgcattttggtagcaaacttgcagatatgccttggcgaatgggctttgtgcttcgtcctgctccaacaataggagagctaagaagtggatcttcaagactgatagagcttaatgactatattcgtcaccttcataagaaagggttgcttgatgtcctcagcttttgtgagaccaaggtaactccaatagttgaaggttatggtggatgggcctttcgaactgaaattgtaccaattgagtcagcatatcctggatttggggaattagttataaaggaattagttcaaaaattcttttttcacccaagctgtagccccaccaaaggtggaggtctgagctttaagcacccaacttcccagttgaaaaggaagccctcctactaa

SEQ ID NO: 56953 - DNA, 183 bp, Glycine max
  Peptide Sequence Number=SeqID_173731
atggcccttgaaagggatgttggacttcgaataagaggccatcaagccattatggacaatatagtttctgaagagctcttggaaggcaaggagttggagttttacaaatgggaaggagatgtacctgacttgttgaaagatgttcgtgataagctcaacatgctttcagaggttgattactaa

SEQ ID NO: 56954 - DNA, 1762 bp, Glycine max
  Peptide Sequence Number=SeqID_173732
atgggagtggatatgaggatgaatctatctttgtttttgacaatatatctctcttccatcttgtttcttcttgtttttcacattatatttcttggtctctggtatatcggctttgtttcacgtgtggcgggaaagagaccagagatcttgaccattcttcaaaactgtgcggagaggaacacatggcttgcaaagtttcttcggatgaacgaattgaaggaccaggtctgctcatcttggtttgcaccagttggatctgcaagtgattatcctctcttgtcaaagtgggttatttatggggagatagcttgcaatggatcatgtcctggttcatcagatgaaatttctcccatttactcactctgggctacatttattgggctttacattgcaaattatgtggtggagaggtcaacaggatgggctctcactcacccattatctgttaaagaatatgagaagttgaagaagaagcaaatgaagcctgattttttagacatggttccatggtactctggaacatctgctgatttattcaaaacggtttttgacctcctagtatcagtgactgtcttcgttgggcgttttgacatgcgtatgatgcaggcagcaatgagtagggttagtgatggaaatcatcaaggtgatcttctatatgatcattttagtgagaaggatgatttttggtttgactttatggctgatactggtgatggtgggaactcatcttatgctgttgcacggctgcttgctaagccttttattcggacactgaaagatgattctgagcttaccttgccacgtggaaacttgctacttattgggggtgatcttgcgtatccaaatccatcagcattcacatatgaaaggcgtctttttgttccttttgagtatgctcttcaacctcctccttggtataaagcagagcagatagctgtgaacaagccggaggtaccctttggggctcaattaaaacagtacaatggacctcaatgttttgttattcctggaaaccatgactggtttgatggactccagacctttatgaggtatatatgccatagaagctggttaggtggatggctcatgccccagaagaagagttattttgctttgcaactccctaaacggtggtgggtttttgggcttgatctagctcttcatggtgatattgatgtgtaccaattcaagttctttacggaactgataacagagaaagttcaagaggatgactctgtgatcattattactcatgaacctaattggctcactgactggtattggaatgatgttactggaaagaacatttcacaccttatttctgattatttaagaggaagatgtaagcttcgaatggctggggacttgcatcattacatgcgtcattctcatgtaaagtcagatgggcctgtacatgttcaccatcttcttgttaatggttgtggtggtgcatttctacatcctacccatgttttcagtaaattcaacaaacttgatgaagtttcctatgaatgcaaagctgcatatccttcctttgaagattcaagcaggctgaatcacatcctccaagatgatacattttctggtcacataaggagtttccttgcatattcttttgttccacccaaattgtcacggaagaaacgagccataattggagttcttcatgtttctgctcaccttgctgcagcactgattcttatgttgcttcttgaaataggcattgaaatatgcatccagcataagttgctagcaacttcag

SEQ ID NO: 56955 - DNA, 261 bp, Glycine max
  Peptide Sequence Number=SeqID_173733
atggcccctctccctcttgtgattgttgttcttctcgtgccactttcttccctctgcatccttctctcaacgtggtggctcctccttcctttgcatatgctcgtggagttgctcaaagagatgctagcggagttaaatgcagatgaggaagaccttgtggagttcacaactgagctggtgacaacatgttgtggttgtgcagtggaagttccttggtggtgtagtggttgcacagaggaggaaggggaaggtataatttga

SEQ ID NO: 56956 - DNA, 327 bp, Glycine max
  Peptide Sequence Number=SeqID_173734
atggccaatttgaagctagtgttcaccatgagttccattcttctagtcttggtgtttttcaatggaattcttccagctatggggaggccactgaaaaaggagcacataacaacaacctacgaaaacagtgtcaaagaaatgggcacagtggaagacaacaatattctcctgtggcgccgcagcatcatagaaaataatgcagcaaatgatggtggtgttgataaatggatcgacgatttccgaccaatggatccaggtcacagtcccggtgctggccactcctcccctaccccaaaggacgctactaacggtgccccaaggccatag

SEQ ID NO: 56957 - DNA, 378 bp, Glycine max
  Peptide Sequence Number=SeqID_173735
atggctaatcctagtgttccactttactatacaggtgctatgggcaatgatggctcagacttagtgtttgaaaggctttgtaccccatggcaagacgctttggtggtaaagttgttaggaaaaaaaatcaatttcatcctcatcaaggaacgcttgactaaaatatggaagctaaaggcggttttttacctcatggactttggtaataacttctatatggccaaattcgacatggaagaagataggacaaagatcattggtgagggctcgtggatgatcatagatcattacctaattattcagactttgtctttctcctttgtgttcccaaaagccaccattgataaaccatggtgtggattagattccctggtttaa

SEQ ID NO: 56958 - DNA, 402 bp, Glycine max
  Peptide Sequence Number=SeqID_173736
atgcagcaatcaaacggctctgattcgtccacgacggagcagaaagcgccgccgccgaggcaatcaccggcggtggcgaggccgcagcaatggctgccgatgcagtaccctgcggcggcgatggtaatgccgcaccacatgttgccgcctcagcattacgcgccgccgccctacgtgcccttccaccaccaccaccaccatcaccagtacgcggcgccgcacgtgccgaaccaacaccagcagcagcagcagcatcaccaccatcagaacggatccggcggcgagaacaaaaccatctggatcggcgatttgcatcactggatggacgaaaactatctccatcgctgtttcgcttccaccggcgaggtttgcatcaaagatccatatacattactaaagtga

SEQ ID NO: 56959 - DNA, 495 bp, Glycine max
  Peptide Sequence Number=SeqID_173737
atttcctccatcaaggttattcgcaataagcaaactggcttatcagagggttatggatttgtggagttttattcacatgctacagctgagaaagttttgcaaaattatgctggaattttgatgcccaatactgagcaaccattccgtctgaactgggcaacatttagcacaggagacaagggttcagataatgttcctgacctttctatttttgtaggagatttagctgcagatgttacagatagtttgttgcatgaaacttttgctagtgtatatccttctgttaaagctgcaaaagttgtttttgatgccaatactggccgttcaaagggctatggtttcgtcaggtttggagatgacaatcagagaacccaggccatgactcagatgaatggtgtttactgttctagcaggcctatgcgtattggagctgcaactccaaggaaatcatctggccatcaacaaggtatgccaaatcactttacttgcttctga

SEQ ID NO: 56960 - DNA, 975 bp, Glycine max
  Peptide Sequence Number=SeqID_173738
atgcaagaactgggaccttttagagtcaacagtgatggaaaaacactttacagaaatcaatatgcatggaacaatgtggcaaacgtgattttcctagagtctccagcaggagttggcttttcatattcaaacacttcgtctgactacacaaaaactggtgacaagagcacagccatggactcttatacttttcttctaaactggctcgagagatttccacagtacaaaactcgagacttgttcatcactggagaaagctatgctggacattatgtccctcagctagctgacactattctcacttataataagcttacaaatcacacagtgatcaacctgaaagggattgcggttgggaatggctggatagatgataatatgtgtggaaagggaatgtatgaatatttctggacacatgctctgaactctgatgaaacccatgagggaattcaaaggtattgtgactttgaaagcggtaacttaacaggtgaatgcagcaaatatcaaagtagaggggatactgagattggatccattgacatttatgacatatatgcccccccttgtgattcagctgcaaaaaaacctggttccagtcctgccactaactatgacagcaattttgacccttgttctgacgattataccaattcctacttaaatctcgcggaagtgcaagaggctctacatgctaaagcctcagtatggtatccttgcagtggcgatacagatgggcgtgttcccataacatcatctaggtattcagtaaatgccttgaaacttccagtggagacaacatggcgtccatggtattctagcaatgaggttggaggatacttggttgggtacaaagggctcacactaatcactgtaagaggagctgggcacatggttccaagttaccaaccgcagagagccctaaccatgatctcatttttcctacttggagaacttcctcctgaattcacctcttag

SEQ ID NO: 56961 - DNA, 491 bp, Glycine max
  Peptide Sequence Number=SeqID_173739
gtgggcagtcaaatggcacagccaaccaatctgaagcagattctacaaacacaactatatttgttggaggactcgaccctaatgtttcagatgaagatctcaggcagccattctcccagtatggtgagatagtctctgttaagatacctgttggaaagggctgtggttttgtccaattcgcaaacagaaataatgctgaagaggccttgcagaagctaaacgggacatcgattggcaagcaaacagtccgtctttcttggggccgtaatccagcaaataagcagtttagaatggatttcggcaacccctggactggggcatattatggggcccctatgtatgatggctatgggtacgcattgacccctcgtcatgatcccagcatatatgctgctgcttatggggcttaccccctttatggaggccaccaacaacaaacaagaatccctcctaattgtggagcggagatgaattttgatagcctgaggtag

SEQ ID NO: 56962 - DNA, 1584 bp, Glycine max
  Peptide Sequence Number=SeqID_173740
atgatgcatggaagcttgagaaatgcaaataaaagtagaaaagcctctagcagagaaagaaaattggctttgcagcaagatctggcaactgagctgaattctccaacttttcaggtggatacgttgaagaagaagctaaggcatgaagagaacattcatagagcattggagagggctttcaacagacctttgggagctttgcctcgtcttccgccttacctccctccctatataccagcccttctggctgaagtggcagttttggaagaagaaattgtaagacttgaagagcaggttgtgcatttcagacaggatttgtaccaggaagctgtctacatgtcatcttctatgaggaaattggaaaattcagtttccgctcctcctaacaagtcaaatccaacaatggatagtcccaagttggataaattgaagtctcttacccaaacaactggtaattcaacagcaacatctgcaactaagcctaccacaacactccctgatgataatagacaagggaaagagaaccaatcctgtactaattcttccaagagcaggaagcaatcctccaaccaaacgaacaaaactccaattaaaaaaattaacaatcaatcactgcagaaaaagttggatcatccaaaaaggaagaaagaaccaaaggtgaaaaaccagcaagttgcagatgtaagaaatcatagtccacataaaaattcaccagaagctcagagtccaaatataatttcagaaaatattctaaagtgcttatcaaacattatcttgagaatgagtgccttaaagaatccaggttctacatgtgacatgccacccgtgtgggatctaaaacctcacaaccgtgatgaaggaacagagtttggggatccatatggcatctgtttggaatttgggaagagggatattggtccatacaagcaattatggaaactagcctcggtcaacttggaaaacctcaaccatcaggagaagcttgcattctggatcaacatctacaactcttgtatgatgaatgcattcatagagaatggcataccagagaatcctcaaatggctgttgcactaatgcggaaggcaacaataaatgttggtgggcacgtgctaagtgcaacaaccatagagcatttcattttaagacttccttatcactggagatttacattttccaagggaacaaaaaatcatgaaatgaaagcaagaagcatatatggaatggaactgtcagaacccctagtgacatttgctctctcttctggaacttggtcctctcctgctgtgagagtttacacagcatcccaggttgagaatgaactggaagtggccaaaagagagtacttacaggcagcaattggattttcaacttcaaagtttgctatcccaaagctactggattggtatttgctgaactttgcaaaagacttggagtcattgctggattggatctgtctccagttaccaagtgaattggggaaagaagcccttaaattccttgaggaaagaaaaaccgagcccttatcacaatttgtacaaattatgccatatgagttcagctttagatacttgatatgcacataa

SEQ ID NO: 56963 - DNA, 516 bp, Glycine max
  Peptide Sequence Number=SeqID_173741
atggcattatgttccatatgccttgttctagggactataaggcaaaatagtgctagcattaaaggcatcgtcaaaggtaaggaattggtgatctcaccaataaccatcatttttgcgtttggttgtgttgaagaagatgaagtcattttggaatttctgaagacattgtttgttgaggaagagcagaggcataatgctgaaaaggctaccatgatggacatagatgagatgaagaatgctcagatggaagaactggagcgagttcaatctgcagcacaacttgcagcacaaatattctctccaaatgttgttcaaaggcaagccaaaataaaagttgccactgttcctgaagagataaaccttgctaaaagggaagctcttgaagaggccatacttcaatcggtcattgaagcatcttttgtagaagaaaatgatgaacaactctttgctactcaatctgatacaacaaatgaagacgaacttagacgattagaagagatttacatagcaccataa

SEQ ID NO: 56964 - DNA, 1377 bp, Glycine max
  Peptide Sequence Number=SeqID_173742
atgctaaagtgcagagagcatgagctagcatctatatatgccataatagacttaaggaaagtgtgtctggtcattgtgttgtacatgcatacagatagtatgaggagcgcactggtatggatttttaccttgaacgtttgccttcaaattttatttattcctggtggtgactcaaagccgcatccacgtttcagagagaaaatcactgaggagtacaatcccggatttataagcattgactgtggagcaagtaacgattacttggacgaggaaacaagtatcttttataagacagacacagatttcatagaaacgggagaaaacttgttgacgtcttctgtatttattaacacaaatatccctggtttaggaagacagctacacacattgagaagcttccctgagggaaataggaactgttatactctgaagcccgagtataagcaaggtgaacagcaaagttatctgattcgggctatgttcggatatggaaactacgatggaaaaaatcatgcccctacgttcgatctctatctcggggtcaactactggaaaaatgttaacacggcagacagatcctatatttgggccgagattattcatgctcccacaacagacaccatacaagtgtgtctggttaatattgacactggtacacctttcatttcgtcattagagttacgacctttaagcacttccatttaccaaatcatgtcacaatcatatctatacctccatgggcggtttgatgtcggtggccctgttgaaacctattataaaaggtacaaggacgatatctatgatcgcaggtggtactggcgcgatgttaaagattggtataagatcaatacaaccatagatgttaataaatctggcaatgatatttataaagtaccagctgaagtcttgaaaaccgcagtgcagtccttcaatcgctcatatgacttgtactatgactatgaaattgaatggaatgttctcttggacaagtattccagatattatgtctactttcactttgctgaaattcaacagcttgctccagggctcagaaggataatcaacatcactctcaatgatgaaaacatactctctgagcctataactctcgaatatatgaagcctgtcactattagtaacaaatatgcaactcaaggttccgttcgctttttaattagagcaactgcagaatcggatgctcccccaattctcaatgcttttgaggtttatcaattaataacagatctaaattcaacaacagatattaaagatggtatgtacgtattccacttatatatatgcctgtctatcctgctgtttaactcaccagcaaatttgtttccatcaatttctcggctcttacacggttacgcataa

SEQ ID NO: 56965 - DNA, 876 bp, Glycine max
  Peptide Sequence Number=SeqID_173743
atggaatatgtagactcgaagaaacaagagttcagctactcagaggttcaaagtattacgaataattttgagagggttgtgggtaaaggaggatttggaactgtctactatggttgcataggtgaaacacaagtagccgtgaagatgctctctcattcaactcaaggtgttcggcaatttcagacagaggcaaatattctcacaagagtacaccatagatgctttactccacttattggatattgcaatgaaggcaccagaacagcactcatctatgaatacatgaccaacggagacctagctgagaagctatcaggcttggagtaccttcataatggttgcaagcccccaattattcacagagatgttaagactagaaatattttactcgacgagaatctccgcgccaaaatatctgattttggattgtcaagaatcttttcagatgatggtgacacccatgtatcaacagcaattgcaggcaccccaggataccttgacccagaatacaacataacaaacaggttgaatgaaaaaagtgacgtgtatagttttgggattgttcttctagagataatcacggggaggacagtcatactgaaaacccaggtgagaactcacataatcaaatgggtaagttccatgctggctgatgatggtgaaattgatggtgttgtggatacaaggttacaaggagaatatgacagtgaggctgcaaggaaagtaatagatgttgcaatggcctgtgttgctccgagttctgttaataggccaacaatgaatcaagtggtcatggaactaaaacaatgtttccccgtggggaaacttgggactacgtccactggatccagtgaaattgtctctgcgggtgaatag

SEQ ID NO: 56966 - DNA, 867 bp, Glycine max
  Peptide Sequence Number=SeqID_173744
atgaagctagctaaacaggaagccataacacggatcttgcctttaagaccacttgttcaaaagcaactagacattcaagtgcgtcccaaccttcatgccaaactgtatcatgaagaagagtatgcatttggcatatatgaagataaggaaccaataatcaaggagttccctctaagacaaactattgctcccaaccctaacagtttgatctttgagcatcgacctatagataaaaagatgtatccttctagtgcaagtgtttggaaaagtagtgaggttgagtttgctaaaatgtctttccttccatacaatgagttgcttactgaaaatgatgaagattctccaccaaccggatatgttaaaacttgccctggtcatctttttaaacatgaggttgaagctctaaagcacaaatctgagctgatcactaatctggatagtaccttttcatttatggtgttcctaccattctttatattcttcttcacacatcacgtggattctaccattgacgaagtcaaattagatattaaagctgcttctaattccatggttttccaagtgtatgatcctccaccttcatgtgcttatgttagtttgcttgaagctgaacttgccagaaccacaaaagctcttgctcaagccttgaaggattgcgctcctactaaaaagaaggctcgcaaatggttcatgattggggactacttctataagaatatcactagctggaaacctcctcgtcctcttatgcccccaaggagccttattcatctctcatccaattctgatgactctattgatgagtttcataggaaacttaatgaagaagttgccaaacaaaaaaaagggataaaaagtaaaagttga

SEQ ID NO: 56967 - DNA, 339 bp, Glycine max
  Peptide Sequence Number=SeqID_173745
atggtcacttgggatgactctaacattgagaagagtatcaattcagacaatgagcaagtcaatatttgtctaatggcatatatagacaaaaaagttaagcattctaatgataagtctggcattggtctagaaaaagaagcatcatcttctaaggcacagtttgacttagacaaatgtgacttctatagtaagtttggacattccaatttcagatgcattcatcaaaagaaacaaatgtctaagggtactaatgctcatggaccaaaaaatatttgggtaccaaaatctcttattgttcctattgcagatatctttggtaggaaaaggtcagagtgttag

SEQ ID NO: 56968 - DNA, 885 bp, Glycine max
  Peptide Sequence Number=SeqID_173746
atggaagtggtggtacaaagtcctagtagtccaaacatggatactttcgattttggtggcaacatgggttcgatctttcaaagtgttccttcttcaccaaaagggtttggtaattactacctaagcgcaccggcgagtccatctaggatgtctgaattatacaccgaatttgaatattattcttcggcttcaccctcttcattcgaagcaggcaacaaaattgatgatgacgatgaagacgaaaacaacaacgattacagctttgcgttttacgtgaatcgcgatcaatcagacaagtcgtctcgctccgccgaagagctcttcgacggtggcaaaatcaagcccttgaacgagtcatcacgtgcgacttctgttgctgaacaaaaaagaggcagagaaagagagagaagttcttcttcaacaacaacaacaaagttgtcgtcctcgaactcgggtgttcgtagggtggcacgatcactttctccttatagaaaatcatgggaagttgaacaacagaaagaacaacctcggatcatcagcaaagaggaatcaagtgcgagtgtcttgtcctcgagcacttcttcttcgaagggttcgaagaggtggtcactgaaggactttttgttgttccgtagtgcctccgaagggagaggttcaagcaaggatgcattgaagaagtactacaacaagaagaatagtaacgaagaagttaaagggtcgtcgagttttagatcctcggattcgtcgaggtcaagaaagggaactatttcggcgcatgagttgcactacgccatgaagaaagcagagtccgaggatatgaagaagagaaccttcttgccttacaaacaagggattctgggaaggttggctggttttggaatctag

SEQ ID NO: 56969 - DNA, 135 bp, Glycine max
  Peptide Sequence Number=SeqID_173747
atggaagaagtggatagttcgcttagcgcgttctcgcacttagcgggcaacctcaggcttagcatgaagaaagcccacaacgaagcccaaagggatttgagagagagaatagataaattagactcttcatcgtga

SEQ ID NO: 56970 - DNA, 201 bp, Glycine max
  Peptide Sequence Number=SeqID_173748
atgcagacatcatgctgccgcattttctgccaaacaggccctcggctcaatcatcatcaacaactcgcacgtgaagtgaacgctcctgttcacacgtggaggccaaccattggtggaacccctgatgagatagccctctcccacgtgccatgcaagatcaaaacaaggaccatctcattcattcgcatccaagttagctag

SEQ ID NO: 56971 - DNA, 294 bp, Glycine max
  Peptide Sequence Number=SeqID_173749
atggaattaatgatgggtagtaggagatcgaggcgacggttacacagtgaacgtgcgatcatgacgccatttcaagaaaactggctaagacaagaaagagggcttcgaaccattgggcaaatcgagctggcgtatggtcgaatcgaagtcaaggcaacaagatttctggatttggcgcaatttctgacaaaacttcacaaaattagttcgacttcgagcaatgtgggtaaccgttctaaggagcagttatgtgcatgcaaggtgtacgtagcaggacacttggcattaggatag

SEQ ID NO: 56972 - DNA, 2139 bp, Glycine max
  Peptide Sequence Number=SeqID_173750
atgtctctttctcgcaaaccactttctccgtcgccctcgaccccagccaagcaaatcgacgccggtgatttagctccggcaccgcggttgaccaggcagaggaagctccggcacctcactcaccaagacattggcttcttccattccgacgagtcttcgtttcttcccggtttgccggagtttcgctcccacgccggttccgaccaccggtctttctctgctctgccgcaaccgctgccgcttcccgaagcgccgttgacccgtcgagcaaaatcaatcagctccagttccgtaaatcgtcgtcgcctttcatcttcgttagaacaacatggctttgctatttcgaggagcacagtgtatcaagaagcagtggcacgtacaaaacctacacttaatttggataaatcctgcttggattctactcttgcaaatgcaaattacaatctgagagagcatactcccgcagcaagtttcttgacaggcaatagttcatggaaaaaccgcagagcagtgtctcatgatgatgattctgaaggtaattcccacttgaagtatggtgttgctgccaagcccaagagtgccccaacaagtgtactcactagtcctgatactagtccatgtagatcaagcaatgtagatttctttgatcctaccgccaacttctctttggaagttaatgacaaatcaaaaatgttatcagctaaaactgttcatagtccagaccaattttctattcattgccctctaagcctcactcgttacttcaatcctaagattgaggaaggatctcaaaaccataaatttttgtccagggtgtgccctgaaaataaccttcttgattcacatcccttaccccttcctcctagagcttcatcaccagaacaattatctgttgtgctgcatcaatcaagtaccatgaaccaatcaagtatcatgcatcacgctactgaaaatctgccttcagtgaaaggtcgatggcagaaaggaaaacttattggacgtggtacctttggaagtgtttttcatgcaaccaacatagaaactggagcctcgtgtgcaatgaaagaggtcaatttaattcatgatgatcctacatctgccgagtgcattaaacagctggaacaggctgttattctgaaaagttctgtgttccaggaaatcaaaattctccgtcaactacaccatcccaacattgtgcagtattatggaagtgaaacagttggcgatcatttgtacatatatatggagtatgtctacccgggatcaatcagtaaatttatgcgtgaacattgtggagctatgacagaatctgtggtttgcaattttacaaggcatattctctcgggattagcttacttacatagtaacaaaaccatccacagagatatcaaaggtgcaaacttgctggtcaatgaatcaggcactgtcaagcttgcagattttgggctggcgaaaatactaatggggaattcatatgatctttcttttaagggtagtccttattggatggctccagaggtcgtgaaaggttccataaagaacgaatccaatcctgatgttgtcatggccattgatatatggagtttagggtgcaccattctagaaatgttgacagggaaacctccttggagtgaagttgaagggccttcagccatgttcaaggtactacaagagtctccgcctatacccgaaactttatcttcagtgggaaaggatttcctccagcagtgtttccgaagggaccctgcagatcgaccatctgcagcaacgcttcttaagcatgcctttgtgcagaatttgcatgatcaacatgttctagttcattcacaatcctatccaagaggagacctaggaccaggaggtaattcagctagtcctagagacactaccaaaaatagacgtggcataatgcaagcctccattagcacacggatttttaacaatattcagaaattaatcggcgatacttccgaacaaagcaatgctaaggagtctaatcatattataccttatcttcactctcatgttccagaagtgaaaattcttcaatctccattggaatctggtaccctcaatttcatgtctgttgcaaattccaaaaacatttcctccgtcatgagaatgatcacgaacttctga

SEQ ID NO: 56973 - DNA, 855 bp, Glycine max
  Peptide Sequence Number=SeqID_173751
atgaaacccaaacccttcatcttcgccaagcgcttcccaattccgttgcttttttcttatccattttctccgcaacaacaacgttttcccttctccactcacaatcgccactccttcgacgaagccgttccaggttgcagcgccgtttaccaacacgtgctcaagttccagcgtccaccgaccattcggtggagcccgcacctcgagaacaccgctagtttcatcggcaccgtcgcccgcgaaccgacgcgcgttaactcaacaaccggtaaatgcggagtttacaccgtgcttaaggttccaaaatccaaccaatcaaatagctcctttttccggttgcttctgatgatgcggaacaatgtggcaaaacttgcttcggaacacttgaaattgaatgattttattcaggttttaggttctttggggtctttcacgaaacctgatgccaatggaatccttagattgaattacaagtgtactgaaattctaggttcttgcttgaatggtgctctgttagaggtgaaggagttcgagtttgttgctcaaaggtctggttatctaggcgacaagaaattggaatctgttgaagcagatgctggcatgcaaaaaaatcaaaatcggcttcacctttggcaagtgtttttttccaatccaaatgagtggtgggatcaaagaaagagcaagcgaaatccaaaacagcctgattttaagcacaaggataccggcgaagctctgtggctaagtgagtatgatcctccatgggttaaaaggcaactccaattgtttgactcaaaaattgctggaggatctgcaggtcgtcgttcacgtgtcaccaactgggtttatgatgagtag

SEQ ID NO: 56974 - DNA, 396 bp, Glycine max
  Peptide Sequence Number=SeqID_173752
atgaagttggaaaggcaacaaatattgtctcaatttataaagatcatgaagaagttctacaaatatcttaatggcattgaatcaaccttgccacgactgaaagacattgtcatggaacctcttggtgtatctgtggatgaagacctcaacaatgcagctaaacaagttgaggatgatatgaagtcgaaagtggaagcaccctttactcctgagttgctccagcggtatgccattgatggtggagaatctgactttgagactgttttaaaacataatggaggaaacatacccacgggtggtcttattagtgttatatccagcaggagtggaatcaagcctgaaaaggaaaatggaagtggtaaaaagcggcgcaaagacaatcacagccataattaa

SEQ ID NO: 56975 - DNA, 369 bp, Glycine max
  Peptide Sequence Number=SeqID_173753
atgcagcaacgtacgaccaagcttgaatccattctaaccataaatggtgacaaccacgactctgatattttaatggctttcacggctgccaatagttctgcacaaagtgctaaggtgcttccaatatgcctcgagaaacatcccataatgataccccagctaagacaagaaagagggcttcgaaccattgggcaaatcgagctggcgtatggtcgaatcgaagtcaaggcaacaagatttctggatttggcgcaatttctgacaaaacttcacaaaattagttcgacttcgagcaatgtgggtaaccgttctaaggagcagttatgtgcatgcaaggtgtacgtagcaggacacttggcattaggatag

SEQ ID NO: 56976 - DNA, 538 bp, Glycine max
  Peptide Sequence Number=SeqID_173754
atggtggcgccggcggatttagagcctccgcaggcggcgcagccggtcgttgaacccgttgttgaaccggagccggaaccggagcctgaagtggtgcctgagccgccaaaagaggcaccagtggttatccacaaaccggagccgaagcccaaacccaagccgaaaccaaagcctaagccggagaaaaaagtcgagccgaaacgcgaggtgaagcccgctgagccgcgcccggtctcgccgtttgagaataacaatacggcgcctgcgcgtactgccccgagtaccacggcggcaacggcaaaaccgatgaccaccgcgccgagcggtcctaaagcgttgaaacgcggcgacccgtcttacccgcaacgtgcgcaggcgctgcgtattgaaggtgacgtgcgcgtgaaatttgatgtcaccgccgatggtcgggtggagaatatccagatactctctgcgaagccggccaatatgtttgagcgtgatgtcaaaaccgcgatgcgcaaatggcgctacgaggcaggcaggccgggcactg

SEQ ID NO: 56977 - DNA, 164 bp, Glycine max
  Peptide Sequence Number=SeqID_173755
atgaataggttgatgactatgaagaacctcatgctagaggacatgggaacacaacgctctgataggatggtgtcacaggtgtctccgcgcatctttcctcctttggaaagcgcacccgtgagcctcgccctcgctcgcccgcgaagggcacgctgcgacaatag

SEQ ID NO: 56978 - DNA, 573 bp, Glycine max
  Peptide Sequence Number=SeqID_173756
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgaattggagctccaccgcggtggcggccgctctagaactagtggatcccccgggctgcaggaattcgatagcacctggcagctggccacggtgagcggcgaaatcgacagcagcgtcaaccagcgctatgcgcgcatcgagcagctgcacgcccagcgcgcgcaggcgcaggccggccagccggccgacctgtcccgcatcgatgggcagatcgcggcgcaatcggcgcagatgcgcgcggccgccggcgcggcgatacggcgggcacacgatacgagcgtgctgatcattgcactgggcgtcgtcggcggcgtgctgagcctggcgacggcatggagatcaagcttatcgataccgtcgacctcgagggggggcccggtaccagcttttgttccctttagtgagggttaa

SEQ ID NO: 56979 - DNA, 833 bp, Glycine max
  Peptide Sequence Number=SeqID_173757
atgacgacgcgacaggttggcagaacccgccttggcgagaaaacttatctcgagcacaagaacgcacggctgctgtcaaatggcatggcgacaaccgacatgcagctgcgcgatatccggcaggcatgggaaggcatcgccaaccgtcagcttcagcgcgaaggtctggacgttcgcatcgatcatcgatcgcatgtggagcgcggtcttgagttgtcgccaaccgagcacatgggcgtgcacgcctcgcagatgcagcagcagggactggccgtcgagcgcggccggctggatgacgaggcggcacggcaaaatgccgaactgatccgccaaaaaccgcaacaggttctgacgctgatcagcaacgagaagagcgtgttcgaccggcacgatattgcgaaaaccttgcatcgctatatcaacgatgacgcccaaatgttccggaacgcctttgccgctgttttggcatcaccagcactcgtggaactccaggctgagcacatcgatccagagaatggcgaggtttccaatgcgcgctattcgacgcgggacatgataaatctggaactcgcaatggcgcgatcggcggagcggctgcatcaggcgcagtcccatggtgtcgatcatcgtcatgtcgaacgtgcaatggaaaggcaggatcacgctcttcggacaagcgctggcggaccgtcggccgcgagcgatccgtcatcaagattgtcggatgaacagcgtcaggcgatcgagcatattaccgggcgagaacgcattgcggccgtggtcgggtttgccggcgccggaaagtccaccatgctcgcagccgctcgcgaggc

SEQ ID NO: 56980 - DNA, 322 bp, Glycine max
  Peptide Sequence Number=SeqID_173758
atgacggaagggtgtggtgaagggttttgccttgcaaaccttctcggtgatgcttttagtttatgggggaacttctttgaggcaaagaaacaaatgatggctgatgccaagtttgcggggctgcttggtcttggcaagccgttggttgaaattttgccccccggtcaacttcgtggtttttgcccgttgttggctaggctagggttggcggtgctggggtttgttggtgatttggaggggagggacgaatcaaagcgacaagggctgaatctcagtggatcgtggcagcaaggccactctgccacttacaataccccgtcgc

SEQ ID NO: 56981 - DNA, 525 bp, Glycine max
  Peptide Sequence Number=SeqID_173759
atgggtgatcaaattcatgttgtttgtaaagcgaaccagctaaagtcttggaaagcttatttgaaggaaaattccacttatgttatgcataatttcaaagtggtgaagaatgatggtcaatttagagtgtgtgaacatcagtacaagttagtttttattggagtgactgttgttagaaaagctgatttgcatgagctgccttttaaggaatttagatttgttgaatttggaaatgtcgttggtgggaattttgtggctggcctgttggttgatattattggggtcattgatcagttcttagcctatttgaatgaacgtgggaatgatggaccgatcattattattttgacacatgccagaataaaagatgcgcagggaagtaatccagcttcagtgagcaattcgttcaaggcctcaaaattattaattaatgaacctgtattggaaatccaggaatttagggagaggtattttggtcatcgcctttactctgtggctgttaaattggtgtatcaactgtgttga

SEQ ID NO: 56982 - DNA, 165 bp, Glycine max
  Peptide Sequence Number=SeqID_173760
atgaggcacgctgataaagagattgtgattgtgaaatcaaaatccctaacaataaagggtgaaatcacaattgaggcgcaaaaatatcacttgaagccacatagtgagggggcatcacaccagtggcacacgacaaagattcaagagaagcaacaaggagagtga

SEQ ID NO: 56983 - DNA, 288 bp, Glycine max
  Peptide Sequence Number=SeqID_173761
atgaatcgaaagcaaatattcacagttgtcgcaacctacccttcggcgggagggcgacgcgtggctcgcgggatgcgtgttccacgaaaggaatacgcacggagtcgccaccaacgtttatttgaggaaaacgtcgaaaaaaccggaaaagacgcgatctacgaacttttaagtgaaaggttcgggagttgtatttacgcacggggaagatgtcgtacaggatgtcacgacatcgcgcttcagaacatgcagattgtatatgacagtatgaacagattaaacaagtaa

SEQ ID NO: 56984 - DNA, 292 bp, Glycine max
  Peptide Sequence Number=SeqID_173762
cccgcatcaattagaccctgcaccttacgcttcaggcccctacaatgctcaatggaatgccccggggcttctccatgacaagcacacgttgcgtttgagtcgtattctcggagaaatggagattgatgaaccttggttggggctttttcactgcaaaattcatttcttggttggtgttttggtttatgctaaagggatggcctttgtggataactgggcggtgggtaaggagaaggttggttattggctgagtaatgacattgttgggttggtgggaaacttggctgtatag

SEQ ID NO: 56985 - DNA, 189 bp, Glycine max
  Peptide Sequence Number=SeqID_173763
atggtgtttgaaatgtctaacgaagacggcatgccgtggttgctaagctctggcacgacgagctggttggaccgggtggaattagacgtgctcgattccgcagagattgctatagaaggctggaatgggaagttttctgacgaaggtggtggtggtgatgttggtggagatcctcacctccctccatga

SEQ ID NO: 56986 - DNA, 228 bp, Glycine max
  Peptide Sequence Number=SeqID_173764
atgtggatatggcatggtgacttgatagacatgcagagtgggtcccaatctaaaccgtttgatgtagaaatgggagattgcttggaggatatgattcgtgaccttggacaagagtcttttcagcaagcacatgcccctatgtatgaaggattgcagagtgactcaaagaagcctttgtatacggggtgcaagaattccttgatgctgttgtcggtggtgttaagtctg

SEQ ID NO: 56987 - DNA, 591 bp, Glycine max
  Peptide Sequence Number=SeqID_173765
atgtttgttttgactgcaattgcactttcattgtcagtggcttctgctgctacaaaccatgttgttaccacggttggattgaccttttcacctgccaagatcaatgtcagtgttggtgatactgtcacttggaactttgctggtactcactctgtcatcaagactgctgatgctcaatcgtgtgctgctgtgcccaatgctttcaactctggtatgaaggccgctggcactagtttcgtgtggaaggctgctacggccggtactgtctggtatgcgtgtggtatccctgctcactgtgctgccaacatgaagggtgttattgttgtcaatgctcttgctggtcctgctcctgctccaggtgctccagcacctgctcctgctccgggtgcacctgcaccaggcgctcctgctccagctcccgctccaggtgctccagcacctgctcctggcacatcatccgaaactgctcctgcttccgctcccagtgctacttttgctcctgctgccgctgccaaatcagatgcccaactcaatggccgctccgccgtggctgctgtcggtgttgccgttgcaggtcttttgatgctgtaa

SEQ ID NO: 56988 - DNA, 525 bp, Glycine max
  Peptide Sequence Number=SeqID_173766
atgttcttgaactcgtggctcttccctcatgccgatgatcctcttcttcaagaaacatcggggacatgtagaactgtacttaccagtcaagggagcagtcgccgctgcctatcacgcggtggaggttctcgtcggtgcagagggcctgggccataccttgcgtcgttgattgaatgttgtggtcggttttcctacgattccccatgctgcatcaatactcttctctttgtagaagtaaagcttcatgatgaatcaagattgattcaaagatgttttgatgataacaaagatgatgacaaaggtgatgacaaaaagctcaaaggtcaatcaaagaatgagttcaagatagaatcaataacacttcaagattcaagaggaaagttgaagaacacttcaagattcaagaggaaagttgatttcaagaatcaagaatcaagaatcaagaatcaagattcaaggatcaagctttcaagaatcaagatcaagattcaagactcaagattcaaaaatcaaaagaaggcttaa

SEQ ID NO: 56989 - DNA, 666 bp, Glycine max
  Peptide Sequence Number=SeqID_173767
atggcaactagacggttggcggcggttttggcccttcccgtgctccatcaaaggccaactgagttcagaactatcacctctgacaacaccaaatcattgttttacaacaacatcaaatcctcgataggaatgatcctatccgtactatcaccttcgcaagatgggtataagggtggagacgggttggatagtttcatacgtgaacctgagcccaacctgatttcccaagtcaaggaaagcacgaaactactcccatttaaggggatcatcaagattatggtaactaacttcattccaacctatattatgatacttgcatatctttgtgctcctaacttgagtgttagagtgtcttcacaagtacacccaccatcatcggtggaggagctcatggaggagcaacaccgtgaggaggttctaccaagttcggagtccaccattcatgggatgcctaccatgagtgcccctaaaaaggggaacccaacaaacgtgatccatttggctaggaccaatgaggctgatactacgtggagtgaagggactcccttcataacacaattggttcaaagagcaataaatgctgacacttggctgcatccctttgttgatgggattatggaggcacaactcccacctgaatggaagatgctgaccatcgatcgttaa

SEQ ID NO: 56990 - DNA, 360 bp, Glycine max
  Peptide Sequence Number=SeqID_173768
atgttctctgatgcaatcctacccccaggtgcattggatagaagactccaagaagattggaccagagatacaggagaaggccctagggttctcatgagccttaaggaacttaagagggagtcagttgtaaaaggcaagagtgacaaacatcacacaaaagcctatattgagagcatcaaacacgagtgtgcttccatcaaagagagaaacacaattttatgttccttaattatggcaggagctggtgacactggtggtaaatatcatcaactagacgaatctcagcactttttactggacgtggtgactacacaaatgcaacgtttgctgaactgtaacaatgaagagctctacggatga

SEQ ID NO: 56991 - DNA, 390 bp, Glycine max
  Peptide Sequence Number=SeqID_173769
atgcggtgcactacagtgacacaaatgtccgaacttcctccttgggtgcctttgtgcagtgttgataataggtctgatcctcgtgtggcacaacaatgccaacaagttgtgagaaccagaggaaaacaacaactagagagggaaaaaagtcgaagccgagtactagaagaagtatgtagtgccgaggttattcgggttccgacaaaaaatcgaccttcaccaagagttgacaagttcaagtattgttgctatcatcgggtggctggtcacaacactgaagagtgcactaccctcaaggacaagataaaaaaattgatccaaaatggacagttgcagagattcattaaagataaggacttttcacaggatcaagattgtgaaatggattga

SEQ ID NO: 56992 - DNA, 162 bp, Glycine max
  Peptide Sequence Number=SeqID_173770
atgaattatgttccaatggttggcaatgataacaactggtctttggtggttatatcaatcaaggcacacaaggtttatcatttacttgcaacccacaaccaagatcatactgaacaaatagcgaccaaggtgcaccgtgtggtaagtttagggactatgtaa

SEQ ID NO: 56993 - DNA, 447 bp, Glycine max
  Peptide Sequence Number=SeqID_173771
atgtcttcctcagagggtgtcgttgaattgggaattgagttctcagaagccaacaattttcttctcatgtctctaatggaagaaacacaagaagaagagtacgacggcgatgatagacttgtgagcatgattcagtcattggaggcagagatcagtgacactgaaatgagtcaaatgtatgagatgagtcacgtggatgatcaagattgctctacgtcagtcagtggccctgatcattgggttgacatggaattgatctcttctttgacctttgatgggatgaatgcatggattccttgtggagatgagatgatggagcatgcagcaatggaatatgaggctggaaatgacatcaatgattttcaattgtgttatggagttttcttggagcaacaatatagagagactaattatctggcacaagggccatgtgatgcagtattctga

SEQ ID NO: 56994 - DNA, 603 bp, Glycine max
  Peptide Sequence Number=SeqID_173772
atggaccgtttaaaaaaattgatccgtaacccgcacggaccatgggccccgcgggccagtccatggacctgggcctatttacccacccctatgcaccagttcggatatgtccagagtattcctccacatcctgtcgattcatgggagtcatttgatgaaatagatgtcaggtggatgcactactcaaaccatcttgcgctagcaggtgagatgtgtgttgtgccaggtcaatgtgtggccgactacatggactggttcttcgtcatttctcatccattcatgaccgcggcacaaccatcaaatccgccgcgagatccacttgcgacgcatgatgcctcatttgtggagccacatatccctcaaatcctgaaaccagcagcagcatcaacacatgcccgttctgaggtggatgagcctagacatgcagtggcttgccatgcgatcgctgaaaggttggagcgtaatctcaacctaaggatagtcacgccaagcacaaagacacatgaggtcatggaacaacgcctcaagattgccaggggtgtcatagaagaccacattgtgtatgtgaggtctcgacgtaggtggtgcacggatcaaccatag

SEQ ID NO: 56995 - DNA, 4455 bp, Glycine max
  Peptide Sequence Number=SeqID_173773
atggatgcgatagctaatgtaccgggtgtttctgaaattgctaattatgtgattacatttattaagggtcaaattgggtacatatcctcctacgatgaaaaccttgaaaagcttataaccgaggctcaaactctgaaggatactcaagacggtgtgcaacaccgggttgttgaggctgaaaggaatggagacaagattgaaaatattgtacagaactggctgaagaaagcaaatgaaatggttgctgcggcaaataaagttattgatgttgaaggaactagatggtgtctgggacattattgtccctatctgtggacaagatgtcagctgagcaagagttttgaaaaaattacaaaagagatttcagatgtcatagagaaaggaaaatttgatacaatttcttaccgtgatgcccctgatctcacaattacaccattttctagaggttatgaagcactggagtccagaacatcaatgctgagtgagattaaggaaattcttaaggatcctaaaatgtacatgattggggtgcatgggatgggtggcgtgggtaaaacaactcttgtgaatgagttagcttggcaagtgaagaatgatggctcgtttggtgctgtggctattgcgaccataaccagttctccaaatgtggaaaatgtccaagaccaaattgttgtagctatatgtggtaaaaatcttgaacacacgacaaaagtaggaagaatgggagaattgcgtcgaaggataaaagcacagaacaatgttctcattattcttgatgacatttggagtgaacttgatttgacagaagtgggaattccttttggtgatgaacacaatggttgcaaattggtaataacttccagagaacgtgaagtgctgataaagatggacactcaaaaagattttaatcttacagctttactggaggaagatagttggaatttgttccagaaaatagcaggtaatgttgttaatgaagttagtataaaaccaattgcagaagaagtggcaaaatgttgtgctggtttgcctcttttgatcacagccgtggcaaagggtttgagaaaaaaggaagtccatgcttggagggttgccctaaaacaactaaaggaatttaagcataaagagttggagaataatgtctaccctgctttgaagttaagttatgattttttagatacagaggaattgaagtcactattcttattcattggttcatttggactaaatcatatcctcactgaagatttgtttagatgttgttgggggttgggcttttatggtggcgtggacaaattgatggaggcaagagacacacattacacattaataaatgagcttagggcctcttcattattgcttgaaggtgaacttgattgggttggaatgcatgatgttgtacgtgacgaggctaaatcaattgcatctaagtctcctccgatcgatccgacctatcccacctatgcagatcagtttggcaagtgtcattatattagatttcagtcttctttgactgaagtccaagctgataacttattctctgggatgatgaaagaagtgatgactttgagtttatatgaaatgtccttcacccctttcctacccccttctctcaatctcttgattaagcttcgctcattgaatctaagatgtaaattgggagacataaggatggtggcaaaactctcaaatttagaaattctttccttggaggagtctagtattgaagagctcccagaagaaataacacatctgactcatcttcgtttgctaaatttaacagactgctatgaactaagagtcattcctacaaatcttacatcaaatttgacgtgcttagaagaattgtacatggggggttgcaatagtattgaatgggaagttgaaggaagcagaagtgaaagcaagaacgctagtttaagtgagttacagaatttgcataatttgacaactttggagatatcaatcaaagatacttcggttttgtcaaggggcttccagttccctgcaaagctcgaaacatacaacatattgattggtaatatttcagaatggggtcggtctcaaaattggtatggtgaagctctaggaccctcaagaacgcttaagctcacgggctcttcgtggacgagcatatcgtcgttgaccacagttgaggacttgaggcttgctgaattaaaaggggttaaggatttgctgtatgatttggatgtggaaggttttcctcaattaaagcatctgcatattcatggtagtgatgaattgttgcacatcattaactcaagaaggttaaggaatccccattcatccgcattccccaatttgaagtctttgcttctttacaatctatatacaatggaagaaatatgtcatggtccaattccaacactgtcttttgcaaagcttgaagttattaaagttagaaattgtcatggattggataatttacttttgtattccctcgcaagaaacctttctcaacttcatgagatggaaattaataattgcagatgtatgaaagagatcattgctatggaagaacatgaggatgagaaagagcttcttgagattgttctacctgaattgcgttctctcgcattagttgaattaactaggcttcagagtttctgtttgcctcttacagtcgatatgggtgatccatccattcaaggaattcctctagcactgtttaatcaacaggatcaatttccaaactcggagacagtggaaatcagcatcatgaatgattggaaatcaatacggcctaatcaagagcctccaaattccttccatcacaatctgaagattaacatttatgactgtgaaagcatggattttgtctttcccgtatccgcggctaaagagcttcggcagcaccaatttcttgaaataagatcatgtggcataaagaatatttttgaaaaaagtgatattacttgtgatatgacccatgtttaccttgaaaaaataactgtagagaagtgtccaggcatgaagaccataattccatcctttgtgctatttcagtgtttagataaattgattgtgtccagttgtcatacactggtcaatattataaggccatcaacaaccacaagtttaccaaacctccgcattttaaggataagtgaatgtgatgagctagaggaaatttatggaagcaataatgagagtgatgatgcaccattgggcgagattgcttttaggaaattggaggaattgacattgaaatacttaccgaggctcacaagcttttgccagggaagttacgatttcaggtttccatcactacaaattgtaattattgaagaatgtccagtgatggacactttttgtcagggaaacataaccacaccaagcctcacaaaggtggaatatagattgagtagagataattggtataggattgaagatcattggtatggcgaccttaatactactgttagaacagctttcactaaaaagtatctatatgatgactgggagacgctagatatcagaaacaacaataatttgaagtccatatggcctaatcaagtgactccaaatttctttccaaacctgacgaaaattgtcatttatcgctgtgaaagccagtatgtctttcccatctacgtggctaaagtgcttcggcagctccaagttcttgaaataggcttgtgtaccatagagaatattgtggaagaaagtgatagtacttgtgaaatgatggttgtttatcttgaagtacggaagtgtcatgatatgatgaccatagtcccatcctctgttcagtttcattctttagatgaattgcatgtgtccaggtgtcatggactagtaaatattataatgccatcaacaatcgcaaacttaccaaatctccgcattttaatgataagtgaatgtgatgagctagaggaagtttatggaagcaataatgagagtgatgaaccactgggcgagattgcttttatgaaattggaggaattgacattgaaatacttaccgtggctcaaaagcttttgccagggaagttacaacttcaagtttccatcattacaaaaggtacatttgaaagactgtcccatgatggagactttctgtcatggaaacttaaccacaacaagccacattgaggtgcgatgcctatatggatggagtaatgaagaatcagaagatcattgggatggtgaccttaatactactattagaacaattttcactaaagagccacttagcaattcttcaatcattgtcaaatatgaaatcttggtgaattccatcaccacattaattttcatgaatgtgattgtgtccattgtgtttaactttggagagatagagcttgcaaatgcaactccttatgtgctattatccaactcgtctgcggctgtgaagaagattgtggatcagaaagataaggttcatatgtttcttgcagtgaggggatcaatcacaggaatattgaagtga

SEQ ID NO: 56996 - DNA, 225 bp, Glycine max
  Peptide Sequence Number=SeqID_173774
atgacactagaggcatttctatctcaggttgaagtagcttctctttatgttgcagagccttcaccatggacagtaccttttgatgcagagccttcaccagttatctctccagcaaccagcgatgacactaaaggcatttctatctcaggttacttagccaggagtctagcttcattctataaggggggtgatacctctggtgtcaatgtaagtgatggagtgtga

SEQ ID NO: 56997 - DNA, 471 bp, Glycine max
  Peptide Sequence Number=SeqID_173775
atggaaccacccactaaacaatcttcaagccatagtgtcgttgttcaatcaagagttggggctacattggtagcttccacatttgcaatctttaatacccctatgatttatcctggaagactatgtagacagttagggagagtttccaaacactatagagccagtgctagagatggcaacacttgtcctttctattgtctgccagaaaatagacatgggatccatgatatcatgcaacaactctctgggaagttaggtgatattgtgaaacctatggttttgaacaaattccagaaagctcgagaagaggaacaccatcatggtcaattagaggcaacgactaattctacacccagaaatcaactttgtcagcctctagtcactacacttgtgataggtattgaagcatttgaacctcctccaatacaatttggtacatgtaaatggctaggcatctacctaatgtcttag

SEQ ID NO: 56998 - DNA, 432 bp, Glycine max
  Peptide Sequence Number=SeqID_173776
atgaagaaaattacaagaagaaaaaaaggaattgcatttaaagccttatcttctattcaagaagaaagtgacaaagaggacttgaatgaaatagaagaagatgatgatttcagactttttgtgaagagattcaataaatttctgacaaacaaaggaaatcaaaggagatcaaacttcaatccaaagaagaaaggagaagattcctccttagccccaaaatgctatgaatgcgatcaacctgggcacttgagatttgattgtcttgtttttaaaagaagaatggaaaaatccaacaagaaaaatttcaaagataagaaagaaaataaagcatgcatcacttggaaagataatgacatggattcatcaagtgattcagaaaacgaaatcataaatctaggcctcatggtcatagactatgaaagcggagaagag

SEQ ID NO: 56999 - DNA, 654 bp, Glycine max
  Peptide Sequence Number=SeqID_173777
atggtccaggaaggaatattgttgggtcataagatcttagcacgagggattgaggtggacaaagcaaaaattgatgtcattaaaaagctacctccaccagtcaatgtgaacggcatcatgagtttcctcgaacatgcaagattatatcgacgattcgtaaaggatttctccaaaattgccaggcccttgtgcaatttgctgaacaaagatgcagtgtttcagcttgatgaagaattcttgacatcctttcgggccttaaagaacagtctagtatctgcttcgataatggtggcacctgactggagtaaagaaattgacctcatgtgtgacaccaatgactatgcagtaggggtaattcttagacagtggagagagaagctaagttatgcgactactgagaaggaaatgttggccatagtctacgcattagagaaatttggatcatatttggtgggctccaaagtagttatctttattgattatgcaataatcaaatatcttctcacaaaggcagatttaaaaccaaggctaattagatggttccttcttattgaagagtttgatatagtgattaaggacaagaaaggctctaagaatgtagtggttgaccacctctctaggttagtaaataaagaagtaactcaagaggagtaa

SEQ ID NO: 57000 - DNA, 891 bp, Glycine max
  Peptide Sequence Number=SeqID_173778
atggccaactacaaagctgcaagtatcattccaaacgacttcaattggaatcaacggaaaaagttcctccatgatgctcgtttctacgtctgggatgatccctatttattcaagattggagtagataatatattgagaagatgtgttaccatggaagaagctagaagtatattatggcactatcataattctccttatggcggacattacagtggggataggacagatgctaaggagttacaagcagaagtttttggccttctatcttcaaggatgcccataatcatgtgcttcattgtgatcaaagccagagaactgggggcatttctcagagaaatgaaatgccattgcaaaacatcatggaaaagctatagctctactccaaagaatgatgccaagactgctatcaagttcttgaagaaaaatacattctcccattttggggttcccagtgtgctgatcagtgatgaaggttcatacttctgcaatgcacagttgctaagagttctagggaattatcatgtcagacctaaggactgctttcgatacttccatttgactatcaccatttcagatggtctatgggaaagtgagaaatggaagttgcaactactagagctagaggagatgaggctcaatgcatatgaatcctccatgatttacaagcaaaagataaaggtgtatcatgaacgaaaattgatgaagaaaacctttcagtccggacaacaagtactgttattcaattcaagactaaggctcttcctaggaaaattcgactgcaaatggtctggtcccaccataatcaaagaagtgaagccttatggagcagtagaactggtagatcctgccccaagtcaacccaatcaaagttggattgtcaatggtcagtga

SEQ ID NO: 57001 - DNA, 471 bp, Glycine max
  Peptide Sequence Number=SeqID_173779
atgccttaccaggatagcattcatctccaaaacattcttctggagaagaatgtggagttcatgcctgacatgagttttacaccaacatctatgatccggaggatggttctccaaagcagtgcaaattacacagatagcccactccagtacgtccagggggttgatttggacactttgacatacgagtccctcagcctggttaaggcagccttcttcctcttagtcggagtagctcatccagatgatgcgaagcctctaccatgtccaacaccacatcattcagaacctacaccagctttccatccagccaccactgatgacaccagaggacttcctacaacaaaaacaagaggcggtgacacctttggcattggtaatgatgatgtcccaaaaacaagagctgatgaagattatgttgcggacatcactgctactcagggatcctgggacccttggccagctcaagattaa

SEQ ID NO: 57002 - DNA, 756 bp, Glycine max
  Peptide Sequence Number=SeqID_173780
atgtctgagcaattttattgcaatgagggaaaggagagtaatttgaagaaaaattgttacgagacaaagggtcaggaatatttgtatttgaatcctgagtttcttttgaagagcattgatctctcaagtaatgatttaacaggtgaaataccaaaggaggtaagatatttacttgaattagtttctttgaatttatcaagaaatagattaagtggagaaattcttcctgagattgggaatttaacttcactagagtttcttgatttatcaagaaatcatttctctggtgaagttccttctactttttccaaaattgatcgttttgtcgtgttagacttatctaacaactatcttgttggaagaatcccctggggaagacagcttcagacctttagtgcctctacttttgaaggaaataccgatctttgtggtgaaccacttaacaaaagcttccctggaaatgacacagcaacaaagcctcaaggaccagcaattcatggtgatgatgacaattcaattttctatgatgcattatacatgagcttggggttaggattcttcacaggcttttggcgcttaataggctatccgggtcaatcttttcagaggatccaaattctcactttcattgtgggcctacacatttccgatgagcatgttgtgtgggaggatatacatgagcaacgtgcactcaacgtctttttggtcgttggtgattgtgttctagttggcttccaggtgatcaacttctcttaa

SEQ ID NO: 57003 - DNA, 147 bp, Glycine max
  Peptide Sequence Number=SeqID_173781
atgcagcatgtgatcatcacaaagagcaatgaaagagaaatccgtgagaagcacgcagcaagcacaagcacaaacccaaaccctaagaaggcacagaagatgcagagagaagaaaatgatttgaagcagagagaaggtgcagaataa

SEQ ID NO: 57004 - DNA, 372 bp, Glycine max
  Peptide Sequence Number=SeqID_173782
atggcaacaacacatcattcactgaacgaacactcctttgatttgggcatcgagaatgacttacaagatttatcacttctcattgttgaagactcattggataaggaagaaaagacagacacagtgtgtaagaaacttggacacaagggtgaaggatcccaaggtgtgtttagagattgtaaaggatttacaaggatagtggaaaatctcaaaccaccaaatctgtctcaggaaaatgacaatctcgaatgcattcaccgttggatcgtcgtgaaatttaagcaacaggttcgcaactcaattctgggaattctcaccattgggaattacgaaaagaaatcggagatgagagaaatattgttcgcatcgtga

SEQ ID NO: 57005 - DNA, 613 bp, Glycine max
  Peptide Sequence Number=SeqID_173783
atcttcaaacctggcacaggtttctgaagaagatctaatagtcatgtgggcctttcataccggccgacaaattgattgggcacatttagtccgcatccctcttgattctgaaccatatattccaatcaagagatctttcttgatcggtgctgctgcggttgcgtcctttggttaccgcaaagagcgtgatgactcttgggtaaaaaaggttgctcaaccaaatgatgatgaaggacaattatcggttgaaggggactcttctctccttcagagtattttggacaggttcgatggactccaaacctatgttggtgaaaggtttgatgctttggaacaacaagtggacatgcgatttgatgcaatggactcaaggatcacaaacgttgaagaatatgtcaccatcattcgcgactgccttgatttacctccaccaccaccatcaaacaagagagggtacatctcttgtggattagttcaagtggagggtacatccacttggttgttcaaagagaacaagggagggtacatcccttgtggatctttggcttgtaaaggattttacaaggttgaaagaaatctcaagaaccgcaggttgcttggggactggatgtag

SEQ ID NO: 57006 - DNA, 192 bp, Glycine max
  Peptide Sequence Number=SeqID_173784
atgtcaatatcctctgcttttatgccctataggactccaatgccctccattttatgttttataggacttcaagcgcaaggccaagtggtcgtgcagggttttgatggttgtttgtcagttccagaaacaaaagccacaaggaagaggcaaaatggtcatttcctagagtttgttgaccctaaactcgcctag

SEQ ID NO: 57007 - DNA, 273 bp, Glycine max
  Peptide Sequence Number=SeqID_173785
atgaccaaaccttcaaaagctgcaggttgggacaaggaagggacaaaggagaacacacatcttttagaagaaattgaaaagatcttatgctatgtatgtgatgaagtctacatgtgcttgctgcattcgtatggcttgctgcattcttatcaccatagagtggtggcagtgaagtgccttaagaatgtcacaagtggagatgcagagttttgggcaaaagtcacaatcattgccagaatgcaccacctcaatatggaactgaatttgagttag

SEQ ID NO: 57008 - DNA, 738 bp, Glycine max
  Peptide Sequence Number=SeqID_173786
atggcttctccacctgcctcacctcctcctcctcctccttctcctcctcctccttccgacgcatcgcctttgccgtctaccgtgaagcagacacgcaaagcctcacgtctacaatcgttgtctactagaccacctagtgctgagagaccggtggtccacattgatcctagtatcggcaaggccgatggtccccataggaagaaattaagaacatatttggggattgtggcgcgtgataaggtggacgtcacctatgagaactggaaggaggtccctattgctcagaaggacttgatttgggaggatattcgggcggaatttgaaatcctagaggcttctgacagtaggacgaaaaggaagttacttcagactgtcgatgagagatggaggcagtttaaatcagaactcatgaggaaatgggcccttgcagccgatcaagatggatgtgcggaaaaaaggcacaggccatccagaaacagaacactacccctcacgttttgtctcgtgggggttatgaatatttggagcagaagctcctggctgagaagaggaagaagaagctggaggaagatgcacagtcaagaagcattgatggtgtcatcgaccctccatcccccatcagacggccacgtgtcaggggagatgacgattgaggccacaaaggaaatcgctgagaagatcgattcccttgaggagcaggcgacacaaggatccttcgtcccccatggacatcaggat

SEQ ID NO: 57009 - DNA, 150 bp, Glycine max
  Peptide Sequence Number=SeqID_173787
atgggtgctcaaagctcaaagctttctccgcgagttgctacttctgttgatttgtctctgctttttctctgtgtgcatcccatacccagcacaaggccacataaacccaatgttcaagctagcaaaactgttgatttcagttacacttag

SEQ ID NO: 57010 - DNA, 285 bp, Glycine max
  Peptide Sequence Number=SeqID_173788
atggagtatgttgaagaagctaatagagcagctggggctatagtgaggttcaagaaagttgtttcactcctaaatagtggtttgggtcatgcaagagtacgtttgactgccattgtcgctgccattgtcgttgttgggtttgagtgtcgtggtgaccgtcgtatcattccaccagtgttgtcgatctccaaggctcgaaccaccgtccttccacttagctgcgtaattgcactcatcggctcaagctacgaccgcagcacgcctcaaccactgccagttaacaag

SEQ ID NO: 57011 - DNA, 1881 bp, Glycine max
  Peptide Sequence Number=SeqID_173789
atggatgcgatagctcatgtcccaggtgtttctcaaattgctaattatgtgattacatttattaaggatcaaattgggtacatatcctcctacgaggaaaaccttgaaaagcttatgacccaggttcaaactctggaggatactcaagttcttgtgaagaaccgggttgctgaggctgaaaggaacggatacaagattgaaaatattgtacagaattggctcaagaatgcaaatgagattgttgctgaggcaaagaaagtcattgatgttgaaggagctacatggtgtctgggacgatattgtccctctcggtggataagatgtcagctgagcaagcgtcttgaagaaacgacaaaaaagattacagatcacatagagaaaggaaaaattgatacaatttcttaccgtgatgcgcctgatgtcacaactacaccattttctagaggttatgaagcactggagtccagaacatcaatgctgaatgagattaaggaaattcttaaggatcctaaaatgtacatgattggggtgcatggcatgggtggcgtgggtaaaaccactcttgtgaatgagttagcttggcaagtaaaaaaagatggattatttgttgctgtagccatagccaatataaccaattctccaaatgtgaaaaaaattcaaggccaaattgctgatgcattgtgggatcggaagcttaaaaaagagacagaaagtggaagagcaatagaactgcgtgaaaggataaaaaagcaggagaaagttcttattattcttgatgacatttggagtgaacttgatttgacggaagtgggaattccttttggtgatgaacacaatggttgcaaattggtgataacttccagagaacgtgaagtgctgataaagatggacactcaaaaagattttaatcttacagctttactggaggaggatagttggaatttgttccagaaaatagcaggtaatgttaatgaagttagtataaaaccaattgcagaagaagtggcaaaatgttgtgctggtttgcctcttttgatcacagccttgggaaagggtttgagaaaaaaggaagtccatgcttggagggttgccctgaaacaactaaaggaatttaagcataaagagttggagaataatgtctaccctgctttgaagttaagttatgattttttagatacagaggaattgaagtcactattcttatttattggttcatttggactaaatgagatgctcactgaagatttgtttatatgctgttgggggttgggcttttatggtggcgtggacaaattgatggaggcaagagacacacattacacattaataaatgagcttagggcctcttcattattgcttgaaggtaaacttgattgggttggaatgcatgatgttgtgcgtgacgtggctaaatcaattgcatctaagtctcctccgaccgacccgacctatcccacctatgcagatcagtttggcaagtgccattatattagatttcagtcttccttgactgaagtccaagctgataaatctttctctgggatgatgaaagaagtgatgactttgattttacataaaatgtccttcacccctttcctacccccttctctcaatctcttgataaaccttcgctcattgaatctgagaagatgtaaattgggagacataaggatagtggccgaactctcaaatttagaaattctttccttggccgagtctagttttgcagacctcccagttgaaataaaacatctgactcgtcttcgtttgctaaatttaacagactgctatgatctaagagtcattcctacaaatattatatcaagtttgatgtgcttagaagaattgtacatgggaggttgcaataatattgaatgggag

SEQ ID NO: 57012 - DNA, 1971 bp, Glycine max
  Peptide Sequence Number=SeqID_173790
gatttgcataatttgacaactttggagatatcattcatagatacttcggttttgccaatggacttccagttccctgcaaatctcgaaagataccacatattgattagtgatctgggggaatgggagttgtcttcaatatggtatggtagagctctcggaagaacacttaagctcaaagactattggcggacgagcagatcgttgttcaccacagttgaggacttgagatttgctaaattaaagggtattaaggatttgttgtataatttggatgtgggaggtttttctcaattaaagcatttgtatatccaagacaatgatgaattgttgtacctcattaacacaagaaggttgatgaatcaccattctgcattcctcaatttggagactttggttcttaagttgctgtataagatggaagaaatatgtcatggtccaatgcagacacagtctcttgcaaagctaaaagttattaaagttacatattgcaatgggttgaagaatctatttttgtattctctcacaggaaacctttctcaacttcatgatatggaaatttctcattgtagaggtatgacagagatcatagctatggaaaaacaagaggattggaaagaacttcaacagattgttctgcctgaattgcattctgtcactttagaaggtttacctgagcttcagagtttctattgttctgtaacagtcgatcagggtaatccatccggtcagagcaatactttggcactgtttaatcaacaggtggtgatccctaaacttgaaaaattgaaattatatgacatgaatgtattcaagatatgggatgataaacttcccgtcctttcatgctttcaaaacttgaagagtttgatagtgagcaaatgtaattgtttcacaagtttattcccatatggagtggcaagagcactggtcaaactacaacatgttgagatttcctggtgcaaaaggctgaaagccattttcgcccaagaagaggttcaatttccaaactcggagacagtgaaaatcagcatcatgaatgattgggaatcaatatggcctaatcaagagcctccaaattccttccatcacaatctggatattgacatttatgactgtaaaagcatggattttgtcattcccacctctgctgctaaagagtttcatcagcagcaccaatttcttgaaataagatcgtgtggcataaagaatattgttgaaaaaagtgatattatttgtgatatgacgcatgtttaccttgaaaaaataactgtagcagagtgtccaggcatgaagaccataattccatcctttgtgctatttcagtgtttagatgaattgattgtgtccagttgtcatggactggaaattggaggaattgacattggaatacttaccgaggctcacaagcttttgccagggaagttatggcttcagggaaacttaaccacaccaagcctcacaaaggtggaatatgaagggatacaatatgtttggcattctagtaaactgagtgaagatcattggtatggcgaccttaatactactgttagaacagttttcactaaaaagctccaagttcttaacataagctggagtaccatagagaatattgttgaagaaagcgatagtacttgtgatatgacggttgtttatcttcaagaaatttatggaagcgataatgagagtgatgcaccacttggcgagattgcttttatgaaattggaggaattgacattggaatacttaccgaggctcacaagcttttgccagggaagttacaacttcaagtttccatcattacaaaaggtacatttgaaagactgtcccgtgatggagactttctgtcatggaaacttaaccacaaccaaccacattgaggtgcgatgcctacatggatggcgttatgaagaatcagaagatcagtgggatggtgaccttaatactaccattagaacaattttcactaaaaag

SEQ ID NO: 57013 - DNA, 366 bp, Glycine max
  Peptide Sequence Number=SeqID_173791
atgcatgtggagaaaaatgtatgtgacagtgtcattgggatgctccttaacattcaaggcaagacgaaagatggtcttgtaaatcatgaagattttgatgatgtcaagaagaattttcttgacaaaggggcagaatgtggatcatccattgttttgatgatgtcaaaaagaaatcacttgattgccatcatcaaaaaggaggagaatgtgaagattgcttcaacaaacaaagccctgtttcaagattcactaaagatcaagccttgcctcagaaaaaagggtttcaaagtcatgcaaggctctggtaatcgattacaaggaagtgtaatcgaataccagaagggaagaatgaaaaagagttattga

SEQ ID NO: 57014 - DNA, 476 bp, Glycine max
  Peptide Sequence Number=SeqID_173792
ggcaccataggtcacatactaaacatcactcccaaagaagagaaaaaggatagcaagcctcaagaggttaacattagcctcccatatttccatggaaaatataatgttgaggcctacctagatagggaaatgaaggttgaacaactctttccttgccatcatattagtgaagagagaaaagttccattggctaccctttgctttcatgggtatgccctctgttggtggacttcccttgttatggaacaaaggatttatggggatcctccaatagagtattggaatgatcttatgagtgcccttaggaagaggcacatttcctcctactatgaaaggaagcatatggacaagttccaaaggcttagacaagggagtatgagtgttgaagaatatagacaacaaatggaactactccttttaagagctggacttagggaagaggagagaacaagcatagtgttcgtgattgtcggcaa

SEQ ID NO: 57015 - DNA, 495 bp, Glycine max
  Peptide Sequence Number=SeqID_173793
atgccaggttaccatctggtcggttcatgtaatgggttgcactgtggggttagcgaaataccagaaggataccgtgtccgtttttggaacaaggcgacaagggtgatatccagagaatcgccaacgctgtctttttccccgggcattggtcgtagaacaatgtttgggtttggctatgatccgtcaagtgacaaatacaaggttgtagcaattgcattgactatgctttcacttgacgtatctcaaaagactgagatgaaagtttatagcgcgggtgacagtagttggagataccttaaaggttttcctgttctttggactttacctaaagttggtggagtgtatctgagtggaacccttaattgggttgttattaagggaaaagaaaccattcattctgaaatcgtaattatttttgttgacctggagaaggaggcttgcagatcattgtttcttcccgacgatttttgctttgttgataccaatcaattctga

SEQ ID NO: 57016 - DNA, 210 bp, Glycine max
  Peptide Sequence Number=SeqID_173794
atgacccttatgctatgcatttcagctattttgggtgaaaaaacatgtttctgtgaagaaaatccaagccgatgtgcttccataacgcttccgagatgtttctgtgagcaatttcgtgaagattttccgtcgttcttcaccgttcttcgttcttcaaccgctttcatcttcatttcgatcacttgcggttttcttttcttctatttttaa

SEQ ID NO: 57017 - DNA, 510 bp, Glycine max
  Peptide Sequence Number=SeqID_173795
atggtaaatggaagattagcttgttccattgttggcttgcagagtattagcaaacagattaccacaccgaaaatgcgtcagcctcttgctaatgaggcgaaggtgagtatacaagccactgtagctccagaggtggaaagcggaggctggaagccagtaaaaaaagaaagagtcactttttcagatagaacttctgagaaggtgcagaagaaaaaagaaccacacactcagaagtatataaggggaggtagagactgtgctattgtcattgaatctgatgaggagattgatggaggtttttcctgcttggtccaagaaaacgcaggagtaaaccttcttggcaacttgaccaaggaagcactggaagaaactgagcgaattttgcggaaagcaaggaggcgcaagaggaaaactaagaacagtaatatggatgtcattttaatgcctctttcttggttgtgcaggaggaatttgatactttcagatgcagaaggaaaaaccccgggctaa

SEQ ID NO: 57018 - DNA, 2826 bp, Glycine max
  Peptide Sequence Number=SeqID_173796
atgacaaagaagtcccaaagacgtccggtgcggtatgagaaagataaatcaggctgcatttggggttttattagtatgtttgattttcgccacggtcactccactaggaagatgattgcagataagaggcgaagcagcaagcatgctgttggtgttgtgcattctaagaataagtttgagatgttgggcaatttgggtgaagtttgtcaaagcagttctgacaacagagagaatagaagaccaacagttgcaactgctgctaataagcctagtgtgaagaaactcatagaagaagagatgttcattgaccagaatgcaatgaaggatacagatggtgctcaaatagaatcaaaggaatccagattaaggcgtgaagtccttttgaagttagattccaaaaggaaaaagaaatcttacaagaaaaaccgtgatacggaggacaccgatgattcaaatttggatactaccttgaaatctgaattcacacataatcagcactcaaggaagcaatcgaaagataatcttgatctggataagatgattgaagacttttgtcatctaaaagatgcttgttccatgatgcatggcaatgatggagaagtagaacttgatgcacaatcaaaccagaagcaagctatctctgaaaaagcaacagatgcaatttgtgaatttgtgaatcagatgatattaaacggcaaagatccagctgaagcgagaaaattcctttgctcccatcaacttatggaagttctccagcttataagttcggataaggaattgtttctttcacttatacaaaacccgaattcacttttgttgaaatgtgttcaagagtttaggaattctcaggaaacaaatgaaaaagaatatggttgtgtcactgattccaacttctcagaacaagatcatggcaacatggaacagaatagggagatagtaaaccacaaaaagcataactttttcggaaaaaagacaaagtctcaatcaaaaacttcaacaaatgaaaatgagaatactaatttgtcaagtagaattgttattatgaagcctgggcagataggctttcaaaattttgaaactggaaacaaccttgcctcatcccaagatactcatgattctgtcaaatacaatggttctccagggagaggtagttcacatttttctcttacagagataaaaaagaaattaaagcatgctatgggaaaggagagacatcgaaaccctgaagggatctcaaaaagacaccctgctgctgaatgtcaaaataagtggcctaccagcaaagccattggtaaagacaatgttggaatgagatctcctaataaagaccacttcttcattgaaaaaattgcaagacctaccactggtgctatgcaaggagacaagactggtacagctaaagattctgaattgattgtggaacatgaaaatggtacttattcaaaacaaagggtttccaacttatatattgaggccaacaaacatctgtgtgagattgtaggtaatggagacgagaaaatagacttgtcaagtaggaagatttccagaacccttggaaaaatactatctcttcctgagtacaacttttctccccttggcagtcctggaagggattgggagcatcattttgtgactgcaacgacaaggttttctacttcagataaagtgccttccaaacaaggaaattcggttggtcatttggatcaggaaatggacaattcagagaagcagtcaagcatttgtcatgaaagctctaaagatacagtgcaggaaattaagtcagactcaaatttcgcagacaaccttagtcatgttcatagagtagaaaattttagtcgtgttagagatgagataattactgaaggtgatatagaatctgcaaaagaggtgaatgttttggaatcttcctcagaaccagttgacctcagtgcaggaaaggaggaccaaaactatggtatctcagaaacttctgattgtgcaagatgttctcaatgttcaaagcaggatgtaacagaagtaaacaaaccaacatctccactgtcatccccctcgcactcttcccccactaagaaaattgaagagctaagtgttacagaggtatctggtcggccaagtcctgtatctgttcttgataccccattcttagaggatgatatcaaccctggctactccagatttcaaccggttgaagtaccagcacggctgctgcaatttgaagaacaaaattgttctcttttgaatcaaatcaatagagacaaatattgtcttaaagaaaatgaatggatatatgattgcatcaaagcagtcctgcaagcctctggattgactgtagatcaattgctgacgaaatgtctttcctcagacaagatactagatccttccttgtttgatctggtagagttcttaccaaaccagttttgcaatgatcagaagctcatcaatgactgcatcaatgacgttctcatggaggtttgtcggaattacttcggggtctcaccttgtgtgtcatttgtaagtcctggcattaggcctattccaaatatgaagaagatgattctcaaagtctgcgaaggagtgtgctggcatttccttcccttgcccccaccgcgtaccttggacaaaattattaaaaaagacatggataaaaatggggcatggttggaccataatcttgatgctgaaacaattggttttgaaatgggagaagccatccttgcagaactgatggaagatacaatacttagctgtgtaagcaaaagtccagaaagtgaatgttctcagcttcaatttgaatataaggacaatgaaaacagcaaaactatgtaa

SEQ ID NO: 57019 - DNA, 342 bp, Glycine max
  Peptide Sequence Number=SeqID_173797
atgcagaagaagaagggagagggagatgcttacaatggccgactaagggtggcggcgcagtggcgaggtggcacggcggcgcggtggcgtggtgaagagagaccgatggcaaatgtgtggacactgaagagaggaggaagaaaatcgagtgtttcactgggtcgtgagagaaggccgaagagagaccttgggtcagtagtgttgggtccttgtctccccaaaaatacccctgaaccccagcacctcatattacctgccaaacgccaaagctcctccgccgctcgctgccgctgcgcgctttgcctcaagcacaaggagtacgacgactatgtccaaaactag

SEQ ID NO: 57020 - DNA, 360 bp, Glycine max
  Peptide Sequence Number=SeqID_173798
atgacttctgctgcaattgtaactgtgatcctgaaactgcgatgtgagcctgcttctgtagcttcccagggctgcactgcaatgctccacttctatagcacacccaatgttgtgaaaattgagattttacacgggactgggagggggatgaaagattgtaaattgaaggatcatagcatggatttatgcaacaacccagtggatgcaaggcagagacagagcagaaatgtggttgcagtgaaattgagagtagagggaggagaagtgaggatcaaagtcatcgtttttcaaaatggattggcatgggtggatcgtgcggtcttggatgaggaagatcgcaatcctccgcaatcttcatga

SEQ ID NO: 57021 - DNA, 258 bp, Glycine max
  Peptide Sequence Number=SeqID_173799
atgcaaaggtatcatgctggcagctgcactagtgcagttaacaacagtacaataggtggaccatctactagggatgcaggaagatctgattcatcttctttgccagctaacttctcctggagtctgttatcaaaccaaaagaaaggaaggaacaaagcagcggtactgtcacaacctggccagaaaaagcaggagatactgccggagaagggaggtggtcgtggttcatccagattcaggaagactgtcccatcataa

SEQ ID NO: 57022 - DNA, 123 bp, Glycine max
  Peptide Sequence Number=SeqID_173800
atgttagatggttgggtaattgacgcaagtgctggtgatgctgatccgcgctataggtacttgctacttagctccaatctttactgtgaagtaacttgggatgttaggagttgtttggattga

SEQ ID NO: 57023 - DNA, 411 bp, Glycine max
  Peptide Sequence Number=SeqID_173801
atgacgttggcaagttcgaccacgtcagcgtctgcttttgccccttggaacaatcctagtttagggaatcccagtggaagtccctttcgaccgcctcaaaatcctctatatggcatgcctacatctttgatggtagggttgcaaaattctcaaccaaacatagagaatcttaatatggcctctccatcaggatctgtagcgggcaatcaaggtaggcaaccaccgattcgacagatccaaatacaggcgcctgtccaagagatacagatgcctaataaccccgggatgcaaatggctcaagcaccacaaccagcggcacgcatagagccaccagtccaacaggtcgaaccaaaccctggtatagtattgattcagactcttaaaggcaaggtgtttcacccaagtccctga

SEQ ID NO: 57024 - DNA, 252 bp, Glycine max
  Peptide Sequence Number=SeqID_173802
atgcgagcggggaattccgatgtgtatggattcctcgagccacagtccattcagagatttgggcaatcgcagtttgaatcggaaagttacatcaagagttggatgcatagttcaaaacgcaatgtctaccttggagcctacctgaatgggtcagacaactaccttaagggaataatgaacagtgctttgaaaggacttgatgatactccacaacctaaatccaaggctggtgctaggtggattgttgttaag

SEQ ID NO: 57025 - DNA, 1178 bp, Glycine max
  Peptide Sequence Number=SeqID_173803
atgcaattattatttctcaggcttggggcaccagactttcatccccaaacaccaaattgtcctgaggagactctgaccagagaatatttgcaatctggatacagggatacagttgagggacttgaggaagctagagaaatttcactaactcaggttccgcattttaacaagaaagttgttcttagttgcaaagaggctattagaaaacgtctgagggccatcaatgaatctcgtgctcagaagaggaaggctggtcaagtatatggtgtggctctttcaggatcacaactaggcaggtctggcattttccctgaactaagaccctatggtgaggacttccagaagaaatggattgagaccagtgtgaacagagcagtgtcgagcaggaaagagagagcagtggcgagcacagtaccattgggagacagaaagcggcggggagggaggctggcgcagatcgtcaaggttgttgtggctggtttatctcagcagcacaagcgattacgctctttggctgatcatgttcctcatggttataaaaggacatcacttttagaggttcttatcaggaataatgttccattgcttagggccacctggtttatcaaggttacttacctcaatcaggttcgacctggttctgttggtatttcttctggggctgctgacaagattcagctgtctcgctctgatgtttggaccaaagatgttatcaattacttacaaacacttgtggatgaatttttgtcaaagaatgctttgcattctgcttctcatggtcgagagcgatcaccacaaatgtcttatactggctcactgcagaataaaaacgatccattattatctgtttctgatggtgaagggccatccttacattttagatggtggtatattgtgcggcttctgcaatggaatcatgctgaagggctgcttcatccttctcttgttattgattgggtgtttaatcaactacaggaaaaagatctgcttgaggtttggcagctgttattgcctataatatatggttttttagaaactattgtcctatctcaaacttatgtacgcactcttgctggattagctcttcatgtcattcgtgatcctgctccaggtggttctgatttagtagataattccaggagggcatatacagcttatgctgtgattgagatgctccg

SEQ ID NO: 57026 - DNA, 5277 bp, Glycine max
  Peptide Sequence Number=SeqID_173804
atgaatgatgggaattttgtactaaaatcaactgaagctgcagggaagataaaaaatagttcagatgattttggtcacattatttcatgtattcagaaacatacagaagatcttgtgaaggctgcaagcccaggctatccaggtcattgtctagctaaagttgccaaagctttggataaagctcttgtgctgggtgatttgcgtgtagcatataaatttctttttgaagatctttgtggtggaactgtatctgaaggttggatttccaaagtcagcccttgcttaagggatttttgcagtactcctcctcgtgacataaagtttacaggtaggaaagatctttcccaagtgcatatagcagttagacttttaaagatgaagattagggatgtgaagatttcgcaaaaacaaacaaatgaaaatcacagagccagtcatcttgcgaagcattcaagtcagcggcataattggaattatgtgggtaatgtatccagattgagatctagttcaaagagtactggttcttcagtatttgaaagcccaggtcctctgcatgatattgtagtttgttggattgatcagcatgtggtgcaaaaaggggaaggtcccaagcgcctaaatctatttatggtcgaactcatacgtgcgggcatcttttaccccttggcatatgtacgccagctaatagtgagcgggatcatggatgtgaatgtaaatgtggttgacctggagcgacagaggagacactatcgcatcttaaagcagctacctggatgctttatccatgatgttctggaagaatctgggattgttgaagggtcgcagctcaaagaagccttgcaaatttacttgaatgaacgccgcctcatacttcggggtcatctgagcgtgtcctgtggttccaatttatctgctctgaagaagaaaaaatatccagcttctacaaaggatgaagtttttgcagtgccaattgatcagagaaatgttatttctaccacaatatcttctaaaaatgcgaaggatactaacatcgaagaactaagaacagcaatctcagtactgttacagctacctaattgttcatctaatttgagcactacaggtgatgaatctgagggcagtgatagaagagccattgggtctccgtacggcaagattgatccagtggagggtacacctgggtgtgaagaatgtagcagagcaaagagacaaaggttaagtgaggaaagaagcacatttgtgcaagggcattctccagttcaatctgatgatgacgatacatggtgggtgaaaaagggaatgaaatccccagagcctctcaaagttgatcaaccacaaaagtcaaccaagcaggtcaccaagagtcggctgaagaatgtgcgtaaaactcagagtctagctcaactggcagcttctagaattgagggtagccaaggggcatcaactagtcatgtgtgtggtaacagggtaagctgtcctcaccataaaacagctatggatggagatgggcagaggtctgtcgatagcatccgaacaagtcattttggggatatagtttccattggaaaagcactaaagcagctacgttttgttgagaaaagggcaatagcagcttggctgttgactgttgttaggcaggtaattgaagacgtggagaaaaatattggtaaagttggtcagttcagcaagccttttcctgttgtggatgatagaggctcaatacagtggaaacttggtgaggatgaactttctgtgattctttatttgatggatatctctgatgatttggtatcagttgtcaaattcctcctttggttgctgccaaaggttcttaatagccccaattctacaattcattctgggaggaatgtggtgatgctaccaaggaatgtggaaaaccaagtttgtgatgtgggagaggcttttctgctatcatcactcagaaggtatgagaacattcttgttgcagcagaccttattcctgaagctttgtcatctgcaatgcatcgtgttgccactgttattgcatctaatggaagagtttcagggtcaggggccctagcttttgctcggtatttgttgagaaagtacagcaatgtggctagtgtcattgagtgggagaaaacttttaagactacatctgatgctagactttcctctgaacttgagtctggtagatcagtggatggagagttaggtttacccctaggagttccagctggagtagaggaccatgatgattttttccgtcagaagataagtggtggtcggttaccatccagagtaggtgcaggcatgagggacatagtgcagcgtaatgttgaagaagcgttccactatctttttggaaaagatagaaaactttttgctgctggtacaccaaaaggtcctactttagaaaaatgggataatggatatcaaattgctcaacaaatagttatgggcttgattgattgcataaggcagactggtggtgctgctcaagaaggagatccctctttggtctcttctgctgtttctgcgattgttggcagtgttggtccaactttagcaaaaatgcctgatttttcatctggcaatagtcattcaaatacaatgcccgctacaaatgcattgaactatgccagatgcattctgcaaatgcatatagcctgtctatgcctgcttaaggaagccctgggagaacgccaaagccgtgtatttgatattgctctagctactgaagcttctaatgctcttgcaggtgtttttagtccaagtaaagcatctcgttctcagtttccaatgtctcctgaagcccatgattctagtaacaccatttcaaatgatatgggaagtaactctagtaaggttgtggcaaaaacaacaaaaattgctgctgctgtttctgcacttcttgttggtgcaattatatatggtgttaccagccttgaaagaatggtgacagttctcagattaaaagaggggctggatgtggtacaatttgtaagaagcactagatccaattcaaatggaaatgctcgttcacttatggcttttaaggtggataattcaattgaagttcatgtccattggtttagattgcttgttggaaactgcaggacaatctgtgaagggttagtggtggaactcttgggtgaaccatctattatggctctttcaaggatgcaacatatgcttcctctaaatttggtctttccgcctgcctattcaatatttgcctttgttaggtggcgacctttcattctgaatgctacagttcgtgaagacatgaatcaaatttatcagtctcttacaatggccataactgatgcaataaaacatttgccatttcgagatgtatgttttagagactgtcagggtctttatgattttatggctgcagatgcaagtgattctgaatttgcaaccttgctagagtttaatgggtctgatatgcatttaagatccacagcatttgttcccctacgctctaggctttttctgaatgccatgattgattgtaagatgccacaatctatttatacgaaggatgatgggagccgaatgtctggacctggtgagtctaaaattaaattcacagatagtgagtctaagcttcaggatatgcttgtgcatgttttggataccttgcaacctgccaaatttcactggcagtgggttgtactgaggttgcttttaaatgaacaagccctcattgaaaaactggagaatcgtgatgtgtccttggctgatgctataaagttgtcctcacctagtacagagaaggctgctgctgcttctgagaatgagaaaaattttattcaaatacttctcacaaggttactggttagacctgatgctgcaccccttttttcagagttgattcatctctttggtaggtcactagaggattcaatgttgtcgcaagctaaatggttccttgcaggccaggatgtcctctttggtcggaagaccattagacaaaggctacataacattgctgtgaaaaaaaatctttctgtcaagacccaattttgggagccatggggttggtgtagtctgtctactgatccattaactgtcaaaggggataacaagaagtttgatagcacatcccttgaagaaggagaagttgttgaagagggaatggatttgaaaaggtgccagctgcaagtgactgagagggctcttatcgagatgcttcttccttgcatagatcaaagttctgacgaatcccgcaattcctttgcaagtgatatggtgaaacagttaagttatattgagcaacaaataactgctgttacaggtggaagtaaatcagtaggaagtgctcctcctggagttgaaggtcagccgaataaagtaaataaccgcaaaaatatgagaggtggaagccctgcattaactagacgacaaacagttgcaacagattcttctccaccgtctcctgcagccctacgagcttctatgtcattacgtttgcagttgctcctgagatttcttcctattctttgcactgacagggagccatctgtgcggagcatgagacaatttcttgccactgtaatttttcgtctccttggtagccgggttgtgcatgaggatgtggacatttcggtgaatgctgtgccatctctgtcgataagggaggcggagtcatcttctgaagttgcttctgctgcttttgtggattcttcttctgggagtctgtttgatcgtttgttgttggttttgcatggattattaagtagttatcctccaagttggcttagggcaaagcctgtttcaaagacaatcagtgaacctacgagggaaatttctggaattgaccgagaattgttggagactttgcagaatgacttggatcgtatgcaactgccagacactattcggtggcatatccaggctgcaatgcccatactcatcccctctatgcggtgctctttatcctgccagccaccatctatttccaattccgctcttgtttgccttcaacccagcattacaaatcctgggtctaactccagtagttcaactattcctcagaggaacccagttctatcaagggttgcttctaatgcatcagggaaatcaaaacaacaggacaatgatttggaaatagatccttggacactcttagaagatggtactggatcttactcttcggcaggtaatactgctagcataggaagtggtgaccatgctaatattcgagccaccagctggcttaaaggggctgtaagggtgagacggacggacctcacatatgttggtgctgtggatgacgatggttga

SEQ ID NO: 57027 - DNA, 909 bp, Glycine max
  Peptide Sequence Number=SeqID_173805
atggcactggttgtaatgtgtgggcaaccatgcagtggaaagtccaaagctgcagtctgtctcgccgaagctctcaaagaatcagaatcaaaacttcaagtgagaatcatagacgaagcttgttttcatcttaatcgtaaccaaagcttcgcgaatatgccttcggagaagaatttaagaggggtgcttaggtcagaagtagataggtccctgtctaaagatagcatcatcatagtagattctttgaataacatcaagggttaccgatacgagctatggtgcttggctcgagcagcagggatcagatattgtgtggttttctgtgatgttgaagaaaccatttgcaggaaatggaatgaagaacgcagggagaaaggagaagccaattatgatgattcgatatttgaagatttggcaagaaggtttgagaaaccagatagaagaaaccggtgggattctccattgtttgaattatggccacacagagaagcaacagagaaatcttcccctgctgttgtagatgctgtctcctacttaaccaagaaagtggactccaaaaccagggatgttaagatactacaaccaactattgcaactcaaacctcgcgtttttctgatgcaaattctctctatgagttggacaaagcaacacaagaggtcacaaatgctatagtagaagcacaatctcaagctcttggaggaccacttaatggagtttccatagggaaagacttgcctgtaattaacatttcaaggtcagttgggcttccagagcttcgtaggatgcgccgtaccttcataaaattgacagggcaaacaagtttaagtgggccaccacctccttctgatgcagatagtgcaaaaagaatgttcattgactacttgaacagggaactgggaacatcctga

SEQ ID NO: 57028 - DNA, 198 bp, Glycine max
  Peptide Sequence Number=SeqID_173806
atggatgttgaaagtccaaagacacggctcaatataggcttttactttctgcacctctcttttttgcttgatgcacctccaaaacacccaaacagacaaaactactcctctagtctaccacccaacaccattgttgacaactccaatgcagggaagaaggtgcagacaaagtcgaagatgaaagaaaggacattataa

SEQ ID NO: 57029 - DNA, 312 bp, Glycine max
  Peptide Sequence Number=SeqID_173807
aattgcatctcaaaattccgcgagaggcgggctaccattaccgccccccccccctcccctcccgctccaagagagcccgctgccgtgttgtcgcctctgacacccgcgacccccctcctcctccgcatcgaaaacgcaccccggaaaagtaaacaaacacgcaaagccctccgccgtcccggtcagcccgcccggggaagtgaacagagcagacagtcgagcgcagctccccccccccccctcaatttcctcttcccccagcggcatccggaaggccttccccttgtgagggagggaggggggctgaactga

SEQ ID NO: 57030 - DNA, 787 bp, Glycine max
  Peptide Sequence Number=SeqID_173808
atgggtggcggccaggctgcgcgcgatggccggcaggtcgcgctgcgcttcgggggtgcggtaatagccccagaacacgccggccaggaaggccggctgcaacgcggtctgggcccagtccatccagccatcggcgcgcgcgcgtcgcgccggatcggccgaccagaaggcgtcggcgccatggcgcgcggccaggtagcgcaggatcgcgtgcgactcccacaccaccgtgtcgccgtcgcgcagcagcggcacccggccatggggattcatccgcaggaagtcgggcgtatcgagcagcccgaactggccgccggccggcacgtgctcatacgccaggcccagttcgcccgccagccacaggaccttctgcacgttgaaggaactgcgccggccccagatcgtcagcatcgcaagcccccttcgagcggcgcgtcagccggccacgacgatgcgcggctcgcacagcacggggaagttgaccgaattggcgatgaagcagaaatgatgcgcgcgggcatgcagggcctcggccaggccggcgtcgccgcccgcggcgatggccgtgacgatgatgttctcgaccgcgcaaaggtgcagataccagagcttgtggcaggccgacagcgaggccaccagcaggtcctcgggattccagcgcgccgcgtcgccgcggaatgcgggatcggccgaaccggcgatatcgggcttgcccggcgactggatcacgtggtcgcgggcataaacggtgtagctggcggtgcccttgccggtattgccggtccag

SEQ ID NO: 57031 - DNA, 180 bp, Glycine max
  Peptide Sequence Number=SeqID_173809
atgccaaagctcatggaagctgatgttcagtttgaatcaccaacctgcccttccaatacagcagttgatcctgaattgaatagtgaggatcaggtgctttgttctgtaagcatagctcccttaaggcctacaactgagagtcagcttgtattgcctctttcaacaactgaattaacttga

SEQ ID NO: 57032 - DNA, 1179 bp, Glycine max
  Peptide Sequence Number=SeqID_173810
atggtaaccattcgtgcagatgaaattagtaaaattatccgtgaacgcattgagcaatataatacggaagtaaaaattgtaaatacgggtaccgtacttcaagtaggcgacggtattgctcgtatttatggtcttgatgaagtaatggcgggtgaattagtggaatttgaagagggtactataggcattgctttgaatttggaatccaaaaatgttggtgttgtattaatgggtgatggtttgatgatacaagagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacgggtaaaacagcagtagccacagatactattctcaatcaacagggacaaaatgtaatatgtgtttatgtagctattggtcaaaaagcatcttctgtggctcaagtggcttatcgccaaatgtctcttctattacgaagaccacctggtcgcgaagcttatccaggggatgttttttatttacattcacgtcttttggaaagagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtaggtatttccgtttccagagttggatcggcggctcaaattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacag

SEQ ID NO: 57033 - DNA, 399 bp, Glycine max
  Peptide Sequence Number=SeqID_173811
atgtctcctgatcgggttgtctttggaaaggcatgtcatcttccagtggagattgaacacaaagcatactgggcagtgaagacctacaacttctctatggatcaagctggtgaggaaagaaagttgcaactgacctacgagaatgccacgttctacaaagaaaagaccaataagttccatgatagcatgataattaagaaggacttcatggttgggcaaaaagtgttattgtataattctaagcttggactcatgagtgttgagatcaaaagcgacgccacaaacaagagcttcaaggtcaatggacaccgacttaagccattcctcacaaacccttctttagtggacgtagtagtggaagagacttccttactccaccctactcttcctccaccatga

SEQ ID NO: 57034 - DNA, 210 bp, Glycine max
  Peptide Sequence Number=SeqID_173812
atgggctcaaaaatctaccctgaggatcatgagaacactaaggccttctttagtagctctagcccaatcctcttggattcttctatccaatacccttggggggtcccccctcttgtccttttaacaaaggctactctcagtccgacgcgtgagatcttagagcctacctttgccacgtccaccctgacgagggacaactctagattttag

SEQ ID NO: 57035 - DNA, 418 bp, Glycine max
  Peptide Sequence Number=SeqID_173813
atgccagagaagatttcagaccggttcggttttactgaggggccctcctcagataaagaagggaatgtttattttacagatcagcccaatgataaaatttattattgggattggaaaacaaatgaaatccgggaatttttaagcaaaacaggacgcgccaatggaacccattttgatcaagacgataatctgattacctgttctgatgatcagggcgagatctggaagatctctaaagataaaaagattcagattttattaaaaggtttcgaaggaaaaaggcttaatggtccgaatgatgtatggggagattcttcaggtggaatgtactttactgatcctttgtataagagagattactggattgattttaaacaggaaattcctcataaaagtctttactacagaaataaagaag

SEQ ID NO: 57036 - DNA, 441 bp, Glycine max
  Peptide Sequence Number=SeqID_173814
atggttggaatagaagccgtatgtgccagtaaaggtgctgtttggctgacttttggcactccaaattgggagcgcatggaggtgtgtgagacatccgatgggggagcagtggctggatctggacatgttgacctaagacgccccaaatccagtggttgtctactggaaaatttgtcggagttgcaatggcagccaatgacaatggaaattaagtttgaaccaaatgtcatgtgtgaacctattgacaagaaagtaacatttcgaacaagccaggtggggagtggctggattccagtgatctgtcatcagctgtcaacttctgatgaagcagaggttggtgggattctgacggtggtggattatggtgatgtgggcaaaaggtgcctccctctgccagtcaatggtagtggcattgagttgccgaggtgtggcaatttgtga

SEQ ID NO: 57037 - DNA, 360 bp, Glycine max
  Peptide Sequence Number=SeqID_173815
atgatgcttagctccctcttaatatttgcatcttatgcttctgctctgcatagctctctgtcgcaacgtgcccttttgcgggcgagcgaggcgaggctcacgggtgcgctttccaaaggaggaaaagatgcgcggagtcgccaccaacgtttatttgtggaaaacgtcgggaaaaccgaaggaaaccggaaggtattagcacctctcacgtttgtctcaaaggacaacaacctattttttagaattgtggaaattgtcgacaaaagcggggcttttgctcctatgtaccctcctttggagaggaaatcagacctacgtagttctttcttaagagtgaatcaagcgattctttttacttga

SEQ ID NO: 57038 - DNA, 1161 bp, Glycine max
  Peptide Sequence Number=SeqID_173816
atggtgactaaggagagaagagacaaaataggaattaaggaggtcaagaggaatcacagggagggaaacattgaagcaaagagtgttttgagcttaaaagacactttgttggaggagggtatattgatcttgaaggaatttaagtggcaacaagtatgtttgtcgggttgtggcatcaattgtcttgtgacggaggcccaggagatgcaaagggaaggacgatttggagcaagtcaacgagatagtttgtgctttaataaatttgttgaggaaatggaattggaagatgttcctgaggagcatgcaaaaatcttgaagagatctttattggaccattgccctattcttcttaggatttctaacattgaagaagttaagagaggcaaagggaaggaagatttggagcaagtcaatgagatagtttgtgctttaataaatttgtggaggaaatggaattggaagatgttcctgaggaaagattggggaattggagaagttggaggaagaaagagtgctaatggaaagggaaatcaacctaaaaatctccttacaagaataattttggaaagtgggaaaaatttgatccaaggtttgaagattggtgagaaatgggaggaagacccaaataaagtcatggaggaagtgaaaaagtctttccaacttgttttgaggaagagggtgaaaggtgacaattttgggagtgtggaagtggtaaaagtcctgattcagaaggatttaactttaaattcatcaaagccaagaagagaagtattgaagggagatatcatgagatatatgaatgaatttcataccaatgggatcattcttagaggatgtaattcttcatttatcacattgatccctaaagtggaggaaccacaagacttaggggaagtttgccctatttcacttgtggggtgttggattaaaaaatttctagagtctacatacattcaagtgcttgataatgggttcccaatgatggaatttgcaccacaaagaggacttaggcaaggtgacccatttgctccatttatgttcacaattgtcatggaaggcaagaatggggttatggtggatcttctacaatatgtcgatgacaccattttctttgtaaaagcatcagatggaaatgtcatggtgattaagagcatgctttga

SEQ ID NO: 57039 - DNA, 264 bp, Glycine max
  Peptide Sequence Number=SeqID_173817
atgaagaagatcctaggcctacaatctccaatggagatacatcatcatggggagaatgtgaatgtatgcatacatgattttgatgatgccaaagaagaatcaaacaaggctacttcaaaggataagcattgctccgagattgatacaagattgcttcaacaaacaaagccttgcttcaagatttcttcaagatcaagccttgcctcaaaacaaagggtttcaaagtcttccaaggctctgataatcgattaccaggcagtgtaa

SEQ ID NO: 57040 - DNA, 417 bp, Glycine max
  Peptide Sequence Number=SeqID_173818
atgcaacaaagggtgccaagtatttcgaagcggccaatcaaaggttgtgtatcatcaaataataatccccggacaaaattagggtatgacaatgaccataatttgtctctgcgtgccatcggacacggtcgtctgcggatggcgaaaaggtgcggaatgaccataatttgtctccgcatgtcatcgggctcgccgcctctggatgataaaaggcgcagaatgaccataatttgtctctgcatgccatcagacacgatcgtctccggatggcgaaaagggtgcggaatgaccataatttgtctctgcatgtcatcgggctcaccgcctctggatggaaaaaggtgcagaatgaccataatttgtctctgcgtgccatcagacacgatcgtctccggatggcaaaaaggtgcgaaatga

SEQ ID NO: 57041 - DNA, 1821 bp, Glycine max
  Peptide Sequence Number=SeqID_173819
atggggcgcaaagagaagcagaacgcgaaggcaatagatgaggaacacgacgtagtaaattttaacggcgcttcaacgccgtccctcgttttcagcagcgacgacgatgaagccaaccaagatctcagcctcaagatcgtcgaaaaggccatgcgaatgcgcgccgccaaacacgccccaaacgacgacgtttcttctccgttttcgcagaaatccgaactcgcagtgcccctaaacgacgtcgtttcggatttgcccagcgcaatcgctgattccgaagtgacggaaaagaagaaaacggccaagttgaagagggaggcggctggggatcaaagtgttgttatagcggaggagcaagagatggaggagacaagcaatgctacagagaatcacgagtttgtggaaggaagcccggttctgataggccacaatatggttctgcgaaagctgcttcggggtccaaggtattttgatccaccggatagtagttggggagcatgtttcaattgtggtgaggatggtcatgctgctgtgaactgttcagcagcgaagcggaagaaaccatgctatgtttgtggtggtttgggacacaatgcaagacaatgcactaaggcgcaagattgctttatctgcaagaaaggtggtcaccgtgctaaagactgtctggagaagcacacaagtagatcaaaaagtgttgctatttgcttaaagtgtggaaattctgggcatgatatgttttcatgcaggaatgattattcaccagatgatctcaaggaaattcaatgttatgtctgcaagagagttggccatttatgctgtgtcaatactgatgatgcaacaccaggagaaatttcttgttacaaatgtggtcagctgggtcacactggtttgcagccctggtgtggcagattttttgtcaaccgccatagacaatttgtgaagggaggccaccatggcggtgccatatggcacaatggcggtgccatatggcacaatggcatgcttatttggcagaattttggccttacaccattaataacacttgggcctcaggcatgttcaaggttgcgggatgagattacaagtggagccacacccagttcatgcttcaaatgtggtgaagaaggacattttgcccgggagtgcacaagttctatcaagtcagggaagaggaattgggaatcatcacacacaaaagataaaagatcccaaaaagaaaatgattacatgggaaatagatctgcatctaatgatatggttggggctcgcagaaagaaacgttcacctaccgaagaaagaggcttttcaactcccaagaaatcaaagagtagaggtggttggacggcggagtatcctaccgaagaaagaggctttacaactccaaagaaatccaaaagtagaggtggctggacaacagagcatcctactgaagaaagaggctttaccactccaaagaaatccaagaatagaggtggctggacatcagagcatcctttggaacaaaaagactacacaactcccaagaaatccaagagtagaggtggatggatgtcagagcatcctgaagaattctttcctcccatgtcctcaaggagcaatggttataggtctctagggacaccatcttctagaaacaataaaattcattcatttggtggtggaagtcacactccaagttataaatcttccaaggtatggaatgatcatgcaggaacttcaatgtctcaaggatcagccaggtcaaatcatcatagattttcagcatcaaggtttggcaactctagtagtgacggacatggtagaaattacaactggtggtag

SEQ ID NO: 57042 - DNA, 897 bp, Glycine max
  Peptide Sequence Number=SeqID_173820
atgaaggaagggcacatccctgcagagttgggtgctttgtttgatactaatcaagggtcagttcacaagaagcaagagatgatacatttcaatgccatgaggcatatgttcggctatcctgactgcaagacatttatcttaagtgtcacacatgtacatgtggtattcttggatgcattttgtgaccttaaccaagctggaagctactcatggggagctgctgcattggtgcatatgtatgagaatttgaatgatgcgtcaaagagaaatatcaagcaacttgcaggatatatcacacttttacagtgttggatctacgagcattttcctactattgctccttgtattgctgctaaagattatcatgagaggaagtcacgtgcttgccattggaagtttgggaaggcattaccagtgtcaacatatcgtaagcggttggatagattgacatctgatgttcttggggatcctcctagacatccacccgtggtgcacaatgatacatttattgaaccagatccttctcaacaggtggtcgttgcactggctatgccaaaaccacctgcagatgaacttgctgatgtagacatgcctcgacatgcactggcttgccatgaaatagtagaaaggttggaaggcttgatcaacctgagggtagtcactaaaggaactgaagcatacactgtaaccgaggagtgcctaaggatcgccaggggtgtgactgcgcaagggaatgaggttgaggaagggttccaaggttcaaaagtggatggaattgagagaattaagaaagaagaagaaagaagaggaaacgaagccgaggcgctaccgaatcgtgatcgcaatcattccctaaatcgttccttgttcgatgttcttcgtgtgaccgtcggttag

SEQ ID NO: 57043 - DNA, 293 bp, Glycine max
  Peptide Sequence Number=SeqID_173821
cacaaggcccatgcttctcatcatcacaaagtggagttaacaacaaagggatttatttggaaaatggaggcgtatttgggagtctaaatattggtgcagaagaggatgtgggcacgacttcttaccttgacgaacagttgcaggtggcgacaccactcaaaggggcacgacttcggcaacgtggcggtggtgggacgaacacgacgttcggaggtcggacgggagctgttggtttcgtcaatgttagggaaatggaagaatgtgacggaaagggcacaatgtcaggctggtaa

SEQ ID NO: 57044 - DNA, 303 bp, Glycine max
  Peptide Sequence Number=SeqID_173822
atggagactgcaggagttgtcgctggtgttggtgaaggtcacaaggccttgtccgtcgacagcccaaacagaggagcggctgcgaaactcgcaattggctgcgattttttaaatcgtgattccagctattctcgtgcgattcagctacaagaaaaatacgccatccgatttgcatcgctggacctccgaattgcatcatatcgtatgaatcgtattgcgatactagtgatacttactaccatggtggaagggtggtcaaagatgaggcttgttatctgccaaacagaagaggaaaaactctaa

SEQ ID NO: 57045 - DNA, 216 bp, Glycine max
  Peptide Sequence Number=SeqID_173823
atgttattgcctagcgctgttcatgtgttctccattatcaagtgcgaagcttctggtgactgggaagcacgttattctgttgttttccagatcggttccttcgccaaaagaaaaaaagaagaagtagagacgagagtcgtcatcatggaaaggcagggcggacgaaatcagtgtcctatctttgctttcctcttatctccgatgagaggtaagtaa

SEQ ID NO: 57046 - DNA, 204 bp, Glycine max
  Peptide Sequence Number=SeqID_173824
atgtatgagatggccccgaggaaacttgcctcaaagagatccaggaaggataaagcagccgaaggaaccagttccgctcccgagtatgatagtcaccgctttaggagcgctgaacaccagcagcgcttcgaggccatcaagggatggtcatttctccgggagcgacgtgtccagctcagggacaacaagtataccgatttctag

SEQ ID NO: 57047 - DNA, 1953 bp, Glycine max
  Peptide Sequence Number=SeqID_173825
atggcgtcggaatccctcaccgtcgccgctgaatcactattcctctccgcttcagttcctgtgatttccggtgaatcggagaattcggaactgtggtgtgattcttctgctgcctcttctcgcttttccgaaatgcttctcctcagccctgttactcccggtcaggtctcgttccttctcgggatcattccagtcgttgtggcatggatatattcggagatattggagtaccggaaaaactctgtctcgtccagagcgcaatcggacatcaacttagttgaaatgggcagtgatgttgttaaagatgaagacagagcagttttattggagggaggagctttacagtcaggatccccaaaggcacggagcttaactggctcaccatcgattatccgattccttttgatggatgagtgtttccttcttgagaaccgtttgacacttagagcgatgtctgaatttggtctcattttggcttacttttatttgtgcgaccgcacagatttctttgcctcgtccaataagagttacaatagggatctcttcctatttctctattttctcctcatcatagtttcggcaatgacttcctttaagatacatcatgacaagtcaccattgtctgggaaatccatcctttacttaaataggcaccagactgaagaatggaaaggctggatgcaggttttgtttttgatgtaccattactttgctgcatctgaaatctacaatgcaatccgtttgttcattgctgcatatgtttggatgactggatttgggaacttctcatattattatgttcgtaaagattttagtctagcaagatttgctcagatgatgtggcggcttaatttctttgtggtgttctgttgtattgtacttaacaacagttacatgttatactacatctgccccatgcacactcttttcactcttatggtttatggggcacttggtattctccacaagtacaatgagattgggtcggtcattgcggtaaaaatcattgcttgcttcttggttgttatcttagtatgggagatacctggagtctttgaatgggtttggagtccatttactttctttctcggatatactgacccaaatcctgccaaatcacatctttctcgcttgcatgagtggcattttcgttcagggcttgatcgctacatatggataattggaatgatttatgcttattatcatccaactgttgaacgatggatggaaaaattagaggaagcagaaatcaagcgcagaatatcaatcaaagcaactgttgtgctgatatgttcattggtgggttatttatggtttgagcatatatacaagctggacaagattgcatacaataaataccatccttatacctcatggattcccataacggtttacatatgcttgcggaatgttacacaaagttttcgtagctatacgctgactctttttgcttggcttgggaagattacactggagacttatatctcccagatccatatctggttaaggggggaggggggtgttccagatgggcaacccaaattgttgctttccctgatcccagacttcccaatgttgaacttcatgcttactacttccatatatgttgcaatttcctataggctctttgacctgacaaatacactgaaaatggcatttgtacccagcaaagacgacaaacgctttatacacaatttaattacagcaacaacaatctcagttgttttatattctttgtctctcggcttccttagggtacctcaaatgttgctacctgtggactcggaagaattctgggcagttgctacaattggtttgtcaggccaactctttaccgaaagatgcattcatctcttttttaaaacctcgactagctggtggcacattcaagcttatattatttccttatgttgggagtctgggacaagttattactgctggctaattggctaa

SEQ ID NO: 57048 - DNA, 837 bp, Glycine max
  Peptide Sequence Number=SeqID_173826
atggtacttccctgccctgcccaaatactagttggcctctccttagacccagatgacagcaaggagcttctgtcatgggcaataagagttctagccaatccaaatgacaccattgtggctgtgcatgttcttgttgctgcggataagaagaagcgtgtctcagtcagaagaaggcaatcacaacttaggcaggcaaaagcatatgttatatctgtgcttggagaatttgcacagtccagttggtctaagcaggttaatttggaggccagggtggcactcaattccacagttggtgaaggtttagtggaggaagtcaagtccatcaatgctgactatcttcttatccgtggctcaagaaaccgaacaaataaaattggaacttctaaaggaatcaccaagtattgctttgagcatgcacatgatgggtgtacaatggtctcagttgggagacgtacaaaggcagatcaaaatgccaattcaaactcaacacgttttcaagataaaaaacaaccaagttcaagatggtttaagaagaataaccaatatggcaagggtgcctcccctattctggaggattatatatcaggaaccaaggctcagaaccgttcaccaagaacagtactagatggtctagagggacaatcgaacagcactgaagatgatacctttagcactagggtctcaagcaccacaaataccccatcatcggattctaagaggcgatccaagataagaacaccacagttcccattcaggttcatagtctcattccttgcttcaccatttagaagcaaaaactttagcatatccacaaatgaaagcgtcagcctttgttga

SEQ ID NO: 57049 - DNA, 1143 bp, Glycine max
  Peptide Sequence Number=SeqID_173827
atgggatcctccatcagttgctgcggctcggagagggtagaagaagtaccaacatcatttggcgtagttcacaattcatggagaatattcacatacaaggagttgcatgcggccaccaacggattcaatgatgataataagcttggtgaaggtggttttggaagtgtctattggggaagaaccaacgatggtcttcagatagcggtgaagaaactgaaagcaatgaactcaaaggcagagatggaatttgctgtagaagttgaagttcttggaagggttaggcacaaaaatttgctgggtcttaggggttattgtgttggagatgatcaacggctcatagtctatgattacatgccaaatctcagcctgctttctcatctgcatggccagtttgctgttgaagtgcaactcaactggcaaaggagaatgaagattgcaattggctctgcggaaggccttctgtacttacaccgtgaggtcgcaccccacatcatccatagggacatcaaagcaagtaacgtgcttctgaattcagactttgagcctctagttgcagattttgggtttgcaaagctaatcccagaaggagttagccacatgactacccgtgtgaagggtacattgggatacttggcacctgaatatgccatgtggggaaaagtctccgaaagttgtgatgtttatagctttggaattcttctcttagaacttgtaaccggtagaaagcccatagagaagctcccaggtgggctcaaaagaacaataactgaatgggccgagcccctaataaccaacggaaggctcagggaccttgttgatccaaaactaagagggaactttgatgaaaaccaagtcaagcaaacaatcaatgtggctgctctttgtgtccaaagtgagcccgagaaacggcccaatatgaagcaagtggttaaccttctgaaagggtatgaatttgaagagaagaaagtcactgccatgagaatagatagtatcaagtataatgaagaattattggcacttgatcaacctagtgatgatgatgatcatgatgatgcaacagctagctatggtgtttttagtgccattgaagttcaaaagatgaaggatccatacatgcgcggtgataacaagaatataggctaa

SEQ ID NO: 57050 - DNA, 993 bp, Glycine max
  Peptide Sequence Number=SeqID_173828
atgcaattagtaatattgtgtctactgatactcaagctcactccagcctttgcaaccaccctgaatgatgcctatggtgatgatagtagtggctgtccattagggactgacatataccaatacacttgccctgaagctgaggccattatcttctcttgggtggagcaggcagtgtctcatgactcaagaatggcagcgtcacttcttaggctacatttccatgattgctttggttgtgatggttcagtcttgctagatgacacacaggactttgttggcgagaaaactgcgggtccaaatttgaattcactcagaggattcgaagtaattgaccaaatcaaatccgaactagaactagtctgtccacagaccgtctcttgtgctgacatactggcaactgctgccagagattcagttcttctgtcaggaggtccaatttgggaggtgcaaatgggaaggaaagatggcattactgctagcaagaatgcagcaaataataacatcccaggtccaaactccactgttgatgtgcttgtagcgaagttcgagaatgtaggccttacacttaaagatatggttgccctttcaggtgcgcacacaattggtaaagctcgctgcagaacatttagctcgcgttttcagactagtagtaactcagaaagtgccaatgctaacattgaattcattgcatcattgcaacagctatgctcaggaccagataatagtaacacagttgcacatcttgatttggctacacctgctacttttgataatcaatattttgttaatcttctatctggggagggattgctcccatcagaccaggctcttgtgaatgggaatgatcagacacgacagattgtcgaaacctacgtggagaacccattagctttctttgaggacttcaagctttctatgttgaaaatgggaagcttggcatcaccaactcagactagtggccagattcgtaggaactgccgaactattaactaa

SEQ ID NO: 57051 - DNA, 378 bp, Glycine max
  Peptide Sequence Number=SeqID_173829
atgaaggccacaaaggaattgagcgagcaagtggaggaaaacgaggtcaaggttttggttgaggaggacgacgaagaatacgagtccgtggatgaagtagtagacgacgcagaagatgatgaagacgaagaagaggacgatgacgacgacgaaggagacgacaatgacgacgaggaagatgatgctcctgacggcggtgacgacgacgacgacgaagatgatgaagaagaaggtgatgtccagcgtggtggtgagcctgacgatgacgataacgactcagacgacgactcagacgacgacgaagatgaagacgaggaggacgaggaggagcaaggggaagaggtagttatctctgattttctttttcaaaatccctaa

SEQ ID NO: 57052 - DNA, 875 bp, Glycine max
  Peptide Sequence Number=SeqID_173830
ataatttggttggacgaggtgggtactcggaagtatacaaaggtgatctttcagatggacgaaccattgctgtgaagaggttggccaaggacaacaaggatcctaacaaggaaaaagagttccttatggaattgggtgttattggacacgtctgccatcctaatactgcaactttagtgggctgctgcattgaaaatgggctttatctgattttcaattactctcaaaatggaaatttggcaactgcactgcatggtaaagctggagatccactagactggccaatcagatacaaaattgccattggtgttgcaaggggccttcattatcttcataaatgttgcaaacaccgaataattcaccgtgacatcaaagcttctaatgttcttctgggtcctgattatgaaccacagattaccgattttgggcttgcaaagtggcttcctaacaagtggactcaccatgctgtgatccccgtggagggcacatttggatacttagcaccagagtactttatgcatggaatcgtggatgagaaaacagatgtttttgcatttggaattctacttttggagattgtaactggacggagacctgttgattcttcaaagcaaaaccttctcctatgggcaaagcctctgatggaatcagggaatattgctgagctagctgatccaagattggaaggcaagtatgatggagagcaactctatagggtagtgctaacggcttcatactgtgtgagacaaactgccacgtggcgtcccccaatgagtgaggtattagagctgctaactagtggccaagagagtgaggttggaaagagctggaggatcccaaagttcacttctgatgaattggatgattactccatg

SEQ ID NO: 57053 - DNA, 1281 bp, Glycine max
  Peptide Sequence Number=SeqID_173831
atggacgccggtaacggttccggagatgccaaactcgacaacacacccacgcaaatggattcggattccggtgctcaagcaaaagacaaagaaaaggaggaactcactgagaatatgaacaagttgcatattgagggatcttcgtctggaagtggatcatctaacatcagaagaaaacctgtcatcattttagttgtgggaatggcagggagtgggaaaacaacactcatgcataggttggtttgccatacacatttgaaagacattcggggttatgtgatgaatctcgaccccgccgtcatgacactcccatatgctgctaacattgatgtgagagacactgttaaatataaagaagtcatgaagcagtttaaccttggccctaatggtggaattttgacttccctgaacttgtttgccactaagtttgatgaggtaatttctgtgattgagaaacgggcagatcaacttgactatgttcttgtggatacccctggtcagattgaaatatttacctggtctgcttctggtgctatcattacagaagcttttgcatccacatttcccactgtagttgcctatgtagttgatacaccccgttcagaagatcccaccactttcatgagcaacatgttgtatgcttgtagtatcctctataagacaaggttacctctcatcttgacattcaacaaggttgatgtagcagcacatcaatttgctttggagtggatggaggattttgaggcgttccaaacagcagcaagttcagatcagtcgtacacatcaactttaactcagagcctttctcttgtgctagatgaattctacaacaatttaaaatcagttggagtttctgcagtttctggtgtaggaatggaagccttctttaatgctgtcgaagccagtgctgaggaatacatggagacatataacatgtatagcagggtgtttgaaatgactaaccaaataacttcattgtatcgtggactatctagggctgatcttgataaaagacgtgaagagaagcaacgtttggaggaagaccgcaggagggagagcatggataaactgaggagggacatggagaaatctgggggagaaactgtagtcttgagcactggtttgaagaacaaagaagcaagtaaaagcatgatggatgaagaggatgaggaaggcgaggacgaggaaatggatgatgatgatgatttggggatatatactgaagaggaggatgctatagatgaggacgaagacgaggagattgataggtttggcttctga

SEQ ID NO: 57054 - DNA, 408 bp, Glycine max
  Peptide Sequence Number=SeqID_173832
atggtgtcaaactctgattggagatgtgaaatcgcagtttatttgcttaacaaaaaagtagttattgatttgtgcttgtcatatattgatgagttctactgtggctgcagttgttgtttcataaaatatgctacttcagaagaagctgatcaagcaattagagcattgcataatcaacatactcttcctggaggtgttggtccaatccaagtgcgatatgctgatggtgaacgggaacgccttggtgctgttgagtacaaattatttgtgggctctctgaacaaacaggctaccgtaaaggaagttgaggaaattttctcaaaatatggccgggttgaagatgtttatcttatgcgcgatgagaagaaacaaagtcgtggtatgtttcctacctatatgggatattag

SEQ ID NO: 57055 - DNA, 237 bp, Glycine max
  Peptide Sequence Number=SeqID_173833
atggatcatactcaaagtgtgaaaggagcttggatttggttgggaatttggaaaacaggttggctcggggaggtttcccaccttagtggtgaccgacatgtggcggtttccgatctgagggtggaaggcaatagcatttactgcaaaagaggaccagtggtgggtcccagtggacgcgcatatttgactggcaaccggtttgggtgtgaacagggggagtgtacacgtgggctgtaa

SEQ ID NO: 57056 - DNA, 1383 bp, Glycine max
  Peptide Sequence Number=SeqID_173834
atggggaaggcatgtcagtttcctttctttacttctcagtctatttacgctagtcctcttgatcttgttttcacagatatttggggtctaacccccttaacttcttctaatggatctagatattacataatatttgttgatgcattctttagatatacttggatgtatttgcttcaaaatacatctcaagcatttactgttttccttcaatttaaatctcttgctgaaaaacaacttggcacaactttaaaagctttacaatttgataatgcaaaagagtatctcacatttactccttatttaactgaacaagggattcatcacagattgacttgttcgtatacacatgaagaaaatggtacacctgaaagaaagcatagacatttgacagaaactggtctcactttgttggcttcaacttctcttccttcaaatttttggggagagtcattcaacattgcagctattataatcaattattttccttcacctgcccttaacaatataagtccttttgaattttcttttcataaaaatccagattataagttcttgagagtgtttggatgtggttgttatcccatgttacgaccttataataaacacaaacttgactttcggtcacacatgtgcctattcattggttatagttctcagtacaagggttataaatgtctctcaccttctggaaaatgctatatttctcgacatgtcatctttcatgagtcagtttttccttataaacttcctggttttgttcctcaaaatactcatcccatgacaactagagccaaagttggtgtctttaaactgaaaacttatgcttcttacaaggaaggaagctatgatcacactgttgagccacatattgtaaaggaagcaatggccaagcctgaatggctcaaagctatgaaagaggaacatgacgcacttattcgaaatgatatatggcccttagtggatccacctcctggttgtaagcctataggctgcaaatgggtgtttaaaagcaagtttaatgttgatggaagttttcaaaggcacaaggccagattggtagcaaaaaggtatcatcaaagagaggggtttggttttaaagaaacctttagtctagtgattaagccatcaatgattagaactgttctgtcccttgtggcttctcagcactggcctattcatcaagtggatatcaacaatgcctttttgcatggagaccttcaagaaactgtatatatgactcaaccaccaggctttgtttcatccgacaaacacaaagtatgcaaactgctcaaagctctttatggcttgaaacaagcccccaggtcttggtttcacaaactcagtttaactttgaggtccttggaatttaattcagccaaatag

SEQ ID NO: 57057 - DNA, 1176 bp, Glycine max
  Peptide Sequence Number=SeqID_173835
atggaggagaagagagagaaagagggaaactcaaagtcatcatccaccatggcaaattctgtggcattttccgacgagattccgaacatgagcatgagcacaagcttccctttctcccctgctttctctagcatctttgacatgatgccacctccaccaccttcctcatctcacgatcctaaagctcccaacaactttgctggcttcatggacttgctcgctgtccctgctgattattatgccccttctttattcgactggccccaaaacaccaccgccacgtcagcaccaccacctctcaccgcccaaatcaaccaccctcttccgtctccggccagctccaatgtccccgacggctccgaggttctcaacactccggcatctcccaactattcgtctatttcgtcgtcgtcgaacgaagccgccgccgccgccgccgccaacaaagcaacgggaaatgataatgatgtcgatgatgaaacaacaatagatgcagctgcaggcagaggagaagaagatcaagaccaagacaagactaagaaacagctcaagccaaaaaagaagaaccaaaagaagcaaagagagccaagatttgcgttcatgacaaagagtgaagtggatcacctcgacgatggctacagatggcgcaagtacggtcaaaaagccgtcaaaaacagccctcatccaaggagctattatcgttgcaccaccgcgacatgcggcgtgaagaagcgcgtggagcgttcctcggaggatcctacggtggtggtgacaacctacgaggggcaacacacgcacccgtgccctgccacgtcacgggctagcctcgggttcatgcattccgaagcaagtggtgggttcggacccactagtggattaggttcggcacactttatgctgccacaacaacaacagtttcgggaccaagcacaagcagcaatgttgttgtacaactccaactcatcgtcattgtcattgccactgaatgttgttaactcagcttcttgtgttaataatagctaccccaatacgtcgtcgttgagtggcttccttcaaggccaagagaatcatcagcgaagtgtgttggctcctcacgctttcttgagggacaatgggcttcttcaggacattgtgccaacgcatatgaggaatgaggagagtgaagatcgtgtttag

SEQ ID NO: 57058 - DNA, 1755 bp, Glycine max
  Peptide Sequence Number=SeqID_173836
atggctctggcagcaattaatgcgcttaatggaatctacacaatgagaggttgtgagcagccactaattgtccggtttgctgatcctaaaaggcctcgtcaaggagattccaggggtcttgcatttggaggcccaggatttggtcctagatttgatgcaccaggcacaagacatccatccaatatcacagatcctatgggtgatcgtatgcctccctctaatgcttggcatcccttgcatccgccgaatatggggccatcttctaatgctggttttcatggcatggggtcaccgttgcttccaagatctggtgacatggcattgcctacagatgctcctctccaattggaaggtaaggctgcatacatctaccctttcgaaaccccacaaggtgggagcaaccttgtgacttggaggtctcagggcggtcctatgactagcttgggaggccccatagatggtcgttttcaagttcagtctattccaatgtcacaacagaatttcaatcagcccatgccacaaattccaccagtcaatcaacaaatatcaccattgcagaaacctgttcagtcatctcaggaactgccaccttcccaccagttgtaccctcaagcaccagttccctatccacaaacatctcttaggcagcatggccagccacaactttctctctctgctggtcctcttccatctcagaagatacatggagtaagtggacagtttctaacttctcagccccaaactcaacagagtgctttgtctgctgcaattcctcagactcatcttgataccggcatgcaatctcatactacattaactacaccaaatcaacagcaagttcctccctctgtgcagcagcagcagccacttcagcaatccccttctccgttagctcagatgttatcacaacaaacacagactttgcaagcaagctttcattcatctcagcaggccttctcccagcttcaacaacaattacagatgatgcaaccttctagtcaagcattaacattgcagcaaaatgcagaagctaacaaaaagcagtcgcaatgggctgggcctgggcctgtagcacaaacagtggccagcactcttgcagctgcacctgctgcagatgtgccttcatccacacctgctaattctgccttaccagcaataaaccagaatatggctcttgtcaaatgtaattggacagaacatatatctcctgaaggcttcaagtattactataatagtgtcactggtgaaagtcggtgggagaaacctgaggagttgacattacatgaacagcaaaagcaacagcaaaggccatctgttcagcagtctcaaactcagtcacaaccttcaatactacctgcccagcaagttccacaaatccaacaggttcagcctcaaagtcatctccaaggacaagttctccaccagcaacaaatacagcagccttctttgtcttctttgttccaggcatatggagttacaggcccccaaaacgtgcaggaagtgggatataagcagttgcaggcatcggttatttctgctggtgatccaggacgctactcgcaggtagggaaccaccgcttcattttgatcccatgtgaccctgtaacaatttatttgcattggcgagttattttggtcctcgttgtcgaggtttcactatcacttactggctcagcactaaggatatgtgggattcaaaatacatggcagggaaatgccctacccagatcgtcctgtaccataatatttgcttaa

SEQ ID NO: 57059 - DNA, 930 bp, Glycine max
  Peptide Sequence Number=SeqID_173837
atgcaacaagttcttgccacaattcgtggtttgaagctcagtaaatatcttcatgaagaacacgttctaaagaaatttgagtccaaagaatatgaagaagttggtatgatcagtgaagcttttctcaattttaaacaacaagatcagttacttgtttcctggctcattgcatcgatgttagcaccaatcctcacaaagatggttggtttggagcaatcatggcagatttggaaaagattagaagtctattatgcgtctcagactcgtgcgaagaaaatcgtagattcactagcagcaattggttttgcgatttctaatgatgatcatatagaagcaattttagatggcttgcctgaagattatgattcttttgttacttctattacatcgcatttagatccatacactgttgacgatattgaggcacttcaattggctcaagaggagcgttttgagaaacacaagaaagcttattcgaatctgattctagctaatactgcttatggacctagttattcttctggcagaggaagaggagataattcaaattttagaggagaatataacaatcgcagtggtagatccaactttcgtggtggttacaattccaatcgaggaggaagatacaacaatggaagaggcaatgacagatcaaactggggacaaaattcaaataattcttggaatcagaacaatagaccacaatgtcaaatttgtggtaagcctggacacttagcaattgattgttggtataggttcaattataattttcaaggtccttctcaagcaaatcacaatcagtatcaacgtttctctcaatctgatcaagcattcatgtcaacaccaacaactgttatggatcctctctggtatccagacagcagagcaagccatcacatcaccaatgatgagagcaacttttctgtttag

SEQ ID NO: 57060 - DNA, 336 bp, Glycine max
  Peptide Sequence Number=SeqID_173838
atgacattctcaggtgcacacaaagcagctttgtctttaatcaagtccttggagagaaggccaacatttaaaacatcaactaccaccaaggaggacacaagttcagtaagttgttttgaacttgacaaaaatgtggtaagatcaaatgatacgtcagatgacatagttaaacccaaagggaaactagttcaagaagaagaatgggaaaagggtagagtagggtttaatgtctactggaaatacatcacaacagcttatggaggagctcttgtacccatatattactttcaacgatactcactgtggcttttcagattgctagcaattattggatga

SEQ ID NO: 57061 - DNA, 243 bp, Glycine max
  Peptide Sequence Number=SeqID_173839
atggtcatcaagttgcaactaatgccgaaaggtgtgcttgccctttggcgttctaagtcacaagaagacgaacgtaggcttttggagtctcacgtttggggggttatcacccccgcaattatatttgccgttaaccccgcgtcatcgccaccaagctccttctgtctttgtcgttatcatttctttaataagtctataaaagcaatactcgaagaaaagaaaaatagcgtatatttggattaa

SEQ ID NO: 57062 - DNA, 744 bp, Glycine max
  Peptide Sequence Number=SeqID_173840
atggttgaaattatttgtggtatccataactcccctttgacactttggctttgtgcatggtgcatgcaagtagcacatgatgtggatcttcaaaagcttccagttagatttgcgttagacgcagctggcctagttggtgctgatggtccaactcactgtggagcatttgacacaacattcatggcttgtttgccaaacatggtggtcatggctccatcagatgagactgaattgatgcacatgatagccacagctgcagccatagatgacaggccaagttgctttaggtatccaagagggaatggcataggcaggatattaaaggagggaagtagggtcgctcttgttggttatggaacaatgatccaaagttgtatggaagttgctaaggttcttgaagctcatggcatctcaacaactgtggccgatgcacgattttgtaagcctctagatggagatttgatgacgagactcgctagagagcatgagattcttatcacagttgaagagggatccattggaggatttggttctcatgtttctcactttctaggcctgaatggtcttctagatggtaatctcaagtggctagccttgacattgcctgacagatatataaaccatggatctcagacagatcaaattgaaatggcagggctgagttcaaaccatattgcagttactgctttgtcattgacgaatgtgcattgggatagtcgtttgcttctcagcctacagaaatga

SEQ ID NO: 57063 - DNA, 345 bp, Glycine max
  Peptide Sequence Number=SeqID_173841
atggtgagggagagaagcagagaggtaggaagcgtacagagaatagtggttttgccggcattgtcgaggccgagaacgaggattcgagcttccttgttaccgaaaagagaggaaaacaatttggtaaacactaatcccatcttccgattcggcacagggacgctcgcagtgcaattgcaattagcgcataaatcagtcacacgagtttcctttctgaatgaaaatgcgatcggatctcagagtagagcagagcagagcagagtggttgaagcaaacgaagagaagggctatatccctgtcgtggaagcaccaaaaatcgacaccgagtttgcttatgaactcaaa

SEQ ID NO: 57064 - DNA, 291 bp, Glycine max
  Peptide Sequence Number=SeqID_173842
atgggcgaagttgtctccaccattccaacaattgggtttaatgtcgaaacagtgcagtataacaacattaaatttcaagtctgggatttaggtgggcaaacaagtatcaggactgactatgaaaccataggcggaggaattgagatcctctccagtgactggaagcatccagtaggagagagaaagacacaacactcttgtggggcccacctagtacttccagtaaatggagaggcaccagactctaggcggagttaccgagtagacacctttgaagcgcaagcactgtaa

SEQ ID NO: 57065 - DNA, 1470 bp, Glycine max
  Peptide Sequence Number=SeqID_173843
atgactgtctgccctaccgacgaccgtcatgtggccgtgttggcgtttccctatggcacacacgcagctccactcctcaacctcgtgcgaagagtcgcagcagaggctccccaagtcacgttctcgttcttcagcaccaagaggtccaatgcctccgtcttcgctggcctcaacgaggagcaacttttcaacataaagccctatgaggtggatgatgggttgccagagaattatgttccttcaaagaaccccaaagacgccgtcgagttcttcgtcaagtccatgccaatgaactatatgacctccatggatgaagccgtggcgaagacagggaggcacatcacttgcttggtctctgatgcgtttttttggttctgtgctgacttggctgacgaaatgcatgcaaagtgggttcctctgtggaccgcagggcctcatcctctccttgcgcatatttcctccaagcatatcagggaaaagttgggccccgaaggagtccgggaaaacaaagaaatcgattttcttactggtttctctgggctaaaggcttctgatttgcctggaggattaaccgaagagccagaagaccctatttcaatgatgttagaaaaaatgggagaagcattgccgcgagcaaccgcagttgccataaactccttcgctacagtgcaccttcctattgcacacgagctagaatccaggttccacaagctactgaacgttggtccattcattttgacaacgccacaaactgttcctccagatgaggaggggtgcttaccgtggctgaacaagcaagaggataggtcagtagtgtaccttagctttggaagttcaataatgccaccaccccatgagttggctgcaattgcagaagccctagaagaaggtaaatatccgtttatttgggcttttagaggcaatcctgagaaggaattgccacaagggttcttggaaaggacaaatacacaagggaaggttgttgggtgggccccacaaatgctaatcctaagacattcagcggttggtgtgtgcatgacacatggtgggtggaactcagtgctggattgcatagttggtggtgtgcctatgattagtaggccatttttcggagaccagatgttgaacactgcaacgatggaacatgtgtgggagattggggtgggacttgaaaatgggattttcactaaggaagaaactctgagagctttggaattgatcatgtcaagtgagaaagggaagatgatgcggcaaaagatggatgaactcaaggattttgcaatggcagcagcgggacatgaaggtgactctacgaagaatttctgtactttttcagagattgtcacaggttcaacttatgagcaactacacgtgcaacaacatggttttcgaggtatccgcaacaaaatcgcaggcgcatttgctgccgcgcattccagatttactcgtcgcaataatccaaagcattaa

SEQ ID NO: 57066 - DNA, 549 bp, Glycine max
  Peptide Sequence Number=SeqID_173844
atggatgccaccaaggccaagacagttgacaatgcaggcactctcacactccccccaccattatatataacatcccatgtcgcaacaacctatgccactgttgtccctaccaccacccaaaagccaccaagaagctttgcaaaccaattcctcatcccccagaacgcggcacgtgcggtgctgaggctgcggccattggtgtgggactccaaattagcacactacgcgcaatggtatgccaaccagaggcgcaacgattgtgccctagagcactccaacggaccttacggtgagaacattttctggggcagtggcacggggtggaagccagcacaagctgttagtgcatgggttgaagagcgccaatggtacaattattggcacaattcttgtgccaatggacagatgtgtggacattacactcagattgtgtggagcaccaccagaaaaattggttgcgctagcgttgtttgctctggtggtaagggcaccttcatgacttgcaactatgatcctcctgggaactactatggagaaagaccttactga

SEQ ID NO: 57067 - DNA, 336 bp, Glycine max
  Peptide Sequence Number=SeqID_173845
atgacaacaacaaccaagccttttcccattgcgaaagctagaaaattccgtgttaaaatcactgcctctataatgagtgtggcacttactgctgattttgaggtgtcagaagaaaaatattcacaagctcgcatagaggaaactgattcagtgtgtttatggctgggagcaattgttatgttggaatattcattagaagaggtgcttccatatatacagttctggagggaccaggttacaataacccaggttacaagccggtgctataactgctcaaaaactggcaaacaaaaatccatacctgcttctaaagttaggagctttaatacatgctag

SEQ ID NO: 57068 - DNA, 1089 bp, Glycine max
  Peptide Sequence Number=SeqID_173846
atgggtagagctccatgctgtgacaaggccaacgtgaagaaaggaccatggtctcctgaagaggatgctgcactcaaagcctacattgaaaagaatggaactggtggcaattggattgctcttcctcagaaaattgggctcaagagatgtggaaagagttgcagacttaggtggttaaattacttgaggcctaatatcaaacatggtggatttactgaagaagaagacaacatcatctgcagcctgtacattagcattggaagcaggtggtccataattgctgctcagttacctggaaggacagataacgacatcaagaactattggaacactagattgaagaagaaactgctcgggaggcgcaaacaatctaacttaagcgcaaaagacacaaacaatggaatagaggagaattcttattcaaatgccctaagctcttcagctcttgaaagactccaactgcacatgcaacttcaaagccttcaaaaccctttctctttctacaacaacccggcgctgtggcccaagttgcatcctttccaagaaaagatgatccagagcctgcagtctttgaatgatggctctagccctgtgatgcaaaatgctttgcctaattccccacatgtcgaacaaggacaaaaagatgagttctgcaagcctcaacatgatggtgcaaagatcaataaccctcaggttcatcttttggagaatatccctttgagtaacggtggagttccctttgttgcttctgggagtagtaagaatccaatgcactcaagccttgcaccaagatctgaggctattcatgagcagactaatagtgtgggatttcagcaacttggtgcactgcagactgaactagatgacattctcaacaacagaataatgggctatgtgccacacgaagatcatgatatggctggatttgattgtttcagagagatgaatagctcaaaggacagcttgatttggtggtccaatgattctgataccaaatcagtatcctcaaattcctgggattcatctgctactccagctcttctaccacaagggatgttccaagattatgaactgggttacagtctgtag

SEQ ID NO: 57069 - DNA, 321 bp, Glycine max
  Peptide Sequence Number=SeqID_173847
atggcatttctaggagaaactagcagtcagacgattgtcaactcaaggttggctttcatttatccaaatggatcgattattcacaatgatactggggtttacttccaaacttcaactccggtgcccattcgagtaccaaataggtgtgattttgcaagcctaaaaaccagaatacacaatacccttcagctatccgacaaacaatttttggatgaaattcactaccggaagccattcaccgatacagaaattttagttgtctttactaaatatgttgtgaaaatcgaagacgaggtcactaggacatcgctaaacaactga

SEQ ID NO: 57070 - DNA, 207 bp, Glycine max
  Peptide Sequence Number=SeqID_173848
atgagattacaaaacctaggctctgaattcgcgacgttacacttagtgccaccctcgggcttagcgcgaacaactgctgcatttagcgcactgatctcgcgcgctaagcgtggggtgctaataccttctgtcagattcttctgtcacgctaagcgcgatgaagctgtgcttagaggtggatgcgcgcttagcccactcaaaatctaa

SEQ ID NO: 57071 - DNA, 985 bp, Glycine max
  Peptide Sequence Number=SeqID_173849
gtcgactctagaggatcccactgctggctgtgccgctgttcgtgctgtacatcaaccggtggcagatccgcgggtcaggccgttacggcgcgatctggcacttcaccgcggcggaataaccttcgtaatcgtcaccggcaatcacgtgcagggtgtggcgcttgtcgatgcgcttcacgtacgagggctcttcggtgttggcgtattcgttgaccgtggtcaccgaccaggtcttggcgaggcgcttcggatcgacaccgttcaagtagacgaagacgctcttctcgccctcggcgacgttcacatcggcatgggtgacggtaccgccgaacagggcgactggcgtggtttccggctcgaacgtgccgccaggcttcctggccaggccggctgcctgcagggcatcgatggcctcggcttcgctgaagttcgaacctgccttgcaggccagcagggcctccagcgttgcggtgccggcgggggcgatggcaggcggggctgcgtgggtagccgagctcgcggccagagcggtcatgaccacggcgaacgcggtatcggatgcgcgacgaaggcgcagcgaccttgccgggccgctgcgccatgccatcagttgctggccgccttcaccgcttctgcggcgtcgacaatgcctggcccgcaaccccccgggcagtttgctgcggcgatcgggcgcgcagtgcgacgcaggatgtccttgacctggtcggtggtcttgggcaccggcgccactgcctgcatcagcgcgacgatgccggcgacgtgcggcgccgccatcgaggtgccggacatgaagtcgaaggcgttgttgcccacggtggacaggatgccctgtgccggatgctggcgggtcggtgcgcagttggtctggttcggcggcgtggccagcggcaggaactcgccgacggacgcgcggcaggaccaggtttcaccaccgggtgcggtgatgtggatgcctgcgccgtag

SEQ ID NO: 57072 - DNA, 123 bp, Glycine max
  Peptide Sequence Number=SeqID_173850
atggcgagaaagctttgctatctttcaccgagcataaaaaatccagagagcgaaaggacacttgaagatggcaaaggtgatccattgagacattttctgtacaatagtgagagatacatataa

SEQ ID NO: 57073 - DNA, 273 bp, Glycine max
  Peptide Sequence Number=SeqID_173851
atggcgaagatagctagaaactcttgggggcgtatctatatcggtcatttgcaacagtcaagccgttgggaaatgcatataccgaaagagcaagtgggtagatatgcttaccaatcagcctcgaccaagtttcaaaagactggaagaatgaagcatcaaggaacatggaataagctggcaatgatgttccaggaagctgacgtgtcatggaagccagaagacacatcagggtctattatatggagttgtccagctgggaataagttagtttga

SEQ ID NO: 57074 - DNA, 1320 bp, Glycine max
  Peptide Sequence Number=SeqID_173852
atggaggatccaagggctgcagaaactgaactggacgctcgtgatgaacttgattatattgcttgtcctgtaccaagtgatgatgatctcgatgggatgcaaacttcaccgggaaggtcacaacaagggcacaaggatgatgttcccatgaccattgaaactgagaatgatggagatgatgtacttgtggaagattatcaagtctattttgctccatcaatctatggtcagaaggacataaaaactgcaatagctttagctatgtttggaggccaagaaaaagatggggaaggaaagcatagattgcgaggagacataaatattcttctcctcagtgatccgggaacagcaaagtctcagtttctcaaagctgtatacactactggcaaaggggcttctgctgtgggtctcactgctgcagttcacaagtatctagtcacaagggagtggactcttgatgggggaacactcattgttctcactgctgcagttcgaggaatttgtcttattgatgaacttgacaagatgaatgaccaggataggcattctgttcggttattgtggctgcaaatcctttggtggaaggatgttgttgatccggtcactgatgaaatgcttgcaacatttgtcgttgacagtcacttcgagtcacaacccaagggtgctaatcaagatgataagtcctttagtaagtcccaagatgtccatgcatctgccatgccagctgatccagagatacttcctcaacagctactgaagaagtacattatatatgccaagttgaatatttttccaaggttacaagatgctgatatggataaactgtcacatgtctatgccgaactgtggagggaatcttcacacggacaaggagtctctatttctgtaaggcacattgaatcaatgataaggatgtctgaagctcatgcgagaatgcatctcaggcaacatgttactcaagaggatgtaggcatggcaattcgtgttctacttgaatcattcatttcaactcaaaaatttggggtgcagaaggctcttcaaaagagctttagacagtatatgactttcaagaaggactataatgatttgctcctttttattctcagcaaccttgtacagaatgctttgcatttcgaagaaattatcactggatctgttgcagttctaacgcatatagatgtcagagtagatgatctctacaacaaggctcaagagcatgacatttatgacctgacaacatttttcaatagcagtcaattttcaagggcctattttgtattggttgaagaacgtagagtgatcagacatcaccttgcctga

SEQ ID NO: 57075 - DNA, 2340 bp, Glycine max
  Peptide Sequence Number=SeqID_173853
atggcgggagacatgaatgaaattttgaacgctacagaggttgatggtggtaattttattgcctcaaaatccaatttattcaggaatgtggtggactcttgtgattttattgatgttcaagcaagtacagtttccacacgccttagtggagttattaccttagagagtaattcagatcacaatcccttgctgatcagctgccacaaggcaaagcgtaagaaatacaagtccttccgctttcaagcgacatggatctctcatccggattatgctacacttgtctcaaatgcatggcatagaactgttggcaacaggaagcacataattgaagctcgtttgaaagggattcaccgccagcttgattattgctttttgtctgatttgcctattactttgacagatgtgaaagatgctttttcctcaatgaaccaatacaaggccccagggcctgatgggtttcaaccaatattttatcagacatattgggacaatattggtggagaagtggcagagtttattgctcaggtttttacaactggaaatatacctcctggattaacagaaacaaggattgttccaattccaatggttgatagtccattgagtctcaaagattttagaccgatcagcctttggcacaatgctctcattgctcaggaagtggtgcgtcatatgcataaaaagcaaggaaaatctggtatcatgatgttgaagattgattttgaaaaagcttatcattgtgttgactggaagtttctgcagctaaccctgcatgagtttggcttccctgaatcaattgtgaaacttatcatgaactatgactgtttacttttagctcaagcaaagccatctcaagctcgtgtgatcaggaaagttcttgacgatttttgtcaagcttcgggtttgaggattaatttccaaaaatccagccaacacagtcattgggtcactagggagacagttacaaaaccaatgacgcaaaggggtttgggagttcgcactgcaaggaatactaatacttcccttctagggaagcattacaagcgttgttcatatacatggctctcaatcacaaaagctgctgaattgcttgaaccaggatttcgatttagagtgggtacaggtgacatgccagtgtggtatgacaggtggaacccgaatggcttcctgtgcgacatggtggattatgttaacatccaggattttaaccttacgttgaaggatgtgtatgagaatggaatgtggctttggaataacatggcaacaattattccctcacaggtgccccaagagttcaattctttatttttgaactcaactattgcggacacagtcatttggagtgctgctcaaaatcatgtttttatggctaaaaccgcttattggtggcttcaatctcaagccaatgtttcccttggcgctcaagcagaaaacaactcttggatgtggctcatgaaaatccctcagaacatcaaatttttcttgtggctcactagccacaagagtctccccacaaagtttttccttgtttatagacatttgtcttctaaccctttttgttgcaggtgttccaatcaagttgagtcagttcttcatttattacgagattgtgacaaggcctgtagtgtatggagcatgtttcaaccaacactggtagtagattttgcagaacatgatagttcggtgtggctgcataaacatgctacatgtgcaactggtgctttgttctgtcttatttgctggtttatatggagagacagaaatgcaatgaccttcagcaatgagaattggcaggagtggttcattgcatcccaggtgaacaatatgctgaatatcataagcaatcagcaggagtgtcaaccaaggaatcgttatacagttcaggtggcatggaaacccccaccaccaactgttctaaagttaaatacagatggatcatctttggttaatcctggtcaatctggattcggcggtgttattagggactctcaaagagattggatcattgggtatactggtgttgagttggcttggttcagaggttattctaatattatttgtgagacagattccaagctcactctggatttaatctctggggaaatcacgacatgtcatccttatgctgctctacttacatgcatgcgttcttacaaaggccagaattggagtatttcctttgctcttacttttcgcgagggaaatcatgttgctgattggatggcaaagaagggtgcttcatctgaggagcctttgcaactatgggattcatgtcctccaactttagacacaatattgttttcggatgctataggcatcactgttcctaggcttgtgtaa

SEQ ID NO: 57076 - DNA, 2622 bp, Glycine max
  Peptide Sequence Number=SeqID_173854
atggcatctgatcctgaatcgccaacctctccttccgttggtttcaacaccgaccagcttcctcacacccacaccagccgtgcctccgaagacgacgaggcttccgtcgatcccgatatcgtacgagacgaaatcgaagaacaacccgaggaagaagaagatggagaggatctttacaatgacaactttttggatgattataagagaatggatgaagctgaccagttcgaatcgtttgggctggacgactcgttggaagatgacagggattttgatcagatcatgcaggatcgaagggccgcggagattgaactcgaggcacgcgatggtcgcgcttccaatcgtaacaagcttccgcagcttctccacgaccaggatacagatgatgacaatcacaggtcttctaaaagggctcgagctgattttaggccttctgcagcaagtgatgatgaccttgatggtatgcaaagttcgcctggaaggtcacaacgagggcacccgagagaggatgttctcatgactgatcaaactgaggatgatcgagatgatgatgattttgatgatggatatgagatgtatcatgttcaaggaacacttagagagtgggttacaagagatgaagtgcgccgcttcatagccaggaaattcaaggactttttactcacgtatgttaatccaaaaaatgaacatagggacaaggaatacgtgtggctgataaatgagatggtgtcagctagtaagtgcagtttggagatagattataaacaatttatctatgttcatcccaacattgccatttggctagctgatgcccctcaatctgtcttagaagcagatccacttgaatacaatgatccgaattgggggagtagtaaccagacgttctggagttttcccccagttgcagcaggtgaaaattcctattcagaggtgaaagtgggatcctgtcctgagtgtcaatcaaaaggaccattcactgtgaatattgaacagacaatttataggaattttcagaagcttaccctccaagagagtccaggaatagtccctgcgggtcgacttccaagatacaaggaagtgatactattgaatgatctgattgattgtgctcgtcctggagaagaaattgaggtcacaggtgtttataccaataattttgacttatcccttaacacaaaaaatgggtttccagtgtttgccactgttgttgaggcaaattatgttacgaaaaagcaagacctattttctgcctacaaacttacacaggaagacatagaagagattgaaaatttggctaaagaccctcgaattggagaaaggattgttaagtctattgctccatcaatctatggtcacgatgacataaaaactgcaatagctttagctatatttggaggtcaagaaaaaaatgtggaaggaaagcatcgcctgaggggagacataaatgttcttcttctcggtgatccagggacagcgaagtctcagtttctcaagtatgttgaaaaaactggacagagagctgtatacactactggtaaaggggcttctgccgtgggtcttactgccgcggttcataaggatccagtcacaagggagtggactcttgaagggggggcgcttgttctagctgacagaggaatttgtcttattgatgagtttgacaagatgaatgaccaggatagggtgagcatccatgaagccatggagcagcagagtataagcatatcaaaagctggaattgttacatctcttcaggcacgctgttctgttattgctgcggcaaatcctgttggtggaagatatgattcctcaaaaacattctctcaaaatgttgaattgacagatccaattatttctcgttttgacatcctctgtgtagtgaaggatgttgttgatccggtcactgatgaaatgcttgcaacgtttgtcgttgacagtcacttcaagtcacaacccaagggtgctaatcaagatgataagtcctttagtgagtcccaagatgtccatgcatctgccatgccagctgatccagagatacttcctcaacagctactgaagaagtacattacatatgccaagttaaatatttttccaaggttacaagatgctgatatggataaactgtcacatgtctatgccgaactacggagggaatcttcacacggacaaggagtccctattgctgtaaggcacattgaatcaatgataaggatgtctgaagctcatgcgagaatgcatctcaggcaacatgttacacaagaggatgtggacatggcaattcgtgttcttcttgaatcattcatttcaactcaaaaatttggggtgcagaaggctcttcaaaagagctttagaaagtatatgactttcaagaaggactacaatgaactgctcctttatattcttcgcgagcttgtaaagaatgctttgcattttgaagaaattgtcaccggatctgcttctggtttaacgcacatagatgtcaaagtagatgatctctacaacaaggctcaagagcatgatatttatgatctgaaaccattcttcaatagcagccacttttcaagggccaattttgtattggatgaagaacggagagtgatcagacatcaccttaccagatga

SEQ ID NO: 57077 - DNA, 3492 bp, Glycine max
  Peptide Sequence Number=SeqID_173855
atggcttctacttgttcttatgtagttggttgtgcttcttcttcctctctctctgttaccaaaaaatatgatgctttcatcacctttagaggagatgatactcgcagcgacttcgcaagccatcttcatgctgctctgcgcagaaacaacgtcgatacatacatagactacaggatcgagaaaggagctaagatttggctagaaatcgagagagccatcaaagactccactctcttcttggttatcttctccgagaactacgcatcttctagctggtgcttgaatgaactcctccaactaatgcaatgcaagaaacaagaagaaaacgttcatgttattcccgtgttctacaaaatagacccgtctcaggtacgcaaacagagcgagaactatcacgtggcatttgcaaaacacaagaaggatggaaaggtgagtgaagagaagatgcaaaagtggaaggacgctctcagtgaagcagccaatttatctggcttccattctaacacatacaggactgaacctgacttgattgaagacattatcaaagttgttttgcaaaaactagatcacaagtacccaaatgactttagaggccctttcatatctaacgagaactatacaaacattgaatcttttctgaatattaattcaaaggaagttagaatcattggaatttggggcatgggaggtattggtaaaacaactcttgctgctgctatttttcataaggtttcttctcattatgaaggcacttgcttcttagaaaatgtggctgaggaatcgaaaaggcatgacctaaactatgtatgcaacaaacttctttctcagttactaagggaagatcttcatattgacactcttaaagtgataccttctattgttacaagaaaactcaagcgcaagaaagtttttatcgtgctagatgatgtgaacacttccgaacttcttgaaaaattggtcggagttggtcgtgaatggctaggatctggtagcagaatcattgtgacaaccagagataagcatgtacttatacgtgaagttgttgacaaaattcatgaagtcaagaaaatgaactttcaaaactcccttgaacttttcagcctaaacgcctttggcaaaacctatcctgaaaagggatatgaggagttatcaaaaagagcaatggattacgccaaaggaatccctttagctttgaaagttttgggatcatttcttcgttccagaagtgaaaatgaatggcatagtgcactgagtaaattaaagaaaagtcccaatgtgaaaattcaggctgtgttgagattgagttatgcaggattagatgatgatgagaaaaacatttttctagacatagcttgttttcttaaaggacaaagcagagaccatgtaacaaaaatattaaatgactgcgatttttctgctgatatagggataagaagtcttttagacaaagctcttatcactactacatatagcaattgcatagatatgcacgatctgatacaagaaatgggtagagaagttgttcgtgaagaatctgttaaatttccagggcaacgcagtagattgtgggatcctgtggaaatctatgatgtattgacaaataatagaggaactgctgcagttgaaggaatatggttagatatgactcaaattacacatataaatttaagctccaaagtattcagaaagatgccaaacctgagattactcactttcaaatctcacaatggagactctgagagaattaattcagtgtaccttccaaagggtcttgaattcttacctaaaaacttgagatatttggggtggaatggatatccattggaatccttaccgtcaagatttttccctgagaagcttgttgagctttccatgccatacagcaatgtggaaaaactttggcaaggagtacaaaatttgccaaatttagagagaattgaactttgtggctccaagcaccttgtggagtgtccaaggttgtctcatgcaccaaatcttaaatatgtaagtatgcgcgattgtgaaagcttgcctcatgttgatccatcaattttctccctcccgaagcttgaaattttaaatttgagcggatgcacatcgcttgagagccttagcagcaacacttggccacaatctctccaagtattgtttttagcacattcaggtttgaatgaactgcctccatcaattttgcatatcaggaatctccatatgttttcttttttaattaattatggtcttgcggatcttcctgaaaactttacggatcaaatttcactttctgattcaaggaaacacgaatgtaacgctttcttcaccttacaaaagttaatgcctagctctggcttccagtcagtaacacgtctagcattttatgattgtcataacttatgtgaaatcccagacagcatctccttgttatcatctttgaaatgcttaagctttcgttatagcgccatcattagcttacccgaaagctttaagtatcttccaaggctcaaacttcttgaaattggtaaatgtgaaatgctgagacatatacctgctcttccacgatccattcagttattttatgtctggaactgtcaatctcttcagacagtgttaagttcatctgctgaatcatccaaaagacccaactgtacttttctggtccctaactgtataaaattggatgaacattcatatgatgcaattttaaaagatgccattgctaggattgaacttggatcaaaatcattatctgcagtagtattagaaaatgaagaagatgcatcctcggacaatgagggcactgatttttattttttcaaattagcaagaaatggtacgatttgctactgtttaccagctagaagtggaaaagttcgagactggttccattgcaactttacacaatctttggtcactattgagcttccccctaatttgttgtgtttcattttctacatggttgtttctcaagtccaatcatgcaacatcggatgctatggaagtattggatgtgaatgctacttggaaaccagctgggatgaaaggatcaaaataccaagtttctttgtagaagaaaatatcttgtctagtcttgatcctcaatttggatttatggcagatcacatatttttatggtatgatgcacaatgttgtaagcagataatggaagtaattaaagaaaggaaagccattaatgacaagagcaccactcatcctccaaagcttacatttaaattctttgctcaaactgaagataacaatgaagcagtggtcataaaagagtgtgggtttcgttggatgttttccttagaagaaagagaatgtaaattcaagagaagcagagaaattcatgaagtagaagccaatgttttcagaaatcaagtcaaggactctgagtctaatgagcaagaagaaacatttcctccaaccaaaaaaattaagcaaggtgtcttcagaacttcaaacttggaagcagaagaaaaagaggacttgaggtaa

SEQ ID NO: 57078 - DNA, 804 bp, Glycine max
  Peptide Sequence Number=SeqID_173856
atgtttgaacggatcctgttgctatatattgccagggcaaatcagaagcacccagaagcagcagtatcttacagtaagagtcaacaaattaaggctcaactattgcagaagcaacaggagcaagagcttcagaatacaaaccagaatcaacaaatacaactcttattgcaaagacatgctcagaagcaacaatgtctgcgtggagcacgacttattagtggcagtgctagctgccctattagcaatgatcctttgatgaggcagaacggggcaacatctaatgctatggcaacaaaaacatatgaagacaggttgaagctttcacttcagaaagatgctttagatgatgcaagcattaagcaaaaagtagctgatgatgttggtcatcttctaaacccaaaccatgccttattgttgaaagctgcaacagcaattgggtctacacaagacataaagagtgatatgaatggaatgatgaggtctcaagctgttgtttcagaaagatcctttatcggttttcatggttcaaatcaaggtggtagcaatttggctccgaaaggatggcctctagcaggactggatgagcttcgctcgggatttctccagccgaataatgggatgcactcttcgcaatctttcaatcaactttctctacagcaacaactcatgcttcaggaactacaaaatttgatttttcgttctgctagttattttgagagttggaatatatttttgattccaatcaacgatcaaaggttaagaaacaacaatcttataccaattcaaaggttccctgaagcataa

SEQ ID NO: 57079 - DNA, 1641 bp, Glycine max
  Peptide Sequence Number=SeqID_173857
atggtgggggaatcaagaaagtgggtgatacttttggcatcaatatgggtgcaggcattcacagggacaaactttgacttctcatcatactcatctgagctcaaatctgtgcttgacataactcagcttcagctcaattacctctctgtggcctcagacatgggaaaggcctttgggtggtgctctggggtctcactcatgtacttccccttgtgggtggttatgtttatggctgcttttatgggactttttggctatggcttccaatggcttgtcattcatagactcatcactttgccttatgttgtgttgaaggtggagacattgacgacgacacaataccccatggttctagaggccctgctttattgctctggaaagtacacggcagtgtcaagatgcagtgcgttgcaatgtcatggtcgtccacaatgcatctgctggttcaacaccatctgctatgtcttatgcatcagacattttccggcaaaccgttcccttgcattatccttgagcattagtttcaatggtgtgagtgcagctttgtacactctcattgccaatgcaataaacacaaatgatgacactgtctatctattactcaatgccattgttcctgtgctaatttctggactagtactcatcccaattctcaatcaaccacagcctcaaccacattctgttgacaccattcagcgcgatacatcggtttttctctgcctcaacatccttgcccttgtcacaggcctctacctcctcttcttatattccttctcttacaccatggctattgctcgcgtaatccttataggtgcaatttttctccttgttctgctcttatttttgcctggcattgtgtattccagagaatggtctttctttactgtccccacaagcttctccttctactactcaagattcactcgcgctgaccctaatgacgatgaactctacaaagagtttattagtatcgaggacagcgtgaggaatagaagtgcacaaagcacaagagagaagaaatgttgtattatgaatgtgttggagagagagcaattttcaatgctaggggaagagcattcagctaagttgctagtgcgtaaatgggacttctggctgtactacatagcatatttctgtggaggaacaattgggttggtttacagcaacaacttggggcaaatttcccaatcactgggacactattctcagaccagttctcttgtcacgctctactcaacatgttccttcttcggtcgccttcttgcagcctcacctgacttcttaagcaggaagatacacattgcaagaactggatggtttggagcaggcttggtgctaacaccaattgcattcattttgctggccatatctggcagtggagctgcattacacataggcactgccttgatagggctgagttcaggctttgtgttttctgcagcagtgtctattacctcagagctatttggcccaaacagtgttggtgtgaaccacaatatcctcatcactaacattcctttaggttcatgtctctatggccttcttgcagccttggaagtgctacctacaaactttcatatggtggagttgtatttcaatgataggattggtttcaagcttcttccttttcataaggactaa

SEQ ID NO: 57080 - DNA, 2322 bp, Glycine max
  Peptide Sequence Number=SeqID_173858
atggcgcctcgttcattcctactcgccctgctgagtctcctcttgactcagtccgattcggcacctcaagccttcaagagagaatccagtcaccctcagtggcaccacggagccttccacgacgtacgagacagcgtccgatccgacgttcgccgcatgcttcactctcgcgccgaggttccgtttcaagttccgctggaagtgaacgtggttctgattggttttagcggagacggaggctatagatacaacatcgatgcgcatcgattggaacagtttctgaaaactagctttccagttcacagaccttcgtgtctggagactggggagctgcttgatattgagcatcacatggtctataatgcgtttcctgctggacagcctgaactgatagcacttgagaaagaactgaaagaggcaatggttcctgcaggaaaagcaagagagactgaatttggaagggaggtacctttgtttgaagttgaggcaacagctgtggagccagtatttcaaaggctgtactcctacatatttgacacggacagtgtgggatcttctgtcacagagatggatagaccagtgccaagtgcaatattcattgtaaactttgacaagttcaacaagtgtgctggtgccctggccaatagtgcttgtcatatggaggaggaccttgtgatgtttcagcaggtgagattagatcctagaaataaggagattgatcttgatagttcaatgtatgagaaaattcctgacctaactgaggaagatatgaaaaaacaagaaggagattacatctaccgttatcgttacaatggtgggggtgcaactcaagtttggctaagctctggcagatttgtggtgattgacctttcggcagggccatgcacttatggtaagattgaagctgaagagggaagtgtctgttctagaaccctgccaagattacaaaatgtgattcgtcctagtagtttgcacacaacttctcatcaatcgagcaatgatatttttcttgggcagcttgcttctttggtatcaaccacagtggaacatgttattgcacctgatgtgaggtttgaaaccgttgatcttacttcaagactgcttgtacctataattgtcttgcaaaatcataatcgatacaacattatggaaaagggtcacaattacagtattaacatagaagaaattgaggctgaggtgaaaagcatgcttcacgatgggcaagaattagtaattattgggggtgtacattcgttacatcgccatgagaagctggcaattgctgtttcaaaagctatgcgtggacattccctgcaggaaaccaaaaatgatggtcgtttccatgttcataccaagacatatctggatggtgctattttaaaagaagagatggaacgttccgctgatgtgcttgctgctggattgcttgaagtgtctgacccgtctctttcaagtaaatatttcctccgccaaaattggatggatgaatctgaagggtcaactgattctattcttaagcataagtctctctgggcttcttataactcaaaatatagcaagaaaaggagaaagaaagtaaagaaacaaggagatctacaaccaacttatggaactagagtaattcctgtgtttgtgctatcgctagctgatgtggatccaaaccttatgatggaggatgaaagtatggtatggacaagcaatgatgttgtaattgtgcttgagcatcaaaatgaaaagattcctttaagttatgtttcggaaacacaaagaagacatgctcttccatctcaggcacaacggcatatattggctggtcttgcctcagttgttggtggtttaagtgcaccatatgagaaggcttctcatgtccacgagaggcctgttgtgaattggctttgggctgctggttgtcatccatttggaccattctctaatacatctcacatcagtcaaatgctccaagatgttgctttgaggaactcaatatatgcccgtgtggattctgtgcttcgtaaaattcgtgatacgtcagagactgtccaaacttttgcagcagagtatctgaaaactccccttggtgaaccagtaaagggaaagaaagaaaagtcaaacactgaactgtggttagagaagttctacaagaaaaccactaatttgccggaacccttcccacatgaattagttgatcgcttagaaaaatatctggatggccttgaagagctgcttgttgatatgtcttcactgttatatgatcatcggttacaggatgcctacttgaacagttcagatattctgcagagcaccatgttcaccgaacagtaa

SEQ ID NO: 57081 - DNA, 402 bp, Glycine max
  Peptide Sequence Number=SeqID_173859
atggccatggatgtcatcgacaacatttatcctacttcatccaaaagacataattttattttggtggccactaattattttacaaaatgggtggaggctgaaccattgattaatgtgactcaagaactcatgattagatttattagacacaacattgtctataggtttggcatacctgagttaatcatgactgaccaaggaactatgcttaatggaggtatggaatggagaaggaagggagagatgagacgccacttcaaggagaagatgagtctagaagaagcttaccaccgtaagaggccatggataagagcttggaagaagaaggagatgaatgaagggagaggaggagaagagcacgaaattttgtactctaaaagagttttgaaatctgaagtttaa

SEQ ID NO: 57082 - DNA, 358 bp, Glycine max
  Peptide Sequence Number=SeqID_173860
attccttactactacaaatccctctagttgtgatgcacttgaagtctgtgatgatgaagatgttcaatgtatgataagtgtttttcagtcgtatgcttttacaactagaattaagctttacgtcgacattgatcaaggtgatagcttgttaatcccggctggcaagatgaggatgtggagattccagaagaaaaatcatttaactcagaagatgagggtgtcaacctcattaatcaacaaggacatggtcaaacataacaaccacttttggattcatcttcacatttttttcaacatgaattgggatcatcttgaccaagaaatggattttcctgaattggatgtacctggttcatga

SEQ ID NO: 57083 - DNA, 273 bp, Glycine max
  Peptide Sequence Number=SeqID_173861
atggtaacaattaacgaaccagttttctcattctcatctcaccctctgcttaatctcaacatggcaaacaccaaacacatcgaacgcttcgacgttgttcaggacgattccgaccactactttctattaccagctggtcccaatccatattgcttcaccaaagcaaggagcgacgtgcacaagaggatcatgaagcagtggagaatcctggccaacaacaaccttcctgaatccatctacgagaaccgcatcgatttgcgccgagggcagtga

SEQ ID NO: 57084 - DNA, 183 bp, Glycine max
  Peptide Sequence Number=SeqID_173862
atgacaaaccaaatgttcataatatacttgcacagtaacagtaacgattggggggggaaaactgccaggaaaccacattacaagcgaaacctcaaagagagttgggcttcgtcctcaaaaggaaacaacaccagaaaatctagcattccatggattcaaacagaaaacgcaaatgaaacatga

SEQ ID NO: 57085 - DNA, 975 bp, Glycine max
  Peptide Sequence Number=SeqID_173863
atggaaaatacgaacgggttcgtgcactttgatgtggtttcagatgatgcagatcaccactttctgggttcaaataaaggaaaatgcttcacagatttaaagagtgaagtgtaccgcaccatcatgaaagagtggaaaatcctggagcagaatttaccggaatccatatacgtgcgggtctacgaacgacgcattgatctaatgagagccgtgatcgtaggtgccgccggcacaccgtaccacgatggtctgttcttcttcgacatagggttcccctccgattacccgaaaaatcccccaaagctgcattaccactcgttcggctacagacacaacccaaatctctactccagcggaagagtgtgcttgagccttctgaacacgtggacagggagaaagagtgagaagtgggacccatctgggtccacgatgctccaagtgttgctctctatccaagcactggttctcaacaagaagccatattataacgagcctggactggctagtattgcgtcctccgagtggaggtcacgtgcctacaacgagaacgtctttcttattacttgcagcacctcccttcatctgcttcggaggcctcccttcaactttgaagcatttgtcagtgcccattttcgccagcgcgcgtttcggattctctcggcatgcagcgactacacgaatgggcgcgcgagggttggccattactcttttgacttgcgtctgtcttcttcttcgtcaaagctacatgtttcacggagttttaaaaagcagatgatagcgttttaccctcggcttcttcaagcatttcgacagaatggagcttctttggagggtttcgccgaacatttggagctcgagagtaagcattccgaaaacaaaagcggtggaatcttcaagaaggtcatggaaaagatcaaaaaggctttcggattgaagaaaaacaaaggacaacaaagtcgtcttgaaagtgcttaa

SEQ ID NO: 57086 - DNA, 201 bp, Glycine max
  Peptide Sequence Number=SeqID_173864
atgaagttggatgaaaaattgggtctggacagtgacagtgggggtgatcgtactgatctacaagaagttgaggcacatggcgcgctcatgagacgacgcgaaggtggagtcgaaggagacgatgctgttggcgaaggcgaggtgcggcgagaagtcgaagtgagaaggggatttcagttgtgcgtggcgtatgagttttga

SEQ ID NO: 57087 - DNA, 1079 bp, Glycine max
  Peptide Sequence Number=SeqID_173865
acttagctttggttaaggagttttatgccaaactttacagctctgaagacctttcaccaaagcaagtcatgggtcagaggccacctgcatattccagatactgcaagttgcccacagattataaagagattgaggctgccttatgtataccaggtcgagggtttattttgaactctgagggccatcctgggaagattctcaggaaagatttgacgaatcttgctcaggtgtggagtgttctctcatattccaacctggctcctacttcacacacctcagacctgacagtagatagagctaggttgatctttggcctagtctctcagatggacatgaatgtgggagcccttatctctggccagatcacatctatggcccagtctaactcttctagacttgggttccctgctctaatcatcgccctgtgtaaagccagaggggttaattctaacagcttggttttcgagcgcctaagctcgatcatcaacttggcctatatcaagaaaaactgttggaatcctgatgatctaacagtttctatcagaggggctaggcgggcaaggacgaggccacctgagcctccttccacatctacagctcctattccagcacgtacctcatcagctccttctgtcccagcttctgcagattttaagcgtcttaaagccatgcttcagagcatccatcaggggaaaattattctattagagagcttacaggtggtggcgcctccaggatctattccttcagtggagcaggaagatgaaggtcccacagcccaggtaccacagcatgtggaggatgattcacctgaggccaccattccaaagccttttgtcagggggatggaggcagaggagacacaggaagctgcggccacacctgagagatctcttgaggcagcttctgagcccctagcacaaggggaggacctaccctcacctcagcctgtagcagacccttccactcctgtgttggacttatcagaaggtcaaactactccagtcctgacactgaacacttctcctccaactactccagtgcttcatctgacagatgaggaggatggtcagacacag

SEQ ID NO: 57088 - DNA, 492 bp, Glycine max
  Peptide Sequence Number=SeqID_173866
atgaaggaaattgtcaaaaaggaggtagtcaagctattggaggctagaatgatatatcctatttcaaatagccaatgggtaagccctgtacaggttgttccaaagaaagttggtatgactgtggtgaagcatgagaaaaatgagcttattccaactcggactgttacgggttggagaatgtgtattgattacaaaaaacataataaagccactagaaaggtggcgaggctcacgggtgcatcttccaaagaaggaaaatgcgtggagttgccaccaacgtttatttgtggaaaacgtcgaaaaaaccgaaggaaaccggtcatgaagaatattccagattcgggagttgtatttacgtttgaggaaggtattagcacctctcacgtcaacaaaagtggggctcttgctcctacgtaccctccattgaagaggaaatcagacctacgtagttctttcaaaagggcgaatcaagcgattctttttactttgaag

SEQ ID NO: 57089 - DNA, 2373 bp, Glycine max
  Peptide Sequence Number=SeqID_173867
atgggaactccaccaacggatgagctcgtgaagaagatccaacagctagaggaaggacacgcgcacctgaagcaagaaatgtccaaactcaaactctccgatgtgagacacggccaccatcgccagaggtcacactccgtctctccgcagcgttccagactgggcgctccgccgaagaagcggagcgatgcaccggctgcgtggaagagaggctcgtgttcttttaaacagtcctcgccgctgcagagggagagtcgcggtggcggtgatcctcaaattcacggcggaggaggagaagaagctgctccgcgccgtggtccttccgccgtcaatttcactgaacggcagtatcttaatatattgcagtcaatgggacagtctgttcatatattggatcttaactgtcgcataatatactggaaccgtagtgcggaaaatctatatggttatacagcagaggaagctttaggacaggatgggattgagctacttgtagaccctagggatttggacttggccaataatacagtgaatcgtgttatgatgggagagagctggacagggcaatttccgatcaagaataaaatgggggagaagtttttagctgtagcaactaatacgcctttttatgacgatgatggaagcttagttgggctaatttgtgtctctattgatttgcggccctttctcgaaatgaaagttccaatgcctagtgtaaggaacatcgagtcagattcagattcaggtggaacccgacctagaagtagcattacaaataaacttggccttgacactcaacagccgcttcaagcttctatagcttcgaaaatttcaaatttggcatcaaaggtgggtaacaaagttaagtcaaggatctggacgggagaaaacaatttggatcgtgaaagtgggagtggtgaaagtcatcattctgagcatagtttgtcggaatctgtttttttagagcagagagaggatgctaattccagtggagctagcacccccagaggtgatgtgccaccatcccattttggtgcgtttcctcatgtcgaagaaaaatcccagggaaaagctctgagagagtctggtgatgagagtgaaggaaaatctattcacaaaatcatacctaaggcggaagcctggattcaaaggaaaacattatcatggccatggagaacaaaagatcgagaaggatcagatgcagcaaatgttcgtgttgctgggccatggagacagaatgatcaagaaaatgaatcagttaatcagaagattctttcttctagcttgaagcaagaaagccaggcaggtgaaagtaatcgccctactaaccatgaggcttcaggatcctggtcctcctttaatgttaacagcacaagtagtgccagcagctgtgggagtgctggcagtggtgctgtcaataataaagtggatgtggacactgattgcttggattatgaaattttgtgggaggacctgacaattggagaacaaattgggcaaggttcttgtggaactgtctatcatgctctgtggtatggatcagatgttgctgtcaaagttttctcaaagcaagaatattcagacgatgtgatactgtccttcagacaagaggtgtctgtcatgaaaagacttcgacacccaaatattcttctcttcatgggggccgtgacttcacctcaacgtctctgcattgtgacagagtttctcccacgtggaagcttgtgccgcttgttacacagaaacacatctaaacttgactggagacggcgagttcatatggccttggatattgcacgaggtgtaaattatcttcatcactgtaacccacctatcatccacagagatttaaagtcttcaaatcttctagttgataagaactggactgtgaaggttggtgattttggtctttcccgtcttaagcatgaaacatttctcacaactaagacaggaaggggcacgcctcaatggatggcaccggaagttcttcgtaatgaaccctctgatgagaaatctgatgtttatggctttggagtaatattatgggaaattgtaactgaaaagataccttgggataatctcaactccatgcagcttgaaatggtagtaaagcctaatgaatggaaatccactgcagagtgtggttttatcttggtgattggagctgtaggattcatgaatcaacggctagaaattccaaaaaatgttgatccacggtgggcttctataattgagagctgctggcatagcgatccagcttgtcggccaacgttcccagaactgcttgaaaggcttagagatctgcaaaaacagtatgccattcagttccaggcagcccgatccactgccaaggaaagcacccaaaaggagtcctag

SEQ ID NO: 57090 - DNA, 601 bp, Glycine max
  Peptide Sequence Number=SeqID_173868
atgggaaaattaaaaagctatatttcagtacttgctgtgacatttgtattggtgataggagtagctgaatgcagaaaaataaaagaaaatgagttagttgacagttttggaggaggtggattaggtggtggtggcggtggaggttttggtggaggagctggtgcaggagaagggattggaggcggacatggtggcggcattggaggaggaataggtggtgcaggtggtggtgctggtgggggttttggaggtggtaaaggtggtggtgtaggaggaggaattggtggtggtggaggcgttggaggtggtgccgggggaggcgcaggtggtggttttggaggtggtaaaggtggaggtgtaggaggaggaatcggtggtggtggaggcgctggtggaggcttcggaggtggacatggtggtggagtagggggaggaattggtggcggtgccggtggaggcggaggagcgggaggaggctttggaggtggagcaggtggaggagctggtggtggctttggaggtggtgcaggtggaggagctggtggtggctttggaggtggtgcaggtgggggtgctggtggtggtttcggtggtggcgggg

SEQ ID NO: 57091 - DNA, 2079 bp, Glycine max
  Peptide Sequence Number=SeqID_173869
atggccactggacaactcttctcccgtactacacaagctttgttttacaactacaagcaacttcccatccagcggatgcttgactttgactttctttgtggtagagaaacaccgtctgttgctggaataattaatcctggttctgagggatttcaaaagctcttttttggtcaggtggaaattgccatcccagttcatgctgatattgaagcagcttgtgctgcacaccccactgctgatgtgttcatcaattttgcatcatttagaagtgcagctgcatcatccatggctgctttgaagcagccaacaattagagttgttgctattattgctgaaggtgtaccagagtcagacactaagcaattgatagcgtatgctcgagcaaacaataaggttgttattggcccagccactgttggaggaattcaagctggtgcttttaagataggtgacacagctggaacaattgacaacataattcattgcaagctctacaggcctggatctgttggatttgtttctaaatctggtgggatgtccaatgaattatacaacactattgcccgtgtaactgatggaatttatgaaggaattgccattggtggagatgttttcccaggctccacactttctgaccatgttttgcggtttaacaacataccacagagccaacatgagactaaagtaggtgtagcggagatgaggatgttgcggtggatgtgtggtaagactcgacaggataaaattagaaacggagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaagaagaatctcgaacttaatgatttggatagaagtatggttaaaatgatggttgtacttggggaacttggtgggcgtgatgagtattctcttgtggaagccctaaaacaagggaaagtgactaaaccagtggttgcttgggttagcggaacctgtgcacgactcttcaaatctgaagtacaatttggtcatgctggagctaaaagtggtggtgagatggagtctgctcaagcaaagaatcaggcactaaaagaagctggagctgttgttcccacttcatttgaagcttttgaagatgcaataaaggaaacatttcacaaattggttgaagaagggaacgtcacacctattaaagagtttactcctccaccaatccctgaggaccttaacacagcaattaggagtggaaaagtgcgtgctccaactcacattatttccaccatctctgatgacagaggtgaggagccatgctatgctggtgtaccaatgtctaccattattgaaaatggttatggtgtgggtgatatatgtatcatgctatgtgctgaccatggtccttgtgtctctggtgctcacaattctatagtaacagcaagggctgggaaggaccttgtctcctgtcttgtttcaggtttgcttacaattggtcctcgatttgggggtgccattgatgatgctgctcgttatttcaaggatgcttatgacaggagtcttacgccttatgaatttgttgaaagtatgaagaataagggcatccgtgttccaggaatagggcacagaatcaagaatagggataacaaagataagagagtcgagctgctacagaagtttgcacgcacgcattttccttctgtgaaatacatggagtatgctgttgaagttgaaaactacaccctcaccaaggcaaataacctagttctaaacgtagatggtgcaatcgggtcacttttcttggatcttcttgctggtagcggaatgttcaccaaacaagaggttgatgaaattgtggagattggctatctgaatgggctttttgttttggcacgctccattggtctgatagggcatacctttgaccagaagagattgaaacaaccactctaccgccacccatgggaggatgttctttacacaaagtga

SEQ ID NO: 57092 - DNA, 327 bp, Glycine max
  Peptide Sequence Number=SeqID_173870
atgaactccctcttcacgatcgccgtcttcgtgggcctctccctcaccatcctgggccaatgcaacctcgagaaccgctctttctgcgacaccgatgtcgacgtacccaagaaggtcatcgtcttagaagtggtattgtttagcttcttcctcttctcatcgctggtggcacaggggctgaagctgacgctgaatctgctccacagcaaggaagtcgacaaggccttccaggcccacatcaacctcaaggccctaaggcttgcatggtgggctccgccattggctccgtcatgggctgcctcttttctctccatggcgctgaattaa

SEQ ID NO: 57093 - DNA, 543 bp, Glycine max
  Peptide Sequence Number=SeqID_173871
atgggcactccgctgaacctcacatccaacatcttcttcttcatcttcaccttgaccatcctctatgtggcctacaccttccccaggctccaaccaaaccaaaccaacctcgtattctacgtccacgaccacttcaccggcgaacactccaccgccgccacggttgccggaaaaagtggacccgcctccaacatcctgcacttcggcaccgtggcaatcgtagacgacccagtaacagtgggacccagcgatgactcagcgctcattggtagggcccagggcatgtacgtaaattcgcagcttgatggcaaaggcctgtacatggttttctccgtgatcttcaccgacggggaattcaaaggaagcagcttggaaattcagggatctgatatcttcacagtgaaagaacgggaatttggggttgtgtctggaacggggtatttcaggtttgtgaaggggtacgggattatggaaacggtgtttatggatattgctaatcttagggctacacttaaactcaatgtaacagtcaagcattattag

SEQ ID NO: 57094 - DNA, 2007 bp, Glycine max
  Peptide Sequence Number=SeqID_173872
atgaacgccctcccttcctcttcctcttccaccttcactttcttaactcagtccaaaaaccccaactaccacttcaagttcacacacaaagtacccattttacccctacactcgccttctccatgttgctccctgagtgactcgtcctcctcgtcgaccacggtgctggacaaaaatgccctttcacccgaacagaattctcgcattgcaggttcgccagaagactcgagctccaaggaaaacctcgtggttcgccggccggtgacggatttttccggcgaagactccggcaaggaggaggaggaggaggaagaagaagaagatgacccgaaggcttcggtgatcgacgagggtctcgcgagattcgcgaagaagatgccgatgtttgagccggagaggatggaatccaaagagaggccactcgcaattaatttggacttggcgttatacagggcgaagcttttggctagaagaacatttcagtatgatgaagcagagtcactacttaaaaagtgtataagcttttggcctgaagatggtcgaccttacgtggtacttggaaagattttgagcaagcaatccaaaacaagtgaagccagagagatatacgagaagggttgccaggctactcagggtgaaaatgcctacatttggcagtgctgggctgttctagaaatgcaaatgggaaatatcaggagagcaaaagagttgtttgatgctgccacggttgctgataagaggcatgttgctgcttggcatggatgggcaaatctagaattaaagcaaggaaatctaaagaaggcaaggattctacttggtaaaggtcttcaatattgtggacagaatgagtacatataccaaacacttgcacggcttgaagctagagcaaatagatatcagcaggctcgatacttattcaatcaggccactaagtgtaatcctaatagttgtgctagttggcttagttgggcacaaatggaggtggaacaggaaaactaccatgctgctaggaaattgtttgagaaagcagtacaggctagtcctaaaaataggtatgcttggcatgtatggggtgtttttgaagctaacatgggcaacattgacatgggaagaaaacttttgaagataggacataatctaaatccaagggatgctgttctacttcaatctcttgctttattagaataccaatactcaactgcaaacgttgctcgggttttgttcaggagagcatctgaattgaatccaaggcaccaacctgcttggggttggatggaatggaaggaacggaacttgaataaagccagaaaattataccaaaaaactttatcgattgatcaaaacagtgaaactgctgccagatgtctccaggcttggggtgttctggagcatagggttggcaatctttcagctgctcgtagattatttaaatcatcgttgaatataaattctcagagttacgtgacatggatgacttgggcatccatggaggaagatcaaggaaattctgttcgtgctgaagagattcgtaacctctatttccaacagcggaccgaagttgtagatgacgcttcatgggttatgggattcctaggtatttttgacccggccattgatagtttaaagagaatcctcaagctgaacccaaattcgtacaacatgccactggattctttgaggaacattgcgggaacaaataaaaacagagttgattcttctagtgacgatgaggatgatgatgatgcaaatgggaaaaatgacttcgatttggatgctttcattaagcaaaagctaaccttagatttgtccaatctagaaattcagttggaaacaccaaaattttattctgtgaagagaaagatagtgtcacttgagaatagtgttatcctttcttcaagatccatctggttcgattgtgtatccaagaatgtaatgagagctatgcagttcactggcacaaagaagaagaaaaagaatgaaggagcaaggcagttccagtgttgctga

SEQ ID NO: 57095 - DNA, 1359 bp, Glycine max
  Peptide Sequence Number=SeqID_173873
actttagcacggctgtcggagaatttcatttggccaggactcagggctgatgttgtcacctatgtcaccaattgtagggaatgtcaggtcacaaaatatgaaacgaaacgcattgcggggttgctatgccctctcccagtaccattcagaccatgggaggatctttctattgactttgttgttggtctacccccctttcaaggcaaaacggtgctcctggtgatcgttgaccgtttttcaaaggggatccatttgggcattctgcctcaggcccataccgctcacatggtagcacagctcttcattaacattgttgtcaagcttcatggtatccccagaagcctagtatctgatcgtgatccattgttcattagtgggttttggcaagagctcttcaagcttagtggcactcatcttcgaatgagttctgcctaccatccacagagtgatggacagacagaagtcatgaacagagtaattgaaggttatttacgagcttttgttcatcgtaggccaacatcgtgggggaagttcttaccctgggtagaactatctcataatacttcatggaatagcagcacaggctcaaccccttatgagataacatatggacgcaagcctttttcttttccagattatattgcaagatcctctaaaattgatgcagtagatgatcttctcttgtctcgtgatgaagtgttcactactattcgccggaaattactcaaggcacaggtttccatgaagaaaactgcggatgccaaacggagagaggttaattatgagcccggcagttgggtattattgaagcttcgtccttatcgacaaagctcagtgaagggtgctcaggcagtgactggcaaattgtccaagcgcttctatggaccgtttcagatcatagaacgtgtgggtaaggtagcctatcgtttgaagcttcttgatggggctcgtatccatccggtatttcactgttcccttttgaagccattccacggagaccccattcttgattcacccaattcactgccgacacgctttattaacggtcaaccgatgcttacaccgcttgccattcttgattatcgacgacataaggagagggacacgtgggaagtattggtccagtggcatggactttcccctgatgaatcctcttgggaggactgggaacagcttaagcaggatcatcaccttgaggacaaggtgattctccaagggccgaaggaagttgatagcagtatattaacagatgtagcatcagaagggcaaattggggaatcaatcaacaaggaaggtgtgcaattagcaaaagcaaagagaaaggttaccaggcccgcatatctcaaggattatgcctga

SEQ ID NO: 57096 - DNA, 671 bp, Glycine max
  Peptide Sequence Number=SeqID_173874
atgcctgctcctgatgaatcctcttcttcctatgacaaacttgaggacgttctcagccgtttaaccaagcaacagctctatttgggggaatcagttaacgcgatgaccctcaagattgaggaacttcttcatcgtgtgtccccgattgtcccaccttctcagcccactccgactccattaccacatcctcaacctgcaactccaattcatcgtttaaaattggaggttccccgatttgatgggtcagaaccaatgggatggatttataaaataaaccaattttttgactaccataataccccagaggcagataaacttaccgtggcgtcttttcacatggagggtcgggcccttgcatggtttcagtggatgaacaccactcaccagttcccttcgtggcctgcgttcttggaggctctgcgtacacgttttgctccttcccagttcgaggacccctcgggggctttgtgcaaactcactcagacgggcaccgtggcccaatacttggctgatttcgaggacttagccaatcggaccattggccttcccactccgttcctcctgagttgctttatctccggcctcacgccggagattcgccgggaagtgcaagcgcaccaacctgctaccctcgtgcaagccgctggtctcgcacggttgcaggaggagaa

SEQ ID NO: 57097 - DNA, 1008 bp, Glycine max
  Peptide Sequence Number=SeqID_173875
atggatagaaccagaggattggattggactttaggcaaggttataggaagaaccttagggagagaagttagtggtgatgcagatgaatcccctcggcggcgaagacccacaacatctgcacataggcaacgggaagttgcatcttttgttgaggatgttgagcatgtggatcatgtagttgacgaggtccataaacagcttgaaaaggcaactgctgaagatgtagatgctgatgcccaggattttccagacaggccccacgatacatcaattttgatggactatattcatcatgtggcagtcacagtttggaatagagaggaacgtcctgagttgaagttgtcatcccatggaaggaaggaagagaaatttggtagacctgtttcagatattgaagaggtcactatcaccatggatgatgtagcattgttgctacatctgtccattacatgtgccttccatagctttaaggctcttcatgtggacgaagtcgtggacctgttagttgacttgcttgaatttagtttagaagaagcaagagatgagacattgcaatgccatgaggcacatgttcggctatcctggctgcgagacatttatcgtagcaaatgtgacgcagcactatggactgtagcagctcaagcatatcttttgcatctgataggttgcacactctttgctaacaagagtgccacacacgtgcatatgtattggatctacgagcattttcctactgtttctttttctattgctgttgaagattatcatgagaggaaactatgtgcttaccattggaatccgacacaaccttgggatcctcctaaacatccacatgtggtgtacaatgaaacatttattgaactagatcctcctaagcagctgatcgctatggcagaaccacctgcaactgcatcctctaatgtaggcattcctcgacatgcagtggaggcttatgaagcgatagctgaaaggttagaatgcttgttcaacttgagggtagtcccttaa

SEQ ID NO: 57098 - DNA, 1203 bp, Glycine max
  Peptide Sequence Number=SeqID_173876
atggttgacactttcagtatagagagcgggcttcttataagagagtttgatgaagatagagatgttaaggtggtggggaagcttgagaggaactgtgagattgagactaaaaagggggtctccattttcaccaacatgatggatgaccctttatctaggattaggttctatccccttcatgttatgttggtggctgagctgcttgaaagcaaggagcttgtcggtgtggttcgagggtgcattaagagtatgcgaactccttctgaatcattgctgaagataggttgcatattaggccttagggtctctcctacgcacaggagaaagggggttggactaaaacttgtcaactcagtagaagaatggatgctgagaaatggggctgaatatgcattcctagcaacagaaaagaacaataatgcctctataaacctatttaccaacaaatgcaaatatatgagcctcagctcacttgtcatatttgtccatccaataattagtttccctgcaaagcacatttccaaggatataaaaattgagaaggtgaacatggaccaggcaatttccttatacagaagaaccctgagggccaaagagttgtacccattagacatggattctattttgaaggagaagctcagcttgggcacctgggtgagctattacaaagatgaaggctgcaggctcaacttgcagaggatggtagagagtgaagacataattaccaatgaaatcacaagctcatggatcatctttagcatatggaacacttatgaggcttataagcttcaacttaaaaagtctcagacgactcttaggcttcttcacacaacattaaatcatgcaagagacaaaatctttccttgtctgagaatgtcggtgagtgaatcactctgcacaccctttggatttctcttcctctatgggctccatggagagggagagaaccttggggagctaatggaatccatatggaggttcacatcaaggttgggagaaagcttgaaggactgcagagtggttataactgagttagggtttggggatccacttgtaaaccatgtccctcaaacagcttctatgtcatgcttcgatgatatctggtacaccaaaagaatttcaagccatggtgatgaaaaggatgatgaactgctgatgaagagacaaatcgggaacgtgttcgttgaccctagagatttttag

SEQ ID NO: 57099 - DNA, 108 bp, Glycine max
  Peptide Sequence Number=SeqID_173877
atggctagactgaaatggggttttcccgtggacaaaggtgtaaggaaaacattcaagaaggtgctaatcgcagtccctaacaaagaagacatctgtacacctacgtga

SEQ ID NO: 57100 - DNA, 1539 bp, Glycine max
  Peptide Sequence Number=SeqID_173878
atggtggaaaatagactcaggtggtttgggcatgtagagagaagaccggtagactctgtagtgaggagagtagaccagatggagagaaggcaaacaattcgaggcagaggaagacccaaaaagactataagagaggttatcaagaaggatctcgaacttaatgatttggatagaatttttgctacacctcaatattgtttactacttcaggatttttcttccaaattcattggcgaaggcaaagttgagatcgtaaatcatagtgcagacacggagaaactccctatgccacatatatcagaacatgcaagttggtctggatgcttttatttccggatcatccaatcagcccttgctgccataggagctccagaggacctcgttgaggtgataacagggtacggccatttgtcttaccattcctttttcctttttgttctatggttgtgtttatcatctatggcattgattgagccttcttccaggtttgctgaaacaggagaagcattggtatcttctgttgataaagtcatatttgttggatcgcctggtgttggtaagatgataatgaataatgcttctaacacacttataccagtgacactggagcttggtggcaaagatgcatttattgtttgtgaagacgtagatctggaccatgttgcacaaattgctgtcagggctgtgcttcagtcaagtggacagaactgtgctggggcagagcgattttatgtccatagggaaatctattcttcttttgttagcaaagttaccaaaattgtgaagtctgttacagctggcccaccacttgttggaaagtatgatatgggagctttatgcatgcatgagcattctgaaaagcttgaaggccttgtaaatgatgctttagacaaaggagctgaaattgttgcccgtgggaatcttggacatataggcgaagacgcagttgatcaatatttcccccctactgtgattgtgaatgtgaaccacacaatgagattgatgcaagaagaggcatttggaccaatcatgccaataatgaaattcagctctgatgaggaggttgtcaggcttgcaaatgactcaaaatatgggctcggctgtgctgttttctcaggcaatcagagccgtgccagagagatagcttcacagatacatgctggggtagctgcagttaatgattttgcatcaacatacatgtgtcagtccctaccatttgggggtgtgaaacatagtggatttggacgatttggtggtgtagaaggtttgcgagcttgctgtcttgttaaagcagttgttgaagatcgatggtggccatttgtcaaaaccaagatacctaagcctattcagaaacttcaatgggcttcttgtctgctacagtatcctgttgcagagaatggattcgaatttcaggagtcacttgttgaagcgctttatggtctcggcatatgggaccgtttgcgagcattagtaaacgttttaaaaatgcttactgagcaaaatcctggtggcagtagcaataagagaagaaatgactga

SEQ ID NO: 57101 - DNA, 1980 bp, Glycine max
  Peptide Sequence Number=SeqID_173879
atggagcatcgcgattactacgcctgcaatacaaaggtaggttccgccatggatgtagaccattgccaagaagatcaacaaaaggagaaggaagaagaacaagaagaagatcctttcctcaaattcgtggattacgcaagatccgagctattatcgctggaagacgatcaaaacggagacggcgagggttccgatggacttggatggagttggatcgtgtctcgtattctcaagacttgcgttgcttattcaagcggcgtcactcccgcgatcttgctctctgaactctctcaggcgtggagtgagcaacgcagggttggggctccgaagaagaggctcgaattaattagccacctcaagaagaattatcggaggacaaagcttccaagcactgtcaccattgattccatatacgagaagaatttcctgtccttgaacagtgttctagaagctgttattatcgatgcatttgtgcttccaggcacaaacatccacatgcttacattaggggattattggagttccaatatcatagatgtgtatctacatcgcagattctatgacttggcaggcctgcagaatggaattctgaagcgagggagagagattttccttactggttgctaccttcgaacttccactggaggttctggacatccacgtcttttgccaacagagtatcttgtgattctattagatgagaatcaggatgatgatgcaatgctactaggagctcagttttgttcagactctttctcttcaatttctcttgatgcggtgaacggaggggcttcgtgttcactttatgcccggattgaaaagattgaatcttcggaaattcaaaggaagtttgaaaccctacaaagaaaacaggttactcttgttgatggtgatggagtcaaattaatgtttttcttgtggggtgagcagattctccttgccaatcttttcagagtgggaagcatgcttgcactggacaaaccatacgtcaatagttcagtggactgtgatactgagacatgtaaagacttgtgtcttgaatacggaagtgaaacacaactatatttggtgccttatattcaacatgaagaacaggtgtgtgtaacattgactccaaatcaccgtcatggttcacggcccttgggttcgtataattccggtcaggatctcaagttttctcaagtgagcttgcctcgtgattctcaggggaccattgatttcagtaattatccttttcggtcatttgtggtcgatcttcgtaacaagatgaatggcatcagtctctatggtgttgttacagatattatcaaagaaaatgaccaacaaactgttttctctttaagaattgcagatactagcggggaaatttggacaaagcttcattttgcgagattttggtcattgggaagagttagtttcggtcacactgtatacgtatctggcatgacatgtacgatgtcaaaacaaaaatgctgtttaccagcattgatcaattcatcttgccttcataagctatcgcgactctctgatatttctgcccagactagctatgcgcaagtatgtcgagtctggctcgatccatctgagtatttttacgttaatacaatattttcacattctctctgtggtcattttgtcaagaggtctgatagattggtggaatgtagcttttgtcgtacaatttatgatgctagaatagtacgcacgtttcatctgaaaattactcttgcggataaggatacgggtacgaaagttttagcatggtgtacaggtcaaactgctatggatttgttgcaaatatctcctgaggagtttaatgaacttcccgaggatgagcaagtaatgtatccgtcgtcgttagaaaatgaaaggtttatggttgcattggtaaactgtaagcgaaatggttgtgtgatagatggcctctcgccagacgattcaatttcgtgggaaatcactcgggcatacaagtgtgaataa

SEQ ID NO: 57102 - DNA, 255 bp, Glycine max
  Peptide Sequence Number=SeqID_173880
atgggggaggcaaaggttggaagttacatggaagttactaaaacttccatcaacggttggaagttacatggaaccttaggttaccacggttgttctgaaagttcacatgcattgggaagcttgcgcccaagaaatcaagagacgcatcgagaaattgaaaggggtagaatcagcggaaccagatctaaagaaagtcgggaggagatgagtcctgatactcccaattttttctcctgtcaccttacacctgactaa

SEQ ID NO: 57103 - DNA, 375 bp, Glycine max
  Peptide Sequence Number=SeqID_173881
atggatgccataacgaaatgcgcttggctcaaggaagctcggcttagcgcgcggctatcaacaaaagatttgactaagttacctgggcttagtgattcagcctcacttagccataggcatctcagcaagaggatgagtgttcatcctcaaaaaatgaactctcttagcgcgtttgataatgcaaaaagaaagcatagatgcaaaatgtgcaaaattttggagagagagaatgcagagaagaagcttgcgaaatctggcaattgtgagtgtaactgccgttacacttacttaagtagttttcgacactgtcgcttagcggaccgccgtgctaagcgagccagagagatgtttggtttctcactaaagctcgcttag

SEQ ID NO: 57104 - DNA, 252 bp, Glycine max
  Peptide Sequence Number=SeqID_173882
atggcggagtttttaatgattgttaaagaaaagcgagacatgctcaaattcttgaaaatggacgagttgaaactaagtgtttggccaagcatcaaggaagggctcataagttggctattgagcctggcattgatccatgggttgaactggctttactattccatagccatgaattacaggaagattgaacttgaggagaagacattgcttaatcttcacaagaagaaatggactgatggtttgacactttaa

SEQ ID NO: 57105 - DNA, 672 bp, Glycine max
  Peptide Sequence Number=SeqID_173883
atgaggctgaagttgaaaatggacgagttgaaactaagtgtttggccaagcatcaaggaagggctcataagttggctattgagcctgtttgatgcttttcgattgatcaatccacaaacaatgatgcttggtcaaggaccaaggcagacaacatccaatttgggacatatgagtaaaccatccattcaagcattgatccatgggttgaattggctttactattccatagccatgaattacaggaagaatgaacttgaggagaagacgttgtttaatcttcacaagaagaaatggactgatggtttgacactttggcagtttgatacacattccaaaactaatgaacagactgtacagttttcagatttggaaaatggcctaatatctttagtagattacatattgatagagtgtcaagctgctaaacgacaaaaattagaaggcggcagcttgcacaaggttggtgatgtgaagcaacaacttaattttgtccataaggctcctaagaagtggaggtttgcatttgtgttacatggtcatcctgaatacctacaagattcagattttgtttctgaacggtttcagagaagggatatatatggtgcttgggagcaatatcttggactagaacatgccgatagtgctccaaaaaggtcctatgtagtcaactag

SEQ ID NO: 57106 - DNA, 387 bp, Glycine max
  Peptide Sequence Number=SeqID_173884
atgtttccgatcagaaccctaggaagatcgaattggccacactctgagggttccgattactccacaatcaagctcgaatgtgagcatgcactcaccatgctccgctgcgggaaccacaccaagggaatgaagcagttgaaggagatttgcgccagagaggagggcttgcctcacaccgtgttcatcaaccgagtccacagcctaatgtgcttcaagacggcgatggttgttgctctttcgaagaacttgtttccccaggacgcaaatgaagaagagcatggcggagtcaaagatatgataaggttggcttacttgaatgagctggaggtgttgtacaatctccggagaagatatgcgctgaacgatatttatgtgagtgtttattga

SEQ ID NO: 57107 - DNA, 411 bp, Glycine max
  Peptide Sequence Number=SeqID_173885
atgcaagtcatgaaatctgccactcaagtggaaacaatacaaccgtcaccaccatcactgtcatcatcattatcgcttgggcttaacaagatgagaccctacgagacggtggaccacctggtgtcgtgcaacgctgtggtggtgttcagcatgagcgactgctgcatgtccaccgtggtcaagcacctcctcttcagtctgggcgttagccctaccgtggtggagctcaacgagcaggcagatggccccgacatccgatccgtcctctaccagcttgccaggtcccaccagcccatccccgccgtcttcatcggcggcaagtttcttggtggggtgcaaaccctcatggccagccacattaacggcaccctagttcctctcctcaaagaagctggggctctgtggctctaa

SEQ ID NO: 57108 - DNA, 387 bp, Glycine max
  Peptide Sequence Number=SeqID_173886
atggctgcaagtactatcatcacactcaagttctcattcctcttgagtctccttctctcagtttcactcttgggtggtgtaaggtcatcacatagccaccatgttggagaagaacgattcctccaacatgcaatcgcatcgagtgccccacccatgatcagcaaggcagtttggtggacacgtaaacgattcaaatgttgggtggaagccgctgcgttgcgagctagtattgctggcacagaatggtctagtgccattgacaaaagccacagagctggtcatgcttctgtttacaccgtggcacaatacaatgacccttttgaatatgagaatgtgaatgagatatggttcttgtttgaaatggaaagtgaacggcatgcaatgtga

SEQ ID NO: 57109 - DNA, 303 bp, Glycine max
  Peptide Sequence Number=SeqID_173887
atggtaattattagagtggggaacaactggcctgggagtagtgtggttagggtaatgcctcgggcccatgggcctagccaagatgctgcgaatggacaggagaaaatagatagaggggttctcggggaggtggaggacgccctcgacgaggcagcaattcttgccgaggacctcgagggcaaaatcactagcggttgcggcggcaaaatcaagcgaaatatttgttgtggcaatcttcagaggtcacagcagcagactgaaggggatgatagtgagggcgcaagagtaaggacgcgagattag

SEQ ID NO: 57110 - DNA, 225 bp, Glycine max
  Peptide Sequence Number=SeqID_173888
atgttcaaggataaaacctatttgataagtgtgcgtatggatgaaagtccaaagggtacccagctggaattttttttgtggagcctttggatgcattacatgcagcaattcttcaaggtgctagctagcaaaggaactgagattgttattccaactgatgttcttgcttggggagaatttggatttgttgaagggcttatgaagtggtgttatagagtgatataa

SEQ ID NO: 57111 - DNA, 177 bp, Glycine max
  Peptide Sequence Number=SeqID_173889
atgcatagtctaactgtgtttgcttttaaggttacaagaagtgtcgaaactggtgatggagaactcagtcctcaagaagataagacaattaaagcaatcgttgatgcaagggtcttgctaggagtcttggagctgctgttatctacaaccaagataagccatgggatgaccatgtga

SEQ ID NO: 57112 - DNA, 207 bp, Glycine max
  Peptide Sequence Number=SeqID_173890
atggcacaaattggacttaacatgataataaaaattgtacaggaccccaaaatcataggtccagaccaaaggaaacttagcgtcttctttcacgccgttaaggtagcaatgagaggaacaatacaagtttattattctcattttcacaagaaaaattttcgatcacttgatacatcagctatccgttttatatgtgtgtgtttgtga

SEQ ID NO: 57113 - DNA, 522 bp, Glycine max
  Peptide Sequence Number=SeqID_173891
atgcaattcaagggtacattggattcaacgcaacaaggatttaaaagagctgagactcagattggtaagttggtggacgacatgattaaagttatggccagaagagaagaagagtatgcagagattgaaacacatcaagaaagcattcttcaagttaacacaatacatcatcaattgatcaccaaagaagaaacggatgaagtctccattattccagaatatccctatatagcaactactggatatgttgtaggcaaagataaaggtcagttggaactcagtgtagaggatcagaaaatctcctttgacctctttgaagcaatgaagcacacagatatcagtgatgcctgttttgaagaagaagaggtggagcaggagatagaattatcagcttcaaccatggtactgcaattccctttggaaaaagatcctaattatgtgatagactgcctagtttgtgatgaagagcttgatgatccaaaagacaaccctattggtcatgtggttcttgaagaattataa

SEQ ID NO: 57114 - DNA, 336 bp, Glycine max
  Peptide Sequence Number=SeqID_173892
atggttagagaaaaaaaattcattaaccgttggattatcgtgaagtttttatatgaggttcgagatttaattccgcactgtcgcaccgttgggatctgtaaactaatatctgtggagggagaaaatggaatcgcacgaagacagtggaatgaaggcttcaatcccttctctttctctctaacgtttgggaaccctaacagagcaactggaggaggagctcaagagagcaccagcaacatcacaattgataatggagaacacttgagtgactacatcaaagtaagggatgagtttatcgcaattggggttagaatgaacatgtgtagggatccttag

SEQ ID NO: 57115 - DNA, 858 bp, Glycine max
  Peptide Sequence Number=SeqID_173893
atggtattggaggagggggaatttttacccacctactctagattttgcaggttgaggactaatcctcaggagattgaagctaggctctgtattccccgcaaggggtttgttttgaatgctaagggccagccatggaagcttctcataaatgatctgacgacactggcccaaacatggagtgtcttttcttactccaacctggctcccacatcccacacctcagatctgaatatggatagagctaggttggtctatggcttggtgactaacatggacataaacatcggagcccttatctcaggtcagatctcttctattgctcagagtagctcctctaggctcggatttccagccttgatcactgccctatgcagagctagaggagttacctctaacagtctgacttatgagagcctgagcccgaccattaacttggcctacattaagaaaaaatgttggaatgtggatgatctaacaattaacttcagagggcgcgaggaaggcaaggctccttccacttctgctactcctacaccagctcctccaggctcatctactcaggactctcagtgctttgagtcaatgcttcagagtcttcatcaaggacaaattttattaatgcattgcttgcaggtatcttggccaggaactctgccttcttttgtgagggaaggtggaggtcccagtgctcagatacctcagcagcagccagcagacccgtctactccagtacttgagattccaaaggaccctgccacaccagtcctgggactgactaccactcttccagccactcctatgctacatttgacagatgaggagggcactcaggatcaggagacccagcaggatgattag

SEQ ID NO: 57116 - DNA, 423 bp, Glycine max
  Peptide Sequence Number=SeqID_173894
atgggcggcgagctcggcgtggccgataatgtcgatttgcagcagattaagcatccacgggccgcacagaatgcccgcgaacagatggcggctggcgaggcgaatcagcagcgcaagcacagcggcagccgtcgcaaggctgaccacgccattccagccgaaatgggccagcgccaggctgccgagcgccgcgccggtcgccataccgataaacaccacggtgaacatcagcgcattgaggcggctgcgcgcttccggcgccaggctgtagaccagcgtctgatgcgccaccagcgtggcctgcacgccaaggtcaaagccgatggtgctgaggataatcaggccaagctgggccggcaccgacagcaccggcagcaggaacatcaggcaaacgacaccatcaccagcgtggcgccatactgg

SEQ ID NO: 57117 - DNA, 915 bp, Glycine max
  Peptide Sequence Number=SeqID_173895
atgaacttcctggcctggaccgccctcactggcggtctgctacttttgatgtcactggcttccggctggattcaccgggggccggtgacgtcgtttggtctctacctgttcgcgggcattctgtgcggcccgtggatgcttaatctgctgcaaatcgacattatcggccacgccgagctcgccgcccatatcaccgaaatcaccatggccgcctcgttgtttatcaccgggctcaagctgcgtctgccgatgagcgcgcacgcgtggcgtgtcgggctgcggctggcattcccggcgatgttgctgaccgtcggcggcatggcctgtctgattcactggattaccggttttggctggccgctgtcgctggcgtttggtgccattgttgccccgactgacccggtgcttgccagcctgatctccgttaacgatgcgcgcgatgacgatgcgctgcgcgtggcgctctccagcgaggccggcatgaacgacggttcggcgctgccgctgctgatgctggcgctgctgctgatgcatccgggcgccttcagtctggagctgctgggtggctgggcagcgcgcgatgtggtgtgggcgattggcggcgggctggcgattggttacctgctcggccggctgatcggccagctggcgacccatctgcgcagcgcgcatcacgacgtggcgcccaatgatttcctcgcgctggcgctgatcgccctgagctacgcggcggcgcagtcggtggatgcgtctggcttcctcgctacttttgcagcaggcgtcggcttacgtcgcgccgagctgcgcgtgactaaacgctttccactggaagatttaccggaagagaagcgctacctgccggcagaggtgctggtcaatcctaaccagcgtctgaagcagcagggcggcagcccg

SEQ ID NO: 57118 - DNA, 252 bp, Glycine max
  Peptide Sequence Number=SeqID_173896
atgacagaaagcaggttttggggagagagaaaggtgccgaaaggaaaaaatgaaaaggggaatcggattggtggaaaagatggaggtggtggagatgggaataatgggatattaggcaaagttggaggtggcggaggagatgggaaaaataggatattaggcaaagatgctgggattgtagggaatataggccaagatggcaattgtggccaaggtggcaatgtagaccaagatgtcactgttgtttgctag

SEQ ID NO: 57119 - DNA, 225 bp, Glycine max
  Peptide Sequence Number=SeqID_173897
atgaataaggaaaggaagaacaaaactcagatatatttctgtactgtacgtaacaaagagaaagcagaatctgctgaagcttcgttcacgcatttgactgagtggaccacaccaaagccaacgaagtcaatgatagagaaggagaaaaggaggtttcaggtgttggtgactgaggcccaaccattggaggctaaggaaggaggaatgaaggcaatgcgggcgtga

SEQ ID NO: 57120 - DNA, 291 bp, Glycine max
  Peptide Sequence Number=SeqID_173898
atggcgttttggtggccgttgctcgttttagcattcgcttacggtatttgtaggttccttctcatgctcattcctcctaaagttccttccatcgacgttgacacttccgatgtgttggacgatggaaaccaagcgcaggagaacagtttcatatatgtacctccaaggggaacatcgcagcaatcgggcaagatagttcagtgctacgaacctgcaactatgaaatatttgggatatgttcctgcattgacgcatgaggaggtcagtgagcttcagcctgtgctcttgtaa

SEQ ID NO: 57121 - DNA, 240 bp, Glycine max
  Peptide Sequence Number=SeqID_173899
atggttgatgaaaattgtaagaaaggatgggctagtagaggacgtggaaagggaagagggcgcactcaaggacgtggcctacttgctccaccatctcaatcaagcagcactatcctttgcgatgcacacactaaacccaacactaagggcccaaaaatgcctgatggtacaagaggcttcaccatgggacgtggtaagcccattagtccttcttctcaagtcacttcacctaaagagtaa

SEQ ID NO: 57122 - DNA, 1215 bp, Glycine max
  Peptide Sequence Number=SeqID_173900
atggaccatacccctgcttcagctatcacacaagcaaaaaaagatcttgtaacatcaattaaagagaagcttgaagccgtttcatctttgaaatccatcttcagagtccccgagaaactcctggaagcaaatgagaagatgtacatccctagcacagtgtcaattggtcctctccatcatggcaaggagggtctaaaatacatggaagatcgcaagtggcattacctcttcacacttctgagtcgacaaccaaatcagcttgaatcaagcttgcacgaatttgtgaatgcactaagcgatttagagaagccagcacgaaatttctatgcagaagaactcaatctcacatgcaatcaattcatggagatgatgttagttgatgggtgtttcatcattgagcttttcttgaaatattctctagagggtataaggcgccgtggggatcccacgtttacaacgccagggttactcaataggttgaggtgcgaccttatattgctagaaaaccaaataccattcctcattcttcaaaggttgtttcaaattgtgctcattccaataaaatatgaccttaccctgaccctctcagagcttgctgttcgtttcttcagaaaaatgttgccaggggataaggaaattgttaatgagaagtttagccaagagggttatcatttgcttgacttaattcgtcattgtttcctaccaacctatgcaagagtaatgtccaaaagaagtgtatctcaaggtgatcttgagactgagagtgcaacaaagctcaagaaagatggtattaagtccaagagttccaaagccaagagcctgctaaacattaaatttgcaaatggggtgcttgaagttccttccttcacaccccatcatcattttacagaaatgctgttttccaatctgatagcattggagcagcaccaaaatgatagccaaccgttcacatcttatgcctttttaatgaaagccttggtctgcaatgaaaacgatgtgaagttgttccgcaaccgagggattgtgatcatggataattacacggagaaagaagtttgtgatctgtttaagaggttgtgcgggaaagtggaatatggggaggacaagttctattttgcagggctaattgaacaaatttttgagtataaaagaaccccgagatcgtggaggaagatattgaagttcagttggcttaaaactcgtacttctacatga

SEQ ID NO: 57123 - DNA, 324 bp, Glycine max
  Peptide Sequence Number=SeqID_173901
atgcccccgactgtccctgttaatcattactccgatcccgaaggccaacacaataggatcagaatcctcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggctccctctccggaatcgaaccctaattctccgtcacccgtcaccaccatg

SEQ ID NO: 57124 - DNA, 579 bp, Glycine max
  Peptide Sequence Number=SeqID_173902
atggaggaaaaggcaaaagctgaggagaagaagataggtatgagcgagacttggttgaggaagcaccgtcttatctacgacggagccactagacaccctcttattattagcatttgcgatggcaccatcattattgcttcctttaaaacatggctcgattacttgttcgttcgggcgtttgtcccatttgcggctagtgtgctgataaaagcttggaaggaatcagattgccgtggtgacatggaagtcatattggggggcgtggcttctctggaggatgagatttcatggttcaaggcagaagccaacaagtgggcattttgggctattgaagcagtgtatcaagagagctttgcccactgcattgaagaaggctccaaaatcccaccagaactgaaggagacttgtgcaagatggggcaatgaggcctttggtaagtactgccaatctctgcagaacattgcgaatagacgcttgcaaaaggcatctgatgaagaactcaaaaaggcagaatttatgttgctaagtgttcttgagcacgaagttgagttctggaacatgagctgtggaaatgtctga

SEQ ID NO: 57125 - DNA, 363 bp, Glycine max
  Peptide Sequence Number=SeqID_173903
atggcagatcttcaagaaaaactggatgctctgaagggtcttgttggtgtgctaaataacatggatgagggtgaaactcacaacaacaatgcaacctcctcacccaataattcccatagtcctgctcctatgcctggaaggaatcgctctgttggaaaatataacaacagtggcactcagaagattaaagtttgtgactgtggcaaatttcaggaattgcgcatgtcttgttctcatgttgttactgcttgtaagcatgctcaccatgagtacaagaactacatgcatcctgtgtataagttagaaagtgcctccaatgtatatagaggattgtttagagaattgcgttacgaagcatattag

SEQ ID NO: 57126 - DNA, 336 bp, Glycine max
  Peptide Sequence Number=SeqID_173904
atgatgctaaaaacactcaatgagatttgggagtttttgcagcaagagtacaatgaaaatgaaaagggacttaacaagcattactctggtggaattagtgaatgcactacaagcacaagaacaaagaaggcttatgagacaataaggatatgtagggggagttttccaagccaagaactacaaagatgcaaacagatcaaagttcatgcaaaaggcaagagtttttccttagatctgatgaaggaggagcaagaagacaatgaagatgacaatgccgacaagaaacaggcagagaagaagccgcatgagaaaaatcttaagagtatgtttggatga

SEQ ID NO: 57127 - DNA, 276 bp, Glycine max
  Peptide Sequence Number=SeqID_173905
atgacggcgtcgctcacggagcttgacgacgatttggttcgaagcatggccataggagccgttttctccgacttcggtgggatgatacattcgattgatttccatcgaaaggatgatttacttgtcacagctagtgaggatgattcggtgcgactttatgacattgctaatgctaaagttgtttctctctgcatgtctccaatcaatgatagcttcatgtctggttctctagaccacagtgttaggatatgggatcttcgggtaaatgcttgccag

SEQ ID NO: 57128 - DNA, 324 bp, Glycine max
  Peptide Sequence Number=SeqID_173906
gctaggccttatccaagtgtggggaaggaagaccctttgaaagataaaactattctaaaagaccctggaagggatatgaggggtaagagaaaaagagatgacaccataattcaaactcctagctatagggtgcaaggtaaacgcagattcaaactcagcaacctcactctcatgtgtcgcagaagccttgcactacggaggctttgtcaacgatgcaggtcagcgacaacagtgtggaacgaggagggaaagaagccgtttgggtgcgaggctggcctcgagattgagaaaggtgttgctaggttttgtcgaggccgtgtttga

SEQ ID NO: 57129 - DNA, 303 bp, Glycine max
  Peptide Sequence Number=SeqID_173907
ggtccctttgacacctttctagttggtggtgacacagccgaagtttgtgatatcaaattcagtaatgacggcaaatcaatgcttctgactactactaataacaatatttatgttcttgatgcatatggaggagagaagcgttgtggatttagtttggaaccatctcctggtaccccaatagaggctacatttaccccagatgggaagtacatggtggcagctgatatgcacaaaaactgttacccttctaatttctcctattattattaccatgaagctgtagaggtggaattgtcttcataa

SEQ ID NO: 57130 - DNA, 351 bp, Glycine max
  Peptide Sequence Number=SeqID_173908
atgtggctacacttattttttggtcttaaccaaagagagcctggagttcgactgagagcatttggtgctttggtgatcatattttgttttatacaactaaggaaataccaagagattgccgatagtaacgttgtgtatagaaataagatacatcattctgttcaacggcgcactcgagagctggaaaatgtagctgcagatccaacacttcctcgcaccaagtctgttcgctgctctcaatgcaatcatggagaagctgtctttttcaaggcaccagtaaaaggggaagaaggcatggccctcatttttgtttgctgcaacccaacttgtggctaccgttggagagactag

SEQ ID NO: 57131 - DNA, 162 bp, Glycine max
  Peptide Sequence Number=SeqID_173909
atggggactcaagagaggacgatgctgaaactcaacatgtggaagaaagggttggctagctatctagaaagtgtgataggaaagagggagagagtggaagagaggactctgtgtgattcaagcggggaatttatagaactaaaaaagccaacaagttggtga

SEQ ID NO: 57132 - DNA, 189 bp, Glycine max
  Peptide Sequence Number=SeqID_173910
atggaggcagatcgaaagagagaaagaatgaaggagaaaatagaaatggaaagcaaaagagaagagaggaacctcgtgattgcagttgcggcaagcatagagaaccactgcctctttttggcgggcagactctctctacttaatcagaaaaataggttgggctcatcgtatcgtaagaactatacctaa

SEQ ID NO: 57133 - DNA, 459 bp, Glycine max
  Peptide Sequence Number=SeqID_173911
atggcagaatttttaggacagttgcttgggcagctccttcagtcaggtgtgggagaagaacctatggaggcaacacatccccgacactctccgaaccccggtgctgttgctcatcctcgccacagtcataaggagctgccaagagcctcgtttaacaacacaggcacacaaaacattagaggtcttataaacaacaccggttgtaccaagggtaatggtttcgtacgaggttttgccaacatgatcgatggaggtgatagcaaccgaagtgtggcaactcagcctcaatcaaatcccaacaataacatgatgaatggtactccattccctcctcttcaacctcctgcagctggccttctaaatggagacaatcaaaagctgtttggagttaccaacaacaccaacataaaattgaagggcgatggtaatggagcattcacgcttggctacttcaaatga

SEQ ID NO: 57134 - DNA, 150 bp, Glycine max
  Peptide Sequence Number=SeqID_173912
atggaattggtgttagttggagtgaaaaggcatgcaaattgcaaaggagtgccaagaagtcacattttgctaataaaggtcgaatggtgtagccttggattgactatcatggttgagtggcggccaaagaatagcagtagccaccactga

SEQ ID NO: 57135 - DNA, 204 bp, Glycine max
  Peptide Sequence Number=SeqID_173913
atgaaggtttggatgtggacaacttggatggggatactccacattgaagataaggacttggttcaagaccaagatgcaaaggacatcagtgatgcccctaataggagaatttggatgatggagatagacatgtccagtaccctggtcatcccatttcccatcatcattcagacgatataccttgacacgctgaaatcgaattag

SEQ ID NO: 57136 - DNA, 1305 bp, Glycine max
  Peptide Sequence Number=SeqID_173914
atgcagcgatcagaagagctgggcttatttgtttatgatgaagaggataatgagaacatacttttgcatcgcatcagttctgatgatatatataggaaacaagaagatacaatcatctcatggagagatccagaatatgctacagaactggcacttagctttcaagagcctagtggctgctcttacatatgggacaatatttgcaatgtccagaggaatatgcattttaatacattaaatagtgagccatttcacagtgtaaacagtgagccaagggagttgcctgctgttgagctatcaacacttcctttgattctaaagactgtggttgacagtggctttgcagatcagttgcggcttacagaactaatattaagtgatccccctgctcttgtcatgtctaatgcagctgaaatggcacttttctgcttgtacattttatatatgcatcctttttcaccggtgtttatattgcagcaagagttttttcggaagctgatggaagtattcagaatgtgtgaagacttggaaaatattgatggccttcacatgattttcaaaatagtcaaagggattgttctgctaaatagtccagcgatttttgagagaatttttagtgatgactttatagtggacattattggtgccttcgagtatgatccagaggttccttgtgttcaacatcatcgtaaattcttaaaggagcatgttgtttttaaggaggcgatacctataaaagatcccgttgtgttgtcaaagatacatcagacatatagagttggttttttgaaggatgttgttctggcgagagtcttggatgagggtattggtgcaaatcttaactccataatacattcaaacaatgcccatgttgtctctttgttgaaggatgacagtacatttatccaggagttgtttgctaggctaaaatcgcccaccacctctcaagaatcaaagaagaacttggtttatttcttacacgagttttgtagtttgagcaagagcttgcagatggtccagcagcttcggctttttagggaactaatgaacgaaggcatctttgatgttgtcaccaatgttttgcaaagtcaagacaagaagcttgtgttaactggaacagatatcctcattcttttcttgaatcaagatcctaatcttctgcgatcctattttgttcgactggaaggatttgctcttctaggacttttgtctgtgatagtaaaactgatgtattacttcaagaatgaatgcaaggcatggtatagtgttgcttatggttcagagccaaaggaaaggaaagattga

SEQ ID NO: 57137 - DNA, 2205 bp, Glycine max
  Peptide Sequence Number=SeqID_173915
atgagtaacaatataaatgtcaaaagtcatgaactcagacttcatgagattaatacacttgaatgggatgacctagtggacacaaatgatcataacgcctctactgtgcctaatggaggcactgttccatattttgatcaacaagatcaaattttactgaatgacagtttcggcaatgtagccaacaatctatctgcagaaattccttcttttggtaatcttactcagccaattgctgggagcaacagagttccttacaatttttctgaaagtgttactcttcagacgatggacaatcaagcaaatccacatgagcagaagaataatacagtttccttaagtggtgttgattccttggacactttggtcaatgatagattgcaaagtcaggacagctttggaatgtgggtgaaccacatcatgtctgattcaccatgttcagtagatgacccagctcttgaatcaccagtttcatccattcatgaaccatattcgtctctggtagtggatagtcaggaatcttctctgccagaacaagtatttactatcactgatgtatcccctacatgtgtatcttccaccgagaaatcaaaggtcctggtgactggattttttcttaaggactatatgcacctttcaaagtccaatctattatgtgtctgtggtgatgttagtgttcctgcagaaattgttcaggttggggtctaccgttgctgggtatcaccacactctccaggatttgtgaatctctacttgagcattgatggccataagcctattagccaagttgttaattttgaatatcgtactcctgctttgcatgatcctgcagtttcaatggaagagagtgacaattgggacgagtttcgacaacaaatgaggcttgcatatttgctctttgctaaacaattgaaccttgatgttatctccagtaaagtatcacctaatagacttaaagaggctaggcaattcgccctcaaaacatcatttatttccaatagttggcaatacttaatcaagtcaactgaagacaaccaaattccattttcacaagcaaaagatgccctgttcggaattacattgaaaaacagactaaaggaatggcttttggaaagaattgttttaggctgcaagactactgaatatgatgctcatggccaaagtgtaatccatttgtgtgcaattttgggatataattgggctgtttccttattttcatggtcaggcttgtcattggatttccgtgataggtttggatggacagctcttcattgggcagcatattgtggaagggagaaaatggttgcaactctgttgtctgctggggcgaagccaaatttggtcactgatcctactccacaaaatcctggtggatgcactgctgctgatcttgcttatatgaggggtcatgatggcttagcagcttatctttcagaaaaatctctggttcagcacttcaatgacatgagcttagctggaaatatcagtggctcactggaaactagcacgactgatccagtaaatcctgcaaaccttaccgaggaccagcagaacctgaaggatacgttgacagcttaccgaactgctgctgaggcagcttcccgcatacatgctgcatttagggaacactctctaaaactgagaactaaggcggttgcatcttccaatccagaggctcaagcacgcaaaatagttgcagcaatgaagattcagcatgcctttaggaaccacgagacaaagaaaatgatggcagctgccgctcgcattcagtgtacataccgtacatggaagattcgtaaagaatttcttaacatgcgtcgtcaggctgttaaaattcaagctgcattccggtgctttcaagttcggaagcattatcgcaaaattctttggtctgttggtgtggttgagaaagcagtgctgcgttggcgtttgaagagaaggggcttccgtggtctccaggtcaaaactgtcgatgcgggaaccggagatcaggatcagcaaagtgatgtagaggaggaattcttccggactggtaggaagcaagccgaagaacgtgttgagagatctgtagtacgtgtgcaggctatgttccgttcgaagaaagcacaagaagagtacaggaggatgaaattggcccttaatcaagcaaagctggagcgggaatacgaacaacttcttagtactgaagtggacatgcaactgtag

SEQ ID NO: 57138 - DNA, 570 bp, Glycine max
  Peptide Sequence Number=SeqID_173916
atggttgtccttgctgcttccattgtgagcaaatctggcaaagaaaagcttaatcttgaatcgcttaatgttgaatttggtgttctagtttctagacagtttgtggacatgtctcgtatcagaattgagggacttctagcagcatttcccaagttaataggcactggaaagcaacacacatatgttgagatggagaatgtgcgctatgtttaccagccaatggaagctctatacctgcttcttgtaacaaacaaacatagcaacatactggaagacttggcaactctgagacttctctccaaacttgttcccgaatattcttactcccttgatgaagaggatatttgccaaaatgcatttgagttgatttttgcatttgatgaagtcatctctcttgggcacacggaaaatgtgactgttgcacaagttaagcaatactgtgagatggaaagtcatgaagagaaactgcacaagctggttatgcagagcaaaatcaatgatactaaggatgttatgaagcggaaagctagtgagattgataaaagcaagattgaaaagaaccagaggtga

SEQ ID NO: 57139 - DNA, 234 bp, Glycine max
  Peptide Sequence Number=SeqID_173917
atggcgaataacttagcggtgcaactggttggttcagagatgcatggattccacacattgcaaggcacgtacttcactgttgatttggatgtggggagcattatggaggaagcaagaaccagatggctccgtcccaatgagattcatgccatgctctgtaattacaagtattttaccattaatgtcaagccagtgaatttgccaaaaagtaattatcatttagctgcaacttga

SEQ ID NO: 57140 - DNA, 2490 bp, Glycine max
  Peptide Sequence Number=SeqID_173918
atgaaggaaaagagagacttttctgaatttgtgtcagaattaatagttctggctgatgaggttgcctcatttgctaagaatcctgaaattgagatagtagaggatgcttttactgagtttgccatgttggttgagaaatttgctccaatcttcaatgatttgagagacaaaagcaaaattatggacaagtcagctatcagaaagtcgttggaatctcttatgaatgagcttacccgggctaaagctttgatcagaagctcctctttgaaagagcgcatcaaacgaattgaggacatagcacatgatctcggtcgatcattaggcatgctgcgtgtggcaagccttgaagtgtccatagattttagagaaaagattggtacattacaaaaaaagctgatgaatgtgagatttggtgggaatacgagtctaacttcaagttcaatatcaacatttgtcaatgaagaaaaggtgggaggggaaatagaagaggagataaataatgttactggagatgatgttttactacacctcaagaatggtgatgctgaagaatttgcagttgcactcttaaggctaaaaaagttcatcaggggtggaaaactggatagcggtttaattaacgtggaagctgctgtttccattctttttaaccgtctattttcatgtaagacaggcaatagattgacaatcattcaattgctaagaagtgttgctttgcaaaatgatgagatgaaggagaagatgacaaagaatgagttattatcagcagtggtgaaatctctaacaagagacactgaagagaggagggaatcagtgggactgttgctagaactctctgaccttcctgcagttagacggaagattggaagaattcaggggtgtattgttatgttagtttctatccttaatggagttgatcctgttgcttcacgtgatgcagcaaagttgttggatatattatcaaataatactcagaatgcacttcttatggctgaggctggttactttgggccactagtgcagtatttgaataaaggttctgacatgaccaagatcctcatggcaacaacactttctaggctggtgctcactgatcatagcaaacttacccttggacaagatggggcaattgagccccttgtgagaatgttcaattctggaaaacttgagtccaagttatcagctctaaatgcactgcaaaatctttccagcttgacagaaaatgtggaacgcttggtcaaaactggaattgtaggatctgagctacaacttcttttctcggtaacatctgtgctcatgactatacgggagcgtgcatcagttatccttgcaagaattgctgagtcagaaactgttcttgtcaataaaggtgtcgctcagcagatgctctcacttttgaatctttccagccctgtgattcaaggtcatatattagaagctctaaatagcattgcttcccatccttgtgcctccaaagtgagaagcaaaatgaaggacaaaggtgcacttcagctaattttaccccttctgaaggaaacaaaaatgaaaataaggagcaaggcattgaatttgctatatactctctccgaagatctaacagatgagttgacagcacattttgatgaaacgcatctttttgacattgttaacattgtcttatcatcaacatcagatagcgaaaaggctgctgctgttggcatactgagtaatcttcctgttagtgataaaaaagtgacagatgtactgaagagagcgaatttgttgcccgttttggtatccattatggattcaggcacgagaagtaactcaccagcaaaaagtatcttaatggagagtattgcaggcgttgcaatccggttcacaagctcctccgacaagaaattgcaacttctttcagcacaacatggggtgattcctttgcttgtaaaactgctctcaagtggttcagcaatcacaaaattcaaagccgcaaccgctcttgctcaactatcacagaattctccgtctcttaggcggtctaggaagtcgaggtggttgtgtgttgctccctcagtgaatgcatattgtgaagttcatgatggttattgctttgttagcagcacattttgtctgatcaaggcaggagctgtttctccccttatccaaatattggaagataaggattgggaagcagtggaagctgctctgaatgccctttcaactctattgcaagatgaaatctgggaaggtggtgccaattacatagccaaattgtcaggtgtagaagctattgtaaatgtattagaagcaggtgatgtgaaggttcaagaaaaagcgctatggatgttggagagaatattcaggattgaagaacacagaatgaaatatgcagaattcgcccagatggttcttattgatatggcacagaggagtgattctagattgaagtctacagttgcaaaagtcttagcagtgctggagctgctactagttcaatcaagttatttctga

SEQ ID NO: 57141 - DNA, 213 bp, Glycine max
  Peptide Sequence Number=SeqID_173919
atggatgaagatcaacaaaactggaagaaaatgtttaacataatgagtaagattaacaaaaaagcagaggaaattttcaacattgttcatgttatggatcagccttatgatgaagttagtaagttattttttgtaagatggaatgatgaactaggacatacttggcatctgttacactctagtgacaacatgcactctgttacatacaactaa

SEQ ID NO: 57142 - DNA, 177 bp, Glycine max
  Peptide Sequence Number=SeqID_173920
atggaactagacggtatggtacaataccaaaagcctctgccttcctactttgataaggaaatgatttcggctgaggaacagaggaaagatatggccaagaagaaaactgacgtggccactaccaagactcaacacactcctattgatcttgaaaaatttggagcaatagaaacataa

SEQ ID NO: 57143 - DNA, 516 bp, Glycine max
  Peptide Sequence Number=SeqID_173921
atgcctatggtgctcatgtccttcttgggtcaggtggtcatagagggagagagaagggatggttgtagtggtcaatatgatcaaatttgcaatgcacgattaccccgagcacttgatccccactctgttccatcagaagagttttccacttctttgggggttcttgctctcggatatggcaatgagattcttattgggatgcacgtccttcctcgtggaggtattttggctgaaattatatttgcatgttcacaagtggttgtggccataactctatactttgcttctgcactagaccaagcaacagtgttctatttcttgctcttcaaagagataatgttgcctccaatgtatacacaatatccagcggtggaccttctatctgatgtaagctccattggagcttgtaggcctaggatcttcttcatcaatggattcctttgcttcttggaagatgaatggcagcgaaatggagaaggaagagggaaaggagacgccacttcaaggagaagatga

SEQ ID NO: 57144 - DNA, 243 bp, Glycine max
  Peptide Sequence Number=SeqID_173922
atggatgccatggcatttgtagtctataatcctccaccctcaaaggcatatgttagacttgttgaggatattcttctatggacctataaagcccttgctcaagctctagaagacaaagattatgctaagaaggaagctaagaagtggtatttgattggggacttcttctacaaaaagctcactggatggaagccccataaaattcccactcttccaagctatcctattcctctttcctcctaa

SEQ ID NO: 57145 - DNA, 258 bp, Glycine max
  Peptide Sequence Number=SeqID_173923
atgcagaaaaaggaattagacaagcttaacttcacaaagctttggatggatggcttcccaggtattgatccctttcattatcctgtttgggacactttacccgaagaagaggaggattcttgtagaaattatggaggacaggaactagtgctcgaagaatttccagttagacaatctgtagctccaaagcaaaacaatatgatttttgagcataggccaattgaaaggaacctatatccacttggtgcctctgtctga

SEQ ID NO: 57146 - DNA, 303 bp, Glycine max
  Peptide Sequence Number=SeqID_173924
atgactaatgcaaactgtccgcaagagtcattgcattcagtctcaaacaggaatctaaggtttgacactgcacaaactcttgtgtcaaggttccttcaggtttcttcttttttcgaggatgagggtgagagccccgtcgagtctgatgaaacaaaagtccaaagttggagctgtgtgtgtgtggtttattttgaacttgtcaacaagggtccacttgcagcccagattcattttctcaagatcatttggtccagattcttgataccatacgaaaactacagttcagactttagagaaatttga

SEQ ID NO: 57147 - DNA, 251 bp, Glycine max
  Peptide Sequence Number=SeqID_173925
aacccacattgtcctgggtcgaagaaaaccctacatacactgttgctactagggtgctgaaacactcgtcgctgctcaaaggtcaaagctttttccgcgaggctccgctgacgtgcgtgtgttgttgggttctcttgatcaagagaatgaaccatgatttctgtagatggatccacaggggtcttgaaattgcttgcaattgctttaacattttactgtccaacagagggggcttgactgttgttgtttga

SEQ ID NO: 57148 - DNA, 252 bp, Glycine max
  Peptide Sequence Number=SeqID_173926
atggctggccatatgggtagaggtgtcatagaggagcaggtatggaggaagggaccttggactgctgaagaggacaggttgcttgttgagtatgtcaggttgcatggtgaaggcagatggaactctgttgctaggcttgcaacaaacaagaactctgagtacttcgacatccttaccttgacagtagcaagatcgcgacaccactccaaagagcacgacttcggctatggcggtggtgggaacaacaggtag

SEQ ID NO: 57149 - DNA, 216 bp, Glycine max
  Peptide Sequence Number=SeqID_173927
atggctgctgaaaaaggcttaaagatggttttggtcacggaaaatatgatggtggcatgttggaccagccatattggtgtgccttcgtgcttgaagtgggcccctcgcagggccatgttcgctgctgcttcaagtgttctcacattttggatacccaataatgattcaaagctggaaacccagtatggtggcacagatgctgaagctggaccttaa

SEQ ID NO: 57150 - DNA, 294 bp, Glycine max
  Peptide Sequence Number=SeqID_173928
atgactttgcagttagcagaccactccatcaccagaccgtatggagttattgaagatgttcttgtccaagacgttgagatccctcttatcttggggcgtccattcatgtcaactgctagctgtgtagtagacaaggggaagaagaagttggagatgggaattgaagatcaaaagataagatttgatctatttgatgaagagaaacaacttctagaccagaatgtctgcttgaaggtgaaggagtatggagaagagattctgaaggagggaaccaagtttgatccagacccttga

SEQ ID NO: 57151 - DNA, 408 bp, Glycine max
  Peptide Sequence Number=SeqID_173929
atggatatggatgttggagatcttatttctagacaaatatctttgatagctcagtccaactcctctcggctaggatttccagctattatcactgctctatgcatggacagaggagtcacctcagactcgttgactttcgagactctcagcctagccaataatttggcgtacatcaagaagaattgctggaacctggatgatccttcggtcagcttcccagggacctgcaaggcccgggccagaggatctgagggtccatcttcatctgctccccaggactctactgatgcaatcctccctaggaagggaccagtcactagagccatgagcaagaggctccaagaggattgggctagagttgctaaagaaggccctagggttcttataaacctcagggtagatttctga

SEQ ID NO: 57152 - DNA, 183 bp, Glycine max
  Peptide Sequence Number=SeqID_173930
atggtagaaggagatataatttacaagctcaaggttcaagtaatcaatttcagctcaatatgggtgcaaaggataaatcatttcattcgcaaggaaagtataaatcttgtcaccggtcctgtggtgggtcctgatccatggcatcctcctcatcagtcagattcagcacaagcgtgcctactg

SEQ ID NO: 57153 - DNA, 348 bp, Glycine max
  Peptide Sequence Number=SeqID_173931
atggcagaatttcagtcttccgataactctgctttggatacgtacaatttcattacaatgtcatattttcataccgatatcaccggaggaatagtattggcctcagaggatgggaagattgtgttggaaaatacccttgatgcacggcttgatgtcattttccggcagaaactacctgaggcatgtaaggaagcgcctgttaggttgaacaacatactgcaatttgaattctcgctttatgtcagcaaatggaagagcaaggatgttgccacttcttttccgctgagcctgatcaaagcaaatgcaccaccccttttgttttttcttttctctaagaccaagttttaa

SEQ ID NO: 57154 - DNA, 1359 bp, Glycine max
  Peptide Sequence Number=SeqID_173932
atgggaataggtacggatggcaaaacgggccaggctaggtggtccgacctgtcagcccactatcaatttggcagagcaggatggagaacccaacccgtcaacctgctgtggcttgccctgccaccccagcgggccaatggcggggcagggcaggtggataccatgattgtccaggctattggtttactagatgatcttgataaagagttgaatacctatgccatgagggttcgagaatggtatggttggcattttcccgagcttactaaaataatacaggacaacatcctatatgccagggcagtcaagttgatgggtgatcgtgttaatgcagctaacctggatttctctgagattttgccagaggaagttgaggcagagctgaaggaggcatctgtaatatctatgggaactgaaattggtgagcttgatttggcaaatattagagaactctgtgaccaggttttgtctctctcggaatacagggcacaactctatgattatttgaagagtagaatgaacaccattgcacccaatttgactgcaatggttggggagcttgttggtgctcgcctcattgcccatggtggtagcttattaaatcttgcaaagcagcctggcagtactgtgcaaattcttggtgctgagaaggctctctttagggcactaaagactaagcatgctactcccaagtatggtcttatataccatgcttccttgattggtcaggcagctccaaagttcaaggggaaaatttcccggtcacttgcagcaaagacggcattggctattaggtgtgatgctcttggagatagccaagataacaccatgggattggagaacagagccaagcttgaagcacgattgaggaaccttgaaggcaaagagttaggtcgttttgctggttctgccaagggaaagcccaagatagaagcatacgacaaggaccgaaagaaaggagctggaggactgataaccccggccaagacatataatccttcagctgattcagttattgggcaaatggtcaattctgctatggatgaagatgcacaagagccttctgttgctgataaaaagaaagaaaagaaagaaaagaaggaaaagaagaaaaaggagaaaaatgaaggggatgaaactgtgcaagctgatggtgacgttggtgaggaaccagaaccagaagttgtgaaaaaggaaaagaagaagaaaaggaaggaaactgagagtgctgagttgcagaatgggaatgacgataatgcaggagaaaagaagaaaaagagaaagaagcatgccgagaaggaagaatctcctgaaatgccaagcaagaagaaaggcaaaaaaaagaaaagtggggactaa

SEQ ID NO: 57155 - DNA, 285 bp, Glycine max
  Peptide Sequence Number=SeqID_173933
atggatgcgctgctgaagctgaaggactccatgactggaagcgtaaactgcgaccaagaacttcgagtcgttgctatcaatgtctcgtttgttcctcttttcggctaccttccgccggagatcggacaattggacaaactcgagaacctcacttccctcaagctcctcgacatctctcacaacgtcttctccggccaaattattcttccgatgacgaaactggaggtcctcgacgtctacgacaacaacttccggcagcataccggagatttactcggagtttaa

SEQ ID NO: 57156 - DNA, 267 bp, Glycine max
  Peptide Sequence Number=SeqID_173934
atgtcatttttttttcgaaaaagcttcttacctccattttcaaaaagctttacttctcattttctctttttcgtgcggcgttgcctctggttcgtgggggtagcaacgttgagcgcagcggtgaaggtgaagtttctggcgtcaagctttgcggtggtcggtggcagcaaacgaggtacgcagatggtgtttgttcgtcgcggacgtacggatgacttccggatcaagttgatccgtaagttccggattaagttgatccatggatga

SEQ ID NO: 57157 - DNA, 239 bp, Glycine max
  Peptide Sequence Number=SeqID_173935
aggaaaacaaagtggatgaccagggagatgaaagagaaggaggaattggtgctggtgggtcatcggaggttccatggcggcagtggcctgcaacggtggtggtggaggaggatcccttttgtttcttcgatgcttctgccattggagttttaggaaggttgggcaccatcaaggagatggggaagaatgagggtctgcacaaagagagagaaaataaggcttatcctgtaactgactaa

SEQ ID NO: 57158 - DNA, 2403 bp, Glycine max
  Peptide Sequence Number=SeqID_173936
atggttctaagcaagcttggtatccaagctgatcatgtcaaatctgacaagtgcttagcaaacctgaagccatattcttctcagtaccaagatggcaaaaccaaaggaactgataaggtgaagaaaatgatgaagtcaaggtcatttcagctttcagatttcgagcctcctcaatcaccaccttcggtcaggagcttgtcccagccaagaaagccatcacctcttcatgttccaactactgcagcatccccacaacagcagaaggctatggtcagaaggtcacccaattacatgaagcctaccagcagttcagatgcaaaaaaggagcttttgccggttagtcatcggaatacccaatctagttcagatggtaagagtctaccacaaaaatgtatgagaaattcaaaagctagctatgtttcttgcaaagagcctgcaaaaactttgtcaagatcatctagtgtgaattcaatgagaacattaacaaagactcctagtttcaagccttgtaaagcttgttcaagagaattcacatcagcagttctgtttgaagatgtgaatgcaccagagagagctacctgctcttcaactttgaaagactgcaagtttcccgagtacctcatgcttgaccctgggggaactgagtctgagggagtttcacttatgaaggtttgcccatatacatattgttctcttaatggccatggtcatggtcattctcctttgcctccattgaagagcttcatgtcagcaaggaggcatcttttggagactcagaagaatataaaggcggaagttgcgagccctcaaagatggaaggtgcccccctgtgatacaaaaaaagactcttatagtgagcagattgtctttcatggaaaacctgcatgtgatgaagctgatacaggtaatccaacaatcactcccttggcacaagaaattggtatggatttcttctttgaaatctatgctaaggaaagggaaggagatggaaaaatgggaaaattcaactctttcaaagaccttgaggagcaagaagatatcaattttgcaaatgacgagaatgacattgcagcagaagaggatggagtcaagcaagttactcccggagtgactcgtgacctcccgaagtctcagatcaatttcgaggaggatttcaaaaactattttgctgatactgctgcaattgaagcaaatagcaaggggagctttcatctaggacaaaatgctgaagatgcagatgaaaaccagccacctagctggtttcatgaagaaacctgttcaggaagctgctgcaatgagactagctatgatggggaacagatggagaatattgacttggatgagtctgattcccaatatagtgatatggactgggaggaggaacacttctgtgaattcaaccatgaggacgatactgattcttccatctgctcaatggaggaaactgactcaaaactcgagtccttatcagagagttcacatgatatatctgaaatgcggttacacgacatcgttagcagtcaatatgcagacattctggttgaagaagcactccaagaagttgaagaagagaaaagtacctgttttgatgcacaacctcattgcactaattctgtcctggaagacacaagtgaaagcatcgagtttgtgactcaagaaacagattatccatccaatgatacaagttctgagaatgaccaatctacttcgactgaggaagtatttcagcatctgataaatgcagaagataacagcagagaaaatgaaaaacatgtggattatgaggtcagttgtgtttcaatggtacttgatgaagttgaaaatagtgaaggccacaaaactagtgaaatttgtgagattgatgagagcagtgaagacagaaatgcaagcctagagaatgatgatgataatggaattagccaggagaaccaaattcactcgtctgaagtgccagaagaaagcaccattgttgttcaggagcagaaattatcggaggaaaatcaagttaaaggtagtaagttgccgagcacaggtggtagtgaagagcagcacacgggcaataataggcaatggggaactaagcggaagagacctatggaagaggatgaggaaatgagaaagatcaacccacgaaagccaaatttcctgcccttggttattgagccagaaccagagaaagttgaactgaagcaccaaatgatagatgaaagaaaagatgcagaggaatggatgcttgatttcgctctcagacaagctgtcacgagacttgctccagcagggaaaaggaaggtgtcattgctggttgaagcttttgaaacagtaatgtcaatgcccaaatgtgaagcccgtatgaaaaatgattcaccctttgctcatgcaaggcctattcaagcgtgtagctga

SEQ ID NO: 57159 - DNA, 336 bp, Glycine max
  Peptide Sequence Number=SeqID_173937
atgggaatgaaatccttgtcaccgtggtccaatgagactcgaggtatgtatgagaagcttaaatctcatccaaatcctaaagtaagcaagaaagcaagacagttcatgtacagctttcaggctatggaaatgatgaaggagacaacaggatctcaattttatttaaagaactcagactaccagaattattttgatgcatttgttgaaaataaatctaactaccccaaagatggcctggttcaagaaagtgcaatgaatcaggttttgccgtatattctttttcttgtttctcctatttttgtcgtactacttattgctgttcggaaaggaacataa

SEQ ID NO: 57160 - DNA, 1359 bp, Glycine max
  Peptide Sequence Number=SeqID_173938
atggtgagagtagcagaggacattgatcaatggtcaaagaactacacagcattgacaccgttgtggtttctagaaagagcagcacaagtagctgttatagcacccaatgttccagctctttatgaagctcactttgggattccaatggcaggagctgtgttgaacgctgttaatattaggctcaatgcatccacaatagctttcatgcttggtcattgctcagctgcagctgtaatggtcgatcaagagttcttttatttggcagaagaagctttgaaaatatggtctgagaaagccaaaaccttcagccctccacttttaatcgtcattggtgatgaaaattgtgaccctaaggcacttatctatgctagcattgctttgggttacacatctggtacaactgctagtccaaagggtgtggtgttacatcaccgtggagcctatctcatgtctctgagtggagctcttatttggggaatgactgatggtgctgtgtatctttggacagtgccaatgtttcattgcaatggttggtgttacacttgggcgcttgcagctcggtgtggtactaacatatgccttcgaaaggtaacagcaaaggcggtatatgaagccattgccaaatataaagtgactcatttttgtgcagcaccagtggttcttaacacaatactaaatgccccacctgaggacaccatacttcctctacctcatgttgtacgtgtcagtacaggtggggctcctcctcctccttctgttctttctggcatgtccgaaagaggatttggtgtcacacacgtttatggcctctcagaagtctatggccccgccgtctattgttcctggaaaccagaatgggaatcacttccccctgaaacacaagcccggctccacgcaagacaaggcgttcggtacattggcttggaataccttgatgttgtgaacgcaaaaaccatgcaacctgttcctgctgatggtaaaactgttggtgaggttgtgatgcggggcaatgctgtgatgaaaggatatttaaagaaccctaaggctaatgaggaggcctttgcaaatggatggtttcattctggggatcttgctgtgaagcaccaagatggatatatagaaattaaagccagggcagataaaaaatggggtgagtctccatgtgcttttgtgacactaaagccaggagtggataaaagcaatgaacagcgtatgattgaggatgtcctaaagttcagcagggccaagatgcctgcttattgggttccaaaatcagttgtgtttggagccttacctaagacagctactgggaagatacagaagcatttactgagggctaaggcaaaagagatgggacct

SEQ ID NO: 57161 - DNA, 204 bp, Glycine max
  Peptide Sequence Number=SeqID_173939
atgggagatcaattagaggatatgatgattcatgatcttggaaagtcttttcagccagatatgggtgaagtgacaaaaacttcacttcattccttaaggtttaagcatttgtctgctaatggagatgacacaaaagaccttagatggcatgtagatgggacaaactgggatggaatgctcttccatctggctgattcttcctaa

SEQ ID NO: 57162 - DNA, 198 bp, Glycine max
  Peptide Sequence Number=SeqID_173940
atgatacagacagcttatgggaacacccttcaatcaatgagaaccctagacaagagagaagagaaggattggaatgaggagctgcagagaggcgacgacactgacaatagtgacaatgataggctagggctccaaagttatttgaaaaccggtgtcgttaaacacttacaacatcgattttcaaataaccgatgttaa

SEQ ID NO: 57163 - DNA, 1308 bp, Glycine max
  Peptide Sequence Number=SeqID_173941
atgaccatcgacttggattcgatcgctcgcagagtcgaggttgataatcgcattccaatccgctattactatcggattgccgataacctcctcaagcagagatcgcgagctgtgttggatgagcttgaatctttgaagcctgaatttaaacgccgggtggaaaaaatgaatgactcacatgtaaaagctccattccctgaagaaaatggcttcaataaggctttgcagagttcagtgaattcatctttggaatggccggctgttagtaaacagcctactgctggattcagttcacactcttcatggaattatgataatatgttatctttagattccaggcctattgacaagcagtttcagaaactatctcttagtctaccccctccaaataaggagactttgtccagacactcatttttaggaccaaatggccttcggggccaatggcttggacctagtgctgaaataaagaggggggaaaatgagagaatcgatattgaatactctaaagttgatggacttgatatggttcaatatccaagcagtagtgatctcacacatgccaaggattcaagcctgaatcaggctgggctatatgatcttggggcaattaaagatggcgatcaaggacctgttacatccacaatggactcagttctctccttggatgatggaagttggttgcgtcctgctgttgagtcctgttctcctgttgtaactgaatcaagggaggaccccttacaattgctcaacatcaagcaacctttgccgcctcctgttcttgctcaggtgtacccagaacatgcccctattcctccttcaaaagttgcagatccaaggccaggaccagctaaatcatctcatgattctggacttggttcaactacatatcaacacctacatattcctgtcaaaatgatggaagattttttgagattagcttcggaaaacacacggaagaacttagagacatgtggtgttcttgcaggatccctgggtattccatatcacaacacttataatcccaaagcaggaatcaacttcagactcgtgatatctgtggtttcatttcagatcatgttaccagaggcaattgctattgtcatggcccctacagatactacaagtccacatggcatattccatctgtctgatccgggtggtgtgtctgtcattcgtaactgtcaacaacgtggatttcatccccatgaggagcctgaggatgggactccaatatatgagcactgttcccatgtctatatgaatgctaacttgaagttcgatgttgttgaccttcgagagcgatga

SEQ ID NO: 57164 - DNA, 1047 bp, Glycine max
  Peptide Sequence Number=SeqID_173942
atggtgtcggtgaacccaagccctgctcaaggcttctacttcttcgatccctccaacatggcccttcccggcgtcaacaatcttccaccgcccccgctgcctgctccgccttctcacgccgccgtggaggatccgagtaagaagatcaggaaaccctacacgattaccaagtccagggagagctggactgagcaggagcacgacaagtttctagaagctctccaatttcatgcacagaagtattttcttaaagttcagaagaagggaacaagtgaacatgtacctcctccccggccaaagagaaaagctgctcgcccataccctcaaaaagctcctaaaactcctactgtatcccaagttatgggcccattgcaatcttcatcttctttcattgaacctgcatacatttatatcccggattcttcatctgcgcttggaactccagttactaacatgccttcgtcatcttggaactataataatacaccacaacctgtcaatgtgccacaagtgaccagagatgacatgggattcactgtagctggacaaactgctcctcttaattgttgctgcagcagtagtaatgagagcaaccctccaacttggccaagtagcaaaaggattaatcaaggtgaccaggagccaattaaagtaatgccagattttgcacaagtctacagcttcatcggcagtgtattcgatccaaattcaactaatcacctacagaaactacgacagatggatccattaaatgtggaaacgcttgactgcctgagtactttatattgtgctgttttgcagatattgttgttgatgagaaatctctccatcaatttaatgagtcctgaatttgaggatcatgcactgttagatcgtagatatgctggtgtgtttggtgtatatctttcgaagatgatgattgaccttggaatgcaggacaatgagagtcctgttaggtcacttctggaggctaaactgtacagtctgttgagtgcttttgtttattatgctgtgaagcttaggattagtatagaagagcggtgttag

SEQ ID NO: 57165 - DNA, 126 bp, Glycine max
  Peptide Sequence Number=SeqID_173943
atggctgatcttataagaccaagacctgtttcttttgatcatgctctcagaggtactgcagtgaccttcaacttcagtatcctctatattcaagatcaagtttactgcgagggttcatcactttga

SEQ ID NO: 57166 - DNA, 438 bp, Glycine max
  Peptide Sequence Number=SeqID_173944
atgaagctatttggtttccccttgaagggttcgggttccatcagtattagtgaggacacaccatgtgtcgacgatggaggtggcaagaaattcaagtgccgctactgtcgtcgccaatttgccaattctcaagcactaggaggccaccaaaatgcgcacaggagagaacgtgctaagctagcccagttcaaatatcttctccgtcttcaacaacatgatcagtaccatcatcataggttcaaccaagcatcaaatgcttcacctagtgttagtgatgctagtgcaacaactagtgctgcagctttgtttcaatttcatagtgcagctgctgcagggtcatcacatcttgggacactgctcctgcaagtaccagctggtggcaacgatgtggatctcaacctcagattagcttgctcctcagagaacttgaagaactga

SEQ ID NO: 57167 - DNA, 1014 bp, Glycine max
  Peptide Sequence Number=SeqID_173945
atggggagagctccttgttgtgagaaggtggggttgaagaaaggaagatggacagctgaagaggataagatcttgaccgattacatccaagaaaatggggagggatcatggagttccttgcccaagaatgcaggtttgttaagatgtggaaaaagttgtagactgagatggatcaactacttgagatcagacgtgaagagaggcaacatcactcctcaagaagaagagatcattgtcaagttgcatgctgttcttggtaacaggtggtctgtaatagcaggacatttaccaggtcgcacggacaatgaaataaagaactattggaattcccatttgaggagaaagatttactgcttcatgaagtccttaaatgagtccctccctcccattgacatggctgctgtaaacgtagctgctaaatccaagagaagaaccggtggtcgaggtacaaaaactcaaccagccacgcaagaggacaagaaagtggctcataacacaagcgaagtgcctcaagttcaaccaatgctcaaaagaagtgcaacttcacaaagtttcaacgatgaggagagcctaacagattatggtttggatgcttattgtgagatgggggacaacacatatgacacaactgcttcatgccccagcatagatgaagttgaggccttgggaccttatcaatggttagatgatgaaatcatgaaacttactcgcatgtttgaaaatggggtgctcgtaaacccaggcggggttttaaccaataatgaagagtggcttattagaaataactttggactaatgggagagggctcatcaaatgcagaaagtggagagtggaacactagctgttcgtcagtgaattctgtctatgactatcatcattatcagtggcctgatatgcaattagaaggtagtgttcaatcctataatccttgggatctttgtgaagaaaaccagaacgtggctaattgcttttggggtactggccataatgaaggaaatggcttttaccagtga

SEQ ID NO: 57168 - DNA, 1011 bp, Glycine max
  Peptide Sequence Number=SeqID_173946
atgaatctgtacttagcttattcttcaagtcttaagtttgttccatctgccaaagctaaaacctgttgtatatacagtcctgatgttgattttaaggaaacctttagccctatcattaagcctcaaaccatcaaacttgtgctctgcattgccatctcaaatcgctggacccttagccaaatggatatgaacaatgccttcttacatggaacactgactgaagaggtctacatatctcaacctaccggctttgttcatcctaactttccacaacatgtttgtaaactggtctcaaacagactccgtgtgcatgcctatggattcttcaactccaggtctgatccatctcttttcatctacaagcaaggttcgtttgctgcatattttttggtgtacgtggatgatcttcttctcactgatgtagcctttgttgtcaataaactcccacaatttatgaagactcctactgccacccacatccaagctctcaagcgcgtacttggctatctcaagtctacaatatcacatggcctccaactaattcctgccaaaagtctcattcttaatgccttttgttatgctggagacacagatgatagaaaatccactggtgcgtacatagtttatcttggtcctaatgctatctcatggtcctgcaagaaacaatccacagttgctcgctcttccaccgaggctgaatatcacaccataggttccactgctactgaacttctttggttacaacaggttctgcaagaacttggcattaccattcaacaaccatcaactattttctcggacaacattggtccgacgtatttatgcgctaatcctgtctttcactcacggatgaaacatcttgctattgactatcactttgttcgagaccttgtgccaagaatcagctcaaagtttcccatgtgcccttcagtcaccaacttgcagacttgctcaccaaacctctctctaccacacgacacaactttctcgcatccaagattggagttgtag

SEQ ID NO: 57169 - DNA, 2169 bp, Glycine max
  Peptide Sequence Number=SeqID_173947
atggactctttggatatcttcaatagagatatgagagtggatgtgtctttcacttatgtttcctactccttttatgggtttaagaaaatgagagttgagaaagaaggagcaaaaaatgaaggcagatacgttggtggtttcttctacttgtttgactggacctcaaaatctcgtaagaaattatttgcagccaagtcagatttgccagagtcctcgaaacagagaagaaaagttgatggcaacatggcaatgatgctgccctatctggtggatgatgatgaaattggagtagggaaatgtattagagaaagtagtgatcatatttgtgcttcatctgttatagatgatgaatcttgtggaacaagggcccctggtgtgattggcaggcttatggggttagattcattgccctcttccagttttccagatccttgttctaccccatactttgacagccaatctcttcaagatgtgcagtactggagaacagaatttaatcatctgcatgaccatcagatcctgtattctggaaagctgattgaaaaagctgagggatcttcttggaaattcatggaggcaaagcctcaacagacccgtagcaggccgattgaaaagtttcaaacagaagtaatgcctcccaaatcagctaaatctattcctctaacacaccataaacttttgtccccaattaagagccctggctttgttccagcaaataatgctacttatataatggaggctgctgcaagaattattgaacctggcccccaagctactacaaaggataaaacacctctggtagcatcatcaactgtatcattgagggttagagatcttaaagaaaaactggaagcctcacaaaaaggacctctaattgggtcatcttcgctgacttctagagttagagatctaaaagaaaaaagagaaacttctcatagaactagcaggcttttggaaccttctcaaaggtcggctgagtctaatgatgccaagtatctaaagggacaatctttcaacataagttggaatggatctgtggatacacaagtcagatcatcttctcaagcagaagaagattcttctttgaaaaataaagggaagtctatttcacttgcaatccaagcaaaagtgaatgttcaaagaagggaaggcttgagccttagtaggggaaaaagtttggtggagcagaaagaacaatgtgacattaaaaccccccagcagcctctgaaggctaatgttaaaaaaaaattgcataagaaatcctctggccaagatgcttctggtgttctcaggcagaataatctgaaacagaattgttctacggataaagacaaactaccatcaaagccattggtttccaattcgaacagtagaaaagttgtgactggggattcctcttgtggacatcatagaagctctagtagtaaatccattgcaaaatctaaagttgggcccaaaaaatcatccatgaatgtgacagatagtgaaaaggaagttttgtatacccgtaccaacaatttcccaaggaagaagaggtccacagacagggactggaatgatagggttgttgataatttgtttattgacaaaactcagaagcctgttcagtctaatctagttagtaataaacaacatgatggggctgaagaagtcaaaagtaaagacatggatgtagtttccttcacatttaccacgccattgacaagatgcaattctggttttgagacatctggacaaactggcctgaagactaatagcctttccttggatcagcatattagaagagtgttgcttgacaatgaaactgatattacaaggtttccagtaggatacaatgctattggtggtgattccttagctatccttttggatcagaagctgagggaattaacatacggagttgagaattcttgtgatgactccgtcaaagcaaggtcaccttccagtactgtaccaaaatctaaagatctggttcccacccttaattcagttaacctctttcaacagttgcaacagaagaaaaaccaagacatgatgtgttcagataagtcagataagttattcagtagccatgaatgtgacatttccttcacttgtcttccagaaatatcatccaagcacagactctgggcatgtatggagtatggacaatatcaggaccccagttaa

SEQ ID NO: 57170 - DNA, 1626 bp, Glycine max
  Peptide Sequence Number=SeqID_173948
atgccagaaccgaggttcgccgcaaccgttacaaggtcgccgttgacgccgacgagggccgccggagaagagaggacaacatggtctagatccgcaagagcaagcgcgaagagagtttgctcaagaagcgtcgcgaaggcctccaagctcaccaacagcttcccgctcctcttcagaactccactgtcgacaaaaatggttcgatcgcatggtttgctagggttttggatgttagttcctgtgatgttagagagtcttcctgcaatggttgctggagtttggtcgaatgataatagtcttcaacttgaagccaccacgcaatttcgcaagctgctttcgattgaacggagccctccgattgaggaagttattcaagctggtgttgttccacgttttgttgagtttcttgttagagaggatttccctcaacttcagtttgaggctgcgtgggctctcacaaacattgcatctgggacttctgagaacactaaggtggtaattgatcacggggcagttcctatatttgtcaagctactcagttcacccagtgatgatgttcgggagcaggcagtgtgggctttgggaaatgttgctggtgactcccctaggtgtagagatctggtgctcagccatggtgctctcgtcccactgttggcccagttgaatgagcatgcaaaactttcaatgctgagaaatgccacatggacattatctaacttttgcaggggtaagccacagcctccgtttgagcaggtgagaccagcacttcctgcactcgagcgtttggttttttccaatgatgaagaagttttgacagatgcttgctgggcattatcatatctctctgatggcacaaatgacaaaatccaagcagttattgaagcaggtgtatgtcccagattgatgcagcttctcatgcacccatctccctcggtgctgattcctgctcttcgtacagtgggaaatattgtgactggagatgacatgcagactcagtgtattatcaatcatggtgcacttccttgccttttgaacctgttgacaaataatcataaaaaaagcatcaagaaagaagcttgttggaccatatcaaacattactgctggaaataaagaacagatacagactgttattgaagctggtctggttgcaccccttgtcaatcttcttcaaagtgccgagtttgacattaaaaaagaagcttcttgggcaatctcaaatgctacatctggtggaactcatgaccagatcaagtatttggtgagtcagggttgcgtaaagcctctttgtgatctgcttgtttgcccggacccaagaattgtcactgtctgtttagaaggcctagagaatattctgaaggttggagaagctgagaagagcctaggtaacactggagatgttaatgtgtacgcacaaatgatagatgaagctgagggattggagaagattgaaaacctacagagtcatgacaacaatgaaatatatgaaaaggttgttaaaattcttgaaacatattggttggaagaagaagatgagacactaccttcaggaaatggtgctcaacctggtttcaatttcggaaacaatgagcttcccgtcccatctggtggattcaacttcagctga

SEQ ID NO: 57171 - DNA, 846 bp, Glycine max
  Peptide Sequence Number=SeqID_173949
atggcaccaaggggccaagctgagagagaatttaaagttgaggtagaagcaattggtcgtgtgcggcacaagaatcttgttaggttgcttggatactgtgttgagggggcatacagaacagtggctgcatggggatgttggaccttggtttttgtgtatcttttcagattggcttatcttcatgaaggtcttgaaccaaaagttgtccaccgagatgtgaaatcaagcaacatactcattgatcgccagtggaacccaaaggtttctgattttgggcttgctaagcttttgtcagcggatcatagttatgtcactactcgagtgatggggacatttggttatgttgcaccagagtatgcatgcactggaatgctgactgaaaagagtgatgtgtatagtttcgggatactcatcatggaattaattactggaagaagtcctgtggattatagtaaaccacaaggagaggttaatttaatagagtggttgaaaagtatggttgggaatcgaaaatctgaggaagtagttgatcctaagattgctgaaaagccatcttcaaaggctcttaaacgggctttgttggttgctcttagatgtgtcgacccggatgcagcaaagaggcctaaaataggacatgtgatccacatgctcgaggctgaggacctcttattccgtgatgatcgaaggactggaggagaatcctcccgttcccatcgcgattatcaactagagcataaggactcaaaattagataaaaggcagataggtggagagatcactgatcaaagtgaagatgacagtactactagtagtagactgcaccctcaaccccatagatcgagataa

SEQ ID NO: 57172 - DNA, 477 bp, Glycine max
  Peptide Sequence Number=SeqID_173950
atggtggatccaactggaaaaggatcggagattgaagtcgaggactcaaactcaaaccctaacgctccttcctcagggaacagtccaagcagcaacaatgagcagaagaaaacctgcgccgattgcggcaccaccaagactcctctctggaggggtggtcctgcaggacccaaggtcagttcaccctccatttctcagatcgcgccacgtggcgttaaaccaacccttgatctcactctctgttatcctttttttcagtctctgtgcaacgcgtgcgggatcagaagcaggaagaagaagagagcgatcttgggaataaacaaggggagcaacgaggacggaaggaaaggaaagaggaccggcggcgctttggggaaggaggtgttgttgcaccgatcgcattggaagaagctcggagaggaagagaaagctgcggtcttgttgatgtcgctctcttatggatccgtttatgcctga

SEQ ID NO: 57173 - DNA, 834 bp, Glycine max
  Peptide Sequence Number=SeqID_173951
atgatgaatgattccattagttttcatgttggtctatctaatggtagtattcgcgtgcctcaaatcacactaaaaatcaacattcatgcgcctcaaatcacactaaaaatcaaagtaaaacaagcctcaaaaacgaaaaaaaaaatcacgcagaaggatgcagtccaaagtaacgccaccaatttagacaaaccacctgaaaaggaagagaccattcgagaggtcattgaagatgctggattccaagccacattcatcagagatgataacgagacatctgttcagatatgccgcatacgtatccaaggcatgacatgcacgtcgtgttcctccaccgtcgaatccgctctacaatcaatccaaggagtggtgaaagcccaagtggctcttgcaactgaggaagctgaagttcactacactccaaacgttgttacctacaaccaaatcttggaagctgttgaagacacgggctttcaggccacgcttataagcacaggcgaagacatgagcagaatagaccttcaagttgaaggcataagaactggtcgttccatgagactcattgaaaattctcttcaggccctccctggggtccaaggtgtagaaacacaccctgagttcaacaaagtgtctctttcttataaaccagacttgacaggacctagaaatttcatcaatgtgattgaagaaacgggatctaggcgtttcaaggcgaagattttccctgaagaaggaggaagaaggaatagtcataggagggaggaaatcaggcaatactatagatctttcttgtggagtttggtgtttactattcctgtgtttctaacctctatg

SEQ ID NO: 57174 - DNA, 215 bp, Glycine max
  Peptide Sequence Number=SeqID_173952
atgactcaacctccaatgttgaggacctgttatctgaatatgagagtttttgggtcaaagactatggtggtgatagtgactcctcttccaggttggaaggatgaaacatgtctccttcccacgaaccaatattcaaacaaagttggtagtctggggatgatccatgcgttagttgtttttgctttaaggttatccagtggtgtgccatgtccgtg

SEQ ID NO: 57175 - DNA, 699 bp, Glycine max
  Peptide Sequence Number=SeqID_173953
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttc

SEQ ID NO: 57176 - DNA, 207 bp, Glycine max
  Peptide Sequence Number=SeqID_173954
atgtcacgaaactttacggattacgaaaccatcccttcttcgacttctggaatgttacggaactttgcggattgtgcattaacactccctttcaactcccgacatgtcgcggaacttcacggattgcctaacgatgggtgtcaagttcctcaaagtggtcaagcgagggtcgcatcccacaaacagatggtccccggacgaaattag

SEQ ID NO: 57177 - DNA, 1013 bp, Glycine max
  Peptide Sequence Number=SeqID_173955
atgaagaggacaagaaaagtgacttgcctaagatcattggctactagaccagttggggcagagaaacccctagtccatgtggatcctgcaacggggaaagccgacagtccccacataaagaagttaagaacatatttggggatcgtcgctcgtgataagttcaagtctgatttaacatcgaaatgggcacttgcagccgacaaggacagtgtcgatgacattgtttgtgaaaaagacccttcgtgggaggaagtgcaaaagaaggcatgggccattcagaaacaaaacattacccctcatgtgttgtctcgtgaaggttatgaatttctagaaaaaaacttgatggatgagaggaaaaagaaacaactgcaagaagctactaaattcggaagcactgacaccatgattgatcctccatctcctatcagacgacacgtgaagtggaagatggtccgcaccaagaaaactgaccgaatgacgtttgaggcaacagagaaaattgctgacaagattgtaaggtcacaaggttcctttgtcgcccatggacgtcaggatgtattgactgttgccattaggcgaccagaacaccttggtcgtgtgcgtactattggagccggtgtcacgatcaaacaatactttggaccagctccaaggaccactcgcacttcttcgtccatgactctcgaagacctggaccagatgcaatcccagtttcaatcacacatgcaatcacagggactcatattaactcctgagctagaggttggtccttcagttgctcgtgtcaacacaaaggagagttgtgttgatccctcagggaatgacttagacacgggtgactcagagaaatgcgggttgtacgtcgaagaaaatcctccctgcctagttgccctaggaatactttatgaggggtcgacaaccgttcacaacatccctttatgccatgatcaagacaagttagtgttgaggaagttagagatgcagatgctcccattcctgtacccactcaagag

SEQ ID NO: 57178 - DNA, 370 bp, Glycine max
  Peptide Sequence Number=SeqID_173956
atggcagagaagtaccctagactttattcagtcttattgcagcagcatcaactcattagatccgtgggagtgtatcaaggcgtggggtgggaatggaactttgcttggagaagagccttgtttgacaatgagatcacctcagcggctaactttctcagagatattgcagaaaataaaatccagcaacagggagaagaagcaagaaacaacagtgaggaagaatgttttgagaagctttggaggataaaggttccagctagcaaagttcaacccatatggtgggaaaccatgtcatggatgcaagttaagggtgcttttccattaagcccaaagcagcacttccttcttcatttgggtgttcaacctgctg

SEQ ID NO: 57179 - DNA, 231 bp, Glycine max
  Peptide Sequence Number=SeqID_173957
atgcgtgatagcctcccgaacacaagttcaagatcatcacaggatccaaacacaacaacatacagggagtcactctcactaagtaagatcatagggagaccagtcagggtcacgatgttttgcgagaatgctccaaccatatggaatcagcataggcttaaaggagcactcaaacccggtgacccccaaggtctacactctgaagagtccgtcagggcctctccctcctga

SEQ ID NO: 57180 - DNA, 285 bp, Glycine max
  Peptide Sequence Number=SeqID_173958
atgcctcctccacctctagaacctcacaatcactcacaaactcatctcaagctctcaggacgacttcctcttcaagcttcattctctacaggtggccttgttggtgcttgcacgcttagcgcaactctggaccgcttagcgtgcattagtgaatttcggcttagcgcgcatcttctcgctcagcggatggactcaagcggtgcacttagcgggatgagccctcgctcagcgaacacacacacaactcagccaaaggagtggtgcgctcagcagatgcctcgctaa

SEQ ID NO: 57181 - DNA, 1273 bp, Glycine max
  Peptide Sequence Number=SeqID_173959
tgatcttggaatagatgttcaatctttctgcaagaaagtagaggctcgtgataacatagagggattcaaagggaagacttacacgaaaagggggtgtttgacgacacaagggagtttggaggcaacaaagatgtcctttgaacaagatggtcataatgaggaaaccgaacaatctagaaagcaaggggaggggataaagtgtgatggatatgagacagttggaaacacacaaattcaaacttttgcatgcgaagttcaagaagatgttagggaaataatgggactcgacccaaagctaatggggtggggtcaagtggtacaacatgatcttagtcagcctggtgcaattgcacttcttatgagacaaaatagtggcgcgagtgtggtggctctcaatctcgtattcaaggtggaaaggcacaaggtggtaaggagtgcatctctagacttttgtgataatatgtctgatggttgtattatgaactgtaacaatctcttgagaattagagatgagatgcaacaggcaggaaaggtatgggatgttggtatgaagctaaaagtgtcgagtaaaggtcacaatgttactattgtaatcgtttatttcccttatgatttggaagctaagtggagacaaggagaaagtgtggtggactatggaagaggtgaaagtttggagttcaacaatttcatcaatgatttggaattggatctcttattgttggtagaaacttcacttggtttaggcctaatggaaaagctagaagcagtttgggattgtggtagctcaaagagtccaagactcgatagtttcaatttcaaattcatcatgaaattttgggaggttttgaaggaagatatgcttcctttctacatgttgaggagattaggattcaatgaaacaagggtaatttggattaaggggtgtctagcatcaagctcagtttccattctcattaatgggagacccaccaaggagttcatgcttcaaaaaggtcttaggcaaggggatccactagctccctttcttttcaatatagtggggaaagggcttagtggattgatgagggaaacaacttctaagaatttgttttcaggctttaagttggcatccaggttgaaagtgatttttcttaaaagtagatttggtgccattggagtggatggagaagctattgaaaaatatgcaagatacttgaattgtagaatattgaaccttccctttatgtatttaggcctcccgaatggagtcaattcgagaaaggtggagacatga

SEQ ID NO: 57182 - DNA, 570 bp, Glycine max
  Peptide Sequence Number=SeqID_173960
atggcccaaaatgattccaaccctactccgcctcaggaaccccatgtagtcgtagtcgtagcggtggaacccattattgaggatttggtccaagacaaagaagaagagaatgataaacgagtccttgtcattgaaggaggtagcaatagggtttttgattctgagaaaaatgccattgatgagctgaagaaactcttgaaagaggaattagaggacgaggaggtttccatctggggcgtccctctcttgaaggatgacaggactgacatcattctcctcaagtttcttagagcgcgggagctcaaagtgaagggcgcccttgtcatgtttcaaaacactctccgatggaggaaggacttcaacatcgacgtccttctggatgaagatctgggagacgacttggagaaggtggtcttcatgcatggacatggcagagagggccatcctgtctgttacaacgtctatggcgagttccagaacaaggacctctaccacaaggccttctcctctcaggataatcgaaacaagtttctccaatggcatattcagttgttggagcgcagtatttga

SEQ ID NO: 57183 - DNA, 852 bp, Glycine max
  Peptide Sequence Number=SeqID_173961
atgggttacgagtgccaacaaggatctttttggcctctaggatttttcatgaaatcatgctctatgcttcacaatcgaatactggctgatcccgcatttcttttcaaaattggctcagagttttcctatgtaacaagattgtcatcgatacatgttgtgctacgtttgatgaaattcaaaaagagaggcaaagacttttgggtcgaatttgagttgtatcttgcagatcttcttgttgggctggttgttaatgttgctttggttggtatgttggcaccctatgctcgttccctgttcatacatattttgcttgattatagacacaagtatcgttccctgttcatacaccctacccccttccctcataccacatgtgttaaagcttttggacttaatcatatatctgcaattggccttgtggatcatctaatagatcataaagacatcagaagaagacatacctgtgccaccacttgtgaagagtgcttctctttgggttttgttcctccagagcttcctaagcctgtcgtgggcattaactttgctagggatggcatgcaggaaaaagactctgaaaataattgcacacaaaatatcaacctcttggatgttatcactttttcacttaaagatgattttgggtttccagttagtggtcctctctacaagttgctactaaagaaggagaaggcccatggcatggatataaattatgtgcgatggagcccttggcattttggtgacattgctgcagccaaagaccttgtgcacaatggaaaacttgcggagatcattttggttcccagtttggtgggtataaggttcccagtttggtggtatatgcttgcataa

SEQ ID NO: 57184 - DNA, 285 bp, Glycine max
  Peptide Sequence Number=SeqID_173962
atggctcttcacttgattcctttgtcctattctttcaaacttgccacacttaattttgttttgtgccacctctacctgcattttgaagaacgggaagacactctaaatactataggtcagggcaccaatgacatattgggacagccagaagatgtccacctagaggattactgtatagtcttgaactgcaagatgttccactcagttgcaactaatcaactaccccctaagcatcagaggatctccctgaagaggattgcccaccaagcggggaaagtgacgtaa

SEQ ID NO: 57185 - DNA, 280 bp, Glycine max
  Peptide Sequence Number=SeqID_173963
atggagccagaatattgggataagaatccttttaaagcaaccgccaaagtattccccccaggatttcactataggccatcaaccctcaacaaaaccaaaaaattttacgaattcattctaatagatacaaactccgtatctatgaaacatttcaaggaccctaaggacccaaacctaaacactcactcaacaatccaaatcctaaaggtaatgcagccacgacattacggctccaatttaaaccaacccaagaagttttctgcaccttttgaccttgcag

SEQ ID NO: 57186 - DNA, 3297 bp, Glycine max
  Peptide Sequence Number=SeqID_173964
atggcctgtctgagagcactgagtagattatgccccctgcccccctgcattgtgccacaaattacaatattgttctgtttcatgtctggcctgaaattttggtatgacaatgtcaatgaacgagactatctacggaccgagggagatcctggtgcttccggttatacaattaaagaagcagtggcactcactagaagtgtgattcctggacaaagagcccttgcattgcatctcctttcgtctgtgcttgataaggcattacactatatttgcaaagacagaacagggtatatgacaaaaaatgagaacaaagttgacaaatcagttgactgggaagctgtttgggcttttgcactgggcccagaacctgagcttgtgttgtcacttaggatatgtcttgatgataaccacaattctgtagttctggcctgcacaaaagttgttcaatctgtattgagttatgatgcaaatgagaactactgtgatatgtcagagaagatagcaacttgtgacatggatatttgcacggctccagtttttaggagcagaccagatattaatgatggattccttcaagggggtttctggaagtacagtgccaaaccttctaatattcttcctttcagcgatgattcaatggataatgagactgaaggaaaacatactattcaagacgatatagtggttgctgcgcaagattttactgtaggtctagttcgcatgggaatccttcctaggcttcgttatcttttggagaaagatcctacaacagctttagaagaatgtatcatttctatactgattgctatagcgaggcattcacctacatgtgctaatgctgtactgaaatgtgaaagacttgttcagacaattgtgaatagatttactgctgacaattttgaacttcgatcttctatgactaaatctgtaaaactcttgaaggaagtgatttctacatcagcagccagagaatcattcctaatgtttcatttgattttggaaaaggtgtttgctcggttagaccagaaaacttgtttagagtttataaagaaagggtattttcaggctatgacttggaatttatatcaaagtccttcctccgttgaccactggctaaggctagggaaggaaaaatgtaaactcacatctgctctgattgttgaacaaatgcgtttctggagggtctgcattcaatatggatattgtgtgtcttacttcttggaaatgttccctgccttgtgtttttggttgaatccaccttcatttgaaaaacttgttgaaaacgatgttttggatgaatctacttccatctctagggaggcataccttgttctggagtctttggctggaaggcttcctaatctattttcaaagcagtgtctaaacaaccaacttccagagtctgctggtgacaccgaggtatggtcttggaattatgttggtccaatggttgacttagccataaagtggatagcaagcagaagtgatccagaagtatccaagttctttgagggacagaaagaaggaagatgtgactttcctttccgagatctttctgcaactcctttgttgtgggtgtatgctgctgtgactcgcatgcttttcagagtgcttgaaagaatgacatggggggatactatcagctcttttgaaactgaagggcatgtgccatggcttccagaatttgtacctaagattggacttgagttgatcaaatattggtttttgggcttttctgcatcctttggggcaaaatttggaagagattctgaaggtgaatcttttatgaaggaactagtttatttgaggcagaaggatgatattgaaatgtctttagcttccacctgttgtctaaatggaatggtcaagattattactacaattgataatctgatactgtctgccaaagctggcatctgtagtctcccacgccaagaacaaagtctctcaaaagaaggaaaagtgcttgaggacggcattgttaatgggtgtttggttgagttaaggtatatgcttgatgctttcatgttttcagtttcttcagggtggcaccacatacagtccattgagtcatttggcagaggaggaccagttccaggggcaggaattggatggggtgccccaagtggaggattttggtcagcaacatttttattggcacaaatagatgcaaaatttctcgtctctttgctggaaatttttgaaaatgcgtctaaaggtgttgtgactgaagaaacaaccttcattatccaaagggtgaatgctggcttgggattgtgtttaactgcaggacctagagaaaaggttgttgtagaaaaggcattggatctcttgttccatgtctctgttttgaagaaccttgatctctgcatacataattttctcttcaatagaaggggtagaacttttggctggcaacatgaagaagaggattacatgcacttaagaagaatgttatcatctcatttcaggagcagatggttgtctgtaaaggtgaagtctaaatctgtggatggcagtagttcctctggcattaagacctctccaaaggttggtgcttgtttggaaaccatatatgaggattcagacatgtcttccatgacaagtccgtgctgtaattctttaatgatagaatgggctcaccagaaactaccacttccagttcacttttaccttagtccaatctcaacaattttccatagcaagcgggctggtactaaaaaagttgatgatgtactacatgatccatcttatctgattgaagttgccaaatgtggacttttctttgttttaggtgttgaagcaatgtccatttttcatggcactgacattccttctcctgttgaacaagtatcattgacatggaagttacattccttatctgtcaatttccttgttggaatggagatacttgaacaagatcggagcagggttacttttgaagctttgcaggatctttatggtgagcttcttgataaggcaaggttaaaccaaagtaaagaagttatttcaaatgataaaaagcatcttgagtttctgaggttccaaactgagattcatgaaagttactcaacttttcttgaagaacttgtggagcagttttctgctgtttcttatggtgatgttatttttggccggcaagtttcactttatctacaccgttatgttgaaacttccattcgacttgctgcctggaatacactgtccaatgctcgtgttcttgagcttttgccacctttagaaaaatgcttttctggtgctgaaggataccttgaacctgctgagcatctgtcatga

SEQ ID NO: 57187 - DNA, 642 bp, Glycine max
  Peptide Sequence Number=SeqID_173965
atggcggcaaatcaaaattccacttctgctactcctacttttcatctgatttctcagaagttagatgattctaacttcttgctatggaggcaacaagttgaacctgtgatcaagtcccataaactccagcgttttgtgatgaatcctcagattccaatgcgctttctcacagaggcagattatcctattcttccgcgtgaacacctcgatgtgatacttgaaggccgaccggaggagtacagtccaatgatctcagtgatcaaaagtaattttgagccacttccgattggagaagtagagatgctactgctggtgcatgaggcacgtatgaaaaagtttcagaaacgcttggtggattcacctttgatcaatgttgctcaaggttacaattcctcttcgaactcttatagttcctcttcgaataacttcatttcgcaaaatcggtccaattattctggaaatcgcggtggaggtcaccgtggtggtggcagagatcgtggtggtcgttatgcaaactttcagtgccaagtttgctataaatttggtcacacagcagcaatgtatcattaccgctatgattctgagtatctttcaaggcaattcgtcgaacacctttggttcagaacagaatcagggaactaa

SEQ ID NO: 57188 - DNA, 741 bp, Glycine max
  Peptide Sequence Number=SeqID_173966
attctacttcaggcaacctgcttactttcaaattccagtgttgattctgttgttaatcctgtttctagtagttctaatgcacaaatttctgattccattgtaaatccagtttctcatgctatgtctgatgccaaaacagcacctagtactagctctcaaactatatggcaccttagattgggccatcctaatgctaatcttgttgtgttgtttcaagttccttaccctgttttgttcaataagtcacctgattacacctttttgaggaactttggatgctcttgctatccttttcttagaccctataacaaacacaagcttgagtttaggtcccatgaatgtttatttcttggctattccacttctcacaaaggctacaagtgtctctcacctaatggaaaactgtatgtttccaaagatgttgtctttaatgagcttaaatatccttacaatgatgtttttccatccttatccaactctgtcactccatctaagagtaactttttaccaactgctcatattcccattgtttcaccttctcctaatgaacccagtcttccctctcaaactgctgaaactaatcctccttctataaatgctgaccctcctattcccctaaatgctgaatccaccaattcccaaaatgtcacactatcttctccctttttgaatgctgaaccaacttctgtaaatgatgaacactctaacactgtttctgactttaaacagagattcaagtga

SEQ ID NO: 57189 - DNA, 1212 bp, Glycine max
  Peptide Sequence Number=SeqID_173967
atgggaaacagtatgcatagagtgatagagggctgggttggtatggcatttgatggagaaggaattacttcattggtatcatggtggcaacagttcaacgagatgcagcattggcgtccactgagcagtaaagggaatgatgatggtgagggtgatgataatgttgaggatgaagaagataaaaatttccaggagtttgaaaaagtttcagcctttgccatgccggtacaaaggaggaggaaaaagggtttggattttagaaaatggaaagagatcactcgggatgatagttcttccatggggaaggaaacagaggaagatgtgtcaagctttagccaaactacagggaaaaagaacaaaaagggcagtaagagtacatacaagaaaacctcatcttcagatgataatgtcatttctccgatgaaagtggatactaaaccactgttagataactcagatggtgggtttatcaattcaactacgactatggaagtagatacatcaaataaggtaaatcaccaggcaaaagttaaatacaccagaatttttgatgacaagggacaaaatgaatctgtgcctggattggaccaaatttcctctgataggatggctgattacaattttggatccctagatttgcaaaggccagggcaaactgacttgacttcaagcatgcggtcttgtcctagttccaatagtattagaagtgaaaaagagtctgtgtctcttgagagtgaaattgatgctgagaatcgagctcagatccagcaaatgtcagctgaggagattgcagaagcccaggctgagataatggagaagatgagccctgcattactaaaagcactacagaagagggggcaggataaattgaagaaactaaaatctgaagtgggtactggctcagactctgtgaatggacatgttcagagtcctcaggatgcaaaacatctgcacacagaggatggcatcactcaaacagtgattgcgccgccatccaaagaaaagctagatgatgagaaaattagcacaaagacttcaaccaccgctagtagtagcgcatggaatgcttggagcaatagagttgaggctgttagggagctacgattttccttggctggggatgttgttgattctgaacgtgtatcagtctatggtatgtgtttctatcttcttatgtttcttttctatcttttggttctaatatcaagatga

SEQ ID NO: 57190 - DNA, 525 bp, Glycine max
  Peptide Sequence Number=SeqID_173968
atggcgcgcaacggggaaaggaagaacagtgggcttggggaaaaaatggaaggagatacccttttccacgatggaaccaaccaagtgaaaggaatcgttttggtttatttggagggagctcgtgttcaccaccttcttcttgggttgctctcctcctttgcccttttgattctccattgtacaacacactggaccaatgcaacacaagaagaagcgaaacagaacagaaaaagtcagagagggaagaaaaagagtgaaactttggagggcaatattttgggcatgggttgcttgccgggagattttcttcctgcaccagcaatgttcttcatacatccagcgattatggttagaacgagaggattgcgttggggtttaggcagagctttaggtagagagaaacatactgagttgaagttggcatctcatgggaggaaggtcgagaaattaggaaggtctatacctcaaattgaaggtttagtggttgatacaagcttaagttcttttttcacacaaggaaactag

SEQ ID NO: 57191 - DNA, 681 bp, Glycine max
  Peptide Sequence Number=SeqID_173969
atgtatcctaagtgtacactatgcatacttaaacttgacactaaggattgtactaagtatctggggtcttcactacagaacaaacccatgtttccctttcaagacatatttcaaagcagcatccttttccccggaaagcatgctcaaatctctcagagtggacgcgtcaaactggaagaggactcgatttacagttcccaacttactgcacccatcacacttgatcaggaatcatcaagctgtgctctctctcttctgtcagatcagtcacagtatctgtcacaccacgcagcatgcaatccattaaccagtcatcgagtctttagtggcatctgcatacccaacagagatggtcaaatttccgaaactcctttgaggataagctctgcagataaacatgcaccaaatgagtcctttccatgtaatacaacctccaaggaggttatcaagaatagatccgctgcgacattttctaacactggtcatgctctccgagtccaccacggagatgatatttgccaaccatcagagttgctcgacgtcaaacaccatttttcctcggaacatgcagccacggttgatttgttccaactgtcctcacatcttcagagggtggagcagcaaagaaattctgttttggtgaagtgggaaaatgaggactactgtttcccaactgtgtga

SEQ ID NO: 57192 - DNA, 285 bp, Glycine max
  Peptide Sequence Number=SeqID_173970
atgcaggatttcattgaagacattgttgatgtcaaagctgatgataattgtggatatcgtgtaaacatggataagtatatgaatattatcaatatgagtgatgtcattacatcaaagtataacgacatccttgtttctctttctctccaacaaagcatgacatttttccttcttagaagtcaaccatcgagagatagttttgtgcattgcattatatgtattggtcatgtctatgacaatcattttgttcaggtttttttgagagatggttgtcctatgccatga

SEQ ID NO: 57193 - DNA, 477 bp, Glycine max
  Peptide Sequence Number=SeqID_173971
atggatgaagataagtggatatatgagagcattatgtctaaagaaattaatatgaatgaagacacaagagacaaacttgttgtggttgaaaatattgattgttttgatgtcttcaatacttctcagaggactggaaagtatagagcatacaagaaagatttagtaccgatggtgactagcactagaaaatatggttgcccttttaagctacgagcgaaaccagttccgggaggtgaatggtggatggtcaagttaatatgtgagactcataatcatacattgactaagtcattgagtggacatccatatgttggtcgactaactaaggatgagaagattattcttggtgatatgacaaagtcaatgggaagtcttgtggattgtcctactaagatagagtatgatgactgccttacgaagtttgaaattgcttgttcactatggctaatgtttgttgactacgtgaaagacacatga

SEQ ID NO: 57194 - DNA, 837 bp, Glycine max
  Peptide Sequence Number=SeqID_173972
atggaatcttggagttatgtccctgaagagaaaggctatttgttttctgatgaaatggagttttcacttgatgctttcatgagaagtagaaaggcattggttgaatgggacaacaaatccaactttgttgagagagatggatttaattcagacagagaggtagttaaaagcatggaatttgtggatttgggattccctgacttgttgcaaaagtcttttcatggaagcctgcctctagagacatctagctatgaactcgatagtaataattctagtaaaagagggaattcctccacacatgtcattgctttggattcttctatgggggaagaagaatccaattcaaagcatttaagttctctagttgagtccaagactcaggattcttcactgattgatctgaaactagggagattagcagattgtaaaggtgcaagcagtgataaagttgagaaagaaggattcactttaacttccatacatccgaccacgctttcgaagagagctcgcacttccagcttgcctgcacaggctcctgtatgtcaagtttatggttgtaacatggatcttagctcctcaaaagattaccacaaaagacataaagtttgtgatgctcactccaaaacagctaaagttattgtaaatggcattgaacaaaggttttgtcagcagtgcagcaggttccatttgcttgtcgagttcgatgatggtaagcgcagttgtcgcaggcgtctagcaggacacaatgaacgccgaaggaaaccccaatttgattacatgactggtaaacaacacaagattcttcagtcatatcaaggtatgaaaaatgcattctga

SEQ ID NO: 57195 - DNA, 381 bp, Glycine max
  Peptide Sequence Number=SeqID_173973
atgatggcacatcaatctgatagcaacacccaggaagagacagacacagtacctcaggtccatgaaggtaggcccaagagaggcaccacatgtcctgtccacttgaagaactatgtaacacctgagtccaaaaaaggcataaccaactcatgtagcaaagtattgaccaagcttgtgtttcaagatagcatgacatcacaattgcaattctcaccaacaaaatcatcaacacagcaaagcatacaaaaatatcaaggaaatgtatcttcatcaggtcgtacctcgatcaagtcgtacctcagtatatgcaagattacgtctagcaagtccagcaaagcgactgatgacgtagcaaacaaacctcgtacctcaatcagctga

SEQ ID NO: 57196 - DNA, 147 bp, Glycine max
  Peptide Sequence Number=SeqID_173974
atgttgtggcttgttctaaacgagaaaataccagaggaagaaagagcaataacaatgaataatgagaaacttgatcgattacaagtggcaatggtgcactatctacccacgcttgccacgtttaaggctgccctaaggtggaagtag

SEQ ID NO: 57197 - DNA, 231 bp, Glycine max
  Peptide Sequence Number=SeqID_173975
atggattacctaatcttgaacatgaacagtcatgatgatggctttcccttctctattgaagatactgtgctcattatccatggtgctgttctacatgtcccctacgcctgcacccgatcgacgctccgtgagtttagacggtgtttcttgaagaagagaatcatcgacgtgagggaagagtcgcgagttcaagaatgggatttcaagaactttaaggtgaaaagaggatga

SEQ ID NO: 57198 - DNA, 198 bp, Glycine max
  Peptide Sequence Number=SeqID_173976
atggctctatgttggtgtttgggggaaggagaaaggaagaaatataaaaataccagcagcaatataactacaaaatcagaaaaaggcgaaattaaaggttctcacaacatcaaagatgctgctagccaagggcaccataaaaatgaaaaagctagaagcaatgatgaaatcttgtacatccacaaaagcattgcatga

SEQ ID NO: 57199 - DNA, 611 bp, Glycine max
  Peptide Sequence Number=SeqID_173977
atggcgcattgctcacttttcctctctctcagacgaaatagcggtttggcttgtctcctgaaccgaacaagattcgtgtcttcgggtgctgtgagcagtgatttggtggaagagagtgtggaaggtgttgatgatgacctaaggagcagaatcttcaggcttaggctccccaagcgaagcgccaccaacgttcttcagaaatgggtcctccaagggaatcctgttacgctctctcagcttcgggatatatccaaagagcttcgaagatctcaacgttacaaacacgctttggagacaattgcaacctatgcggtcccaattgcggtcacgatatctgagtggatggttagccatgaggaatacgagttatcagactctgattatgcagcccgcatagatttgactaccaaagtttttggcattgatgctgcagagcgctactttgagggtctacctcttgctacaaagactgctgaaacatacacagcactcctccattcttacgcaggagcaaaattgactaaaaaggctgaggaactttatcaaaggataaaggattcaaacctttcctttgatgcccttacttacaacgaaatgatgactctttacat

SEQ ID NO: 57200 - DNA, 225 bp, Glycine max
  Peptide Sequence Number=SeqID_173978
atgatgaaaaatgtggaagaaaaagccttgaagaaaaagttggaagaagtggactcttgcttagcgagcaagttcaggcttagtgttcagctcgctcagcgtgcagcccaagctcagcgcacagtctcgctcagtgtgcaaccttggcttagcgtgagaaggcccacgaggaagcccaaggcatgcttagcgtacaaatacgcgcttagcacgaagtcagcatga

SEQ ID NO: 57201 - DNA, 451 bp, Glycine max
  Peptide Sequence Number=SeqID_173979
atgttgcgaagatggagcaaagcagttactccaatctccaaatttggatcgcagcagagtcatttgaatttcgtgaaggacgtcacgcgccaaagctacgccggggttgcacccgcgccaacaacgatagaggataaacctcaaccccccgtgcaagagggaaatgagggtgttgaatttggccagtacctttatgagatttacaatcatgatgtggagctaagagtctctaaagctggagttaacctactactgactaagtggatgaaagagctcgagaagattttttatgggaacattgttgcttatgatactgccatacttccagaagctaaaccgggtgatttttctaatgttatatggaggaatatattctctgaagatggttcttcaacaccagatgctgctgcatctcaatcagtacagacttttgggatgggactattccctg

SEQ ID NO: 57202 - DNA, 1854 bp, Glycine max
  Peptide Sequence Number=SeqID_173980
atgggggtagcaggtagcgactgtagagaaaaggaagggaaggaagtggtttcgaggaaagctccaattgcctcagccctaaaacccaaggctgctgagtgttgcagaggcatgtctgagtcggacacgaagaagaagaagcagcagcagcgcagcggcggaaagcatgaaggagaagaagggttgatgatcaagccccagagcttcactccccccatcgacacctcccaatggcccattctcctcaaaaactacgagcgcctcaacgtccgcaccggccactacacccccattccctccggctactcccccctgaagcgccccctctccgagtacctcaaatacggcgtcctcaacctcgacaagcccgccaacccttcctcccacgaggtcgtggcctggatcaagcgcctcctccgcgtcgaaaaaaccggccactccggtaccctcgaccccaaggtcaccggtaacctcatcgtctgcatcgaccgcgccacccgcctcgtcaagtcccagcagggagccggtaaagaatacgtctgcatcgcccgcctccactccgccgtccccgacatctccaaggtctcccgcgccctcgaaacccttaccggcgccgtcttccagcgtccccccttgatctccgccgtcaagcgccagctccggattcggaccatctacgaaagtaagctccttgagtatgaccctgataggcacttggttgttttctggatttcctgtgaggctggtacctatgttaggactatgtgtgttcacttagggttgcttcttggtgtgggtagccacatgcaggagcttaggagggttaggtccgggatcatgggggagaaggataacatggtcagcatgcatgatgtcatggatgctcagtgggtttatgataattatagggatgagacttatttgaggagggttgttatgcccttggagattctcttgactagctataagaggcttgttgttaaggactctgctgtcaatgctatttgttatggtgctaagttcatgattcctgggttgcttaggtttgagaatgatattgatgttggggaggaggttgtgcttatgactactaagggtgaggctattgctcttgggattgctgagatgactactgctgttatggccacttgtgatcatggggttgtggccaagatcaagagggtggtcatggatagggatacttatccaaggaagtggggtttgggacccagggcttccatgaagaagaggcttattagtgaagggaagctcgataagcatgggaagcccaatgagaagactccacaggagtggcttaggaatctggttttgccaactggtggggatagcatgattgctggcttggctgctgcgccagaacctgaggacgacaagcttcagaagaaggaggagggagatggggaagggaagaagagaaagaagcatgaaagcacagatagcctggttgctgttcctgctaagaaggcgaaagtggtagatgaagtggaagagcttgaaaagctagaaaaggtgaaggtgaagaaggtagatgaagagactgtggaggttgaagttgagaagaaagagaagaagaagaaaaagaagaaggataaggagaacagcgaggtggcctcttcggatgaggagaaaactgagaagaagaagaacaagaataagattgaagatggttcgccggagttagacaagtctgagaagaaaaagaaaaagaagaaagacaaagctgctgccgctgctgctgaaattagcaatggaaaggtggatgacagtaatgctgataagagtgaaaagaagaagaataagaaaaagaaaaacaaagatgctaaggaagaatag

SEQ ID NO: 57203 - DNA, 1212 bp, Glycine max
  Peptide Sequence Number=SeqID_173981
atgggtctgcatcatcatcatcacagaaagttgatgccattgccagaaaaaatctgcgggttaatttgtcatgtgaagaagtccgagccttgttcctcagattgcaaagtttgccttaagatctgtctaaccaatccccaatatccttctttttattattctcctccaccaccacaagttcctccttttcaatcatatgatgatgttgttgatggcgcagatcaagcatacaaccacaaaatctccacctatttgttccttgcacttgctcttctaactgctgctttctttgtcgtttcttgtcgtgccatctataccaggtttagctcaaggaggagggtatcatcaccatcaacatcaaggcgccaaacccaaacacaccatgatgatgatgattttgttgatgatgaagagcatcatggccgtatggttgaccaccccatatggtatatccgcacccttggccttcagcaatcaattatcaatgccatcacagtttgtaagtataagaaaggagaaggtttgattgaaggaacggattgtgctgtttgcttgagtgagttccaagaggatgagaatctcagacttttgccaaaatgtcagcatgcttttcatcttccttgtattgatacctggcttaggtctcataccaattgtcccatgtgccgggctccaattgttgctgagattgagtcttctagttttgttgattcaaattccttggaaaatagccatatggaagttttggagaatagtgctcctggtggttctgaattgatgaataataatagggtagaggaagtaggccaattggaagaagttgttgatgatgatggagtgagggtttgtgaaactgaaaccccggttgaagatgtggccgcaagcattcgtcctagaagatctttttctctggattctttttctgttgcaaatttcaatcttgctcttgcaacagcagaatcttatggcaactcaaaaagagtgcagggaggtgtggatgatattgatgatcctactgcttcaaagggggttattggaaactatttggcaacttcttccaaaggtagctcctctttcaggttaacaagatatctgcagcagggtattcctagttcttcagtgaaacggtcacagtccttcaatgggaaataccttctatcccggtatggccgcagtcagaagaagccaaatgctcctctgagaagcttttga

SEQ ID NO: 57204 - DNA, 447 bp, Glycine max
  Peptide Sequence Number=SeqID_173982
atgtcgttagtcaaatatattgacatgcgacctctccacgcactagtgccaccatcaaacaatgacccacaccaccaaatcacaaatcgcaacgccaacacaccaccatggcacaaacatagtgtgcaaacaccgccaccatctgaagaaggatatggagatgggggttgtgagttgcaatgcgagcgtggcctccctttgctcctcaatgtgggcagcagcagaggattcacacttcaggatgaaggtcttgtggaggtggacaaattcgagggtttctttggaaagggaattgaaagattgagatttctcagtgacagagtgttggagggaggaaaagtgggtggagagggtggtgaagaggtcggtgcatttggagagaatggttttcttcgcttcgagttcatcgaagaattggtggaccccgtcgccattggagagtgctaa

SEQ ID NO: 57205 - DNA, 443 bp, Glycine max
  Peptide Sequence Number=SeqID_173983
atggataagaggctcgtgggattacacgagggctttgtctacaacaaggaagctataagtaatgcaactaggatctcatggagagttcgatcctgcctcaggaagaacgctggcggcatgccttacacatgcaagtcggacgggaggtggtgtttccagtggcggacggccacactgggagtgagacacggcccagactcctacgggaggcagcagtggggaattttccgcaatgggcgaaagcctgacggagcaatgccgcgtgaaggtagaaggcctacggcatcggctaactctgtgcccgcagccgcggtaagacagaggatgcaagcgttatccggaatgattgggcgtaaagcgtctgtaggtggctttttaagttcgccgtcaaatcccagggctcaaccctggacaggcggtggaaactaccaagctggagtacg

SEQ ID NO: 57206 - DNA, 267 bp, Glycine max
  Peptide Sequence Number=SeqID_173984
atgctccactctgcagcagccattaacgaaggaggagaagcttacctcgatggtagaagtggtggagacgtctcaacggaagcagccaatgcgcgaaaaatgaaccaacaagtagcggagatgtcctccaatgctcacgctcaagaagagaagaagccaatagaagtgatttctattgaattgtgcaaaccagtcaaattgacgatttcctccgttcaaggtcggttcacttgcatagcagttttggaggttaaccaaactagatag

SEQ ID NO: 57207 - DNA, 846 bp, Glycine max
  Peptide Sequence Number=SeqID_173985
atggtcgatgccactcgatccaaaaccaatgtcgatcattgggaggatgcctttgctaagctttcctcttccatgaccgccaagatcgacgagcttcttcactgcataactcaattggaaacgtcgcacgctagttctcacataccatcacctttccccaggtcttcatctgcacctaccacgaaccctgctaactatctaaaattggaggtccctcgcttcgatggctctaacccagaggggtggatattcaagatcacacaattctttgaatatcatgcaaccccataccacgaccgtctcaccatcgcttccttctacatggaaggctttgcattagcctggttgagccccattattcgacgggaggtgcaagtcatgcagcctcactccttggctcaggaggtttccttcgtgaagattcatgagaagttgttagatagtcgtcatccttctgttcgaccccctcctactcctactatttccttcccttcacgttccttacctccaccctccaccaaccctcttgaaccacccttgcttcctgcttcggccaaaccacactcaaccaccattcctttcaaacgattatctccgactgagttggccattcgccgtgaaaaggatttatgctttaattgtgacgagaaatactctcaagggcataagtgtacttcctccttgttcttgtttgttacaaaagaagatgagtgtctccaggactccgatccgctccctcgtcgccaactgctcttgctgcttctcaggactcgtcaccgacgcagatcagtctccatgcattttcaggccacagggctctggaaactttacgtgtcaccgacttaa

SEQ ID NO: 57208 - DNA, 1695 bp, Glycine max
  Peptide Sequence Number=SeqID_173986
atgtcttgttatgaagaacgaaggagtgaagagagttcaagaatagaaatgggaagaggaatgtcaaggaaacagaggaggtgtggggacaaatctttcaacctcagcactaaccaatttgcggatcttcatgatgaagagtttaaggctttactaactaatggtcacaagaaggaacatagcttgtggacaacaacagaaacattgtttaggtatgacaatgttactaagatcccagctagcatggactggaggaaaagagagcaagaactagttgattttgtgaaaggtgagagtgaaggatgctatggtgattatgtggaagatgcatttaaatttattaccaagaaaggtagaatagaaagtgaaacacactacccctacaaaggagttaacaacacttgtaaggttaagaaggaaactcatggtgtagctcaaattaaagggtacaagaaagttccttcaaaaagtgaaaacgcactcctaaaagctgtggcaaatcaacttgtgtcagttagtgttgaagctagagattctgctttccaattttattcaagtgggatttttacagggaagtgtggaactgatacagatcatcgtgttgcactagctagttatggagaatctggtgatggtactaagtattggcttgcaaagaattcatggggaactgaatgggacgttgttacccttactagaagcagccaagaagcagcaaaccagataaaccgaaaagatactcactgggaggttctgttcctcgttctcactgtgtggatatcccgtgtaatgtctcgcgggctcattacatctgagagacatgagaaatggatggcacaatatggtaaggtttacaaggatgctgcagagaaggagaaacgtttccaagtattcaaaaacaatgtgcagttcattgagtcattcaatgctgctggggacaaacctttcaaccttagcattaaccaatttgcggaccttcatgatgaagaatttaaggctttactaaacaatgttcagaaaaaggcaagtagggtggagacagcaacagaaacatcgtttaggtatgagaatgtaactaagattccttctaccatggactggaggaaaagaggtgctgtcactccaatcaaggaccaaggctacacatgtggaagttgttgggcatttgcaactgtggctactgtcgagagtctccatcaaataactacaggtgacagtgaaggttgccgtggtggttatgtggaaaatgcctttgaatttattgctaataaaggtggaataacaagtgaagcatactatccttacaaaggaaaagatagaagttgtaaggttaagaaggagactcatggtgtggcacggattatagggtatgagagtgttccttctaatagtgaaaaggcactcctaaaagctgtggcaaatcaaccagtttcagtttatattgatgcaggagcaattgctttcaaattttactcaagtgggatttttgaagcaagaaattgtggaactcatctagaccatgctgttgcagttgttggttatggtaaacttcgtgatggtacaaagtattggctagtaaaaaattcatggagcactgcatggggtgagaaagggtacatgaggatcaagcgagacatacgtgccaagaaaggcttatgtggaattgcttcaaatgcctcttatccaatcgcttaa

SEQ ID NO: 57209 - DNA, 753 bp, Glycine max
  Peptide Sequence Number=SeqID_173987
atggataagattgctagctctctctccttagagcttctcaaagagccagactcagacgctctctctgtctcgcagcgcctcaacatgagcttctcccacatcattccagcccccaatttaattctccaaaccctaaacctctcccttcaagctggcctgcaaaatcaacatgtatcacaccctacaacatttttgggagttcctaagaacaatcagagaaaaaggaaaacaccatacatattagttgtggttgttgtgactcaaggctctgctgaatcaagcaagtctgatgaaaaaatcccttcgtgggccaaatcggactctgatgaaccaccgccatgggcccaagacaagcccaacaacaacaagaaaaaggaatcgcacgaagacaatacaaatggaggtttcaatcccttctccttctctctaatgtttaagaaccctaagagagcaactggaggaggagctttagagagcaccaaaaatgccacaattgataacggagaactcttgagtgactatatcgagataatgaatgagttattcacaattgagtatggggttatattgaacaagcttttaactggaaattacccatatgttgagacaaaatatggtcccaccaagattgtcatggaagttgtggagggtaagctacgacctaagcttccgtgtgatgatgttggccaacttggaaccagagagattgaaggcgctttgcatccaatgggcaaaatactatttgatagttaa

SEQ ID NO: 57210 - DNA, 498 bp, Glycine max
  Peptide Sequence Number=SeqID_173988
atgaaagagctgacaaagatcgttgattgggttcaagaaacaggtccaagtgtgctccctgttttctatgatgtcactccttcggaggttcgaaaacagagtggacagtttggagaggcttttactgaacacgaagaaaggcctcaaaatgaagaaattgaaaaaattgttcaagaggtaatcaacatactaggttataatcaaatttcgagttttggggatgatttagttgatatacattctggtgtgaaacgaatggaagattttctagatctggacgcaaatgaagttgttctagttgtaggaatttgtgggattggtggaataggaaagatgacacttgctcacttgctactgctttatttaataaaatctctcctcgatatgatgcttgttatttcattgatgatgttagcaaaacttatggagattttggagcccataggtgcacaaaaacaacttcttcgtcaaactctaaccaaggaaatattgagataa

SEQ ID NO: 57211 - DNA, 255 bp, Glycine max
  Peptide Sequence Number=SeqID_173989
atgagggggacttggcttggctccatcttaggaaggatagattccctactaagagaaaatccaagcttagtcctagaggtgatggaccttttcaggtcttggaaaggatcaacaacaatgcttatagctgatgctgaggaggaggaaccaacaaatttgaggtcaaatcctcttcaagggggagggaatgatgtaatcctccctaggaagggaccagtcacaagagccatgagcaagaggctccaagaagattag

SEQ ID NO: 57212 - DNA, 111 bp, Glycine max
  Peptide Sequence Number=SeqID_173990
atgtctacaacttctgccccatggactaattgtacattcaactacaatgtttgggcagagagtaccttctctgcagcgttttgtctgttaggcgaggttatagtcttatag

SEQ ID NO: 57213 - DNA, 399 bp, Glycine max
  Peptide Sequence Number=SeqID_173991
atgaagagtccattaccaccaatagcaagcgatgatgatgtagaggacaaaaagatgaagaagaaggcaaatacggtggaaaacgatgacgacgtggagcacatggaggggctggtgcatttcaacgacaaccttctatttaaggtgttgaagcacatggacgtatggacgctggcaatgtcgaggtgttcaatggtgagccttgacagaagcaaggacttggtaacgatgaatggaacaatagatgtgaagaagatggcacctgcgctaagcgagcagagcgcgctaagcgcgagtacgcagacccaagtccactctagcaactataaaaagggagtcaagccaaaggaaacagacacaccgaatcttagaacactctcatacatacctaaagcctga

SEQ ID NO: 57214 - DNA, 1413 bp, Glycine max
  Peptide Sequence Number=SeqID_173992
atgcacggttctatagattggtatcaaaatgatgatggatatctatggcgtgttagagatagagatacatatccaataaagaaccaaatggttcttatttaccctcaatcaacaaagtacattgctacacaaaaagatcctttctcatcacaatttgatttattcagaaaagcaatttcctcaccatcgtataatgtattaatagtatgtggatatagctttggcgatgaccacatcaatcaagaaatatctctatcaatgtcaaatccggataacaaaactgttctcctcgctttttgtcaagaggtaggaaataaacttccagatatattaaccacttggcttagagggagtgatatgatgcaatttattccaatcgaagaattaaaaataggtcagatagttgaagtttccggtacgaaagtaagggttgaactatcaaataaagtagaagaattaactagaagctatgaaggtaaagtctatccaatagggcagcttggtagcatagtaaaaattcactttgggagaaatattatatttggatttgtcacactgcttagaatgaggtctgatgaaatacaaactaactcgctaccaatacctcctgaagcagaccaaagaataatggaagtcgagcttttttcacatggacaatggtcacaatccacccagaaactaagtttcagccgtggagttaaaacatatccacttcctcaacaaggtgtatatttacttacacaaaatgaatcttcaggattattttcggctgccgaagacattagagaagatgagtataatccattggttccttttgctagctatactagtgcaacatcaatcccatgccgagcaaacattgataaactatttggattacattgcgcaattttgggttcaacggggtcaggaaagtctggggctgttgcaacattattgcatagtattttagatcattcatgtatatatggaaatgaaatagcaccacggattattatgatagatcctcacgatgagtatggctcagcatttttagatagaggcataacatatcaagcatatagcaccatagataagaatgataaaattgatataaaattaccatattggcttatgtcatcagatgaacttagaactcttatcattggaaaaactgagaaagaagcaacctcacagaataacattatatataaagctttagcccatagccgtatggtttcagtaggtttggtatccccagccccaacaaattataactggaatatccctgatgataacttacctttacatgatcctcgcccaaaagctggtagaactttcgaggagataatgtcatttgactctgacaaaccaatagcattttcccttatagagttcgaaaaccatatcagatatattcaagcatctagaata

SEQ ID NO: 57215 - DNA, 228 bp, Glycine max
  Peptide Sequence Number=SeqID_173993
atgacttattgtaaacaaatcatatcccacacatacatatatagaggaaatcatgttggtgacatggtggtcatgacgatgatcacactggtgatggaaatactggtgacaactatcatagtaatggttgcagttgatggtggttgcgataagagtcatgatagttgtggcaaaaacgatcatgacaattatgatagtcatagtggtgatagatttgagatattttaa

SEQ ID NO: 57216 - DNA, 150 bp, Glycine max
  Peptide Sequence Number=SeqID_173994
atgaaggccttggtggagggtcatggggttggggttgtccaagctgaagaagctggagacaagggtcatgggatcaaggttggcgctgccggtggcaaagaaaaaggcctcaatgtggagggatgtgaaggaaacgtgatggttggttag

SEQ ID NO: 57217 - DNA, 537 bp, Glycine max
  Peptide Sequence Number=SeqID_173995
atgttgtggtacagtaatatctctcctctagctgaatatctaggatttaaatttgtaattgattgccgaatttgtggtgatccacattcagttctccgttttgcttttgttgagtttgcagatgagtatggtgcaaggactgctctaaatcttgggggtaccgtgcttggatactatccggtcagggttcttccttcaaaaactgccattcttccggtgaatcctacattcctccctaggtcggatgatgagcgtgaaatgtgtgcccggactatctattgtacaaatattgataaaaaggtttctcaagctgaagtgaagaatttttttgaatcagcttgtggcgaggttatgcgccttaggcttttaggggaccaagtgcattcaactcgaattgcttttgtggaatttgcaatggctgaaagtgccattattgcactaaactgtagtgggatgctcttggggacccagcctataagggtgagtccttcaaagactccagtgaggccaagggtccctcgtccggcatctcattaa

SEQ ID NO: 57218 - DNA, 519 bp, Glycine max
  Peptide Sequence Number=SeqID_173996
atgcaattgtaccctacgatcattgctacttgtagtaacatagtgggattgtttgtaagtggagattggaaaactctggaaatggagatgaaggaatttgaaaatggtaacttggaattgaccataactccattccttgctttcatggtctttcatgacaagattaatggggttaaggttatagccttcttgttagctatatggggctttttgtcttatatgtatcaatattacctagatggcacaaaggccaaggaagataaaagttcatacaaagagaagttagcacttgcatcaaaagaagacaatgtccaagttgaacaacatctaggtgaaagtgatagtggaagcaatagtgacttggttggaataagtttaagtgatctaactttatatgcatttgatattgaaaatttggttttaaatgacaatgttgaagatcacttctcaaacgaggaagagtttgaagataatggagatgaagatgatgatggtggggtgatattggatatgatttaa

SEQ ID NO: 57219 - DNA, 315 bp, Glycine max
  Peptide Sequence Number=SeqID_173997
atgtcattgaaatggaatgttgatgatgttggaaatgcattgacaagtggatgttgtgtatgttcgtggggggcggagtgcactaaccttgtcggatggcccattcgtgggggacaagcgtggttaaagaatctaagcatttatgaggggatgcttaggcgctttaattgggggtgcattgaccttgtcggacgtcccttgtgtgggaaactaaagtggttaaagaatccaagcatttctgaagggatgcttaggagctttaattcatctatggttattgtacttgatggtgcccatgtttcatacctcatatga

SEQ ID NO: 57220 - DNA, 273 bp, Glycine max
  Peptide Sequence Number=SeqID_173998
atggaagaaaaatggattgaaacggatcgtcaacgtgactctcacgctaagtgtgtatgtccagctggatcaagtggtcgtgcactatgcacaggatgtgtgctcagtgcgcttgcttgtgacagttgtcttccaatgtggctccttgtgctaagcggctggcttgggctgaatggttatgactcgctgagcatgacacttctattcattcatcttctttcatgtctttgctataactcaactctacacaaaacacaaccaaaattactctaa

SEQ ID NO: 57221 - DNA, 177 bp, Glycine max
  Peptide Sequence Number=SeqID_173999
atggaggagcaaaggaggccgatagcgagggccccagatcaaaatgcagtgatcattggggaggtgttggcaatatggctaaggacaaaggcactagagctcaaagtgggaggtggtggagctgagagggagattgagaagaagagcgttgaacatagatgttttttttcttcttaa

SEQ ID NO: 57222 - DNA, 453 bp, Glycine max
  Peptide Sequence Number=SeqID_174000
atggagaaggtgaggtggaacgtgccatcgaagaacaagaggttgtgcggatcagcatgcttgacgagcgacagggactcaaggatctcaaaaccagtgacatcgtggatgtcaaagcggcggagcatggcgaccttgtggctggagctgacaaagacgcagaggacacgagagtggttgaaggcggtgaaacaaaggaggaggtggtcacgaaagaggaggaagaagaagaggagtggattgaacgtgcaaggtgtgcttctcggcaaggacatggggtgcgtggaggagaagttgcaggtgtcgagcatgcagaggaagaggaagaggagcgtgagagaagttactgcgattgctacgaaggagaggcacttaaggaatttgacgatgagtcttccttcttctcctccccccagcttcatgtttttaggatctccttatcatctcctttaa

SEQ ID NO: 57223 - DNA, 210 bp, Glycine max
  Peptide Sequence Number=SeqID_174001
atggtgtttggtcacgcggtggtggttggtcgcagtgatgtgcgcattggagaaagggtggttcgtggtggagttgtcattacggtgttgctggtaatgtttttgtttttcgaatttggacctttccttcaagatttgaaaagatgtagttgttggtggttctttggaggtgatggaaaacgaaaatgtagtgtgcttggaagcggttga

SEQ ID NO: 57224 - DNA, 270 bp, Glycine max
  Peptide Sequence Number=SeqID_174002
atgcctcaaccagaccaacaagggcaaatttccccatttggggtacttttaaaaagtatttccccagatggggttgttttaaaagatattccggcagtgggcacttttgcacgtaaagtgcatgcatggcccaagcaaaccgtcagtgagattgacgagttcgttgtcgatgaaggactcgccactgcgaatggcgatacgcacatgcaaggtgaaggactcgccactacgaatgatgatatgcacatgcaaggggaaccgccagtttga

SEQ ID NO: 57225 - DNA, 282 bp, Glycine max
  Peptide Sequence Number=SeqID_174003
atggaaacaagtctaaatgggttccttggttttgatggctacatcatcaatatcaggcatgaccttgacgacagtggcattagtgtcgacctagatggcaatgtgacagttggcattaaagtggatctcttggtgtttggtagtggcgatgctttcaagtggtggatggtgggttttggacttttggttggtatggtttgtggtgttgcttattctgttttgcttaagaagacaataaggaaggtggttccaagcgtgatggtggcactagtggtttggtga

SEQ ID NO: 57226 - DNA, 606 bp, Glycine max
  Peptide Sequence Number=SeqID_174004
atgtcagttatcctaattgcactcaaccctgaatctgaggacacaaagcaccatcccaaagagaagcaaataattgggatcctctgtgccatagtctcatctgccacgtttgcactccatcactctcttgtgcagcgttgttttgagaaagttataaagactaaaacctttgctactgtgttaagaatgaatttttacccaatgctcgttgcttcagtttttggcagtgtggggttgtttttcagtggagattggagaactatgggaatggagatgaaggaattcgaaagcggtagtgtgtcatatgtaatgactttggtttggactgctgtggcatggcaaatagccggcgtttctatgttggggttgatttttgaggtatcttcattgttctcagttgtaataagcaatttggaactgaccataactcctatccttgctgtcattgtctttcatgacaagatttatggggttaagattatagccttcatattagctgtatgggcctttttgtcctatatttatcaacattatctagatgaccgaaaggccaaggaagataaaagtgattgcattaaggtttcaatgggaaatggagaaatttga

SEQ ID NO: 57227 - DNA, 218 bp, Glycine max
  Peptide Sequence Number=SeqID_174005
aactcgctaagcgcgcttatcacgctaagcgagttcatcctttgaggatgaacaatcatcctcttgctgaactacctatggctaaccgcacgctaagccgagctttcctgggccaagcgcgattggttgcagcatccgttgagctaaaagagttggtgccgctaagcgcagcctttaaggagcttagcgcatatccttgcagcaaatgttcagcttag

SEQ ID NO: 57228 - DNA, 291 bp, Glycine max
  Peptide Sequence Number=SeqID_174006
atgaagaataaatacaagatacattatatagcaaaagggtgggtgagacatgctgtgactcactgtccatgccgccattcgtactggcaggacatgctgagtaggaaagatgctgatctcgccagtccttcctgcgagacacgagcccatgccgccattggtactggcgggacatgccaacgtggacagtcccgccattggctccagcgagacacgttcacgccatgcataggtttgaagatgccactgttgatgatgagactgaagcatttttttcgtgatgcaggctag

SEQ ID NO: 57229 - DNA, 161 bp, Glycine max
  Peptide Sequence Number=SeqID_174007
ctgaggcagatgtggagctaaagtgcctcaacttttacaacccagatgacaccattgaaggaaagtttgttactaagaagaagaatggtgtgcttgctgtccagctttcggccatggacctaggtggttgcaccacaaaacaaccacagggccaaccctaa

SEQ ID NO: 57230 - DNA, 243 bp, Glycine max
  Peptide Sequence Number=SeqID_174008
atggggctccggataagattcgttggtggaggatgcacgaacaacgctaggcaatcaattcgtggggctccagactcgatgcgcttggcaatcaatttgtggggctccaaactcaatggtggaggatgcatgaatgagaatcaattcatgaggctccggataagattcgttggtggaggatgcacgaacagcgctaggcaatcaattcgtggggctccggactcgatggtggaggatgcatga

SEQ ID NO: 57231 - DNA, 372 bp, Glycine max
  Peptide Sequence Number=SeqID_174009
atgttgtcgaatttggatggtattggtgttggggtgaaggcagcacagtgtgtttgggtagtggactttgttgttttactacttgtttattatacattggtgcgagttgggttaaggttcgagggggaaagggagctttgggttcgttgtggtttgaataggattaaggttctggtgagcacattcgaggtaggggtcgagtgtcttcgaatggggggctcattgtggtgggaagagatgaggaaggagtggagggaggagtgggtgaggggagaggaggggccaaaggaaggagttgacaacatgaagagagttggtgaagagggtggattagaagggaagggagaagtggcagagagagaaacgtcttga

SEQ ID NO: 57232 - DNA, 1341 bp, Glycine max
  Peptide Sequence Number=SeqID_174010
atggaggtggttcaagagcagcagctacaaaatacagatggaagaaaattgcacaactcagacagaaactcaaatgtcacacagcaacttcaacatccaagattcagaaaatacaaatggtggctacgtgtgtccctctacataatctttcttcttgtaggccaatctgcagccactcttttgggaagattatactatgacaatggtggtaatagcaaatggatggcaacatttgttcaatcagctggattccctgtacttcttccactccttttttacttcccaagacaaacacatgccaagtttaataacaatcccagcaataatgattattcctacaaaacaaaaccaaaattctccacccttgttttcctctatctagcttttggcctaattctcacaggggacaacttgatgtattcctatggacttttatatctccctctttccacctattctctactatgtgccacccaattaggcttcaacgcggtgttctctttcttcctcaattcccagaaattcacagcattcataatcaattctgtagtcctccttaccatatcagcttctctgcttgcaatcaactccgattccgacgaggactcaaccggtctttccagagaaaagcatgtaattggattcttctgcaccattggtgcatcagctacattctctttgtacctctctcttgtgcagctttcttttcagaaagttataaagagagaaaccttttctgctgtgttggacatgcaattttacccatccttcattgctacatgtgcttgtgtagtagggttgtttgcaagtggagagtggaaaagtttgaacaatgagatgaagggatatgataagggaagtgtgtcatatgtaatgactctactttggattgctgtgacatggcaaatatcctcaattggtaccttggcattgcctattgttcccatccttgcaattgtattcttccatgacaagatcaatggggtgaagtttgtagccttgttgttagcagtgtggggctttctgtcttatgtgtatcaacattatcttgatgacaaaaaagccaaggcagagaaaagtgatggccttggggtttcaaacagtgagggacgtgtaaaaacaggggaatgggtatttctcgattttgtgttggcggatttttatcttttagtttgggaactgtatatttgcttaagtaactggggcacttttgcacgtaaagtgcatgcatggcccaagcaaattgccaatgggactagcgagttcgctgtcggtgaaggactcgccactgcgaatggcgatacgcacatgcaaggtgaaggatgcaaggtgaaggactag

SEQ ID NO: 57233 - DNA, 255 bp, Glycine max
  Peptide Sequence Number=SeqID_174011
atgcctttgctcttcttggtgggatctggacgttcttccttattttctgaatcagatagcagctgggtgaatgcaaccaagttcttaaccggggcctctgctgttggaagcattgccattccagccatattaaagcattctggtgttataggttggggagcctttgcaatggaactctcttccttctttgtgtttgtatttgcaatattgtgttacattcggattaatgatgaagatgattatagtagtctttga

SEQ ID NO: 57234 - DNA, 540 bp, Glycine max
  Peptide Sequence Number=SeqID_174012
atggttgaggtcattagtaacataagattagattcagtccgtttgaaagaacttatttatatttttgtgaaagggtaccattggtgtgtggatgctgaagaggcgcttgacaaagacgaggagagtgaaggtggatctaaagtgggagtttgcttcgatttggggttcatgggtttgccttatcattgtgggcttaatggagttcacactaaccacgctttgtcgtcacaacaaagacatcagcacgatctggatctagatttggagaggaaggttcaagataatgatggtgttggtggtggcagtggtggttgcaacgacattggtggtggttgtggtgacaaaggtgatggtagtgacagtgacaataatgatgatgttggtaacgataatggtggtggtagtggtgctagtgtcatggtggtgatagttagttttggcggtgacaacgatgttgatggtggtagtgtggtggtggcaatgacgaagatgatattagtggtggtgatgatggtagcggtggtgtggtggtggcaatga

SEQ ID NO: 57235 - DNA, 445 bp, Glycine max
  Peptide Sequence Number=SeqID_174013
atggagctattaaaagattatgattgcacaatcttgtatcatccaggtaaagcaaatgtagttgttgatactttaagtagaaagtctatgggtagcctagctcatagtgttgaagttatgaaacctgtagtgaaggagttccaagatcttgtagctaatggagtgagatttgaggtcacaagcactaaatcacttctagctcatgttcatgctcattccactttaatggataccattaaggtcactcaaggtgaagaccctcatttaaggaaaattgtggaggagattcaagcaggaaaggtttctgattttgtagttgattttgaaggcattgtagatcaccgattgggtggtttgaagttggagagcctagttggagaggagatgacttgggagccaaaaatcattatgcgtgagaagtacattcacttgcttgagactcaag

SEQ ID NO: 57236 - DNA, 396 bp, Glycine max
  Peptide Sequence Number=SeqID_174014
atgactgagacaagtatgcgagttgggaatatcgatgtgtatggattcctcgagccacagtatatccagagatctagccaatcacaatttgaatcagaaaattacattaagaactggatgcaaaattcaaaacgggatgtgtacctaggagcctacctgaatggtgcacattggcaaatggtcgtcattttgcctaaggaaaatgttgtcatttggttttgttcgttgcataagaagtcagacaactacctcaaaggcataattaataggtcagtgttgtttttcaatacatttgcattagcattagtcagtgctttgaaagggcttgacaatactcaacaaagtaaatccaagcctcctgctaggtggattgttgttaaatactgtgtagactaa

SEQ ID NO: 57237 - DNA, 2091 bp, Glycine max
  Peptide Sequence Number=SeqID_174015
gtaggactagttgtggggagaataggattcgtacgtagactattcgcgaaattcaacctaacgtttgggtttatcattgattttggaatgacatgttatatgtttgcattggggatagagatggatcctcatgctctgtttgcacgaccaaataggtacactaaggttgcttttacaggagttttatgcacgttggtcgtgacaggaatttcaacaccgatttttcgatacttcccaagtcatcataggctaatagatttcaccctctgcttcgccacattggctgctagcacagactcgccagtgctgacacgcttaataactcagctcaaaataggcaaatccgacatagggaagcttgtgattggagcaggggtgcactcagattttgtgtgctgtttgatcctttgcattgggtacattgttcttccattgcctgaattttgccaccatttggaagacaagatggacattaagaagtcccttcaaatggggtgtgcagtggtggtgcaggtagtgttcactgccatggtttcaccaatccttatgaagtgggttggtaatgaaaaccctgaaggcctttgtgttcccagggagggtagagtttccaaatgggttatcaccaaaatcaattatttgatgaccactattttctttcccatctttttcctgtggatggggtatgaaactgatttcacgatgattgatgcacctaatgctttcacatggataagactagttgtgctctttacagtggcaacagctggaaaagttgctggaacagttatttctggtgccatgctgggctttcactggcccgaatccgttgcaattggaatgctccttgtcactaagggccatttgcaaatctacttagctatcaaagtgataggttgtggtgctacaagtatgtccaccggcattgtcatggtaattgcaacctttttaacaactttgcctgccccaacaattgtggcaaaaatcattaaacgtgcaaggaaaagagcacctactcatcgtttggcgcttcaattgcttgaccctttaagtgagctaaggatcctcctgtgtgtccaaggacctcagaatgttcctgcctccattaacttggtcgagatcacgaaagggacggctgacaccagtattgtgctatatgtcactgacatgattgaactcactgatgaattatcagacacattggagagggatgaaggagtgcacacgaccacagtgaaagacaaagaagtcatggacatgagagaccaagtaaccaacttatttcaagcctatgtggtggagaatgatgatggcattacactcaaaagaaccatggcactctcaacaatcactagcatgccacaagacatttgcattttagcagaggacttgatggttgccctcatcatattgccattccacaggagtcagcgtgaggatggaaaattggatggtggtaattcagggttcagatacgtgaaccgaaaggtactaagaaatgccccttgttctgttgggattctagtagatagaggccttggatcagttgagcatataacaagatgtcaagtagcagtaaatgtgggagtcatattcattgggggaaaagatgatagggaagcacttgcctacgctagccgtgtagcgcagcatccacaagttaagctcacagtaataagattcctggaagatagcagtgtagaatcctcatcattgttcaggatcatccttccagagcaggagcaggagaagcagttggatgatgaatgctttacacagttctacgaaaggcatgtgatcggaggaggtaggatttcctatatggagaagcatcttgcaaatgcttctgagaccttctccactctcagatcatttgaagggcaatactcattggttattgttggaagagaaggaggaatgaactctattttgacaaggggaatgaatgattggcaacaatgcccggaattgggaccaataggggatgttctttcaggatcagacttctctacaactctttctgttttgatcatccaacaacatagacttaaaggagaaatagatgggttagatgaagacttctctatgatataa

SEQ ID NO: 57238 - DNA, 708 bp, Glycine max
  Peptide Sequence Number=SeqID_174016
atgttgagctatgattatgctggcactagttatggtgcagcgcaggatagcgatgcgacaaataaagtgacgccatatgtcggggcagtgtacgcacttgaccctcagcactcggcctacgctagttacacagagatttacaatccccaagttcaactagatgctaatttcaaaatcttgcctcctgtgcaagggagtaatcgggaagtgggtttaaaaagtgagtggtttgatcgtcacttgaacacttcagtagcttactttgataacaagcaagataattttgcccaaagcactggcgcattagttggaatcgtgcaaatttacgaggcaattgatgttcggactaaaggttttgagttggatatgtcgggtgagattggtgatggctggaacatgaatgccggcctaaccaggttgatgagcgtaaaggataatgaaggtgccagcctcaattggcagagcaaagtatatgcaaatattgatatgacctctaccggtgccgggattgtaaagtatacgcaaaactcttacgcactcttgaatttgttagcgagctacgatatcaacccgcattggcaagcagccgtgaatcttaacaatgttacgaatgaaaagtacctggcaagcatgatgtgggttaattttgggcaggggtattatgcgcctggaacaaacgggtatgccactctgacatggaagtactag

SEQ ID NO: 57239 - DNA, 757 bp, Glycine max
  Peptide Sequence Number=SeqID_174017
atgacaactttgcctgccgtttctgaattgctcgcgtttgagcaagtgacagtgtcgctgggcaggcaatcgtttggcccctttacactatccattcggcctggtgagcagatcgctattttgggtccgagtggcgctggtaaatccacattgctcaaactgctggcacgtgagttgatgcccgcttccggacacgcgcattttgatcaacgcactttcagagattggtccctcgctgacctgagtcgtcgccgtgccattttgccgcaatcccatgaggtggcatttggcctgcctgttgagctagtgatcggccttgggcgcgttgccaggacgtatgatcccaatctaaacagtattgtgcagcaagctgccgggcaggcttgtgcaacacacttgcttggccgacgttttgacaccctctctgggggtgaaaaagcacgcgtgcacatggccaggatatttgcccagttatgggatgcagaacaaggcctgctgcttgttgatgagcccttagcggcgctggacccaggtttgcaattcgagttgatggatgcgatcaatacctttgcctcccgacgcgggcatgccattctggcaatcctgcatgatattaaccaggccttgcaaggctttgaacgcttgatattgattaagcatggcaagttggtcggtgattatgaaacgtcacatgtctcgatttcattgcttgaagcgttgtatggggtcagcctagcctgtgcaaccacggacgatg

SEQ ID NO: 57240 - DNA, 651 bp, Glycine max
  Peptide Sequence Number=SeqID_174018
atggatgaatactactgttgtgcatacccgcacatctctgcctccgatttcgcgtcagaaactccattttgtcccgatgatcaacgcttcagtgtagaagttgcgtacacgaacatgtacgttctgaatgcccgcgaattcgaaacttccgaatataccactcaccacagtttttcaaacatctcaaaggacgaaataatgcaagaaacaacgatcgtgtcttggctttccagcatgggtgtccctagcgaggctcacaggtctgtcgtggcaaaagtattgcaatgtgcgcgtggcatggcgaatgataggattcccacaaaggttttatctatgcgtgtggatgtgactatcactcaacccggtgatgattttgaagactacgacgaagaatacgaagacgaagatcacgatgatgatgatgaagatcatgggttggtgcaggcagcggcaaagtcacaacacgttgaggggttggagacggttgaacaagaagggtgtaaaaggtgtgcgatttgtctcgaggattttaatgttggtgttcgcatgccttgtttgcacatgtttcatgaaaactgcatcggtgagtggttgcaaataggcaattcttgccccttgtgtcggtttaagatgcctcctcaaatgggataa

SEQ ID NO: 57241 - DNA, 2556 bp, Glycine max
  Peptide Sequence Number=SeqID_174019
atggctacagattccaactttgtgcaagcagccattccacgatttgatggtcactatgaccattggagcatgctaatggagaactttctcccgtcaaaggagtattggcctatcattgaatctggaattcaagagccagaaaaaggcacaaaaacttccaaggacatttgggattctatgaagaaaaagtatcaaggttcttctagagtgaagcgtgcacagcttcaagccttaagaagagattttgagacattaacaatgaaggatggtgaatctgtttctagctattttgcaagaacaatagagacaagcaataggatgcgattccatggcaagaagatgaaagatgtcaccattgtagaaaagattttgcgatccttaacaccaacgtttgattatgttgtctgtgcaattgaagagtccaaagatatagatgcattctcccttgatgaattgcaaagttctttgttagtacataagcagaagatgaaccgaagttcaaatttgacaggaaaagagcaagctttgaaggcttctaccaacactcattccataggtagaggaatgggtaaaggtagaggcagaggaaggggtcaaggtcgaggcagaagcaactatagaggaaatcagcagcaacaaaaagaaaaagaaagaggaagttggagccatcagacaactaactacaagttagcaaacaagtctaacattgaatgttttaaatgtcatcggttgggccattacaaatcagagtgcaggaccaatttgtccaaggagcaaggggaaaaatctaactttgttgaaatagaagaagaagaagaaaacaaatcagaagttttctctactttcaaaagcttcaaagctcgtgtagaaaatgaagcaagaaagaccattcagactcttcgaactgatcgtggtggtgaatattgctcaaaagaatttgaagcgtattgtgaacatcatggcattcaaagagagcttacagcagcatatacaccacaacaaaacggtgtatcagagaggaaaaatagaattatccttaacatggcttggagtaggagacaaccatctgtggatcctttcaaaaattttgggtgcattgcctatgctcatatcccggatgagaagaggaagaagcttgttgacaaagctgaaaaggatgttatttttgatgaagacaacacatgggactggaatgagcagcaacccaattcaattattgttgacaatgaagatgtaaaagaactacagctactcgtaaacattgtcttaacatctccaaatgaagctcaaatagctcctgagacagagatttcaacaccaacaaatgctggaacaacagatgcaacaactgcagctcaatctaaatgtcttcgaaggaggccagcatggatgtcagattataaggtaactgggattgaccaaactgaagatcctactactcactttgccttattttcagattgtgaccctacaacatttgagagtgctgagcttattgatcttcttagaggacacaaaaccattggcgtaaagtgggtcttcaaaacaaagcttaaagaaaatggtgaagttgacaagtataaggcgcgcttggtggccaagggatacaagcaagaatatgggctagatgtcaaatctgcattcttgcatggatacttggaggaacaggtatttgttgaacaaccccctggctatatcaagattggacatgaacataaagtgtacaaattgaaaaaggcactctatggactaaaacaagccccaagggcttggtatagtcacattgaggcttatttaatgaaagttggttttttaaaatgtccttatgagcacacattatttgtcaagtctgaaaatgaagggaaaatgcttattgtatgtctgtatgttgatgacctcatatttactggaaattgtgaaatcatgtttcaagaattcaagaaatctataatggatgagtttgaaatgtccgatcttggtgattacaaccctacaaacacttcaaccgagtttggcttgaaattaaataaagatcatgaagggaagaaggtggacaacactctctacaaacaaattgtaggtagtttgatgtatctaactgcaataagaccagacataatgtactctgaaaggtggaaaacaattttgtttgggtttactgacattgattatgctgcaggagatcaagatgatagaaagagtacttcaggtacagaagctgaatttgttgttgcaacaacctgcgcttgtcaagctatttggctaaggagaatacttgaggagctgaaattcaaacaatcagaagctactatagttttttgtgataacaactcaacaattaagctttccaagaacccagtgctacatggaagaagcaagcacattgatgtgaggttttattttctaagagatctcactaatgaaggagtaattgacttgaagttctgcagaagtgatgagcaattggctgatacgtttacaaaatctctcaaggtttcaggttttcaaaacttaaggaggttaatagaaatatacactttgggtgatctagtttga

SEQ ID NO: 57242 - DNA, 492 bp, Glycine max
  Peptide Sequence Number=SeqID_174020
atgaagcatgctgaagttataattagaaaattgttaaaggtgcttcttaagaaactgaatgtaaaggagttagataaaccaagagaaaaaactttaatgggggcaatgatattgggtttcaattactacccagcttgccctgaccctgaagttgtagcaggggtaggccctcattccgatgtatcatcaatcactgtccttctacaggatgatattggagggctttatgtaagaggcattgatgatgatagttggatctttgttcctcctgttcagggagcattgagcatagagtggttgcaaaaagaaaccaggatctccattccaatctttgtcaacccagctcctgatgctgttattggtcctttgtcaaaagtgttggaggatggcgatgaaccaaaatataaacaagttttgtactctgactatttcaagtatttcttcagcaaggctcatgatggaaagaaaactattgaatttgccatggtatga

SEQ ID NO: 57243 - DNA, 651 bp, Glycine max
  Peptide Sequence Number=SeqID_174021
atggtggtgaaggtctatggccctgactatgctaacccaaagcgggtgatagtgtgtctcattgagaaagaaattgagtttgaaacaatacatgttgatagctttaaggaagagcataagcagcctgaatacctcaaattgcagccctttggattgatgccagttattcaagatggtgattatactctttatgaatcaagggcaatacttaggtactattctgaaaagtacaaaaaccaagggactgatttgttggggaagactatagaagagaggggccttgtggagcaatggcttgaagttgaggcccataactattacccaccaatctacaacttggttatgcatgttttggttcacccatataagggggagccatttgacccaaaagttattcaagagagtgaagaaaagcttgggaaggtgcttgacatttatgaggagaggctatccaagacaaagtacttggcaggggatttcttcagccttgctgaccttagtcatctcccatttactcattatttgatgaatcacatgaaaaaggggtatatggttagagaaaggaagcatgtgagtgcttggtgggatgacattagcaataggccatcttggaagaaggttctccagctatacaaagaccctaatttttag

SEQ ID NO: 57244 - DNA, 234 bp, Glycine max
  Peptide Sequence Number=SeqID_174022
atggctgatggttctgttccgtggatgagtgttaagaagactttgactgctacttctaccgtgaaagttgagtttatctcttgctttgaggctacatcacatggtagtggtgatgggggctgccagaagcaatatgctgaacagttggagtgcatcttagcgtccaagccggaggtggcaagggttttcagagatcatggaaagggatggagaataaaaacaaaaatattttga

SEQ ID NO: 57245 - DNA, 207 bp, Glycine max
  Peptide Sequence Number=SeqID_174023
atggtggtgaaggtgtatggtccaacctatggatcccccaagagggtcctggtgtgtctgattgagaaggaaattgagtttgaaacagtgcatgttgatctcttcaagggagagaataaggaacctgagttccttaagctgcagccatttggatcccttcctgttattcaagacggtgattatactctctatggtaaacccttttag

SEQ ID NO: 57246 - DNA, 396 bp, Glycine max
  Peptide Sequence Number=SeqID_174024
gtgctggatgtttatgaggagaggctgtcaaagagcaagtacttggctggtgacttcttcagccttgctgatcttagccacctcccatttggtcactatttggtgaaccaaaccgggagaggaaatttggtcagagacaggaagcatgtgagtgcttggtgggatgatattagtaacagacctgcttggcagaagccgaggaaagcagagtcaatcaaagaagtgatttggaggcctcggagactgtcttggatgaagtgtaattcagatggagtagccaaaggttctgttggtattttcatagatattgagttgaatttcgttggtgcttttgcgtctcatattggaatcaatggcaaccatcttggcaatagaaaaggcgcgcggatagtaaag

SEQ ID NO: 57247 - DNA, 411 bp, Glycine max
  Peptide Sequence Number=SeqID_174025
atgcagtcccaatttcagtcgcagatgcaatcacagggactcacagtgcctcctgagcctgaggttggtccttcagctgctcgtgttagtacaaaggagagttgggttgatccctcagggaacgatccagacacgggtgactcagacaaatgtgggttatacatcgaagaaaatcctccccgcttggttgccctaggaagactttctgagggatccacaaccgttcacaacattcctttgctacatgatcaagtgaaggttggtgttgaggaggttagagatacagatgctcccattcctgtacccactaaagaggttaagttagtggggcagacacttttcttgcttggtcgacatatcttgtcaagcgtttatcagaatagggagctatgggactggggaaacttatag

SEQ ID NO: 57248 - DNA, 135 bp, Glycine max
  Peptide Sequence Number=SeqID_174026
gattcgttgaaggagcagtcctcacagggttcctttgtcgcccatggacgtcaggatgtactgactgcttccattgggcgaccagaacaccctggtcatgtgtgtgctgctggagccggtgtcacgatcaagtaa

SEQ ID NO: 57249 - DNA, 1242 bp, Glycine max
  Peptide Sequence Number=SeqID_174027
atgaagggagcaagcagtggcagctctaaattgtgcaatagcctgagatgctttgacttagtccatatgatggtcacagttagtgtgtcagaccaccactcaccatgcactctggcaagccttggtgttgcattgtgtatttctaccacgagactctacagcaaggccaagtttctcaaagctggtgataccttggcaaggaccccccttgagaaagcccaccctgttggtcaacctttcaatccctcaactcctgtaaaatgttgtgaggaaggggggaagagaactgattccttagagcaaacaccaagcagctgtatctccaatgtgctaagtactcaatgtgacactcttgattctacggaaggaattaggacagggagtcttcacagtttggataagaatgacaagaatacagcttctgtttcaccttggccatcaaccacatacacgaggaggaacaagtctataggttttgaatgtgacagtgatttatcgtcctgtgactcatccgattatggtgggcgacatatgaaaaaaacagattcactaaataatgagagtacatataaaccatcgcctaatcctaccccgatgaagctatctgatgagatgcaaactcctggaactgcttacccttcagcaaaagacttgccaaatggtaagcctcgagttaagtcccagtttgtgtatccaatttacaaccctggtcatcatttctctcagaagaaatttgaagagagtgaatcagttgagccgtctcaagttacaacttcaacttctgaaaaagagttaaagaaaatgtcttgtgaaaatgaatgtaaggtagaggaaagcttgtcttcctggttgaagcctgcagctgtcattctggaggagagaaacaagagaatgcagaccagttataatcaggtccgcaaaacacctgctgataggcctatcattgggatggttgcagctcactggaacaaggatggggattctcaagctcctcctccgaagtggtgggatggtaacggcataccaaattcaaccaataagtataaagaagatcagaaagtaaattggcatgcaacatcatttgaagagaggttagagaaggcattatctgaggagactgtcatctctcaaaggaaggatacatgtggcaaatcaattccttttgatgagaacgaagaaagtgatactgctctatctcagctgcaatcttcaactcatccacagtccgtggtgtcattttga

SEQ ID NO: 57250 - DNA, 1851 bp, Glycine max
  Peptide Sequence Number=SeqID_174028
atgtctattcgaacaaatcgctttaaagcagtggatagagtgttgaaggatctggagagagtagaaaaagaagggaaattgaatgatttgaagtctgagttgaacaagataaaggaggtgtttttgaaggtgaaggagaatgaagaagaactccttgacacgttagcggttgtggatggctatattcgcaacaaaaacatagctaagttgagggaagaggagggacacttttgccagaaaatatggaattcaactctaaagttgctgccagctgctcatcatgctcaagctgctgcctcatctggacaatcatctcatcatgctcaagctgctgcctcatctggacaatcatctcatcatgctcaagctgctgcctcatctggacaatcatctcatcatgctcaagctgctgcctcatctggacaatcatctcatcatgctcaagctgctctcccatctggacaatcatctcatcatgtcacaccactcccttcttccaccactccacaacttcatcaggaggaggacttgcaaattattaaggactattataacagccttggtcgttttgacaaacgttgcttctcatctctcttgcagtttcctgaaaatgctgttttcaagagaagggaaatctctttctggttctctccgtttgaccaagtggttgatcctcttttggagggtaaagtaattgtaccccatggtaatggcaagtctcccattgcgagtaaatttaaaattaatccgttggtccgtcacaagtcactaagtccattgtttcaaaatgaggaagtgccgatttgtggttattattcacaaataaagacctcatcttcatctcgtgccagtgatattgggtatgaacgtttagtacttgaccaacgtaaaattaaattaagtgatggctttggctttaaatctaaccgttgctattatatttataatgttggtgcaagttatcttaattttggacccggatggatggccaaaatgaaggatttgctggtgcttcaacttggtcgttggacgaaagattcaccaaaacatcatattgaagtggacagtgaagaattcctcaaggagttgagtggtcacgagtatttgttctgtcttagccttcgagggatatcaagaatattcgagcttccaccttccatcgtaaaaattgagagcctagaaactctagatctcaaggcctgtcacaatctagaaacgctacctagtgatatttcatcattgcgatggctccggtatttgaatttgtcagagtgctacttgttggacagaatgccaaaggggattcagaacctgacttggcttgaggtactgaagggatttgtattaggtagttctagcaagactccctgcagaatatctgatattgctgcaagattgaaaagactagagcgactcagcatacgtataggaagtggggccgtgatccaagaaggcgagtttgaaagcttggaaaagttgcgtagacttgagcgtctaaaaatatcatggggtgtatttgacacaaggtacattgatattcagataagtgtgccttcaagtttgaaaaagttgcatcttgaaggctttcctggccaaaatattccagaatggttgaagcctagcaaactacctcaagaattggaattgagagagctacatataacaggaggaaaactcaaaagtttggatcatggtgaaaataatgattggggtgtggagatggtgtatctcaagtacctaaagtatttggatgttgacttggaacatttgcgaaagttgtttccttctctaaggtacgtagaaataaaacaaatcttaaaccagccataccttgaatggagcattaattga

SEQ ID NO: 57251 - DNA, 1428 bp, Glycine max
  Peptide Sequence Number=SeqID_174029
atgggtgctgagaatggaggtttctccgtgaatgtgaccaatgaagaggtggtggcagcagtggtgccaatgcaagaacattggcttccactctctaaccttgacctacttctacctccaatcgatgttggtgtcttcttttgctataagaaccccatgctaacgtccactaccttaggggacacttgcaccaacaaaataacctttgaatcaatgttggggtctctaaaaaaggccttagcacaagctttgatctcttattatgcatttgcaggtgaagtggtgcccaacaacgtgggtgaacccgaggtgctttgtaataatcgtggtgttgattttgttgaagctgtggctgatgttgagctaaagtgcctcaacttttacaacccagatgacaccattgaagggaagtttgttccaaagaagaaaaatggagtgcttactgtccaggcaacatcactcaagtgcggtggaatagtactagcatgcatatttgatcaccgcatagcagatgcatattcagcaaacatgttcctcatatcatgggccgagatagcccagcccacgaagcccacaactactaccaccaccccatgtttccgtcgctcactccttagtcctcgtcgcccaagttctattcctcgttccctttatgacatgtacctccccatttctaagatcacccctcctcaagccacaaccgcccctctcctcagtcgcatatactatgtaacggcagagcaacttgaaaagatgcaatccctcgtcgtcatgacaaatgaaaacaacacaaagcgtacaaaatttgagtgtttctccgcgttcttgtggaagatagttgctcaggcagcttcaagaggcaacaagaagggcaaaaaggttattgccaaaatgggtattgtggttgatggaaggaagagactgtgtgatggtgacaaagagaaggaagcattgatggggtgttacttcggcaacgtgctttccataccctttggagggaaagaagtggaggagttgatggagaagccattagggcttgttgccgaagcggttcacgagttcttggcggtggcgacgaaggagcatttcttagggctcattgattgggtggaagctcaccggccagagcctggggtggcgaagatttactgtggtggtggcagtggcgacgaagggccgagttttgtggtgtcttccgggcaaaggttaatggagggaaagatggattttgggtggggggaggttgtgtttggatctttccattttccttggggtggtcaagctggttatgttatgccaatgccaagccctttagggaatggtgattgggttgtgtacatgcatcttgccaaggagcaattggaggtcttagaatctgaggccagtgatgtctttaggcctataagttgggattaccttaatcagtga

SEQ ID NO: 57252 - DNA, 414 bp, Glycine max
  Peptide Sequence Number=SeqID_174030
atgagcgttcgagcttcgcttctgcaaagcgaacaaagtagcggaaactcgatatcaaaaaataaaaaagctgcgaacagtggtatagttacggtaggtttgtgtttgccggaaggagaagaaggcaccgtagctgtgggggcggtggcggaggaggagtcgcgggctctgaagcaagcgaagaagcatcccatggtggtggttggggagcaggatcgggaaacgaacctgaatgtcgaagctagcagcagcagcagcagcagctctgggcagagcgtgtcatggaagaggctcggagcaggcggcgagtgggatgaggctgtgagggtgatgaatgtttgttttttgcactcgtgtgttaaacaagaatgttcttatggatggatatttgtgataaaaaatggaatatcttag

SEQ ID NO: 57253 - DNA, 253 bp, Glycine max
  Peptide Sequence Number=SeqID_174031
atggcagccaagagcaaaatcctagtccttggaggaacaagttacattggaaaattcatagttatggcaagcgtagaagcaggtcactccacttttgccttagttagggagagcaccctttctcatcctcaaaagtctaaacttattcagagcttcaagagctttggagttactcttctttatggtgatgtaaataatcatgaaagccttgttaaggcaattaagcaagttgatgttctaatatttacactag

SEQ ID NO: 57254 - DNA, 1904 bp, Glycine max
  Peptide Sequence Number=SeqID_174032
atggatccgactcaatcgaacgacgttcagcaatacccacaaaccctaatctcagagcctaaagattcttcaatgcacgacgccaacgagtccttgttcgattcgatggtttgcgactccagttcaagactggtcccaactgggcttacgagatctggcaacgcagaagaggagtgtttcatgtttgtaaatgcgggaggggatgcttttagtgaagcagctggtggaataacgttcctgggtgacacctattttgatggtggcaacgttatgcgtaccaatgagcaaatagtggagggtggagactacccatttatctaccaatcagctcggttgggaagcttttgttataggtttgctaatcttcctcctggagactacgttgttgatcttcattttgtggagatcattaacataaatgggccaaaaggaatgagggtgttcaatgttctatctgaattggatatctatgcagttgttggagccaataagccattacagatggttgattcaagggtgtctgttaaggatgatggggttattctcataagatttgaaagtatatctggaagcccagttgttagtgggatttgcattagaagagcaacgaaggcgtcagttccacaagtgacaagtgattacattaaatgtagctcctgtgctgcacagattgaaattccttcatcacagatgaaagttatgcaggcaaagtctacagcaaagtacaagagcaagataaaagagctcacaatgcagtgcgatctcaaggcaaaagaatgctatgaggcatggatgtcattaacagcaaaaaatgagcaattggaggcagtccagatggaacttgacaaagtgacatttaagttactcacaactgatcaaactgtagagaaacaagctgaaagcctgaggaatatttctaataggtatgagcttgataagaagaaatgggcagaagcaattaacagtttacaagaaaaaattaagttgatgaagagtgattattcaaaactttcctttgaagcgcatgaatgtgttgattcaatccccgaattaaataagatggtttttgcagttcaggaattggttaagcagtgtgaagatctcaaagtgaagtacagcgaagagatggcaaagagaaagaaactcttcaatgaagttcaagaggctaaagggaacattagggttttctgtcgatgtcgtccattgaataaggctgaaatctcagctggaagcaatacagttgtggattttgatgcagcaaaggaaggttgccttggaattttgacaagtggctccaccaaaaaatctttcagatttgacagagtttatacaccaaaagatgatcaagttgatgtttttgctgatgcatcatcaatggtaatctctgtactggatggctacaatgtttgcatctttgcttatgggcaaacaggaacagggaagacattcaccatggaaggaacacagcagaatagaggagtaaattacaggactcttgagcacttgtttaaagttagtaaggaaaggagtgaaacattttcatatgacatatctgttagtgtgatagaggtttacaatgaacaaatcagagacttattggctacaggacaaacatcaaagcggttggagataaaacaagcttctgaaggatttcatcatgttcctggtgttgtagaagccaggattgataacataaatgaagtgtggaatgctaaaaatttgttgagtggcgaatctaccaagagcaagctttggcttgtggatttggcaggtagtgagagacttgcaaagactgatgtgcaaggggaacggcttaaggaagcacaaaatatcaatcgatctctttctgcccttggagatgtgatatccgctttagcagcgaaaagtagtcacattccatatag

SEQ ID NO: 57255 - DNA, 1069 bp, Glycine max
  Peptide Sequence Number=SeqID_174033
ccgaaattagccagcggcgttactgtagccaatggcaaattctatgtgctggcaaataccttccagattgactccttgaatgttacctctggtgcaaacacattgcctactatacaagcttccaatagtttgctgtcatgggtagccagcgtaaacagcaataacgcgctggtgttacagtctcaggtgcataatgccaacatgatttctggtgtcagtggcaatgctgcaaatgcactaaatacattggtaaacgccaataacccattatttagcactattgccaatatgggctctgatagtcaagtcgcacaggcttcgcaatcgttggtaccagaagtgaacggcgctagtgtcaatgccgcgcaaaaagccttgggcagctccatgcaaattatcagcaaccgtaacagtgcggcacaaaccaattttattaccgggttgtctggccagagcggtgttgccacaggtgatgcgcctaataatacggggaccaagacagacgtaaagcaaacagatggctaccaggtcaatgcctatggcatggcactaggtgtagataggatcgtcaatactgataacaatttgcgtgttggtggtgcgtttacctataccaattcaagtattgatgccaaaggcagcaataagggcgatagtgttggtttggatagctatctgggcagtctgtatgcttcggtaaatatgggtgattggtacctgaatggtagcctggttgccggacagcataagtatgacagcaagcgcgtggtggttggcaatgtggctaaaggcagttatgacgcgaaccagtttggtgtcaatgctgaagctggcatgcctatcaaaacggcagtcggcactttgattccattagtctcagcagcctataactacctggatattgacggctatagtgaacgtggcaccggtggcttgaaaatctctggggaaagtgttgactcattccgcactggcttgggggcgcgcatctggttccatgagtttgccgataatcgctttgataccactggccgctatacaacaggtggtagcagttttaaaacagcag

SEQ ID NO: 57256 - DNA, 396 bp, Glycine max
  Peptide Sequence Number=SeqID_174034
atggcatcattcaccatgacagcttctatctttggctgcccagctgtcaccaaacggtcggcagtggctgcgcagaggagattactcgtagtgagtgctgccaaagctgaaggggaaaaggtcagttatgacaacaatgatagcaatggaaggaggaacttgatgttcgctgtggctgctgctgctgttttctctgttgctgggatggcagtggcagatgagcctaaaccaggaacctcagaagccaagaaaaagtatgccccggagtttatgaagggacttacaacgctggaagaagtggaggattgcgaactcatggcgataatggatagtggattgattgctacagatgaagtcaagtgtgaaaaacggattttggctggtgagaatgattga

SEQ ID NO: 57257 - DNA, 621 bp, Glycine max
  Peptide Sequence Number=SeqID_174035
atgagagaggaagggagaagggttgggggtgattgtgaaagaggaatggaaaagggcaatagcaatgcccttggcgtttccccacaggcccacacagtacagctcaagcaagcaaaagggattcttgttggggacatcatagaggaatttgtgctgattagggtgggggtagctatgtatctcactctgctttgtgcttgtgctattttgatattttttcaatccggttttgttgttttctttgcttggattttcagtgtggctccaatgatggactggacagatcatcactataggactttggcacgcctcatatcgaaacatgcttggctctacacggagatgcttgcagctgaaacaattgtttatcaaaagggaaacctggacagattcttggcgtattctccagatcaacatcctattgtgcttcaaattggagggagtaatttagataatttggcaaaagcaactgaacttgccaatgcttactgctatgatgagatcaacttcaactgtggatgcccgagtcctagagtagctggacgtggatgctttggcgtacgtcttatgcttgatcctaaggttagaaaatcgtccatacttgacgcgcaaacagattga

SEQ ID NO: 57258 - DNA, 165 bp, Glycine max
  Peptide Sequence Number=SeqID_174036
atggacctagatagagggggtgatttcatttacaaggtttcttctttgtcacctgctaagcatttcgtaattcactcaaggaaggcactgcttaagggcctcagcccagctgaaaatcggagtattcctccactgaagtatgtgccagactgctggaaaatttga

SEQ ID NO: 57259 - DNA, 648 bp, Glycine max
  Peptide Sequence Number=SeqID_174037
aaccacttaggaaatggtaaaatcggtctagaatcaggcaaaccagtgaaagatagttgtttctggaagtgcatcttggtgaggcaaagacaaatcgaaggtgtgatgaaggatcttgtgttgtccagatgtattagtggcatgcggacggttttgataaacccgtctttgaaaatgcattacgacatcggttcttgtagaaccgacgtagaatgcgagagggaaattaaaacccgcatctcttccttagttttgcaaattaaaaccctaaattcctcatcgctctctttgttcgcgttgtttcttccaattcttccaagaccaccgccgtttctctattcaccaaactccaacaataggaccacaaacctcactccaatgacctcaccacctcacgtgccactgcctgattctgacgaccagattccgacgacttcgaccctcaccttcgcgagcacctcctggtgcaattcgagcaatgccactgcccacagaagcaaagaagtggatgcctcttgcaccgcgaagaggaagtcgaagagtactcaagcatggggtaggaaaatggcgcacgatgctcttattattgattcaccttcttctacctttgtttgctgtcaagatttactcacactctgtactatttaa

SEQ ID NO: 57260 - DNA, 495 bp, Glycine max
  Peptide Sequence Number=SeqID_174038
atggcaagttcaacatgctttcaacaaattccttcacaaataactaccacaatgcataaacctagtaaactacccatcatatctcccaaaacccaatacccacgaaaatcaagtgagaaagaagtctacccaaacctgaaatttcgaagtcccacacgtagagatgcacttcacgactccgaaaatgccttcctttcgcgatttggagcagaaatggctaccaaaggttggagctttgttggagcttcaatggtggaggaagaagaagaggatggcaacccattcaaaatgcaccgtttacaaaaattccgggtagaaatttccaggatgtcacagttcggcaaagtctgttgcctacatccagtccccaagaaacccacttgggagttccactatctctcaaatcctttacactttctgaaacacacaaggacaacccttcctttatgtttagatgctttacaacaagagactctcagtctcttagccttttga

SEQ ID NO: 57261 - DNA, 462 bp, Glycine max
  Peptide Sequence Number=SeqID_174039
atgcaggaaaaagactggttatctttagttgttgttcatagtgatacatggctacttgcccttgccttttacttcggagccagatttggatttgataaaactcacaggaatagactattcagtatgatcaatgaactaccaacaatatttgaagttgttactagtgcagcaaagaaacaagttaaagagaagtcttcggtttcaaacaacagtggcagcaaatctaaatctaggtctaacttgtatgatttcatttcttggaagcaccaatttagaatttatccagatctagagttgaccttaggtcttcctatgcatactgatttcaatgttctcataattgttttacagtcacaagtttctggtctccaagtgatcaaagatgggaaatgtattgcagtacctgttattcccaatgcatttgttatcaacctgggagatcaaattcagagaaaaggctag

SEQ ID NO: 57262 - DNA, 1368 bp, Glycine max
  Peptide Sequence Number=SeqID_174040
atgggagcatggctcgatacaaaattcatgaaagatgcagatccttacaaagtaattgaagaattttgttgtcggatgacgggaacattgaaagaatggtaccacaatctaggagctgtgcgtcaaaaccagttccatgaattgagatctgctgtagctgttctggaactctccatcaagaatacagattcttctgatgaagaatcttcagcttctccaatccccatctcctctatacaagaagaacagtctatcaggctagcgattcctcaaccatgtgttgaaattcaagtgttggccaaaaagtttgaaaaacctatcaatgttattgcctttatagacactggagctcagaggacgatgatgaatccagatattctttcacaagaatattggaaaaatgaagtagcctatcttgtagctgctaatgggaaatttttcagaagacttagtaacacatggctcttctctttagcagaagccccgctagaagttggagagtttaaacaaaagatttcctccggatgtgcagacagtcatgaagatttcaaccatccatatcttttatggaaaaacaaagaatactttgttgatctaccaattcgattaaatgaagatatcaatccaacaaaagcaacccatcaggatgacacctttagatctacaagcagccatacaagaatgccaagatctactaagccaagaacagacgataacagtcaaggaactcaagaagatgcccaaaatcccccagccttgaagattcctggaacaggattgattacccatactcctgcacagatccttgaatatgctaagtctcattacttcccttttctgcatgaaaccatgagattcaaatacactccaacacaaatatttgaccctgagataccctttggagcatggtggcgtatgaagttgaaacaaattctagacattgtgagacaaagaggaatctcagaagatctcataggagaactagtttctattgtgattattcaccaaccttaccttatggagcaaggacaactctggtctagaaatgaagctcaaatttggggaacttttgaagcatattccttggaggaaagttatcgcaaccagccggcaagacatctctgtgaaaatactaatgatgctcagatccgaacagagatttatgtttcggaacttgagtttcaaaaggtggaagatttggttgatgggcattctgcattagaacaagactcggaagactacaatgctcaattgatggaggaattgttacacaaaaagagatatccttatcaccacctagtgtacggaagtctcaccagatcagaagtacaacattacaacttgtcattatccaccagatcagactag

SEQ ID NO: 57263 - DNA, 783 bp, Glycine max
  Peptide Sequence Number=SeqID_174041
atggtagaaacttggaagactagttcctctcctgatatgtttgatattgcaccagtgattgagggtgctgttaaccacattgcctcaagaagatttgagtttggaggtattgatctaactaatttcctggctcaagaacttggcaaatccaatccgttagtgaatatcagcatctctgatgttgagaacataaaacagcaatactcgtgctgtgttgaagatgaattagcttatcagaagacccaaggttcctgccctgtggagacacatacccttcctgatggacagaggtggtggaaaggccatgaacctttcacaagggtgggcatgttgaactgcagtgatggcggctttgaatggttgaacaatgatagtgggggctttgaattgaaccaaggtggtaggggcttcaaacagttgaatgtggcggtggtgattacaattggaagagaaagatatactgttggcgaagctttattccagccatgtctattgggtttggaggctcatggcattgttgagcagcttgtccatgctatttcaacggtgtcatctgaaaatcataggcaacttcttgaaaatactgtgtgttcgcctgggactagtcaaagggctagtgcacagccagccggcttgggtgttggggctgcggagtgtggtgggatgttaggatccaattgcaatccattggggcaagagctaacaagtgatttgggtagagcaggcaacaagctggaccacaagagttcagagttgggtaccgtgggagagctcaaaatctaa

SEQ ID NO: 57264 - DNA, 1119 bp, Glycine max
  Peptide Sequence Number=SeqID_174042
atggccatggcgtctgcaaagctcaacaccttgtcttcccagtggatcgcccacaattccttctctcctcgccgtggatcctcttctcgccgagtctctcttccgatccgcgcttcttcttaccaacacgaactcgtccaaaccgccaaatctattgcatctcccagtcgtggaattcttgcaattgatgaatcaaatgccacatgtgggaagcgtttagcatccattggattggacaatactgaggtgaatcgccaggcctataggcaacttctgctcaccacacctggccttggtgaatacatctctggtgcaattctttttgaagaaaccctttaccagtcgacaacagatggaaataaatttgtggattgcctccgcgatcagaacattgtgcccgacatcaaagttgataagggtctggtccctctgccagggtctgctgaatactacaagcaaggtgctcgatttgccaagtggaggacagttgttagcattccatgtggtccttctgcattagctgtcaaggaagcagcgtgggggcttgcacgttatgctgctatctctcaggacaatggtcttgtgccaatcgtagagcctgaaattcttcttgatggagatcacccaattgagaggacactggaagtggccgagaaggtctggtcagaagtcttcttctatttggctgaaaacaatgtcctttttgagggaattttgctcaaacccagcatggttacacctggggctgaacacacggaaaaggcttctccggaaaccattgccaaatatactctaaccatgcttagaagaagagttcctcctgctctccctggaatcatgtttttgtctggtggacaatccgaagtggaagcaacactaaatctaaatgccatgaaccaaagtcccaacccatggcatgtttctttctcatatgcacgggctcttcagaacactgtgcttaagacatggcaaggacaccctgagaatgtggaagctgctcaaaagtcccttttggtgcgcgctaaagcaaactccttggctcaacttggaagatactctgctgagggtgagagtgaagaggccaagaagggaatgtttgtcaagggctatacctactaa

SEQ ID NO: 57265 - DNA, 237 bp, Glycine max
  Peptide Sequence Number=SeqID_174043
atgaggttatctcacagttttgaagagagatttcagaaggaatctagcctaagttcatctgctattcgacctaccctagtaaagcctccagaatacatgccagaaaatttaaccatgaattctgcatgggtgggaggtgccatacttgccaaagtagtttttcctcaaaatcagcatgtaaccaaggcagattatgatgaaactgggccttccattgttcaccggaaatgcttttga

SEQ ID NO: 57266 - DNA, 225 bp, Glycine max
  Peptide Sequence Number=SeqID_174044
atggtcgacattgaattaagcaatgaagggtttcaaaacctcattaccaatggaagagaggtgggtttggacgatggtggggagcttcttggtgtcgaggtaggaaaggacgcaaagtgtgaggtttaccatctggaggtcttttgggtgcctttgcggatggtggagtcgaggattccactagaggaagagaggatggtgcgctacttttcgtcaacgatgtag

SEQ ID NO: 57267 - DNA, 219 bp, Glycine max
  Peptide Sequence Number=SeqID_174045
atgtggttttgcaaaactatcaacactcgttgtaacagggttttcgcgctagcaactgcagcagtttccaatgagccaaaaattttgacttggctcaaaactactacaaataaagtgaaagtagaaaggctcacgtatggacaaagaagggctgaattcgtgggtgtgatagtgatggtgctggtgatgctcttggcttggagtgagggcataggatag

SEQ ID NO: 57268 - DNA, 1146 bp, Glycine max
  Peptide Sequence Number=SeqID_174046
atgattcttagttcaaattgcaacgaacatatactgactgagtggacaatgtttcaggaaccagtgataaaaccaatttggaatacatttgctagcagtctcagtggaatttggaagggtgtaggtgctgtgttttctcccatcacagctgaaatggaaccaatggaaataggtagcaagaatgaacacctatatgactgctatactctttctcgcatagaggcagtaccatcagtttcaggtgagcgtacatctcaaatccagagaaaggttaactgggtgactttgaatccttatggcgaaataccacagcatattgaaggcagcaatgtagctaaagacaagcagcacaaatccagcgataatgtaattaatcatgttttgcctatatttgaatcatttgactttaaaaggagcgatgtgatggaagaagatgtcatgggctgtgaaccaggccttgtttactttgaagacgggtcatattctcgaggtcctatagatattccagtgggtgaatacaatgatacaaagtactatatctcaccaactttcaagttcgaacaatgcttggttaaaggctgccacaagaggatccgaattgtccacaccatagaattcatcaatggtggttcagatatacagatattgagagtcgccttgtatgaagaagaatgggtcagtcctgcttccatcgatgaccagagtgatacggagttcgatgcaaagccattttcacaaagaaaacgaaccaagccatcagagctaacagggtcatggaaagtctttgaggtaagtgcaactcctgtgtatgatgaggagagcacggaagaaggcaacgctgccccatatgtgtacctttgtatggaaaatctaaagaagaggagcctccccgagaacaccaactactttggcgaggaggagcggcttgacatgcaggatgtgaccatgctatggcttcctgggggcgtgacatgctatgttgacattaacaaggatggcattctttgtattggagttggttggtactctgatgaagggatcaaccttgtgatggagagagactatgggttggatggaaagctcaaagaggtgagatggaaatcagaggtgaaaagaaggtggtctaatcctcctcctattgaataa

SEQ ID NO: 57269 - DNA, 333 bp, Glycine max
  Peptide Sequence Number=SeqID_174047
atgtctttatgtcttcttttgatgataaaccacacctacacaatatggattgtccatggtggttcactccaacaaaagaagaaaagggcattattcatagttattagaggtcggttctcagttgaagcgttaccctcgctggcgccgcatctctccgcagcaaagcgccgcacctcaccgcagcaacgcgccgcacctcactgcagcagctccgtcgccggcaacgccagtgggcctccagaaactgcagcgtttgggacgacggaaacaggctcgagctttgaaactttctgtgctttgctctgtttgaaagttctcgaacccctctgttga

SEQ ID NO: 57270 - DNA, 645 bp, Glycine max
  Peptide Sequence Number=SeqID_174048
atggaaggagaaggaaaggtgtctgcagaaaatgagaaccaaaacaggttcaaaagaatatgtgttttctgtggtagtagagttggatacaagtctgcattcagtgatgcagctcttgagcttggtaaattgatggttgaaagaagaattgatttggtttatggaggaggaagattagggctaatgggtttgatctctcagactgtgctaaatggaggttgccatgttcttggagtgattccagaagctctattgcctcgtgagatatctggagagacctttggagaagtgaaaacagttgcagatatgcatgaaaggaagtcaacaatgtttgaacatgctgatgcattcatagcacttcctgaaactttattaaagttgcactgttcaggaggatatggaaccatggaagagctgctagaagtgatagcctggtctcaactaggaatacatgataaaccagtgggattgtttaatgtagatgggtatttcaatagcttgttgagcctatttgataagggagtggaagagggttttatagaaaactctgcaaggcatgttatggtcatagcagacacagcaatagaactgataaagaaaatggaggaatatgttccggtccttggtatggttgcacccaaataa

SEQ ID NO: 57271 - DNA, 1461 bp, Glycine max
  Peptide Sequence Number=SeqID_174049
atggtggtgagcttcttcttgactcatcttctccttgaagttgcgtctccaatcatctttctccttctctattccactgccattgaaattctagaagcaaaggattccattgatgaagaagatccaaggcctacaagctccacatggagctacataaccacgcttctccaacgtcaagccttccacaagacctatgggaagatttgggacctagctatggtagaagtctccgtggaagtgattgcatccctttactcagtattacgatcagcccctgaggtgcctcacattcgaggatttccagctagtacgactgtggaagagtttgaagaaatcctgggatgtccacttggagagagaaagccatatctcttttcggggttctatccctctatggcaagagtagaaaaggtagttaaaatctcggtgcaagagttagaccgtgtgaagcaaaataggaatggggtagttggaataccaaggaaacatttggaaggaaaggcgaaggctttggccaatcaaggagaatgggttttgtttattgacaccttcgcattgttgatatttggagtcgtcctctttccaaatgtggaagggttagtagacctagcagctattgatgctttccttgcttatcaccatagcaaggaaagcccgaccatcactattttggccaatctctatgacacgtccgcctgtccactacaaggtcaccgtttatgcatcgagaaaggaaaggcgaactgggaccaactcttggctagtatggagggggcatccattaattggttccctcgctggaaggaaggaagaactgggcttggctaccccatgagaggagcgccatcggaggaaagtgtcacacctttcatcacacggggtttcagtgaccccaacgcgaggctacttcaaggagttcgcaaggcatgggaagcggcgcaaaggaaggacaaagagcttaggggaagtagtaatggggtcatcgacgtctatcataagtgtctaagagtccggacacaagggttggattggctcccaaagctaaaggctgcaagagaggaagaggctaaagctctggaagaaagtgaagaggtacaagccctaaaggcggagctcgaaaaagcccgagcaatcaaagagaagttcaagtcaacggttatcaaagtccgaaaagaatacaatgaactaaaggatatcaatatggccgctgccaaagccttggaacgagaaaccaagagggcccgaaaagaagaacacggccgaaacaattttcgaggagctttgtggggtaggaacaatgagcttaagctccaaagagatgaaatggatcagtcgcgggtcaaaggcatgatcatgaaagacgagttaaaggcttgccttaggtcgaaaagaggcttgtcccagcagttaagcaagattgaaggaaatatgtgggccatcatcgatgagtacaaagtgtag

SEQ ID NO: 57272 - DNA, 1311 bp, Glycine max
  Peptide Sequence Number=SeqID_174050
atgtctccacaaagtgtagctctttcacttttcatcaccatgtttgtctcatttggggtttgttttggctctttcctagaggacacatatcatctaactaattatcaacgttactctatgaagccaaacaatgaacattttggtatcatgacaagggcttatggatctaccccatctacaaggtctcaaagaaggattaatgttgatgactatggagccaaaacaattgatggaagagatgacactgaggcatttgagaaggcatgggatgaggtatgttctacaggggggattgttgtagtccctgaagaaaagatctttcacttaaagccaataactttttcaggaccatgccaacccaatattgccttccgggtctacggaacaatcaaagcatggcctaaaatgtcagcataccaaaatgatagactacactggattaagtttgagaatgtcacaaatctcagagttgatggtggtggcactatcaatggcaatgggagaaaatggtgggagaactcttgcaaaaggaataaaaaccttccatgcaaaccggcaccaactgctgtgactttctaccaatgcaacaacttgaaagtgacaaatctgaggttcaaaaatgcacagcaaatgcatataaggtttcaaaaatgcaacaatgttgcagcttctaatttggtcgtgagagcaccagggaacagccccaacactgatggaattcacgtcacggagacaaaaaatattctgataagcaacagtatcattggtacaggtgatgactgtatttccatagtaagtgggtcccaaaatgtacgagccatagatatcaagtgtggaccagggcatggaatcagcattggaagtttaggagctggtgactcaaaagctcaagtgtccaacgtgttagtgaacagagccaccttaacaagaacgaccaatggagttagaataaagacttggcagggaggttctggctatgcggaaaacataatatttgtgaatatagcaatgcgaaatgtgacgaatcccataattgtagatcaaaactactgtgaccaggagaagccatgccatgagaaggactcagcagtgaaattgagcaatattatgtaccaaaacatcagaggaacaagtgcttcagaagtggcaatcaaatttaactgcagcaaaaccgttccatgcaaaggaatatacttgcaagatgtgattttaacaccagaaggccatggtggttgcagcagcaccattgctacatgtgaaaatgttagatatgtcaatcagggaaaggtttttcctccatgctctacttga

SEQ ID NO: 57273 - DNA, 270 bp, Glycine max
  Peptide Sequence Number=SeqID_174051
atggacaaagatacattggggtataatgggcggagaggttcgaagagcccaagggatagcaagttgagactatccagcatttggtgtactcatttggcgcgggtaactcacagacttcactttgctactcctgacaggcttcaaggctatgttttttcagttggaaacttggggatcggttgggctctaacaggtgagaagtgcattagtagcgcgcttaggatcttgagagtgttcgaaggactcacgcctacaaccaacaactttaag

SEQ ID NO: 57274 - DNA, 519 bp, Glycine max
  Peptide Sequence Number=SeqID_174052
atggagagtcagttcctaatggtgcttcagatgaggatgtggtggtgcagggataatctttcacccaatgaggtggttgctgaagcaagaccaaaatccaattggaaagtgaataaggatcctataaagggtaaaccttttgcccgtggaaaatctgcttttccttctggaaggtttctgccacggaatgcaggggtgcatgctgaaacaatattacaaaatggagaattacatacggatttaagtgagaatttggaacgtgggagaggaaacatgtttgctacggtgacaaatactactgtggagataatagtttctgaacacgtctttggttctgtttatggtgaagatggtggcaatttggatcgaatcagacagatttcaggtgcaattgttacggtttatgatccttccgttggtacaagtggagggaaagttgtcatatctgggacaccagatcaaacctttgcagcgcagagcttgcttcaagcctttattcaaacgggacaagcaagctga

SEQ ID NO: 57275 - DNA, 306 bp, Glycine max
  Peptide Sequence Number=SeqID_174053
atggagacatggagtatgacaaacatgagaagaaatggaaaggaatggagagggaccatacaggctttcatcatgattcatgatcactttgaaaaagtgaatgatgtcagagagctcaggatggataaacttataaattccatgaacatagagagcatgaaaacaatgaataatctaaggggagccaactattctttggggtcttacaatgttggtccaattggaaaaaagattgacaatatttccttcaactatgtagttcagcttagcagcttgagttttgttggaagttggaaccaaatataa

SEQ ID NO: 57276 - DNA, 276 bp, Glycine max
  Peptide Sequence Number=SeqID_174054
atggccattgagggtttacaactgggggtgaaagaaagaatagggataaaaacaaagaagatagaggaggaagagagagctcaggcttggagtgctgaaaacaatgttgtcaatgagaatccttgtataagtgccaataaagagtgcgtagatgctgtcaagggtggtatacaagttgacaaccgaactacaagttctgataaacatactccagaagcagcagaagacactattggtatacttgctggaaatggtgaaaatgttggttcattttag

SEQ ID NO: 57277 - DNA, 1248 bp, Glycine max
  Peptide Sequence Number=SeqID_174055
atggtggaaagaggctgtgagccgaatgtttatacttactctgtgttgattggttacttctgtaaggaggcgatgaggataaatgggcagagtcggagaagctggtcagatttggagtccctcaaggaaaaacacttcaaagcaaatgagcttgtatatacagccttgattgatggatactgcaaagctggggaaattgaagatgctgtttcaatgttcaaaaggatgcttactgaggaatgtttgcctaacttgatcacattcaatgtattgattgatggcttacgcaaagagggtaaagtgcaagatgcaatgttgttagtggaagacatggcaaagtttgatgtgaagcccactcttcatacttatactattcttgttgaggaagtactgaaggaatatgacttcgaccgagctaatgagattctcaaccaaatcatttcatcaggatatcagcctaatgtggtcacctatactgcatttattaaggcatattgcagccaaggaagattagaggaggctgaagagatggtggtgaagattaaaaatgaaggcatattgcttgactcctttatctataacttactaattaatgcatatggatgtatgagactacttgatagtgcatttggtattctcaaatgcatgtttgatactagttgtgagccttcttatcaaacatactctatccttatgaagcatctagtaattgaaaaatataagaaggaaggaagcaatcctgtggggcttaatgtaagtttaacaaatatctctgttgataatgcagatatatggaataaaattgatttcgaagtcacaactgtgctctttgagaaaatggcagaatgtggctgtgtgcctaatcttaacacttacagcaagcttattaaaggactttgcaaagtgggactcttggatgtagccttcagtctgtaccatcatatgagggaaactggaatctctccctctgaaattattcataattctcttctaagtagttgttgcaagttgggaatgtttggggaagcagtgacattgttagattctatgatggagtgtagtcatttagcacatctagaatcctataagcttctaatttgtgggatgtttgagcaaatgaacaaagagaaggctgaagcagttttttgtagtttactacgttgtgggtataattatgatgaagtggcttggaaagttcatattgatggtttagctaagagtatgttgatcaatgctcagaatttctga

SEQ ID NO: 57278 - DNA, 1155 bp, Glycine max
  Peptide Sequence Number=SeqID_174056
atgcaagaccccgccacctccgacaccgatcaccaaacgacgccgtcgccgaagcgcagcaacaccaccacgactaaccgttctagcaagcgccccgtgttcaaggtcctcccggggcagatcgcgttccgcctcgtgtgccacgcgtccaccgtcggcgggctcatcggcagctccggctccatcgtgtcgcagctccgccgcgagaccggctgcaaaatccactgcgaggactccctctcctccgccgaggaccgcgtcatcctcgtcatcggctccctctcgccgcgaaagggcctcctgctcggcgacggcggcgaggtcgaggtctccagcgcgcaggaggccgtcgttagggttttcgagagggtttgggacctcgaagccgagaaaggcgttaattctaacagagctgttaacggcgaggttttctcgaagttgctagctcacacttcgcagattggtgccgttgttggcaaaggagggaagaacataacggccattaggaacaataccggtgccaaaattagggttttccctcctccgcaatgcgccaccaaagacgaagagttagttcaagcatttttgcctatattttttaccgggggtgttaaattgcctacaaagggatataggataactggtggaattttggctgttaagaaagcgctgatttctgtatctcattgtcttcaagattgtccgccattatgcaaagttccagttacttctagtacaccaactgttagctcttctgataggttgtcctctgatccaaatgctgaacttttccctcaccttaattcattgttaacctccatggaaggtttatctatatacgaacggaccacaaactctaatgaaacctctaaccgtgactcaaaaggtgcagaacacgaagttgtgtttagactcctttgctctaataatgtagctgggagcgtaattggcaaaagaggggctatagtcagagctctagaaagtaaaacaggtgcttctattatctttgcagctcctttaagcgagcatgccgaacgcattgtcaccatttctgctgtagagagccttgagtcttgtaattctcctgcacaagatgctgttattcttgtctttgctagaattattgacgatcacattggacagggttttctccaa

SEQ ID NO: 57279 - DNA, 195 bp, Glycine max
  Peptide Sequence Number=SeqID_174057
atgccgcaccaccctcccccatctgaattcgagaatgagtttgtcattgttgcctccctcaactcgctccacaacaactccgccatcaacgatctcacccaccccccctccaacgagtgcaccctcaccatgaaaatgcaaaactctacccacatgggtagtgctattagcacttccattagtgccataaagtag

SEQ ID NO: 57280 - DNA, 246 bp, Glycine max
  Peptide Sequence Number=SeqID_174058
atgggtggggtggacccggatccggttctgatttcgacggtaacaggggagggacctcacatgaggaacccctgcgaggttggggctgtgctctcaaaatccgagcatgatgtgtcaaattcccatggcatcaatcgctcacacacccacctagcatcaccttcccctcccttgttgcttgatagtgatggattagattggatggatgtgatggctgagtggggtcattattcatgttttcaataa

SEQ ID NO: 57281 - DNA, 858 bp, Glycine max
  Peptide Sequence Number=SeqID_174059
atgggagagaaagagtggtacttcttcagcttacgtgacagaaagtacccaactgggttaagaaccaatagggctactgaagctgggtactggaaagccacagggaaagatagagagatttacagctccaaaacttgttctttggtggggatgaagaaaaccttggttttctaccgtggtagagctccaaagggagagaaaagcaactgggtcatgcatgagtatcgccttgaaggcaaatttgcttaccactacctttctcgcaactccgaggatgagtgggtcatatcacgtgtgtttcggaagagtaacaccacaccgatcaccaatggaggctccaccatgtccgcttctactaactccaagaagacaagaattaacaacaccacctctcttatccatgaaccaggttcaccctcttcagttttccttccacctcttctagactcttctccctacaccaacaccaccaccaacaccttcaccgaccatcacaatagttcttatgatagtgccaccaaaaaggagcacgtgtcctgtttctccacaatagctgcagcaacagctgttgtctcccccaacaacaacttcaacaatgcaagcttcgaccttccaccttctcagcctcttgcaaccgacccttttgcaaggtttcagagaaacgttggtctttctgcttttccaagtttgaggtctctacaagacaaccttcagctacctttcttcttctccacggcggcggcgcctcccttctccggcggaggctccggcgacttcctcagctggccagtgccggaggatggtgtttccaacatgccactgggcgtgtcggagcttgattgcatgtggggctactaa

SEQ ID NO: 57282 - DNA, 1446 bp, Glycine max
  Peptide Sequence Number=SeqID_174060
atggcaaaagcacacgtgctgatcttccctcttccattgccaggccatttaggctccatgctcaagctcgccgagcttcttgccctagacaatatccacgtcacctttgtcgataccgagaacatccacattcgcctcactcgtttcggggacattcaagaactctcagaatgctaccccacgctccatttcaagaccattcccgattgttacgatgaagaaggcgagcaccctggattcggagaccgtgttggggacttcattacatctacggctcagcacgccaagccctttttgagagacattctggtgtcccagcacagtcctggaattcccaaagttagttgcattattcaggatggaatcttcggtgccctttcctctgattttgctgctgagttacgtataccactcattcattttcgaaccgtcagttcctgttgcttctgggcttatttctgtgttccaaagctcttagactgcaaagaacttcccattaaaggagaagaggacatggaccgcataataaggaatatgccaggcatggaaaacttgcttcggtgcagagaccttccaagtttctgcagaccaaacacagaggggaactttctggagtgggcagtgttccgaacccgacaatcacttgcagcagacgcactcatgctcaacacatttgaggatctagaaggctctgtcctctcccaaatgggtcagcacttccccaaactctacaccattggccctatccaccaccatttgaaaatcagaaaagcagaatccaacaaagcaaaagacattcccacgtttaagaacagtcttttccaagtggacaggagctgcatggcgtggctcgaagctcagccacaagggtccgtcatatacgtcagcttcggcagttccacgattgtgaaaagagaggacttgatggagatttggcacggtttggtgaacagcaagaaacggttcctgtgggtgatgcggcctgacattgtggcggcgaaagacaatgatgaccggataccggctgaggtggaggaagggactagagagagggggctcattgtggggtgggccccgcaagaggatgtgctggcccacaaggccgttggtgggttcttcacccacaacggctggaactcaaccttggacagtgtggtggctggggtgcccatgatttgctggccttactttgcggatcagcagattaacagcaggtttgtgagtgaggtttggaaacttgggttggacatgaaagatgtgtgtgatagacacgttgtggagaagatggttaatgatctcatggttcataggaaggaggagtttcttaaatcagctcaagaaatggctatgttggctcacaagagtgttactcctggtggttcctcttactctagttttgacgatttgattcagtacataaaatcagcaagcaaggaaaaaaattaa

SEQ ID NO: 57283 - DNA, 363 bp, Glycine max
  Peptide Sequence Number=SeqID_174061
atggctgaaccgcaccttgcaccgtcggcgacccttggcctcttcactcccttccacttctcctccatcaacgaaaaaacctcgtgtgccgtcgtcgacggcggcctggtgataaacaatctggtagcagctgccatcatgcacgtcctccacaacaagcgcgattttctgtcagtgaacagtgtggaggatctcctcgtcctgtccatcgaaaacgaagctcaggcgaagagaatgaacaacatcggcgagtgctcgacgtcgacggtggttgacattgcgctcgaaggcgttttcaagaccgttgaccagatgctagaaaacgccttttgttggaaccatactatctacgtcaagatttag

SEQ ID NO: 57284 - DNA, 963 bp, Glycine max
  Peptide Sequence Number=SeqID_174062
atgacagaaggtgaaggagcgcacgcgctcatcttcccttgcccattgcagggccacgtagggtccatgctgaagctctctgagaatcctaccctacgctccattattcattttcgaaccagcaacgcgtgttgcttctggccttatttctggattccaaagctctttgagtgcaaagaacttcccattcgatatgaggacatgtaccgaatcatatgcaatatgcctggcatgggaaacttgcttcgatgtagagatctcccaagtttctgcagaccaggtacagaggggaacttgtctatggactgggtttggtttcagaccaaacaatcacttgcagcagatgcagtgatactgaacacatttgaggacctgttctctccagatacgtcttcactttcccaaactctacaccaccatttgaaccctcaagggtcggtgatatatgtgagctttggaagttccacggttctgacaagggaggagttggtggagttttggcacggtttggtgaacagaaagaaccggttcttgtgggtgatgcgtcctgacttggtggtagggaaagagaatggtgactggataccggcggagctggaggaagggactaaagagagggggttcatggtggggtgggccccacaagaggaggtgctggcccacatggccgttggtgagttcttgacccacagtgggtggaactcaaccttggagagcttggttaacagcaggtttgtgagtgaggtttggaaacttgggttggatatgaaggatgtgtgtgatagaaaagtcgtggagaagatgattaatgatctcatggttcataggaaggaggagtttctgaaatcagctcaagaaatggctatgttggctcacaagagtatcagtccaggtggttcctcatactccagtctcgatgatttgattcagtacataaaatcagcttgcttggaaaatagttaa

SEQ ID NO: 57285 - DNA, 283 bp, Glycine max
  Peptide Sequence Number=SeqID_174063
atgtctggcgctctgttagcctgtgcgctgttgctcagcggctgcgtgtcagtgccggatgccattaaagggagttctcagcttccacagcaggatttattacgcgtgatgaatgcgccgcagctgtatgtcggccaggagtcgcgcttcggcggcaaagtcgtgaaggtgaccaaccttaacggcctgacccggctggaaattgccactcagccgctggatgacagcgcgcgaccgcgcctcggtgcagcctcaattggccgcatttatgcgttctttcatg

SEQ ID NO: 57286 - DNA, 702 bp, Glycine max
  Peptide Sequence Number=SeqID_174064
atgtccgcccgaattttagccctggacaccgcgacagaagcctgttctgccgcgctgctgaatcagcagcagatcgatgcccgcttcgaaatcgccccccgcgatcatactcaacgtattctgccgctggtgcaggaagtgctgcaggcgcagtcgctggcgctgagcgcgctggacgcgctggcgtttggccgcgggcctggcagttttaccggcgtgcgcatcggcattggcatcgcgcagggcctggcgctgggcgcaaatctgccgatgattggcgtatcctcgctggcaaccatggcgcagggcgcctggcgtttgaccggggcaacgcgcgtgctggcggcgattgatgcgcgcatgggtgaagtctactgggcagagtatcagcgtgatgagcagggcgagtggcagggcgctgagagcgaagccgtactcaagccggaagcggcacaggcgcgcattgcacagctgagcggcgagtgggccaccgtcggcaccggctggcaggcttatccgcagctgctggctggcgcgagcggggcacaactgctgaccaccacggtcacgctgccagctgcagaagatatgctgccgctggcgctcagcgcctggcagcgcggcgatagcgtggcagtggaaaatgctgagccggtttatctgcgcaatgaagtggcatggaaaaaattgccgggacgctag

SEQ ID NO: 57287 - DNA, 216 bp, Glycine max
  Peptide Sequence Number=SeqID_174065
atgccaatggtgatggaaaacttggtttttttcctacttttagcatttactcttgtcaacaggcatccttattggactgcattgtctccaaaccagaatggaggaataaaagggagcaaattgacgtttgacagcatatggattctgctgtttgagaaggggctcaagggtgcaccctgggatactcataaataccaatgtgttatgaagtcctga

SEQ ID NO: 57288 - DNA, 186 bp, Glycine max
  Peptide Sequence Number=SeqID_174066
atgttgcaactgggaaaaagtctaaaaatcgaagattttctcttgtcggagtgccccgggtttttcgagttgttctgcccgcttctggattggatcagtttgcatggacactttacgcatgggcaccatatattgctagttctgttgtgtttctacgaagctatctgttgtcctgtgtttaaatga

SEQ ID NO: 57289 - DNA, 184 bp, Glycine max
  Peptide Sequence Number=SeqID_174067
atgaggagcagacggatcggaagcggaggaggtagagagggctttcgaggaggagttgtgatattttgtgtaggaggtcctttgggagttcagaccaagcttaaccaaatccacgacgaggtagtagggttcttgccggcaagtggcaaccatggccactaccagcttgcagatgagccctcag

SEQ ID NO: 57290 - DNA, 1377 bp, Glycine max
  Peptide Sequence Number=SeqID_174068
atggcagactggtctgaactcccaaaggacctcctacacaaaatatcacaactcctcctcgaaagccctctctacctcctccgcttccgatccgtctgctcctcatggcgttcttccactcccccgtctcccttcaacccctcaatctccctcaccaacaccttctccctctcccaccgcaccctcctcctcctcaaccctaactctaaccctaaccctaacccccgcccccgcccctggctcgtcaagctctccctcgacccacacgccagcaccgcgcgtctcttccaccctctctcccgcttccccatgaaactgccccgtttcgccctcgacctcttcaccctccccgccctcgacctcggccgcgagttcctcctcaccaacacgcgccacacccgcgactccctctacattgaaaagctcgtcttcctccctctcacccatcgaaaagaccgttttgccctcctcacgatccacgtctccgggaaactcgccctcttccgctccggcgaggacggctggaccgtgatccccgacatgccgaccccctacgacgacgtctgcgtctttaagggcaacctctacggcgccgacagtaacggccgcaccgtcagggtgcggccggatgacggtggcctcaccctcgccgccgagcctgtctttggtggcgacaagaagttcctcgtggagtccgagggcgcgctgctgctcgtcgacatgtacctctcctactactcctgcacgcagggtttgttccacgaggatttcgacgaggaagatgtggccgggatggggtgggagaggacggtgaagtttgacgtgttcaggctcgacgaggaggggaagaagtgggtggaattgaccgatttgggggagagggtgttgttcttgggggatgattgtgctttctcggcttctgccaaggatttgaaccttgggagagggaattgcgtggcttttagagatgatgggttgggttttaatagggttttaaatggaatgggggtttttcgtttggatgatgggcatcgtttgttgctagttctgttgttggtctacaaagctatatgcttctgtcctgtatttttcaaactaaggctttcgagtgtttccatggtgaattgtgcttatcaatgtcatcaatggaagaacatggcagagggccaaaactccgccatatcaacatgctattacaccttatggtgccaccatgggcaccaagtcattggtacgagtagtattgggctcaatctccttaagcaagggggagggttcgagctttgtagatggaaaaaacgtggttgggagggtagtcccattaaaggtggccagccggattttctggcaaagattagtcatcagcaaagctggtag

SEQ ID NO: 57291 - DNA, 179 bp, Glycine max
  Peptide Sequence Number=SeqID_174069
atgaagaccgacacggaggccttaaaagagcaaatggccacaatgatggaggccatgatgagcataaaggagataatggaggtcaatgcggctgcaatagccggtaccagcaccattgctgaggtggacctgacccccctatatggcctcaaccaattaatcatccaagctcagatatg

SEQ ID NO: 57292 - DNA, 414 bp, Glycine max
  Peptide Sequence Number=SeqID_174070
atgtggcatcatttattacatccacccattacaagtgccttccataccttcgatgctattgatgtagacgaagccatggacttgttagttgagttgcttgaagtcaatacacaagaagcaaaagatgagactgatcaatgcaaaggggcatatgttctcctagcctggctgcgagacatttattgtaacaaatgtgacgcaagcaagagtgtcacacacatcagtgtggtattcttagacgcatatcgtgacctcagccaatctggagtctattcatggggagcggctgcactggtccatatgtatgacaatctgaatgttgcatccaagcatacgacaaaacatcttgcaggatatatcactctgttacagtgttggatctacgagaaccccacaattgcttccatcatttga

SEQ ID NO: 57293 - DNA, 168 bp, Glycine max
  Peptide Sequence Number=SeqID_174071
atggaagttgttcacagaattgctataacattaacaacaagtagaagagcacgtgactctcttggtttgaagcctaacactaggggagggaagcaacatttctttggtcattgtcattggaaatttgttgtaccacatcttaatgccaacattgttggtggtggttga

SEQ ID NO: 57294 - DNA, 351 bp, Glycine max
  Peptide Sequence Number=SeqID_174072
atgtggcgtctccaatcatcttccttccttctccattccgctgccattgatcttcaagaagcaaaggactccattgatgaagaagatccaaggcctacaagctccacatggaactacatcacacttgatgacaatggaattcttaaggttgctcagttatctcttgatgaaccagaaaattccccacaatacaatcaagggaaaactaaaatgtgggacattgcagaagatgaatttggtccacttgatgacaatggaactcttgaggttgctcagttatctcttgatgaaccagagttagaagttgtgtttttcaatgatggtgaacaagaacaaaaggaaatggcttaa

SEQ ID NO: 57295 - DNA, 510 bp, Glycine max
  Peptide Sequence Number=SeqID_174073
atggttatcagtgatcgttggtcttcttacaaggaggatgatgtcaataaggttttatttgtgaaagaaactttgttgagtggtatttggtgggataaggttgattacatacttgctttcactactcctatctatgatgttcttagaaaaacggatacggatgcaacttctcttcacttggtatatgaaatgtgggattcaatgattgagaaagtgagaaaggccatataccaacatgaaagaaagacaaaaaatgaagaaccaatcttttatgaggtagtgcactcaatattacttgatcattggactaagagtagtagcacacctcttcattgtctagctcattctttaaatccaaggacattgcaggagatgaatctggtccactttgatgcaatcttacccccaagggcattggatagaggagtccaagaagattgggctagagaggcaagagaaggccctagggttttcatgagccttagggtagattttgggcccttggactaa

SEQ ID NO: 57296 - DNA, 321 bp, Glycine max
  Peptide Sequence Number=SeqID_174074
atggaaatcaaaaggacaaatgaagagtggctaaaaaaatgctttgtgggatggttaaacaaggaggcatctttgttcaaccttcaaaaggctttcttggggttaggatggtggaagaggttaaaccttggagggaaggaagttgttgttggcaaaggaatcatgtcatcgttgatgatgaatcagtcgaagaagaatggtgaggttcgttgtacctgggcaaagccaacatttgcaaaagcgttaacaaggttttgcctagctaaattaacatttgtgtcacaaagtgggccacaacaggacgacgataaaataagctaa

SEQ ID NO: 57297 - DNA, 294 bp, Glycine max
  Peptide Sequence Number=SeqID_174075
atgatgatgcagtctagtgcgaggttgttgacaatgaggttttcaagaaacaacattggtgaggttgtactatccgatgacaacatcggtgaatggaggctggttcgagttcaaacgacattagacaatgtcatgcaaagagggaaaccaaaaacgcgaagcagaagagacttgagaaggccaatgaagtgcctgcgtgcaatggctaaattgtgtccccatgggtcgtgtccgtgtcagaagcacgtcggacatctcaacacaccactccatagtcgtgttcgtgcttcctag

SEQ ID NO: 57298 - DNA, 537 bp, Glycine max
  Peptide Sequence Number=SeqID_174076
atggagtcaaacaacatgccagacttgaacggtgtcgctaagaagactaaaggtcgacaaaagatcgaaatgaagaagatgagaaacgagagtaaccttcaggtgacattctcgaagcgttgcactggggttttcaagaaagccagtgagcttgcaaccctttgtggcgtggatgtcgctgtgattatgttctcacccgataatcaagtattttcgtttggcagtcccagtgttgattctgttgtccaacgctataagacacagggcccacctcccctccttaccttggacctcaacaaggtgcactccactgtggacgaagttgagctccacacacacctccactgcttgtccaaccaaattgctattgagaagaagcgcacaaaggatttaaatcatttagcgaaggctgcagaggatcagttctggtgggctaggcctattgaaagcatgactgattcccaacttgacaagtataagaagatgttagaggattttaagagacaactcaaagaaaaacgtgggaacctcaactga

SEQ ID NO: 57299 - DNA, 409 bp, Glycine max
  Peptide Sequence Number=SeqID_174077
atggcgaggattcatgacaagatttggtctattgatggatcaaaagaaacgcttaagcttgttgttaggatcaccgatctttggttcgttgggactcctaacaagtctgagcaagcggaaatggtttttgttgattatgagggtgatcaaattcatgctatttgtaaatcggaccacctcaagtcttggaaagctgatttgaaagagaattgcacttatgttatgcataatttcaaagttgttaagaatgatggccaatttagagtgtgcgaacatgagtacaagttattttttattggagtgacagttgtaagagaagctgatttgcatgaactgccttttaaggaatttagatttgttgaatttgcaaatgttgttgctggcaattttgtgtctggcctattggttg

SEQ ID NO: 57300 - DNA, 303 bp, Glycine max
  Peptide Sequence Number=SeqID_174078
atgaaagggagtggtcgagaagggtgggaggtgtttcttgattggttgatgattacgccttcaataaggaccggaagggtggaatcgagtgagggtgatgtggaatcaaagacaagtataaagagaatggtggtggtggcagcagtgccgatggtgctggtagtggtggcaaccagtgggtgtggtggtagtgacaatggtattggttgtagtggtgatggtgataatggtggtggtgttggtagctgtgcaaatagtggtgatggtgtcggtggcagcggaaaggatcattgtcaaatgtag

SEQ ID NO: 57301 - DNA, 1099 bp, Glycine max
  Peptide Sequence Number=SeqID_174079
atgaagatgatcatcgagagtggtactatacacaaggatatcatccaagaaaaccaccgtgaatttacgcaaaaatggctgcaacagagcattcatcgtggcctgaaaggtagaaggtgcattgctcaagccaaaaggcattacgcgatattcgtaatggccttgatgggtgcgaaaggcggtcttcggtcaagcttcgaaaaccatgaggcgtggccaaggtcgtccaacaattcatcaatggttggcatggggaaacgatccttgatcgtgacggagtttagagcacggactttgactcaggcgaatcagaccggcctggaggagagcaacaacttgcctttcgattttggacttctggcaatagggataacgataaggacagacgttaataggtggggcagaaggttaaaggttgatacgatggacaatttggcggggcggagagtgggtgaaggttcgggtagtaaagccaaatggaatagggctgaggttgaacgggtctggataagccgtttaacctgtggtgcagatatgggtgtaagcccaaaagacacgtctgccttcaatgtaactgggcctaacccttttaaccaagcaatccctaatactacgtctgcgccgctaatgaggaacctggtggcagtcgaggacggaaccgttgccgaccaggacgcgcaatggcgtggtctcggtgacaggcaagtgcaggaacttggcgacgcgtggctagacgaaattgtggggtccagtggtgtagggtctgaggaaggagagaggggtgggctagggtcagttgtaacaaaggcccttctcgcgacgaaaaaccatctcctctggcgtacgggcggtagctgcggcgacggtcagtcaacttgtcctcctggagtttcgccaaggcggcggcctgggcccgacgatgcggttagcaagacgctcgaagtccgtaaggccatttcacgaggtaataaagccattgcggtacatccattggtaccagctcagggctggaccatccatgtaaaacgaggccatggtgatgcggtcctcaaaacaccggcgacggtggcggaggaagcaaggtcaattgattcaagcg

SEQ ID NO: 57302 - DNA, 207 bp, Glycine max
  Peptide Sequence Number=SeqID_174080
atggagcaatatgaaattcttgaacacattggaagaggttcctttgcttcagctctacttatcaaacacaggcacgaaaacaaaaggtatatccttaagaagatacgtcttgcccgccagactgacagaactagtagatctgctcaccaggagtgtttttggtttatgcttcacaaatgggagttattttggactggaaaagtttaa

SEQ ID NO: 57303 - DNA, 204 bp, Glycine max
  Peptide Sequence Number=SeqID_174081
atggagacaaaagagatgaataaaatgacaccacaatcacactttgataatcgacaccttgatgggaatcaaaacggttcaactcaaaaacctaagaggagcttactgattctcacagataagcaaggcttaatcttcactcaaccacatcaaaacggttcaactcaaaaagccatacctaggtatgacaataaaagttcctaa

SEQ ID NO: 57304 - DNA, 413 bp, Glycine max
  Peptide Sequence Number=SeqID_174082
gttcaggctctaattttatgaatcccttcgaggattgtcaatctccaactaatcagcctgtaatcaacactaaaggatattctgatcttggtgatcaactcatccaatatagatattgtaatgcacaaatgtggtatgatgaaagaatatcaaaaaataagaattgtcagaatccaaggttcagtttatatagtggagatggcaaagttgaattgccattattacaaaatccaccccaatatctgcaacaacttatatttcatgatgatacaattgatagtaaaaattatcaacataacttgcgagcatacaacataatgtttgcctttacttctgctggaattaagctagataaaacaattaataattcaagaggacctacgacgatcaaaataagggcaaccatgccatag

SEQ ID NO: 57305 - DNA, 2049 bp, Glycine max
  Peptide Sequence Number=SeqID_174083
atgcttacttggcctgttccctcttcgcagaaggaattatgcagttttttgggtctcaccggtttttaccgtcattttatcaagggatatgtttccattgcctcagccctgacacctcttctttgcaaggacaagttcctctggtctccagcggctcaggcagcctttgatcggcttaagcaggctatgacctgcgcccctatgctcgctcccccagattttgccattccttttgtgttagaaacatatgcatccaatagtgcaatgggtgcagtcctcatgcaacagggacacccgattactttcttcagtaagcaattcagtccacgcatgcagcgagcctcaatgtatgtgcgcgagctccacgtgatgacaactgcaattcgaaaatggcgtcattatctgctgggtcacccatttacaatactcacagaccaccggagtttgaaggacctaatgtctcaggtaattcaaacccctgaacagcaatactatctcactaaacttttgggttatgattacaagattgcctacaagccaggtgcaactaatgtggtggccgacgcattatcacgaattgagtctggccgcgatagtactctattcatcctcacatatccctactttgattttatgactcagcttcgtcagagtcttcactccagccctgactttcaggcgatgcgtgattccatccttcgtgaccccattgcttatccagattaccgaattcaggatgacttgatattctgcaaaggcagcatttggttggattcgaaaaatcctttcattcaaactcttctcttggagtttcattccagtccattgggaggtcatctcggtgttgctaagactctgcatcgcctccaggccaatttccaccttactcaccgtctggcgggtcttctccaaccactttcggtgccgttaggaatctgggaggatctctccctcgacttcattacccatcttccgaaatcgcacggttacaccgtcattttggtggttgtggaccatttcacgaaaggcgtccacctcggcgccttgccggcccagttcactgcatctaaagttgccactctgttttttgatattgtgtgcaagcttcatggtattcaccgtagcctggtatctgatcgcgaccaagtgtttgtcagtgcattttggagaaagttgtttaaactcagtggcaccttacttcgtcttagcaccgcttatcatcctcaaacggaggttatgaattgcgtagtggaacagtacctctgttcctttacccattctcgaccgtcggagtggcaccagtttttgagcttagtcgaatggtcctataacacctcgctacattcaagcaccgggatgactccatatgaggcgaccttcggcaaacctccttcttccatccctgactatgtcgttgggacttccaggaatgaagttgttgactcattgctgactaacaggcagattatacatgcttccttgacacaatgtctgctcaaagcacaagccgctatgaagaagtatgttgacgccaaacatagggacaaggagttcacgggatccgttacaaagaccacaaatcagaagcttgctaaacgatattttggtccttttgaaattttggagcgcattggcagtgttgcttatcgcctcaaactgccaactgattcaaggattcaccccattttccactactccttactttgtcctcactatggtcccatttctccccaccccagtgctctgccccctcacgtcgtcgataatcaaccagtcctagaacccctttccattatttcctctaaaatggatttgaccaccagtcccctaacacccatggttctggttcaatgggtgggtctgccacccgaggaagcaacttgggagccttggaataccatccgcgatacttaccaccttgaggacaagaacccaactgaagacataccggtgccacaaggaagcagcaagcccaatgaagtcgagacccatagggagaggcccaaacgaagcaccaaacgccctacgtacttggatcagtatacctga

SEQ ID NO: 57306 - DNA, 285 bp, Glycine max
  Peptide Sequence Number=SeqID_174084
atggaggccaatacattcctgccaccagccacaaagtcccaggccaagtactctgatgacaaatcaaaaacgggaagacaaataccaagtggctctctatacctagccaggaagcatcttttggaaaggaaattagtacatttttttggtggggtgaacgcaaccgatgcagcctcttcttttgctggtgcctctattgtgtcgtcatcggcgactgctgctttgattgttctggagaacttgaggggcttcgagcgggagaaggagaggtgcggtcgaaattag

SEQ ID NO: 57307 - DNA, 465 bp, Glycine max
  Peptide Sequence Number=SeqID_174085
atggaaagggaaccttgtcgtctcattcttgccgacgtgttttcccactcttgtgcggcggctgaaggagacgatttggggttgggtggtggtcgaaggaagatccaatcatttaattcgttagtggagatgctggagatcaaaagaggggcgtttggtgcttcgtttgggcctctccctatgggtctcgacttcattgggcttgctgcttccttgtggcaccggtatgtcttcagttgggttctagggattgctagcaataccccctgccgggaaaaccaccttgtcctcaaggtggtaagtatcgcggatggtattccaaggctcccaagggttctaggactggttgattatcgacgacgtgagggggcagagcactggggtggggagaaatgggaccatagtgaggacaaagtaaggagtagtggaaaatggggtgaatccttgaatcagttggcagtttga

SEQ ID NO: 57308 - DNA, 174 bp, Glycine max
  Peptide Sequence Number=SeqID_174086
atgaccaattatcaaaagagtgcctcaaacaacttaatcaggagatccatttgctcagtcagctttcacagggatatcaaaggggctaacattctagttgatcctaatggtgaaatcaagctgacagactttggaatggctaaacatgtaagtttatttgcttttagagaatga

SEQ ID NO: 57309 - DNA, 482 bp, Glycine max
  Peptide Sequence Number=SeqID_174087
atgaatgatgggtattccaacctggtgtgctacgtctatggtgagggctccgaagactccatcggctatgaagcaattgatcttgggctttccggggtcttgggagagaagaatgtgtctgatgtgaggttttgcgtgcaaatttatgtattgaaagaggtccactgcgctttgtccggaacgagggtggtggtgagggaggccatcggggaaggtcttgaattggagagagggatcgccgaaacggtggaggcggtggtggatgaagtctgtgttgaggaaggtgatgtggaagccatggagagcgagaagctgtgcaagcttcaacatggtgctgacatggccctgcgctggacaggggaagatggccacgagacaccacttcaaggaggtaggagagttgagaggagacgtcacttcaaggagaggatgagtcaagaaaaagctcaccatcataggaagccatggataagagcttggag

SEQ ID NO: 57310 - DNA, 1518 bp, Glycine max
  Peptide Sequence Number=SeqID_174088
atgatacccattatttatgaagcatatatgagcaaagcacaaaaagaaaacgcaacaagagcaaagatgaaggcggaagaaacaactgatacccacgtggccatcttcccctgtccagcgcagggccatgtcagcaccatgttgaagcttgcacagcttctcgctctccatggcttccacatcaccttcctcaacacagacttcatccaccaccgcctccaccgtttcggcgatctggaagctcttttacaaacctacccctctctccaattcaagaccttccccgatggcctccctcaccaccaccctcgttccggacaaagcgcagtggacctctttcaatacataaatttgcacgcaaaacctcacatcagacacattcttctctcccaagaccccggaaagcccaagatcaattgcttcatagccgatggagtcttcggagccctcaccatagacgtagcacaccaggttggaatacccatcattcattttcgcaccatcagcgcttcctgcttctggacttacttctgcgttccaaacctctttcagtctaaccaacttccaatcacaggggatgaagacatggatcgcgtgataacatgtatcccagggatggaaaacatgttccgctgtcgagacctcccgagtttcagtcgggggactggatccgaaatagtatatgctttgaattctttggccttggagacacgtgagtcgcttcaagcacgtgcactcatactcaacacgttcgaggatctagaaggttccgtgttgtcacagatgcgtctgcagtttccccgtgttttcaccatcggtcctctccacgcacacttgaacaccagaaaagagtccaacaccgaaacgacgccgtccacaagttgtgtcggtgaagtggatcggaggtgcatgacgtggcttgattctcagccgttgaaatcggtgatatacgtgagcttcggtagcattgccaccatgacaagggagaagctaattgagatatggtacggtttggtgaatagcaagaagcggttcctttgggtggttcgtcctgacatggtggggccaaaagaaaatggtgaccgggtaccggctgagctggaggaagggactaaagagagagggttcattgtggggtgggccccacaagaggaggtgctggcccacaaggccattggtgggttcttgacccacagtggatggaactcaactttggagagtctggcggctggtgttcctatgatttgctgccctagctttggagatcagcatgttaacagcaggtttgtgagtgaagtttgtaaggttgggttggatatgaaggatgttgcatgtgataggaaccttgtagagaacatggtcaatgatctcatggatcacaggaatgaggtgtttctgaattctgctcgggaagtggctttgttggctaaccgtagtgtgagttccgggggttcttcttattccaatttggacggcttgatccagtacataagatccattagtcaagaaattatttga

SEQ ID NO: 57311 - DNA, 687 bp, Glycine max
  Peptide Sequence Number=SeqID_174089
atggcgatacaagacattttacctaacaaagtcaagcatgccataactcgcttgtgctttttcttcaatgccatatgtagcaaagtcattgatcctctcaaatcgtatgagctggaaaacaagactgctattatcttgtgtcagttggagatgtgcattgtagaagaagctattgagttttattcagagtacattgaaaagacaaaatttgttgggcttttcgagtcttggcatgacaaaagagtgggagatccttgtgatgaaaggtggtcagtggttctacacggaaaaaccattggtattaatgtgaagatgatgatgattcaactattgatacttgtacacatggctacaccacctaactctcttcatcctcctcctaagtcagcagcaccttcgtcgtttacgtcgaagaagacaagaaaagcaacacgacttagatcattggatactagacaagttggggtggagagaccagtggttcatgtggatcctaccactaggaaatcgatgactgaatttgatattcatgaaccatccgatttgaggatcaagaaaaagatacttcataccgtaggagagcggtggaggcaatttaagtcaaatttgacctccaaatgggctctgacagatgacaaggagggcaaagatgataaagatgtttcaaagaaggcacatgccatttag

SEQ ID NO: 57312 - DNA, 204 bp, Glycine max
  Peptide Sequence Number=SeqID_174090
atggctaatccgggatgtaaattacatttcggattagggtgcagtgcaggaaacaagtccggagtagggtacaggaagcaaggtcgaagtttgggtcctgagtcctgcctgttgtttctcctcaaagcagtaataatgaattttgattatagttttttagttcttgacatgagaggaacaaagagaaacttgagctcaaattga

SEQ ID NO: 57313 - DNA, 360 bp, Glycine max
  Peptide Sequence Number=SeqID_174091
atgggcaaagtagacggggtgcaagagcggataaaggccgacatagaggccttgaaagagcaaatggccataatgatggaggccatgatgagcatgaagaagatgatggaggccaacatagctgcagttgctgagggaggcaaagaattgggaagtgcaggcgccccccattttgtgcaagttcaaaacaagcatcccttcccaccatatggcttgcctcccaattatacaccacccaatgtggtgcacactccttatgagaatgtcaataactccattcccatactcatcgagagccaacaacctcaatctgatcatgcacatgtctctcaacccatgagggaggcacatgaggggtaa

SEQ ID NO: 57314 - DNA, 396 bp, Glycine max
  Peptide Sequence Number=SeqID_174092
tctcagttgatagacattgagtcttcgacaaagggtgtagacgactatgttggtctctgcgtgtcatcagactggattgtgcttgcttgcatcgggttgacgaagaggagactaatgtcgtctcggttgatagacattgagtctttgacaaagggtgcagaccaccatgcgaccatgttggtctctacatgtcaatgggctcgcttgcccctggttgacgaagggaagactaaactagtcttggtcgtgataattgcgaggactttgagtcctatgaaagataaagacgaggactttgagtcctatgaaggcgaggactttctgtcctctataggcgaggactttgagtcctatgaaggcgaggactttgagtcctctaaaggagaggacctttag

SEQ ID NO: 57315 - DNA, 147 bp, Glycine max
  Peptide Sequence Number=SeqID_174093
atggaagccaaatatgatcctattgggattaaaggaattttaagcatgaagtattactacttgttgcgtaacttggccaaaattcaaaacgtaggtgttgctcatttagaatacagtcgatttgatgtggaatattacaatttctaa

SEQ ID NO: 57316 - DNA, 438 bp, Glycine max
  Peptide Sequence Number=SeqID_174094
atggtcgctcgctttcattgttccgacactatcaaaatcccccatcatccaaagacaagcgagtccgatagcatgcggagaccatcatgtttatccatttttatcgatatcaaggcaccaaggcttttgctaatgcacctaacctcttttatgctctttcttttgacaggaaatgagcaaaaaactcaaaatgaaggtgaaaagatcaatttagggggtgttcttcagcactgggcccatctaggcccatcaggaagcttcaacaggaagcaacctgctcgcctgggcaagctaggcggtaacctcctcctccattttttctataaatggacgtggagggctgaggggaaggggtcagcacccttggtattcatatttcacataaaattagtgaggacaaaaagaaaggagaaaatcaaggccgaggcgcttccgtaa

SEQ ID NO: 57317 - DNA, 255 bp, Glycine max
  Peptide Sequence Number=SeqID_174095
atgcttcagaagaagaatctgatggtgacgactcaggacctggacgattcatcgtctgttgatgacaataaagaagaagtcaacctatgtctaatgcctgatgcgtccaccaataaagtagaaccaatactggacacaggtttagatgatgaggatcctcggtctaatgacattgtcaaccctgacggtgaagagctctatgtggagcttgtaggccttggatcttcttcatcaatggagtcatttgcttcttga

SEQ ID NO: 57318 - DNA, 558 bp, Glycine max
  Peptide Sequence Number=SeqID_174096
ggaaataattggcgctgtaataaacttcagatatccgattttggactggcaaagtggctcccaagtaagtggacaaaccacgttgtcttcccaatagaaggaacatttggatatttggccccagagtactttatgcatggagttgtggatgagaaaactgatgtatttgcttttggagttttgctgttggagctcataacaggtcaccgtgctgttgattcgaatagtagacaaagtcttgtcatctgggcaaagccactgctggacacaaacaatgtaaaggatttagcagaccccagattaggagaggaatatgatcttactgaaatgaagcgcaccatgttgacggcttccatgtgtgtccaccatgcatcctccaagcggccatacatgaatcaggttgtgcttctactaaagggtgaagagacaattatagaaccaaagaaaaatttagttgcacagaaatctctcatgttagaggcatgtgacctagaagattatacttgctcaagttacttgaaggacctcaatcgccacaggcaattaatcatggagtaa

SEQ ID NO: 57319 - DNA, 466 bp, Glycine max
  Peptide Sequence Number=SeqID_174097
ggcgtttggtgcttcgtttgggcctctccctatgggtctcgacttcactgggcttgctgcttccttgtggcaccgtcactctttcattgtcaattcaaacatgaatcttttactcgccgctgtaactctcctcgtattctacatggtgaattttttttactcaaacctgtggatcccatggagaacagagcattatttcaaggagcaagggatatggggtcctgactaccgtctgatcttggggaactcattagagatccgtcggctctacgatgaagccaagtcagaaccaaccccttcatttgaccaccaccatgttatcatgggacgcgtggagtatgtgaaagttccgttcaaccctcagtccaagatgctttttggacaaggccttgtgggcttggagggtgaccaatgggccttttacagaagtatcataaaccttgcctttaactttggaacttgttaa

SEQ ID NO: 57320 - DNA, 372 bp, Glycine max
  Peptide Sequence Number=SeqID_174098
atgggagccacggagaaaactgatgtgtttagctatggtgtcatggttcttgaggtggccagtggcaggaggcctattgagaaagatgctcctgctgttgggaatggtaaagttggaattagcatcaatttggtggaatgggtttggagtttgcatcaagaaggtaagttgctaacaccagctgatccgagacttgaaggcaagtttgaggaaggggagatgaggaaggaacttttggttggattagcttgctcacaccctgattcaatggcaagacctactatgaggggtgtggttcagatgttgttgggtgaggctaaagtgcctattgtccttagagccaagtcgtctaccagttatagtacttcttaa

SEQ ID NO: 57321 - DNA, 120 bp, Glycine max
  Peptide Sequence Number=SeqID_174099
atgtctggaaggttatcatttactattgctaattggccttactgtggaagctctttgattatagcaactccagccagtagtgcttgtagtttatgtacggagtatgtgggagtgtgttag

SEQ ID NO: 57322 - DNA, 312 bp, Glycine max
  Peptide Sequence Number=SeqID_174100
atgtccaaagatcacatgccattgtgcattaaggaaaggaagaggattaagtctctaggtggatacatagatgatggttacctgaacgaccagttaggtttgaattatgcactaggcaactggaatctccaaggaatgaaggaaattaatggaaagggtggaccattgagtgttgagcataaacttaaattaatcacattgacaaaagaagatgaattcttcataattgggagtgatgggatctgggatgttttcacagcgaaaatgccatacactttgctcgaaggagtcttcaagagcacaatgatgtga

SEQ ID NO: 57323 - DNA, 402 bp, Glycine max
  Peptide Sequence Number=SeqID_174101
atgcccttgcggggtaggattgcatcaatgcaggtggtttttcagaatcaagggcaaggatggaggtcacatcctgggaatcaattcaacaaagaccaaggaggaccatccaataggcctcaaaatcaaaggcctagcctgtatgaaaggacaactaagctggaggagactttggctcagtttatgcaaatttcaatgtctaatcctaaaagcactgagtcaactatcaagagcctggagatccaagtgggacaactagctaagcaaatagatgagaattcttctagaagttttggagctaattctgagaaaaatcctaaagaagaatgtaaggcggtcatgactagaagcaagagggagaccatggtggaggatgaaaataagactagtgatgagaagtag

SEQ ID NO: 57324 - DNA, 562 bp, Glycine max
  Peptide Sequence Number=SeqID_174102
gtacttggagacattgtagagtctctggctggagcaattcttgttgattcaggatacaacaaggaggttgtgtggcaaagcataaggccacttttggaaccccttgtgacaccagaaacattaaagctccatcccatccgagagttgaatgagctatgccaaaaaagaagttataagattatactagaggacgtgtcccgcaaagatggtctgacttattatagaatggaggtagaagctgatgggatcattcacaagtacgagtataaaggtgatgctcttagggacacagccaagaagatagtctgcaaggaaattttgaattccttgaaggatggcggtgctcataaggacacagccaagaagatagtctgcgaggaaaaattaaattccttgaaggaaggagaatcaaatgaaaaacctggagattatcaggaagctgaaaagcttactgctgtgaagggttgtttagaagagaaagcaatgtcatttttagcaaaaatagctaaatttgagtcagactttgaatccaagatggccaaatctgatgagtttgtgcatg

SEQ ID NO: 57325 - DNA, 657 bp, Glycine max
  Peptide Sequence Number=SeqID_174103
atggaatctattccaaacatatataccatggttccttacctcgacagggagttcttctattcaatccttttccttctccttgttgctggatatctcgttcgtacacatcttctctttgtttctcgagtctatagtgagttacagacagagttcgaaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagtaaaacaatctattccttgataagaaaaataaaaaacgtgaatggtgattggattgatgataaaatagaatcctgggtcttgaacagtaattcgattgatgataaagaaagagaattcttggttcagttttctaccttaacgacagaaaaaaggattgatcaaattctattgagtctgactcatagtcatcatttatcaaagaataactctggttatcaaatgattgaacaaccgggagcaatttacttacgatatttagttgaccttccataa

SEQ ID NO: 57326 - DNA, 405 bp, Glycine max
  Peptide Sequence Number=SeqID_174104
atgattctcaaggaagcattcaacctggaggtacccatccaactaccccagaagaaacctcccaggacagggtcaaacacaaccaaatactatagatatcaccacggtattggtcacaacaccaaagactattggaccctgaaggacaagatagaagaacttatacaggttagggacttcaagggcatcaatctcgtcaatcaagacgaccctatggttgtctccatcatcatagcaaacttcatggtgtctagggtcttaatcgaccagggagcttcgctgatatcctgtattgggaaaccttccaaagactcgaggtctcacccgacactgtccaccctcacgctggtccactcttgggtttcacaagtgagagaggcaagaccagaggctacgtggacatga

SEQ ID NO: 57327 - DNA, 270 bp, Glycine max
  Peptide Sequence Number=SeqID_174105
atgggagaagagcgtcgtacagctgtcaaagaaaaagtcaacaatctccttcatgccaacttcatcacagaggttaggttggtcgatggaacgcccggattccaggtgctaagcttcccagacacttactccagatacaaccagatcagaatgcatcctccagatgaggaaaaaatgacattcattatcgaacatgacaacttttgctacaaggtcatgccattcgacctcaaaaatgcaagcacgacataccaacaaccaatggattga

SEQ ID NO: 57328 - DNA, 3294 bp, Glycine max
  Peptide Sequence Number=SeqID_174106
atgaaggtatatacatgtgtaagtgaagctgtcctcacagagttcataccaacatcaacaccaaaattcaagttttaccagggcaatgaagttcaatctgtattatttgaagatttagcatttaaactgaagatgttaaaagagcagcatgaatccaatctaaaaagttcagatttcactaaatcagcagctgagtttgcacgaagaagaacaaaaaagattttttctgctttaatattttgcctggatgagcttggtgtttggttggctttgaaggctgcagaatctttatcttctaatgatattcaattattttcatggggacattctggggatacagttgttaaaaactttatttcagctggtgtgcaaacactcaaaacttacttaccatgtggtcctcagtggtcaattggtgacaatattaaatatgatgtggagatggagctgttatcctccaaagtttgctgtcttattgactctatacttgagtacaggggtttgactgacatgagatgcataatttttgtggaaagggtcattacagccgttgtccttcgggatctattaaataccttgcttccaaaatacaatagctggaagactaaatttattgcaggacaaaattttggattgcaaaatcagtctaggaaaaaacaaaatgaaatcgtggaagaatttcgaatgggattggtcaatatcattgttgcaacatcaattcttgaagagggtttagatgttgaaagttgcaatttagttattagatttgatccatgtcacacagtgtgtagtttcatacagtcccgaggacgtgccagaatgcaaaattcagattatatattaatggttaagagtggggattcagttacatgttctcgactagcgaaataccttgctagcggggatattatgagaaaggagtcattgcgccattcttcccttccatgtgatcctcttgaagaagatagatttgacaaggaaacttatcgcgttgcaagcactgaagcctttgcaaatcttagttctagcattagtttgatacacttgtattgctcacggctccctgcagatgggtactttaaaccaactctgaggtgggacaaagagactggaacattgtatcttcccaagagctgccctctacagcctattcgtgtagaaggagataaaaaaatcttaaagaatatcgcatgccttgaagcatgtaaacaacttcataagattggagctttgtcagataatcttgttcctgatattgtcatggaagaagcagaggtggaggaattagggaatgaaccttatgatgaaaaccaaccaacttttgtcccatttggattggtaaattctgtgtcaaataatagtcaaacggtctatcattgttatttcatggaattcaataacaaatttagctatgatgtatctgtccaagatatttttcttctcatgcgaattgagctcgatccagaaattggatgcatgcaatttgatatgggttttgacagaggtagcttgtcggtaaactttagatacaaaggaaccattaatctttcgcctgatcaggttcttttgtgtaaaaaattccaagttactatacttagaattctaatagatcatgatatgaataagttgactgctggtttggacagatgctatttggaagatgatcttgagattgattatcttctgcttccagctatgggtaaagggaaatatacagctattaattggttagctgttaattctgtaaatccatctgaagttagctgtaagtatcatgaaccccacataaggacaaaaagtggtttagtttgcagttgtaaactacaaaatgcattggtttgtacttcccaccctattggtaagattagcttctatattgccaccggtacaatggaattggatggaaattcacctatggaactaaggggtggtggggttactacgtacaagaagtactatgaacaacaccatggcattcaattgcaatttgaacatcaacgactacttaaagcaaggcacatttttcaagttaaaaatcactgtcatggacgcaaacaagggaaggaaggagaagtaagcaaggcctttgttgaattacctcctgaactgtgttcgatagtcatgatgccgatatcagatagtctcatttattcctactcatttattccgtcaatcatgcatcggtttgaatcattgcttggagctttcaacttaaaaaagatgcatttggatcattgtgcacggaatgaaattcaaacaatcaaggtgttggaagcaatcacaacgaaaaggtgcaaagaggcctttcattatgagtctctggagactcttggtgattcttttttaaaatatgctgcgagtcaacagctgtttaaaacctatcataatcaccatgaaggtctccttagtctgaagagggaaaagatcatttctaatgctgccctctgtaagttggggtgcagttctggacttccggaagagactagtatggagtgtaggcagaaaattgttgagtgtgtacagatagctaggctctgggctggtggtttcatacggaatgagccttttgatcctaatacctggattattcctggtgataagcctagaagttttaaattgaaagagttggttgccaaggggaaaacaatttatgttagtggaaaaagaaaattaagacagaagattgttgctgatgttgtcgaggcattaattggtgccttcctcagcactggtggtgaaaaggctgcattgttgtttatggattgggttggtattaaagtgagttttaataaaataccgtatgacagacactttgacattcaaccggagaagctggtaaatgtcagttttctagaatcgcaattaaattactcattccatgaccgttcccttttagtggaagctgtgacccatggttcatacatgctgcctgaagttcctagatgttatcagcgactagaatttctaggagattcagtattggattatctgattacttggcatttgtacaataaataccctggcatgacacctgggcagttaactgacatgaggtcagcttcggtgaataatgattgttatgcatggtccgccattaagcatgggttgcacaaacatgtactccatgcctcacaagaactgcatatgcatgtttctgctacactcaacaaatttgataagctatcttcattgtccacttttggttacgaggcagagacatcactccctaagatagaagaagtgagtagactcccattaatgttaaggacaaatttggaaaaatattacaattaa

SEQ ID NO: 57329 - DNA, 373 bp, Glycine max
  Peptide Sequence Number=SeqID_174107
atgctgtttgaaagaggatctccggcgaggtgctacatgacgccgccgccgcagcgaacttcgccgtggaagccgccacattcacggtcttctagtgtgccgttttcagagagaaaaatgtcaccaaattctgtgaataaaagtgatatttttcatataattcacaaggttcctgctggggactcaccttatgttaaagccaagcaagttcagttggtggataaggatccgggaagagcagtttcattgttttgggctgccatcaatgccggagatcgtgttgagagcgccttgaaggatatggccttggttatgaagcaactcaataggtcagatgaggcaattgaagctattcgatctttccgtcatcttt

SEQ ID NO: 57330 - DNA, 168 bp, Glycine max
  Peptide Sequence Number=SeqID_174108
atggtggaagatgtggcggcgaaaggcgataaggggcttgagataagaaaggaacttgaggttgaggatgttgattggaagagtggtgatgtgagaagtgtatgcagcatggttggaacacaacttgataacgaaggaggtgaaggatttggatctaagacgatttaa

SEQ ID NO: 57331 - DNA, 276 bp, Glycine max
  Peptide Sequence Number=SeqID_174109
atggggattgatggtcacttacggaaatgcccttggagggttcttttcttttttaaggaagggaaattaaatttggggtttggcatttcacacacttgtcttacatgcagttctcccgggaatgggtttgggttcagtccccacttactcattcctaccaaccaatctgtgtcatttttcacattcaactttgatcgtgccaaacttttcaccaatcagaaccctccccaagtagtcatttttgagacatcaacaatctatttcgatcgcctctag

SEQ ID NO: 57332 - DNA, 585 bp, Glycine max
  Peptide Sequence Number=SeqID_174110
atgaagaccttgatgagaaaaagggaacttgaatgtctcatgtgttctaccaaagggcatatgacctcccaatgccgaaggtggaagacacttacaagtgagttaaaagaaaaagagatgaaagaaaatgagttgagagaaaatgagatgagacaaaaagagttgagggaaaaagaaaatgaaatgaaagaacaagaaattcaacagaaagcaataagagaaagagaaataattaaaaaagagcttgaaaaagaaagagcaaaagataaagagaaatatgattgctcttatttttattctaacccactgtttgattgtcatgatcatcttgtgaaagaatttgaagaattgtttcaaaaggaggaaagcaaagcatcaaatgaatatcaacttgagttttcaaagacacttgatgttgcaacaaaggggcattgtcctttccaagtggttgaaaagatgagtgatacttcttataaccttcagtttcatgatgatgaacttgatttgaggatgaatttttttgaagagggatggaatgatatgatccagcaagggtccaatgtcttcaaatatattttgcaatag

SEQ ID NO: 57333 - DNA, 378 bp, Glycine max
  Peptide Sequence Number=SeqID_174111
atgaatgagattgaagatgaggtttcaatggaggaatgcaggactctaattctttcttcgaagaatgatgagcttaattcttattgtaattatgtttgtgcttctaactatgaaatgtcttttgttttgatgcctaaggaagaattgttcatcaataatcaatgggcaaggcaatttggaaaagagatggatgcacatgagaatcaagcaaaccattgggacaagaagattttgaatcatataatctctaggcctaatgttttgattgatatgaagggacccgtcactagagccatgagcaagaggctccaagaggattgggctagaactgctgaagaaggccctagggttctcatgaacctcagggtagatttctga

SEQ ID NO: 57334 - DNA, 156 bp, Glycine max
  Peptide Sequence Number=SeqID_174112
atggagggttgttgtcctttgagacaaaccgcacccgtgagcctcgcctcgctcgcccgcaaaagggcacgttgcgacactgatcctttccgagcattagctcaggctatagggaattcgaaaaagggagaagctattggagttgctgggtattaa

SEQ ID NO: 57335 - DNA, 285 bp, Glycine max
  Peptide Sequence Number=SeqID_174113
atgccttgtgatgctttaaagaggcttctaacatcaactgtagatataaaaactggtggtgttataagcaaaaagtgggaaataacgaagaagaaatcagaaatggcccaacccagcatctcgcttagcgcgtacctcgtgctaagcgagacaggagacataggtgctaagagagacgttaagcacgaaagtcagaactcgcgcttagcgcgcaacagaaaacagaacccgctaagcgagaggagcccgctaagcgcgcgatccaacagaagcaccaagcgctaa

SEQ ID NO: 57336 - DNA, 1428 bp, Glycine max
  Peptide Sequence Number=SeqID_174114
atggatgcaatccaaaccgagaaaatctatgttgctgttgggaatgatgtgcaggatggatataagactttgaattgggctctcaagaagtggaattctcatccaatttccattgttattctccatctcacacacaatagtaccaaggattatgtccatacaccatttgggaaacttccagcaagatctgtgagtgaggagaaactacaaattctcaggaaagatgagcaggataaaatcaacaagctgctttccaagtatattgctttctgtggaaaggtgccagcagagattcttgaagttgagaaatttgatgaacctatgcaaaagcgcgtcatagacttgatctttggtctaggaataaccaaattggtcatgggattttcattcatgaagccctccatgaaatctaaaggtgctattaatggattgttccatgttcatgagcaaaagccttctttctgtgaattgttcgttatttgtggagggaaacaagttttcttaagagggaagaatgatgagaaaatcatggaggatgatcagggggtcatggttgcaagaatgagagataagataactttcaaagattggttagacaagtggttcaaagacaaaaccaacgattcacaagatagaattgcatcactttcctcaagcaatttggagtcccctgtaaaccgaaaccagtgggaattttacctccaggaaattgaaaattactatcaagaattgttgtcttcgaagccggaggaaggaagctgcgtgcaagaaaatgacgactcacagattggaccaattgagccacatgtcactgaacagaacaattataatatgagtactgcggaaaaaattgagatcctgaaaaataagcttaatgaaggtcagaagaccatccaattgaagaggaaagaagccaaggataacatagagaggcatactaaagctgaatgggcaatttgtttatgcaacagtcgggccgaagaactagaaagtcgaatacgtgaagaggtgagtgcaagagaggagctaaagaaggaatcagacgcagagaaggagcaaacagaggagatgagaacggaggtggaagagaggaagaggaggctgagctcgctcacggaagtccaatcggagctctcaaaccggctccaaatatggacgttagcgaagattcgggcggagacgcagctggagaaggcggtgggggagaggagggagatggggagggagatagaggagctgaggcggcagagggatgtgctcaacagaaggatcgagttctgcaagcagaaggacgccatcggaatggccgcgaggctcgccgagacaacgttctgtgcgttcagggagtacaccgaggaggagctccggttggcgacggataacttctccgagcgcctcaggttgaagtccggcggggattggaccaat

SEQ ID NO: 57337 - DNA, 1509 bp, Glycine max
  Peptide Sequence Number=SeqID_174115
cactatctatcattggctggttctcttgtattgatcccattagtcatgatacctgtcatgggtggaacagataaggatactgctaccgtaatttctacaatgctgtttctttctggcatcacgactattctgcactcctaccttggtactcgactgcctttagttcaagggagctcatttgtgtatttagcacctgcattagttatcataaatgcccaagaatatcggaatcttaccgaacataaatttagacacataatgagggaactccaaggagctataattgtaggttcagtattccaatgtatcctgggatttagtggtttaatgtctattctactgaggttaatcaacccaattgtggttgccccaactgttgctgctgtaggtttagcattcttcagctatggatttccacaagcaggcacttgcccagaaattactattccacagatagcgctagttctaatattcactctggttcccttgagtttgactataatttggatctatgcgtcctttttaacagctggtggagcatataattacaaaggatgcaatccagatataccaagttcaaacattttgttggatgcatgtagaaaacatgcatataccatgaagcattgcaggactgatgtttccaatgcattgtctactgctgcatgggtcagaatgccataccctttacagtggggtatccctattttccattttaggacttccataatcatggtcatagtgtcactggttgcctctgtggattcagttggaacttatcgtgctacatctctgcaagttaattcgaggcctccaactcccggagttgtgagccgaggaattgctcttgagggtttctgtagtatattggctggtctttggggttctggtactggggcaacaaccttgacagaaaacatgcacacaattgacgtaacaaaggtggcaagtcggaaggtagtggtagttggagcagctttcttgatcatgttctcatttataggaaaagtgggtgcccttcttgcttccattccactggccttggctgcttctgtactatgtttcatgtgggctcttactgcagcattgggcctctctaatttacagtatagtcaatctgccagcttcaggaacataacaatagttggagtttcactgttccttggcatgtctatccctgcttattttcaacaataccaagctgaatcaagtctggtactgcccagttatctggttccttatgcagcagcagcatcaagtgggccattccgttcaggcataaagcaacttgattttgcaatcaatgctcttatgtccttgaacatggtggttacactgttggtggcattcctactggacaacactgtccctggcagtcaagaagaacgaggggtgtaccaatggtcgcgagcagaagacattgccactgatccctcacaacaatccgaatattcgctgcccaagaaagtagcccggtgttgttgtcgtttcaaatgcttgggagtctaa

SEQ ID NO: 57338 - DNA, 489 bp, Glycine max
  Peptide Sequence Number=SeqID_174116
atggtgtgcataaggaaggcgacggtgaaggaccttctggcgatgcaggcgtgcaacctgttctgcctccctgagaactaccagatgaagtactacctctatcacatcctctcctggccccagctcctctacgtcgccgaagactacaacggccgcatcgtcggctacgtcctcgccaagatggaggaagagaccactgactgccacggccacatcacctccctcgccgtgtttggtgccgagtacgtgtccctgcacgtgcgcaagagcaaccgcgcggccttcaatttgtacacggagactctagggtacaagattcatgatgtggaggccaagtattatgcggacggggaggatgcttacgacatgaggaagcagctcaaggggaagcagcaccaccatcatcaccatcaccaccaccaccgtcacgagcacggcggtggctgttgttccggggagcccaaggggaatgttgcaaaagccacctga

SEQ ID NO: 57339 - DNA, 201 bp, Glycine max
  Peptide Sequence Number=SeqID_174117
atggtgctggaaagaaatttgttactttcgcctccattggaaccacatcacacaacaccctaccattgtgaaaaagaggctaaagcatcaatatcaaggtcgcgcactaagtgcgagatcagtgcgctaagcgctactggtgccttcagccaggctaagcgtgagactggcgctaagcccaatctcacttacttgcgctaa

SEQ ID NO: 57340 - DNA, 600 bp, Glycine max
  Peptide Sequence Number=SeqID_174118
atggaaactgggtcgaaatcagaatcactgaacagaaacgtggcgatgagtgtgaggggtggcactgggaagaagaaacagcagggtggtgtagcaggcaaagtggactcttttgtgccgagaagtgagcacaacccgcgagagttacggtcgtgggcgaaaagaacgggttttgtttctgattactcgggggaagcagggacaagtgggagtgcaaagtttgaagctttagagaggagaagagaagggtcatctccgaagatagagatagatccggtggtgggaagagcgaggcaaaacgagatcgtaccagagtctcatggaggtgcaacgaggggtgagaatggtgctgttttggatgggagggggaggaaagagaaggagaatgagggtggtgagaggaaagttggtttcaatgggaatgggaatgggcatggagtgtctgcagttgctcctgtgaatgaggaaaaggagggggaggagggaaatggggatgttaaggtcaatgtgtttccagaaggggaggaggttggtgatggagggtggcagggaccgttgggattgaagtgcgggctcaaagaaaatccggggattggttag

SEQ ID NO: 57341 - DNA, 305 bp, Glycine max
  Peptide Sequence Number=SeqID_174119
atgattctgatgagagtgatattgctgaattggatgaggatactgaggatggagaggaaattttcatgcggtcctattctgatgctatgaatgaagaactgaagacaaccacccttcagaaaagttttgttcgtgctaatgaacaaattccaaagaaggatcagggaacgtcaaatgcatcagaacatattgtggacgaggatttttctcctgtagatgtggatcaagggcttcctggtccagcttccaatttgcttggcctcatgggggtgcagttaccacaagatggcaagaagggcaaatga

SEQ ID NO: 57342 - DNA, 516 bp, Glycine max
  Peptide Sequence Number=SeqID_174120
atggctgtctctctgacacgtttgtcatggtggttgtggggtcgtagcaacaaggagaaagagcctgttgtttctggtggctctacactgaattcatcttctgaatggagttttaaggaaagagagagtgttaagtttccttcagtgaagggaacaaagatagctccttctcacaggaaggttaaaaggaaatggcagagcagggaagagaggagacatgatagagagtatgatgttgtgttggtgccatctgatggtgatggttgtttgtcaagctctgaatctgatgactcagatttttccattgggtggttggagcctcatggctctgatttccttcagagtgatgatgatttggacaatagttttgctgtgctagttccttgctataggaaggaggtggagagttcaaacaaggagcttttgagtgccatcaagaaccttccaaatgaattttcttctgatgctaatgcactgcttagcaattataaatgcaatggtaattggggcttgtaa

SEQ ID NO: 57343 - DNA, 2895 bp, Glycine max
  Peptide Sequence Number=SeqID_174121
atggaggaaaaagtgcaaactgttttgaagctcttagaggaagagggagactcttttgctaagagagcagaaatgtattacaaaaggagaccggaactgataagctttgtggaggaatcattcaaggcttaccgagctttagccgaaagatatgatcacatatcaacagagttgcaaaatgccaacaacaccattgcttctgtctttccagatcgtgtcccatttatggatgaagaagatgatgatggatcaccaaggccttcaagaaaaaaggcagaagggttcaaaacaaatattccaaagcctcccattaaagatttaaaaaatgtcataacaacagcagcagccacaaggaaatttcattccaagaagccagctgccacagcagcttctgctgctccgaaagttcctaaatctggtttgagcagaaaagaggcacttgaagaggttgacaagctgcagaaacagattctggctctacaaactgtgaaagagtttgtaaagaactcttatgataattccattgctaggtactgggaaactgatgagcaaatcaaggaattgcaagagagagtttccactctgcaagatgagctgggagaaggtgttgatattgaagatgatgaagctcgccgtttgatggcagaagctgctcttaaatcatgccaagaggcattgacacagttgcaagagaagcaggaaaaatcacttgatgaaaccagaattgaatccaaaagggtaaaggatgtgaaggccaagttgggctctctcatggacgaattccattatgaacagagtaattccgaagagccaagggtccaaagagatttaaaagaaatagcagaaacaaaggacttggaagagaatgccggattggctccgaagaagcaggagttgcaattattgaaggagaacattaaagagcactttgagactagctccaattcatcactcagtgtggcagaaatggcagagaagattgatgagctagtgaacaaagtgatcagcttggaaactgcagtatcgtcccagactgtgatggtaacgagattgagaacagatactgatgaacttcaagagcaaattcgaactctggaaaatgataaggaaagtcttatcaaggacagaaacaaattgaacgaacaactcagaaagatggaagaaaagatgcatggagtacaggatctaaatcaaattgttgaggataagaataacaatctccaaacccaattcaatgaagcacatagcaatcttgatcaactctcagagaaagtccaaaacgtgcagcagccaggcgaggaggccaagaccacagatttatcacacacacaaaaggattcatcaagccaggctgaattaaaaagcaaatctgaaggacaagttcctttgaatgaggacaatatcttgttgaatgatattaaatctgaaaaggagcttacgaatgatttggtagaagatgatgcaaaagataaggagcttaaggttgctggtactgttgaagatgatgtaacatcagacaacaagcttgaggccactggctcaccatttgctaatgaacctaatgtcacccgttcattggaaaatgatgctaagtcagtagataaggttaaggtcaccagttccttagaaatggaagaggcaactcctatggaaaaaaaatctccaaaagagttggaagaacaagagaagactgtaaatcctggcaatgatgaaaagacaacagttgctgtgagcactaccacagaaaatcaggaagtcagtcagctcccagcaagcaacaaggcagatagttcttcagagagttctgagaaacagccagaaaatgatgctaagcaaagttcatgtgagatagataatgctctcaaagttgatcccaaggggcaggcaacagcacaagaagatgaacctgattggcagcaattgtttacgaatggaatgcaggatagagaacaagttctgctaagtgagtatactaatactcttcggaattataaagatatgaaaaagagactggctgaaatagagaagaaaaatcaagacagcaactctgattcatctttgcagctaaaagaactgaagacagctaatgccatgaaagatgaagagataagacatctgcgccagaaattaggtctcttgcagagaagcatggaaggaaatgaggatttcacagaggaacttttacaaattgaaccacctgaatctacttcacccattgaagagaaattcaggtcaaacatggatgaagttctagaggagaacttaactttctggttaaaattcagtgcttattactctgagatacagaagtttgaaaccactatcaaagatttgctgaccgacttatcaaaattagaggaaaaagggaagtcgtcagagggtagtagcagcataaagcattctataaaatcagattcaagaccaatttacagacacctaacagagatccaaaatgaaataacagtctggatggaaagaggtgccttgctgaaagaagaactgcaaagtcgattctcatctttgtgtgacatccaagaacaaataacatcagcattgaaaaccagtgctgaagatgatgacttcaggttcacaagctaccaagctgccaagttccaaggtgagattttgaacatgaaacaagaaaacaacaaggttgccgatgaacttcaagcgggtttagatggtgtaacatctctccaacttgaaatagaaaaggctctagtgaagttgaatgatgaatttgggttctcagcatcaaagagacaacaaaatggccagctaagacaatcagagactcgagccaaggttcctctcaggtcatttatctttggcgccaaaccaaagaaacaatcaatcttctcctgtatgacccctggaatgcataggagaataccg

SEQ ID NO: 57344 - DNA, 528 bp, Glycine max
  Peptide Sequence Number=SeqID_174122
atgcataacagtaatagagaggtagagggaaagagaaaagagatgcaaaatagtgtgagggaggtgcagaagacagagagagagagagagagagagagagagagggaggtgcaaaagagagaggggaagaggtgcaatagagatagagcactcaccaaagctttgggtgacagtttgacagtgagacattttcctgcactctcatgtgagtttgcatcagttgatgtgagtgatgtgctgggaacaaacaggctcaatataacaaaaacagttcgtaagttttctattgattcaaatttaagacccactggtgctgagtttcattcgggtacagttgcaaatgctgtaaagcatgatgatgaagtagatgaagaatctgttgaagatacaatgaatgaattgtgcagaagttctaataaggctattgatgaagaaaagtatggtctagtagatccagcactaaatgggaggcccgaaaggcttagccaaacgctcagctggatgggaggagtttattcactgagctag

SEQ ID NO: 57345 - DNA, 459 bp, Glycine max
  Peptide Sequence Number=SeqID_174123
atgccaacccctcatttccacactgcgagaccacatcacgttttcaacacatcctcttctcttccaccaccagggggcactactccaactggatcatgccacattcaacctcctaaacttcagcctcaacctttagaggggttacctgcgaaaatcctccgtgagattgccatccatagaccattttcagttcatcaagccatggtcttgcacgttttattgaggccaaaatccgtgacaaccaagggtcgtcttctccagctcttgtgtttggtgggagatttttcaacaaagtggttccttttccttcattgggcacaatcaaagaaaatatgggtcgcgtgtgagaacaagcaaacaaacgtagaagagacctcaccttcgtcgttttcaaaactatcgccaaacaactctgaaaaggccaccggagctacgccggagatactatggcccttttaa

SEQ ID NO: 57346 - DNA, 120 bp, Glycine max
  Peptide Sequence Number=SeqID_174124
atgggtgtggtggcgtccaccacgagggtcagttttagtgaggaggtagtaggaatagaacctactttgttcatgataagatatcatgccgctactaggactcaaaccgagatgctttag

SEQ ID NO: 57347 - DNA, 2028 bp, Glycine max
  Peptide Sequence Number=SeqID_174125
atggatgtttatgaagaaatggaagaagctaaagctgaaattgagaaactcaaggtaaaactaggagacaagacaaatacacttcagaacataaagaaatactatgatgcacaggtcaataagatacaggaagctattttcaaagttgagaagctgaatcaagaaatgcttcaaaaggcagatgatatcaatgatgatctcaaagagagtttaaataataaagagtccatcgccaaacatctcaatgccgcaaatgatgaacttggagcaaattgtgatgataaatttagaaagtggcatgatgaagaaagagggtatgtattggcgttagaggaggcaaatgagaaactggataaccaagaaaaacagatgcatctgagtagacaagagattgaaagcatggaaggttgcttttcaatttcatacaacaagtgtttggaaatagagaaaaatttagaagcatcaagcaaactaggagaagcgaatgacatgtttcagaagttagaggaggaaaacatgaaggtggaagaacaattagaatggaaggaggaacattttaaacatcttggagaggtacatgaaaaacttatagatcagtttaaggcaagtaaggagtgggagttggaaaaacctacattgcttgatgagatttcctcattgaagtctatgttagactatcataaaagaatatcgcatgatctgcaacaccagttacagatgtgcaaccaagcccttgctcatgaagaaagcctgagaaagcgtctggaagatgaagtctcaaatttgaacaaagagaaagaagagaagtgttttcaattgaagcagatggagttgaaagatgctgctttgatcagttccaagaaagatatcagtgaagagcgagagcaagcagcatgtttcatgaggcaggttgagtcctatggacttgccaatgaactgctgcatttgccacacaacgaatttgattggcacaaggatttgcatatggaagatggtttcaaagaacaacttaatgaagtttatgatgctttagacagggcaaacattgaattggatgagagaatatgtgaaaaaagtgaaatggagtttgaattgagaatatggaagtcatttgttgaacgtttgaggaatgctcttgaagaaaatcttgtcatgcgaaaagaactggaaaattcactccttgcacaagtagattttagtgaaagcctcgcgcaagagaaagatagcctggtttataagttggaagaaaaagagaataaaatagaatgcctgcagcaacatgttctcctatttgaacaagaaccaaaagtaaaggaaacagaagcttctgttccagcaagcggggaaatagctgagtcctctgaaaatgttgaagtgagatatctccagataattgaagagaaggacaagattttagaggagttccaaaaagaggttcttagccttgaacaagagtcattaagaagagaacttgaaagtgctatgattgcaaaaagcaacatggaaagaaccaatgagtttgagaaagagaatcctattcagattataaagggaaagaatgtgagaacagatgaactcatgcaacaggtgacttcactggaacagaagttcactaactccttaacctccatttcctcacagcttgctgagaaacaggcagaaattattcatgtcaaagaagcttgtgataagatcacagcagctgaagttctagctgcacttgaagttgaagagaagaagttgatgttagtggaacttgagtatgatatccatgatatggagcagaaactgaaactgaaagatgaaaattggaggcaatcagaacagcttgcattggatattgaagaggaaatggatgcaaaacaattacaaataaaagagttaattgatcaaatggagaacaagcttagaggctcagatgtttttcttcaaaaactcaagatagagaatagaagtttgcttgaaaagtgctacaagattgtcatcagaaagggaaaacttgttgggttttgttctgggattgggtga

SEQ ID NO: 57348 - DNA, 1713 bp, Glycine max
  Peptide Sequence Number=SeqID_174126
atggagctcggatacctgaatcagggtcagccttctagaggaacaacaccacttgtcactcttccattgttgctttcaacacttgtgttcttctccactttcacacatgccttctcttcttctgtgtttccggaattgaagtttgataacaaatttgggggggggggggttaagaaattcttgtgtttgaggtttgatgttagtattttaagaagaaagaagaagaaaaagattgaagttgctgtcgttgagatttcctactttggtgaacgttttggcaccttgaaagagatactagtagaattgaatcctattaaacctaggcactcacgtcttctcaggagtgctgtgcaacgagaaactcctacatctcagttgtctgaactatggtcacctctggaaagccaaggatggaaaccttatgttgaatcaaataagccaacattaccagagaagtcagagggatatatccaggtctttcttgatggaggtttgaaccaacaaaagatggggatatgtgatgcagttgctgttgcaaagatactgaatgctactctggtgatcccataccttgaactgaatcctgtatggcgagattcaagctccttcatggatatatttgatgtggatcatttcattgatgtattgaaggatgatatttctatagttaaagagttgcccaaagagttcgcctggagcacaagggagtattatggcttggctattcgagaaaccagaatcaaggctgcacctgtgcatgcatcagcctactggtatctggagaatgttttgcctgtcctacagagttatggtattgctgcaatctctccattttctcaccgactgagttttgacaacttgcctgtggatattcaacacctacgttgtaaagtaaacttccaagctttaacctttgtttctcatatcagaacacttggagatgcccttatcagccgccttcgctatcctcaaggctcagctgaagaaatgggcttcaactaccttcaagaggtcactggtgcaggtgctaggaaaaatgcagggaaatttgttgttctacacctccgatttgataaggatatggcagcccattcggcctgcgattttggtggaggaaaagctgaaaaactggcccttgcaaagtatagacaggtgatttggcaagggagggttcttaactctcaattcactgatgaagagttgaggagtcaaggtcgttgcccaatgactcctgaagaggttggattgttactagcagctatgggatttgacaacagcactcgtttatatcttgcctctcataaggtctatggtggagaggcaaggatttcaactttgagggaattatttcctcggatggaagacaagaagagccttgcttcatctgaagagcgttctgagataaagggaaaagcttctctactagctgcacttgactactatgttggcttgcatagtgacatatttatctctgcttccccaggaaacatgcacaatgcattggttggacaccggacatacttgaacttaaagactataaggccaaatatggcattgatgggtcagcttttcctgaataaaaccatagagtggtcagagtttcaggatgcagtggttgaaggtcaccaaaatagacaaggcgaaccaaggctgaggaagccaaaacaatcaatatatacatatccagctcctgattgcatgtgccaagcttag

SEQ ID NO: 57349 - DNA, 1134 bp, Glycine max
  Peptide Sequence Number=SeqID_174127
atggcgactcgcgcgttgcttggagcaatcaagaaacgcgccgtttcgttccccgcattccccggccactccggttatcgacacggtagcacgcttgttgtggcggaacacgaaggtggttttatcaaacccccttctctgtctgcacttgctgctgccacgtgtcttcccgatccctactcttccgtttctgtgctcttggccggttcgggtccttctctgcatcaagctgcttcacatgctgcttcgtgccacccttcaatctccaaggtgctcgtggcagattcggataaattcaagaaccctctggcagagccctgggctaaattagtccatttgcttcagcagagtagcggttactctcatataattgctgctgcaaattcttttgggaaaaatgtcatgccgcgtgctgctgcccttttagatgtctctcccattactgatgttactggaatttctgattccaatactttcgtgagtgacctctccagcaattgtcttagtcttaaaaatttagaacaaatgagtttgcatgtggccaatatatgctggaaatgcactttgaaccaccgatatactggtgccaatccttgtatattaactattagatccacatcttttcctgttcctcagaagtcagttgactcaaaatccaacgaggcttcaatatctcaggttgacctttcaacctttgatgaagatctggacaagtctagatatatttctcaaacttcccaggatgatgaacgaccagatcttgggaatgcacggattgtagttactggtggccaagcactaaagagttgtgagaactttaaattgattgaagatctagccaagaaacttgttgctgctggtttcaccattgctgttggtgcaactcgtgctgccgttgatgcaggatatgttccaaatgatctccaggtagggcaaactggaaagattgttgctcctgaactctatatggcttttggtgtatctggagctattcaacacttggcagggatgagagattccaaagtcattgttgctgttaacaatgatgctgatgctcctatatttcaggttgctgattatggactgtttgaggtgataccagagttactggagaaactccctgagaaaaaataa

SEQ ID NO: 57350 - DNA, 432 bp, Glycine max
  Peptide Sequence Number=SeqID_174128
atgcgatcctatggtttgtttgatattgctgctgtttcactggctaattcattgactctcttcccatacattgatgaaatatctgagaagttggactatataggcataaactactatgggcagactatttctgataactgggagtgggctgaaggatatggtcccaagtttggacttgttgcggttgaccggacaaataatcttgcacggatccctcgcccctcttaccatctatttttaaggttcgaactcccatctatatttattgtgaatacaggcaaagttacacatgaagatcgtgaaagagcatgggatgaacttcaaagagctgcgaaagagaagaaaacaaggccattttattgggctgtggataaacaccgtttaatgtatgtagtggtggacttgacgaacctgaacaacgaccttatatag

SEQ ID NO: 57351 - DNA, 246 bp, Glycine max
  Peptide Sequence Number=SeqID_174129
atgacgggtggtagtagttggagacgacaacacaatattgatagtagtgacaatactaacaacgaggaaaatgataatggtggttgcgacatgatgacaatggttgtggtgacagaaatcgtgacaatgacatcaataatgataacaacgatgatgaaaatggtgggagttgtgacaacggcgatcgtagtaattattatgacagtgatgacaattgaagtagtgatgacaatggtgagagtgtga

SEQ ID NO: 57352 - DNA, 474 bp, Glycine max
  Peptide Sequence Number=SeqID_174130
atgaaggaaatacttgaaaggcatcatttgcactcaaagaatctagcaaggatggagcaaccatctctcgagttgcagctagttgaaaacagcaactgctccagattgagcaaggaagttgccgaaaagagccatcaactaaggcagctgagaggagaggatcttcaaggcttaaacatagaagaattgcaacaattggagatgtcacttgaaactggattgggccgtataatagaaaagaagggagagaagattatgagtgagatcgctgatctccaaagaaaggggatgctattgatggaagagaacgagcgactcaaacgtcacgtggcggggataattaatggtcaaaggcatggtggtgccgaatctgagaactttgttatggatgaaggctaccatactccggctgatgagaaagtgtgtgaggagataaaattaactcaagcaaaagtgcacaagattatggtctaa

SEQ ID NO: 57353 - DNA, 234 bp, Glycine max
  Peptide Sequence Number=SeqID_174131
atggcgagggagaagattcagattaagaagatcgacaacgccaccgcgaggcaggtcacgttctccaagcgtcgcagagggctcttcaagaaagctgaggagctttcggttctgtgtgatgctgatgttgccctcataatcttctcttccactgggaaactctttgagtactcaagctcgagcatggtggtatatgctcaagttggttctgttggtacggatagtgagctttaa

SEQ ID NO: 57354 - DNA, 978 bp, Glycine max
  Peptide Sequence Number=SeqID_174132
atgccagatcaagttgcccttgaaactgaggcaagaatgtcttctgtgatcaatgagaagaagaaattgttcaatgacttattgacatctaaaggaaacataaaggtattctgccgtactaggccattatttgaagatgaaggtccctcaattgttgaattcccagatgattataccatccgtgtaaataccggagatgaatccttgtctaactccaagaaagaatttgaatttgacagagtttatggacctcatgttggacaggctgacttgttcagtgatgttcagccaatggtgcaatcagctttggatggatataatatttccttatttgcatacggacaaacacattctggaaagacacacactatggaaggatcaagctatgataggggtttatatgctcgttgttttgaggagctgtttgatttgtccaactcggacacaactgctacttctcaatgtacattctgcattactgtttttgagctgtataatgaacagataagggatctgcttttggagtcagggaaaagcttgcctaaactgtgttttggatcacctgaatacttcatagaactaatgcaggaaaaagttgataaccctctggacttttctagggttttgaaagctgcatttcagagtcgaggaaataatccattaaagattaatgtttctcatttggttgttacaatacacatattttataacaatttggtcaccggtgaaaactcatatagcaagctctctttggttgatttggctggaagtgaatgtttgataacagaagatgatagtggtgagcgtgtcacagatatgcttcatgttatgaagacactttcagcattttttgccaaacgccataggccgcaatggtgtgtttatatggcggaattatggccttctgccatatttcgacatccatcattgagaacaatggatcccaaaaagcagatgactgagcctaaaaccccttag

SEQ ID NO: 57355 - DNA, 645 bp, Glycine max
  Peptide Sequence Number=SeqID_174133
atgttgcattaccaccatggggtccagatcagagccttgcatggccatgagggtcagatcggagcctcgcgcaaccgtaggggccaaatcaaaggcacacacgattcagataatctttatctaatatataattatttgattattttttttatgttatggtgcggtctttggggccaaatcggaagggcacatggagcgatgagaagagaaaacaccgagcttggctggaggaagagggagagggaaaacaaagggagaagagagcttgggtggagggggagggaggttcgtggaagagggaagaagagaaagaaagaaaagatcggcggaggagagacaccaattgatgtttccgaaagtggcagtcctacaccacttgctcgcccaatgggacaaaaggaggtcaaaaggaaggtcaaagtaaaaggaacatcttcttctacaccatgtgtggacttgtctgtcattgcaaaagaaatgaaggaaataaatgttgtccaaaaacaaataataaaggcaatggagtccaataacatcgtgaagatgtacaatattcttatggaggacacgtttaacaggattgaagatcaacacaagaaacacgaaatcacttgtaattatatttttaaaaagtttagtagttag

SEQ ID NO: 57356 - DNA, 684 bp, Glycine max
  Peptide Sequence Number=SeqID_174134
atgacaagagaaaattgtgggagttcaaaaaccctgatgattgtaaatgtgtgtccaaattcttcaaatttatctgagacattactgtccctcaatttctctgccagagctcgaaattctgtattaagcctcggaaaccgagatacaattaagaagtggagagatgttgcaaatgatgcacgtaaggagttatatgagaaggaaaaagaaatccaatatctgaaacaagacggtctgagacttaagcaagcacttaaagatgcaaatgatcagtgtgctctactcttcaatgaagtacagaaggcatggaaagtttcttctgcactgcagacagatttaaagtcagagcatattttgctggccgataattataaggtagagaaagaacaaaatgctcagcttagaaatcaagttgctcatatgttacagttagaacaagagcaaaatttgctgatacaacagcgtgattcaaccatccaaagtttgcaggctaaaattggaagccttgaaatacaactcaatgaagcccttaagtccagcaacactgggtcaaatgttggcccagaaactctgtctggaactctatctaatcccaggacaacgggggatggcacggattcgtctgcagtaaccaagaaactggaagaggaactcaagaaacgcgatgctctgattgaggtctaa

SEQ ID NO: 57357 - DNA, 345 bp, Glycine max
  Peptide Sequence Number=SeqID_174135
atggcggagcagggaaaccgttggagctgggacgtcgccggcttcgagccgtggaagtcgccttcgccggagcaaaacgatcagaaacctactgtgccgttggcgaggagaaactccacctcctccttggttcctccgcattccttggcttccaaagttgagggattaagagaaaaggttaagctgaaagctgttagtgttgtgttgggcaacaataaagagtatacagaggggaatgtgcaagcttggcttctatgtgccttatgtcttcaaaatctgcattggatttctaacagtcaggaggttaaaatatcttctcaatcagcggcggacccagacatttga

SEQ ID NO: 57358 - DNA, 447 bp, Glycine max
  Peptide Sequence Number=SeqID_174136
atgaagatgctcttgataccacacgacgtggctccatgtggagcttgtaggccttggatcttcttcatcattggagtcctttacttcttgaagatcaatggcagcggaatggaaaacccactaatccaagatcacgtccaagattctccactaagtgtgctcaggtgtcatgacgcatcccatgggcccaaaatctaccctaaggctcctgagaaccctaggaccttctcctgcatctctggcccaatcttcttggagtctcctagccatggctctagtgatgggtcccctccttgggaggattgcatcatcacagttgcctttgggactgagaatttgatctggactgcaactaacaggtggatatttattttgtggttctgtagacaaaatggggttggactcaagtctgcagacaaaagtgcagtcaataattcagccatgtag

SEQ ID NO: 57359 - DNA, 360 bp, Glycine max
  Peptide Sequence Number=SeqID_174137
atgtcaaatgttccaaataggtttatggatgactggggtacaagcttaggtcatggttcagtgtatggtttccttgagcctcggcctatacacaatactaaggatagacgtcaagaatgtcatcattacattgaagcatgggtgaaggattcgcaacggcaagtgtacttaggagcttacttgaattatgcaatgaagacaataaccagtagtttggatggtatgtctgatcaacctacacctcggtggattgaagcaaagtggttttctgatggaccaacgttagacatcgaggccatcacaacacttcgcaagaaatgggcagcatatttgttagcttgcaaaaacatgggatgttaa

SEQ ID NO: 57360 - DNA, 1092 bp, Glycine max
  Peptide Sequence Number=SeqID_174138
ggtaaatttgacattcctgaaggttcaactgccaagaagaaggtgatgtcaacggtcgccaccaaatggaggcaatttaagtcttccctcaccactaaatatgtatatgctaacaatgaaggtcaagataaacatgatccttctgctaagtatgtggaagatggctcaaacaaagcgatatgggtagatgacatctatagtgtgatgcaatcctaccccgtaaaagcattggatagaagactccaagaagattgggctagagatgcaggagaagaccttaggattctcatgagccttagggttcatgtagctggaactggtgtcacaatcagtcaatactttggacaggccttacgtggttcgaacacttcatcagcatcaatcaccccaaaagaattggaagaaatcataggaaatctaaaggaacggtggaggagagaagtagaagaggaaaacaaatgcagtttggagataatgaaaaaagagttgaaggaggcgataaaaattgagttatcccaaatggcctcgcaacactcacccccatttgagacatcggatacacgcgtattagctacacgtgtcaccactaagggaagttgtgctgaagctattacaaatcctttagttgaagatccttctactattgatttcaacactatgggcttgtacatagttggtgagcagcgtacacggctagtggccttgggaaaagtctttgatagtgccaccaccatacacaatgtcccttacgcagatgatgtggtttgggtcagtgttgtaacagtttacgacgctgacgctccgatcccttttctgacttcaaagattcagtatgtgagaaggtcgctaacacattcattggatggccaacacatcttgtcaaacatgtatctgatgtgcaatatagttgctggagaggatccgttgggagaattgatgaagatcttcgaggcgaggctcacgggtgcgctttccaaaggaggaaagatgcgcggagtcgccaccaacgtttatttgtggaaaacgtcgggaaaaccgaaggaaaccggtcaaaatgaaaattctaagttcgggagttgtatttacgtttga

SEQ ID NO: 57361 - DNA, 129 bp, Glycine max
  Peptide Sequence Number=SeqID_174139
atgtatcgtgggccccgtggctcgtacggtgtagaaggtcgatcgaaagtcggcccgtgcgatcataccagcactaatgcaccggatcccatcagaactccgcagttaagcgtgcttgggcgagagtag

SEQ ID NO: 57362 - DNA, 261 bp, Glycine max
  Peptide Sequence Number=SeqID_174140
atgggtgccaaatacctcgaagtggtcgaacgagggtcgcatcccaacaacggatggtccccggacgaaattaggacgctgaatgaccataatttgtctctgcattttgttggacacaatcgaacctgggtggcgagacacagaatgaccataatttgtctctgcgtgccactggacacgatcgcctctggatggcgaaaaggtgcgcggaatgaccataatttgtctccgcccacctctcgacttattgtccctgaataa

SEQ ID NO: 57363 - DNA, 240 bp, Glycine max
  Peptide Sequence Number=SeqID_174141
atggaggttgaagatgaactatggcatctattggaagaccatgaaggcctcaaatggcatatgcacataaatccaaaagaagaagatttcaagtgctttggaggaaaaattgatgcaaaaattggacaaaaaggccttgtagaaaagttgaaagaattggacagctcgcttagcgcacaatccaggcccagtgcgcactctcgcttagcgggtaagttcaagcttagcatgcacgcttag

SEQ ID NO: 57364 - DNA, 420 bp, Glycine max
  Peptide Sequence Number=SeqID_174142
atgagtgaagctcaaatgatagatcatgtgactcagctccatgatgctcaaacaaagaaaaaggttgacgaagaagaagcactaactactactactacaaaagaaaaggttgcctccgtccaagatgaagcatatgctaaagttatggatgataccattgtatgtggggtcattattgatcttaccaacactgctaccatgaaagaaacacctaaggtgtccaatgcagccatagctgatgaggttgtacatcacatacaagaacctgtgtccaagctctccatgccgaatgctatcatgacccaattctcaaaccttggtgttttccttctacaaaatcttcaacaagctcaaatgtccatgcttggcattgttgttacacctacacccatgcctgttcctatacccccaaacacttga

SEQ ID NO: 57365 - DNA, 642 bp, Glycine max
  Peptide Sequence Number=SeqID_174143
atgggggatagaggtggacgcagttgtgttgaggaaactggatgcttcctgagaggaatgataggagttccatcaattgactcattatctaaagaagacgagcttgcatcctccttgtttcttgtgaaagagaccatccactccttatctccaaacttgggatcaaagggcagattctccatcaagtggaagagtatgagcttgtggagatctgatagtgatgtctttgaacttgccttgcacctggttgccttggtaattgagttgctggacaacaccatcttggttcctagaaccttggatactatgagatactatgaccttcttgttgaaaaactcaatattcctccaaaaggtcttgatgagttcagggttgttctacataaacttctgtcataccctaatttcgtctgggaactattgcttgatggcacacaacctttgattgaccgcttcgagactcttcctccagaaggcggttgcttctggaagaagcaacctggctcgcctaggcgagctgagctcgcctgggcgagttgggggttcagccttcttggcacttcgtattcacttgaaattgctgaggaaaattgtttccgtgaagaaaatccaagccgaggcacttctgtaacgttttcgtgg

SEQ ID NO: 57366 - DNA, 751 bp, Glycine max
  Peptide Sequence Number=SeqID_174144
atgaagaacgtcgaagaacggtcgaaaaccttcgcgaaattcctcacggaaaacgttacggaaacgtttcggaagcgcctcggcttagattttcttcacggaaacaatttttccaagcaaattcgaaagagagagaagtgcctaaggagcttaacccctttcttcttcacttcctcccctatttatagcaaaataggggaggtgcttgccgcccagctcgcccaggcgagccaggtggctatcttggcagatttgtttgacacctttgaccggaggtgtgagaaaaacagtgcacggattgtctgttgtttacccgctctctgtgtgtggttgatttcacacctattccaacaagatacgagacacccgtgtccgcttcaaagctatcgctcatgcgccgaaaaaggaagagtcgattgggaccaacatttggctgggatagggggcagcgcgatcaattggtttcctcgttggaaggaaggcaaggaaggagttatcttctcgtgtggggactaccctaatgttccactgatagggactaggggttgtattaattataatctcgcactcgccataagacagctagggtatcccatgaggggagcgccaaccgaagaaagtctctcgcctttccttgtgaggaatctaggcgcgcaaagtctcaaggcgatacaaagagtccacaaggcgtggagaagtccgttgaagaaagacaaggagcttagaggcatccgaaatggtgtcatcggag

SEQ ID NO: 57367 - DNA, 285 bp, Glycine max
  Peptide Sequence Number=SeqID_174145
atgtgtagtcctctgaaggcgtggatgtgtagtcctctgaaggtgaggacgtgtagtcctctgaaggtgaggatgtgtagttctctgaaggcgagggcatgtagccctctgaaggggagggggttgaagcttaaactcaaaaacaaaggggggagaatatggagaattaaggttgtcatcatcaaaaagggggagattgtagaagcaagcttcatgatgatgaatcaagttgattcaagtagttttgatgatgacaaagatgatggcacaaagcctaaagaatga

SEQ ID NO: 57368 - DNA, 304 bp, Glycine max
  Peptide Sequence Number=SeqID_174146
gcgctgttgtgttgcatcctttggttaccgtaaagagcatgatggcttttgggtgaaaaagggtgctcaacccattgatgaagaaggacatttacatggtggagaagattcctctcttcttcaaaagattttggacaggttcgatggtcttcaaacctttgttggtgaaaggtttgatactttggagttactagtggacattcgattcaatgagatggagtcaaggatcaccaaggtcaaagaagatgtttcttacattcgtacaagctttgatctaccaccaccaccgccaccatcatcttag

SEQ ID NO: 57369 - DNA, 408 bp, Glycine max
  Peptide Sequence Number=SeqID_174147
atgggaacaaccagtattgttcaggcttacagagatataattatcccggcaggaactactgcaacgactttgtctttcgactggaaagcagatggggaaagttcttatgactatttaagagtctggctggttccggcatcttttatgcctgtagcaggagctcaaattactgccggaggaggaagaatccaggttggagctttggctgtaaatggggtaacagcaacaggtgctgtactgagctggacaggtccgacgccggcacctgccaatggatatgcttattatcttacaacaacgaatactccgcctgttgcaggtacccctccaacaggaacaagtactacgacttctgtaaacttaacgacgttaacgccaaatacaacttattactggtgggtgaagtct

SEQ ID NO: 57370 - DNA, 738 bp, Glycine max
  Peptide Sequence Number=SeqID_174148
gtcctcactttcagaggactacacgtcctcacctttagaggaccacacgtcctcaccttcagaggactacatgccctcaccttcacagggctacacaccctcacctttataggactacacgtcctcgccttcagaggattacaggtcctcgcttttagaggactatacggattcctcaccttcaaaggaccgtacgtccttgccttcagaggcctacaagccctcaccttcagaggactacatgtcctcgccttcagaggactgcacgtcctcaccttcagagggctacacgccctccccttcaaaggactacatgtcctcgcctttagaggactacacgtgctcaccttcagagcaccacacgtcctcgccttcagagggctacacgccttcaccttcagaggactacatgtcctctcctttagaggactgcaggtcctcgctttcagaggactacacgtcctcacctttagaggaccgcatgtcgtcaccttcagagggctacacgtcctcgctttcagagggctacacgtcctcgctttcagagggctagatgtccttaccttcagaggactacacgtccttgccttcagagggctgcacgccctcgccttcatagggctacacgtcctcgccttcagaggactacatgtcatcgccttcagagggctgcacgtcctcgcttttagagggctccacatctgtgccttcagagaactcaaggtcttccgcccctaa

SEQ ID NO: 57371 - DNA, 192 bp, Glycine max
  Peptide Sequence Number=SeqID_174149
atgtcgtggagcttcacggattgcctaacgatgggtgttaagtacctcgaagcggtcaagcgaaggttgaatgccaccaaaccaatgatggcttcccgcaaaagaaaggctccagcctcagcatctcaagcccgctatgataatcgagattcacatcccaaaagacctgggatcgctattctaacattgtga

SEQ ID NO: 57372 - DNA, 255 bp, Glycine max
  Peptide Sequence Number=SeqID_174150
atggtatgtgttgacaatgctgataggactggccatttacttgctgacctcctgcctaatgctcccgatgaacgcactccatctccaccaccaagagatccctcctcttcattgctgaatgatgttcttagcgagcttttggatcttcgtgcctttgtcagagactggtttaattctttggattcacatattacgcgacttaaggacgatataagctttatttgtcattgctttgatcctccgactgatccctag

SEQ ID NO: 57373 - DNA, 801 bp, Glycine max
  Peptide Sequence Number=SeqID_174151
atgagggacttgaaaactttaaaggaattggtggcaagcgttacagattggaagtcgctcgagaagatgtcttgcaaaccctttaagccttccattttgcatttggcaatatcacaagatgcgccccacttatatagcgaagaacagttgattcaattaaagaaattaagcaaactactttcaagcgctgaatcgaagccaaatacaaataagactgataagagggtgaccaaaaaaagacaaattgaagagagacctaaagaagaaagagtcatgccagcaacgattaaaaaaccaagaaagataatcttggaacagaacggaccatcaccagatttgccgccaagaaggataatcttggaacatagcgggccatcaccagatttgccaatgcaattcaagaaccgagtagctgagttgagtggtcatgatcttaaatatttgatgcacaagagactcttctggtcagacgtgaagccgaacaacaatcgtctctccatgcccataaatgaaattatgtgtgaatttctcacacaagcggagattgaaaaattggatgaaagaaatggaagcaacggaaaaggacggctcgttggtctggaattgactgtgttagacccatgtctgagagaatttactttaccattgaagaagtggagcatgcaaaggactgacacctacaacctggtaacagattggaatagtatcgtatctactaatgagtttgaagaaggccaagagctccaaatttggtcttttaggattgataacaagttatatcttctcctaaacaaactgtga

SEQ ID NO: 57374 - DNA, 264 bp, Glycine max
  Peptide Sequence Number=SeqID_174152
atggaggacaagggcacacacgaaactttaaggaagcacatcaagcataacaagcacacattgaaggagaaagagaaggagaagctcagcttggagaggagaagtgtagataaatttacgttgatggagcatttttttataggagaaaacgtaaacaagcaacggtcaaaagcctactcctgcattttcaccttcatctgcaaccctaacctgcatcttcagaaaacactgcaaccctacactgcaaacactgtgcatggctga

SEQ ID NO: 57375 - DNA, 162 bp, Glycine max
  Peptide Sequence Number=SeqID_174153
atggtgaaacttggatccttaagactgatcatgagtgagatggtgggcgtgcatgttggggttgctaagaagtccctaaacctagtgctggaggttatcgtggtggctaacgctgaaaaggcctatagaatggatgcgtgggtgaatcccaagataggttaa

SEQ ID NO: 57376 - DNA, 243 bp, Glycine max
  Peptide Sequence Number=SeqID_174154
atgtggactaacagatgtaatatcataggcataggagatttcaccttaccttctccaacatataccatttcaaatgataggggaatgattcaaggcgggccaagcagcaagagaagggctatggtactggacggattggcccacttagaatataaagaagaggaagatgccaagagacagaaaagggtagagaccaaccaccgaaacaagggactaagagctatgggtcatcccaggaactaa

SEQ ID NO: 57377 - DNA, 120 bp, Glycine max
  Peptide Sequence Number=SeqID_174155
atgaatcaaagcctatcatctcagcctttccagctgcctaatccgataagcctgaacatggtccaaggagttctaacaatcgggggcccttgctttagtgatttccctcaagggttttag

SEQ ID NO: 57378 - DNA, 508 bp, Glycine max
  Peptide Sequence Number=SeqID_174156
atgtgccggccagccaacgccgatgcgcctttcaggcttgttctcacgcgttcgccgcgaacagcctccgcccgaccattcgacgacaagaacggaattccagcttatgacccagcgttcgcgccaagtgaagcatgcccgccgtttgaaggccctccagtgggcgatcgcgctggcgatcggcgcgagcgcttgcagcccggcgttggccatgcgggtcgggcattcgcgggtggtctcggccccgggcgcgcccttgcaagcgctggtgggattgcaggaactcacacccgacgaaatcgcttcgctgcgggtgtcggtggccgacgaggctgcgtggcagcgcgcgggcctgaagccgcccgcgccgctggccagcctggtggtgagggtcgaggatgggatggatccgacccacaagaacctgcgggtgcggtcgactcaggcgccgtccggcggctcggtcgacctgctgctggacatcagctccagctcgggccagcggcag

SEQ ID NO: 57379 - DNA, 213 bp, Glycine max
  Peptide Sequence Number=SeqID_174157
atggaggttgatgaaccttggctagggttatggctaccattgaattatcaagtagatatgggagcaagtcagcctaggacactggaattggggtgggttttgtggtgtgatttagggatggcctttgtggataactgtgtggtgggtaaggagatgggttgttactggctgagtaatgacattgtcgggttggtgggaaacttggccatatag

SEQ ID NO: 57380 - DNA, 201 bp, Glycine max
  Peptide Sequence Number=SeqID_174158
atgtttggtttgcatgtttggtttagggttggtggtacttctgctgttctgttctgtgttatggcacgttctccagacaagataaagagcattgatggctcaaaagaaactcttaaactcagtgtgaggatcagtgatctatggtttattggcacgcctaacaaatatgagcaagctgaaatggtgtttgtggactccgat

SEQ ID NO: 57381 - DNA, 555 bp, Glycine max
  Peptide Sequence Number=SeqID_174159
gttgttgtgtttgtgtttaacgttgttgctgtttctggctagtgtggcaatggcagaagaagattcagatcataataagcactccctaaaagccacgtcacacgcgcagatccagtgcacaatgtgttcctcttgtaacaacccttgcaaccaagttccatctccgccaccaccttcaccaccaccaccatctccttccacaaacaactgtcctccaccaccctctcctccttcctccggcggcggcggcggaggagctccgtactactactccccgcctccaccctctcaatatacctactcctcaccacctcctcccgcatccaccggcggcggtggtggcggaggaatctactactaccctcctcccagcaacggaaactacccgagaccaccaccgccgaacccgattgtgccgtatttcccgttctactactacagccctccgccgcccggatttgcagatctagagattccgagggaaatgagagttgagagtgagagtgaggtaatagaagtgctcgtgaatttcccaatctgccctgaacatgtgaa

SEQ ID NO: 57382 - DNA, 1083 bp, Glycine max
  Peptide Sequence Number=SeqID_174160
atggaagtggaaaatcacagacagcacaccaacgttgatgcaaaagaagtaaaaagaaaagtcaataagttcacgggttcacacatgcgtgtccgcttgaaaagtctcatgtccttcaaactcaagtgtaagaaattgagaagagaagaggtcatagacacaacacaagacatgtctgttgttgagtcaggtgaacacaacaacatcagaggagtacctactcatggtggacgctatgttcagtacaatatctatggcaatctctttgaagtttccagaaagtatgtccctcctattcgccctgtgggtagaggcgcttatggtattgtttgcgctgctgtaaatgcagagacaggtgaggaagttgccattaagaagattggcaatgcatttgataacagaatagatgccaaaaggaccttacgagaaattaaacttcttcggcacatggatcatgcaaatcctagtaatttgctattgaatgccaattgtgaccttaagattgcggactttggtcttgctagaactacatctgaaactgactttatgactgagtatgtggtcactagatggtaccgtgctcccgaattgcttcttaattgttcagaatatacagcagccattgatatatggtctgttggttgcatacttggtgaaatcataaccagacaaccactctttcctggcaaagattatgttcatcagctgagacttatcacagagctgataggttcacccaatgatgccagccttggatttctacgaagtgataatgctcgtagatatgtaaaacagcttccccaatatccaaagcaaaacttttctgctagatttcccgacatgtctcctggtgcagttgatttgctagagaagatgctcatctttgatccaaacaggcgaattacagttgatgaggcgttgagccacccatacatggcacctctccatgacatcaatgaggaacctgtttgcaccagacctttcagttttgactttgagcaaccatcattcactgaagaagacatcaaggaactcatctggagagaatctgtgaagttcaatcctgttccaccagtctactga

SEQ ID NO: 57383 - DNA, 2061 bp, Glycine max
  Peptide Sequence Number=SeqID_174161
atggaaaatgttaaatgtttgaggtcaagagatgaacagagtgagacacagacgtgcccgcaactcaagccgctttcggaagaatattccatcctaccattgtcatgttcaaatttcgaaattcggaagatgctcctccgaagccactgttgctactaccttaccatcatcaccgcgctggcagtgttccttgcaacgacgtcgttcgccgacgcccaatcctgcaacggcatcctcgtctcctacgcccacaccggcggcgtgcggctgccgccgaatgtctccgacccggcaaagcagccttaccggttcgagtcgacggtgacggtactcaacaacggcctcgacgagctcaagtcgtggaaggtcttcgttgggttcgaccacgacgagttgttggtctccgcctccaatgctgtgctcgccgacggcaccaccctccccgccgccgtcggaaacggcaccgtcttcgccggcttccccatgaccgatctcaagaccgccgtcgaaaccgccggcgacttgacccagatgcaggctcagatagaactcgtcggcaccgtgttcggggtggcgccgcccagtgttccgatgccgaaatccatcaacctcgctaatgatggattcctctgtcgcagatccaccgctcaagggaagaatgcgagtagtgtgtgttgcacgagagatcccaaattcaaaactaacattactacggatgaagagtttctgccacgtcagagtggtgatcttaccattatgtatgatgtgatcagaacttatgattcaaattactgggctgaggttactattgcaaaccataacccacttgggaggcttgacaactggaggttgagctgggactggatgaatgatgagtttatttattcaatgaaaggggcttatccttctgttgtggatgcttctgattgtctctttggtaagcaaggaacattctacagggatcttgactttgcccatgtgttgaattgtgagaggaggccaaccataattgatctccctcccaccaagttcaatgattccgaccttgggaagattcccttttgctgccggaatggcactattttgcctccatcgatggatcctagcatgtctgcttcgagattccaaatgcaggtcttcaagatgccaccagcgcttaaccgatcccagcttttgcccccgcagaactggaacataagtggcacactcaaccctgactataaatgtggccctcctgtaagagtgagtcctactgaaaatcctgacccatccggcttaccatcaaacaaaactgtgatggccagttggcagattgtgtgcaacataacaacagccaagagaacatcaagtaaatgctgtgtctcgttttcatcttattacaatgattcagttattccgtgcaaaacatgtgcttgtggatgccccaagaacgcagagagaacatgtagtactactgctccagctatgtggcttccaccagaggcacttcttgttccttttgagaaccgaaccgccaaggctgttgcttgggcaagtctgaaacatctccgggtgccaaacccaatgccatgtagtgataactgtggtgtgagcatcaactggcatttgtacacagactacaccaaaggatggagtgcaagggtcaccctttttaactggggagagactaattttgcagactggtttgccgctgtgcaaatggacaaagcagctgcaggttttgagaaaatgtattcattcaatgcaactcttctagatggtgtaaacaatacaataatcatgcaaggtttgccaggattgaactaccttgtagcagaaacagatgcagctgatcctctgagagatcctagggtgcctggtaagcaacaatcagtgatctcgttcacaaagaaaactactcctggaatcaatgtagctcatggagatgggtttcccactaaggtatttttcaatggggaagaatgctctcttccttcagtgtatccaagcagtagtggtttcagggatggtttttcattggctactcccttgcttctaacactgttgatgatcctcttgtag

SEQ ID NO: 57384 - DNA, 1968 bp, Glycine max
  Peptide Sequence Number=SeqID_174162
atgaatctcagcaacggaaagggatccatgtcaacccttactgcaagcgtggttatgaaatccggcgacgccgtctccgaccagtttccggcgggtctccgggttctcgtggtggacgatgatcccacgtgtctcatgattcttgagaagatgctccgcacgtgcctctacgaagttaccaaatgtaatcgagcagaaactgctctctcactgcttagagagaacaaaaatgggtttgacattgttataagcgatgtgcatatgccggacatggatggatttaaacttttggagcacattgggttagagatggaccttcctgttataatgatgtctgcggatgatggtaaaagtgttgttatgaagggtgtgactcatggtgcttgtgattacttaattaagcctgttcgcattgaggctttgaagaacatatggcagcacgtggttcggaagaggaagaatgagtggaaagacgcggagcaatcagggagtgctgaggaaggagatcggcaaccaaaggcttctgacgaagcagattactcttcctcagcgaatgaaggcagttggagaaactcaaagaagagaagggatgaggaagaggaggcagaggatagagatgacacatccacactaaagaagccacgggttgtttggtccgtggagctccatcaacagtttgtggctgctgtggatcaactgggaattgacaaggctgttcctaaaaaaattctggaattgatgaatgttcctgggctcactagagaaaatgttgccagccacctgcagaaataccgattgtatcttcgaaggttgagtggagtttctcagcaccagaataacatgaacaactccttcctcagcccccaggaggcaacattcgggacaatttcttcaattaatggaattgatcttcaaactcttgcagttgccggccagctcccagcacaaagtctagccacacttcaagcagcaggacttggtaggccaactggaaaagctggtgtacctatgcctctcatggatcaaagaaaccttttcagttttgaaaacccaaggttaagatttggagaaggccagcagcaacatttaagcactagtaaaccaatgaacttgttgcatggaatccctaccaacatggagccaaagcagcttgccaatttgcaccagtctacccaatccattggcagcttgaatatgcgagtcaatgcttccgctacacaaggcagccccttattgatgcagatggcacaatcccaacctagaggtcagatgctaagtgaaaatattggtcctcgtgttccaagacttccatcatctttggggcagcctactgtatcaaatggaatttctaatggtcttctgggcagaaatgggattgctggtaataacagaggacctgcatataatcctgttccaccaagctcttcgttgttgagttttccaatgaatcaaacctctgaaatgtctgtcaacaatagttttcctcttggaagcactccaggtatatccagtatcacaacaaaaggctcatttcaagaggaagttacatctggaatcaaaggatctggtggatttccaagttatgatatttttaatgaactgcaccatcagaagcctcatgattgggagataacaaacccaaacttgacttacaatgcctcccagcatgcaaaccctttacaaggtaatattgatgtcacaccatcagttttagtgcatcaagggttttcttctacacaacagactggtcaaagcagagatgctgctttgattggaaaagctatgttctccatgggagagggcttggaacaaaataacttccaaaatgctagtcaaaacctcaattcacttcttcttgacaattcaataagggtcaaggctgaaagaattcttgatgcaagctcccagactaatctcttccctgagcattatgggcaggaggatctaatgagtgcacttctaaaacag

SEQ ID NO: 57385 - DNA, 546 bp, Glycine max
  Peptide Sequence Number=SeqID_174163
atggtggaaaaagaagccattgaagaagctcagagcaagctccaatcagagttccttcaaatcctgcgtagtaggcgacccgctcaagttccactaacagtccaactcgcgaagccagtggcgaatcctttgtttcaggactctcctccatcgatcaaagagtgtgttcgaaaaggaataggatgcgaggtagcaagggttttcatgagtcaaatttcagggcgttcgaaaaggaataggacacgaggaataggacgcgagggagccggtcgaacaatgatcaaggttgcatgtgaggctcacaaaaactcaaaatgttggtggcacaaggatgccggatggaggtggtggcaggcaaggtggtcattggtgagaaagaggggcattgtccaaggacaaacgggaaaaagaagagaaaaacagaaaagaaaaacttcaaccattgatttaaaaattaagaaatcaaacagtcctaaatggcttttcccacgtgggagacataaggtggcttcgcacctaagcctgcgtcttgatggtaaaaagtag

SEQ ID NO: 57386 - DNA, 1170 bp, Glycine max
  Peptide Sequence Number=SeqID_174164
atggcggaaaaagaagccgttgaagaagctcagagcaagttccgatcagagttccttcaagtcctgcgtagtaggcgacccgctcaagttccactaacagtcgaactcgcgaagccagttgcgaatcctttgcatcaggactctcctccatcgatcgaaggggtatcgtatcaacatttcttttttcaatttctacttaatttgctggttcaatcgcatgagaaccttttacagatcgagataatggagtcgtgtccgaaggctgatatagagaaccttgaagacttgctcgaggaggagaatctctacttgaatacagaggaaggagagcaaggacggttgcctttgttggttttgaagttgaaggaaagcgataagcagagaaaaaggcctgcggttgtttttcttcacagtacgaataaatacaaagaagccgtgcgtccattgcttaaggcatatgcttcgcgaggatatatagcaatttctgttgattctcgttaccatggagaacgtgctaccagcgcaaccgcctatcgcgatgtctgggacttgattaaattggcagattatctaacacacagagaggatgtagacccttctaggataggaatcactggaatatcacttggaggaatgcatgcatggtttgctgcagttgctgatactcgctatgctgtggttgctcctctgattggcgttcagggatttcgatgggccatggacaatgataaatggcaggctcgagttgatagtataaagcctctttttgaggtggctcgtgatgatttgggtaaaggtgctattgacaaagaagtggtggagaaggtgtgggaccgaattgctcccggtttagcttcccaatttgattcaccttattcagttccaactatcgcaccacgtcctttgcttattgttaatggtgcggaagatcctcggtgtcccattgcaggcttggaaattccaagggcaaaggcaagctgggcatatggagagtttgactgtttagataatttcaagattattacagaacctggagttggacaccaattaacgaggcttcaggttcttgaaaccttagcccgtgccctcatatgtgttcttcaagccctgtgtggttgttgctctagctcattgcctcatttctgttgtcttcgtatgattgtgtcatga

SEQ ID NO: 57387 - DNA, 486 bp, Glycine max
  Peptide Sequence Number=SeqID_174165
atgcaggcatcgcgggcaaggctgttcaaggagtacaaagaggtgcagcgggaaaaggctgttgatcttgatattcaactagtttgtgatgattcaaacatttttaaatggaccgctcttatcaagggaccctctgagactccttatgagggtggtgtgttccagcttgcgttttctgttccggagcagtatcctctacagccacctcaagtccggtttttgactaaaatatttcacccaaatgtgcattttaaggtaggatggatccccatgattatgtcgtcctcaggtggcagtggtgacggtgggcaaagggatggtggcagtaatggtgaaggggtggcggcagtagtggcaatggaggtgacaacaatggtgattggtgatgatagcggctgtggcaatgcagtggcaaaaattggtggtaggagttgtgatggtgggggtggcaatgacagtggtggtagcaggaggcatagttactag

SEQ ID NO: 57388 - DNA, 333 bp, Glycine max
  Peptide Sequence Number=SeqID_174166
atggtggaaccatcgaagaagcgcaagggttcttcaagtagaagccaacgacactccgaggctcaggatactccaattccttcctccatttcctcctcctcattgttctcatcggaaaaaaaatccttttattctaaccttgaaattcaagaaagtaccttgatttctgaggtctatgggataaagatggtcattgaccaatccctgttgtatgatttgacccaattgtctagtgatggtgtaccatttgaaggtgcactggacgatgattggaatttgatttttttgtgcatgatgcccgctggttggtttgcaccaaccaagcggatatga

SEQ ID NO: 57389 - DNA, 237 bp, Glycine max
  Peptide Sequence Number=SeqID_174167
atggtccaagatagctccagttcaactccactagctgggcaggttgttcttgcgagagaggaggagctgtcaagagactttactgctggcaaccacgaagaaactctcgcatccctactatactacctacggcttgcaactgaacacgagacaaccttgagatcattacgagttggtactactatatctcagagatgcatgcacctgggcgagggactatgcgcaacacccagatag

SEQ ID NO: 57390 - DNA, 504 bp, Glycine max
  Peptide Sequence Number=SeqID_174168
atgggcctggcgcagcctgagctggttgaccaggtagttgaagtggtgcagcgccatgcgccgggcgactacaacccgcaggtcaagccgagcagcaaaggcaactaccactcggtctccatcaccatcaacgccactcacatcgagcaggtcgaaaccctgtacgaagagttgggcaacattgaaattgttcgcatggctggccgcagaccggagcgcccgccctacgcgcctgtatcccaagccatgcataacttcaccgacagtcgtaccgagaccacaccggacgagctgtggctggtgcagcatcacccggtgttcacccaaggccaggccggcaaagccgagcatgtgctgatgcccggcgatatcccggtgattcagagcgatcgcggcggccaggtgacctaccacgggccgggccagcaggtgatgtacgtgatggtcgatctgaaacgcaacaaggtcggcgtacgccaattggtcacggcgatagaagatacg

SEQ ID NO: 57391 - DNA, 639 bp, Glycine max
  Peptide Sequence Number=SeqID_174169
atgaaggacagtccaaccagtcccgaaagcagcacctacacactatctgggacatcaacattaattttgtcgacacctcctatagcgaagtgtccctcctatcacctttacagcacaaggacttcaggggcatcaatctcatcaaccaagacaatcccggtggttgtctccatcatcatagtgaatttcatgagactcgaggtttcacccgacattgtccacccttacgcaagtccactcctctgttttataggcgagagagtcgaaacccgaggctatgtggacttaatgaccaccttcggtcagggcaagctctctaggagcttcaccatcagatatctactggttgacgcgaccacatcatactttgccttaataggaagaaagacactcaaggaattgggagccatatcctccatgccccatttgacaacgaaattccctacactgacatgggagattgtaatagttaaggctgaccaaaaagacctctccgctcatgaatatcggtgccttgctgacatgctatgcaaaaacattgatctctttgcctcgcaaccatctgaaatgtcgagaatccaccttgacataatcttccaccaacttgctatctggccccaggccaaacaagtatcatag

SEQ ID NO: 57392 - DNA, 147 bp, Glycine max
  Peptide Sequence Number=SeqID_174170
atgtgtcctccaccatcaagtgcggagcctctgagaaagaagaaggagagacgggagtcatcatcgactaatcgcggaaagggcaaagacggacgaaatcagtgtcttatctttgctttcctcttatctccgataaaaggtaagtaa

SEQ ID NO: 57393 - DNA, 261 bp, Glycine max
  Peptide Sequence Number=SeqID_174171
atgggcaaaatgttgctaaatagcaacgtcatccatatccacgtaagattggtcatgttggtgcgcatgatccgcactcgtctttttgtagcggcacgggtgaaatcttgccccggtatgcatagtagatgcgtgatagtctccctctctggatgtactcgcacagttggttgccctccaatatcaaggggtggcccaggaactgataaaggaaactactggccccttaaccgggagcgcaagtctcggttgagcatctaa

SEQ ID NO: 57394 - DNA, 387 bp, Glycine max
  Peptide Sequence Number=SeqID_174172
atgacaaaaagatattggaacataatcttggaagagatgatggaagcaggagttcattttggccacggtactagaaaatggaatcctaaaatgtcaccttatatatctgcaaagcgtaagggtattcatattacaaatcttattagaactgctcggtttttatcagaagcttgtgatttagtttttgatgcagcaacggattcagtagcacgggctgcaataagagctcggtgtcattatgttaataaaaagtggctcggcggtatgttaacgaattggtatactacagaaacacgacttcaaaagttcagggacttgagaatgcaacaaagacgggagactcatagttttccaaaaagagatgccgctatattgagagacatttag

SEQ ID NO: 57395 - DNA, 498 bp, Glycine max
  Peptide Sequence Number=SeqID_174173
ttaagaaggtgatatggaccttccggcttcccgtgacaaaagacaagaccaacatacaacgcgtgtgtgacgacatgatgttgatgcgcaaaaagcataacatggggatgtacccagtggtcatatctcttttgatggtttctagaggtatcatccccttcgacaagcatattgcggcagtagggactactagcaacaatatgttatcaaagagaaaaactctagatgagggttcagtgttatcaagcaaatcgaagacccggcatgagcacagattcacctccactccttatgttcccctggacccgggtatagggccccttttcaactcaacgcctaactctctaaaaacagtccccagtggagtcgccaactgtcgcaacctacccttcggtgggagggcgacgcgagggctcacgggtgcatcttccatgggaggaaaatgcgcagagtcgccaccaacgtttattcgaggaaaatgtcagaaaaaccggaaag

SEQ ID NO: 57396 - DNA, 197 bp, Glycine max
  Peptide Sequence Number=SeqID_174174
ggatcacgcccgcaagacaccctgtggactcgaagaagtccaatagggtcttggggtttccagctctgattacgagcctttgtcagttctacggagagcccatcgcccccaacaaggtcatcaggccccctattaaccaggctctcatcaagaagtactgcgcctccaggcaggtgcagggcaagtcatcacagtag

SEQ ID NO: 57397 - DNA, 1578 bp, Glycine max
  Peptide Sequence Number=SeqID_174175
atggctggtgctgcccttttggatattgttcaatctaaaccttcctgctttcctatatcttcccaggagttgttcagtatccttgatgatgctagtgaaaatacttgtttatgtgggacagcagaatcaatgcaaagatatgtatttgatggagaggctggaaaaattggtcttgaaccaaaaaacctagttgcttgcacaagtttcttgctagaacagaaattggtaattgtctttcttatggtgaaggcatggcttgctgacaaggatgctgaagcactaaggtgccaaaagcaattggtggaggaggaagaagctgctcagaaaagacaagctgagattttggagaggaaacgccagaagaagcttagacaaaaagagcagaaagctagggaacaaagacaccaagctgaggcagaaattaaaggcgatattgacagtactgtaaaggctttatcaccggcagaagcatctttagatacatacaattttgaagctcataatccaagtacattttcagataacgcagcttcacctgtacctttccaatgtcctgacaccagtgaagaaataaatggggatattcattcagagtctgaaactatcactgatcaggatattgtgagacagtcagcacatggacataaacataagcgccaagcagttgccagacaacaggggctgccaaaattacaatgggctgtagccaatggtttgcatacaaagcagaattctccagtgtcaaaacttgaaatcaatcagaaatatggaacccactgtgatcaaaaggcatcttctatagttaatggtagcaaagtatggactcggaagtctaaaacagaaattgacaaggtggttttaaaaaccataaaagagaaggaaccagaccaagttaagaatcaagaagtcttaataggatctatatctgttaatcttagcaattgcagccaatcagagggtaatatggtggcttctcaaaaggacttcattgttgagaatatgggaaagcagaatatttctcgggataagccaatgaaaactgatcttgccatgggtgacaacaatcgctcaacagtcaagttttggaggccagttagccggcttgaaactaaagatccacttccagttcaaagtggcgggacaaaagttgatgcagttcatgaaaatggtcaaaacttgtcaggtccaagttctttaagggtgtgtactgctgccggtggtgatattggttttgctaagtatttctcccatacagaggataaagcagatccaggaagcttctggttcgacatccaggctgcaaaagctttccttgcacaaaggtggaaggaagctatctcatcagaacatgtgacattggttatttgccccgactcggaacctcctgggtgcgaggagatacaggatttgaaaacagcagcatgtcaatcttctgatatggatggatgtgacattgtggcaaatgcagataaaagattgcctgcaacctccaaagttgcgaaatccaaacccaggttgaagaagtctgaaaagggaaccaagataaagtatattccaaaacagaagacaaatacctag

SEQ ID NO: 57398 - DNA, 260 bp, Glycine max
  Peptide Sequence Number=SeqID_174176
ggtgtgtgcaggttaccatcgggtgtctccgcatgccaccggactcttgggtcacagtagcaaaagtgcggggcgagaaagtcgctagcgcacaggattttggttggcaatcaaagggagaggaccacttcaggcgaggatgggcattctcaccctgggtcaaggtttatggtgagttaggattttggctcaaggcttgtagaatggctggacacgatatatgtcagagtgttggtttggccagcagttcagggatatag

SEQ ID NO: 57399 - DNA, 456 bp, Glycine max
  Peptide Sequence Number=SeqID_174177
atgccaattgcaaaactcaaagcctctggcactccagatgtgatgaaaaccgaagacagaatagataccttaatcagacaggcaattggcaaagaacctttcattccttttccaagggccagtgaaagccctgtacagtggattcaattactccatgctttagatccgcaaggtgtcagcaatactttttcagaatttcctgggtggcctttgttctctcctctgaaggttcagttgcagaagtgtgacaaatgttctcgagagttttgctcccccgttaactatagaagacatatacgtgtacatcatcggttgaaaaagcttgataaggattttacaaaaactaaggatcttttaggagcatattgggataagctctccgtagaagaggcaaaggaagttgtatcattcgaaaatgtgctgctggaggctgtgaattggaagagagtagaatga

SEQ ID NO: 57400 - DNA, 336 bp, Glycine max
  Peptide Sequence Number=SeqID_174178
atggcggattttcatggcggtttttcgaaaaaacgccaccgaatagcggtggcgtggcgggtttgggatggcagcgccatggcggccgccataaccatggcggtcgtggcggttatggccccacacgcgcacccagccgcgtccctcccgcaccccacacgtgcacccagccgcgacacccgcagccgcacgcgcacgcagccgcgacgacctccggcagcgacgcaccagcacaaacggcggcgacaagctccggcagcgacgcacctgtcacaaacggcggcctgcagcaagaagttctcgcggagaagacgaagctgtcgcaaagggttttag

SEQ ID NO: 57401 - DNA, 417 bp, Glycine max
  Peptide Sequence Number=SeqID_174179
atggatcacgtaccgaataggaatgagaaacgagagagagctccgagaataacgaggatcggcgaagcggcggcgaaggggaacacggagtgtttggcgggaaggaaaatcggcgagaaaaggcgagaaagcgatcagcaaagaaggtttagagagagagggaaagagacagagtatatgaaattcatgaaacatgaaattgttggaatgaaggcgtttgggagatggagtttacagagagctcgtaatgaaaggatatgggatgataagctgtggcggatccaagacctaaactttatagtctactttgtaagaaggcaagtcaatctaatagctcatggtttaaccacggtagttagagactatgctagccctcatattctagttgccctccaagttgtattgccgaggagttga

SEQ ID NO: 57402 - DNA, 552 bp, Glycine max
  Peptide Sequence Number=SeqID_174180
atgttaaaaactagtgtccagatcagactaaatagcatgttccaagataccatgcataatatcagatcagacgatcatgttggaaggacaagtgacattggtaacttccacccatgcccattaaagccatgcagcaaatttctaataggttttgtgtgctgtgctgtgcagtgcagtgcagcagacaagtgtcatatgtatcatccccctttaccaccaccacctccccacattgacccaccacctgagctcatgccactgttatcacagccatcgttatcaattattatccatcgcagacggcagaacatggtggaaggccaaaatttcaccattgcgccttacagcaggcctcccttcacaaattgcttatggcagtcggcaaaaaattcgccacgtcattccaccatggtgacaccatggccgctatttaacaacactgagcatcattgctgctgttgctgcttctataaactctgtagcagagcaattcatcgtcatggttgtagcagcaggaatcatggtggcagtcatgcaattttcaccatttaa

SEQ ID NO: 57403 - DNA, 366 bp, Glycine max
  Peptide Sequence Number=SeqID_174181
atggcttctatctcccttcttctcgccctgttcgtgttcttcctaattgccacttctcttaccgaaagtaggaaggaattaaggaacaagcaggaaactgcattacagatgttagagcgctcaattcatttttccaacagaattaatccatcacgtgttgtccaaatctcttggcaaccaagggtttttctatacaaagggtttttgtcggacaaggagtgtgactaccttgtttctttggcatatgctgtgaaagaaaaatcctcagggaacggtggcctttcagagggggttgaaacttccttggatatggaaagttttactaatggtgaaatgttatttatgtgtgggtttctggaattgtga

SEQ ID NO: 57404 - DNA, 2190 bp, Glycine max
  Peptide Sequence Number=SeqID_174182
atggattcaaagcgattcgatcgcgcgagtcgcaaggttcgggtcgtcaccaggatccgcgggtttgcgggtcccgaggctaattccgaacctgccgcttccagaacggtggagtgggtttcggtgaaccgcgaaaatttggaggatgtcaccatctccttcggagaccaatcttccagtcggtattcggtggactattgctataaggaagatgaagataatgaattgatatattcaagggaggtgaagcctcttgtgtctgcagcttttgatggtcataacagcactgttattgcacatggtgctaggggtagtggaaagacgcacgcaattcagggctctgctgagagaccaggtttggcagtgcttgctatcgctgagtttctttcagtggctgagaaaaatgggaaaaacatagctgtttctttctatgaggttgatcatcaggagcgggccatggatttattaaatccagagaagccaccaattttggtttttgaagatcatggcagaattcagtttaaaggactaactcaggttcttgtgaaatccattgctgaatttcagaatttgtactcctctgcatgttttgcactgaagggagctcccaaaaaaggaggatgtgaacatgttcatagaagccacatgggattaatcgtccatgtcttttcccagaatggaagtcttgtaagcaaagtgaattttgttgacttggcaggttatgaagatgctagaaagaaaagtggtgatggatcctaccttgctgagattaacaaaattaacaagtcaatttatgccttattgaatgtttgtcatgctttgagtacaaatgaaagtcgtgttgcctaccgggaaagcaaaattacacgcatgctgcaggattcgttgagggggactagcaaaattttattggtttcatgcttgaacccatcattttgccaagacactatttacatggttagcttggcatcacggtcatgtcattggattcatcgggcattcttagattccaccaagagaaatgcaagttcagcaaaacaaatggtgaattctcataagaaccagatacccaaaagtgtttcaggaacagcaaagaaattacatgtttcttctaaattacttgataaaaaagttgttgttgctaagaagtctgcaataaaaggaaggaaattgtttgatgaagccagtcactctgttactaaagctgagaaggaaattgctgttgcccaagttactcaagcatcaaagtctttattggaagctcaatgcatcaattggtctctaatgcaggacaattcattgttggaaactggaagtgatgtcgtactcaactctggaatggaaaagaagactggaaatcatgttgtactcaactctggaatggaaaagaagaccagaaatcatgttgtactcaactctggaatggaaaagaagaccagaaatcatgttgtactcaactctggagtggaaaaggatgactcattttcaaaagctagagagaacgtgaaacttgatctgatggtgcaaaatgatgattcatcttttaatgctaacattgaagtggaacttaatcccctagcagatcagggtatttcggtggatgaggaggatcatcaaaaggagcatactccttatgctagtaattactctgaagtattggcaaaaatagttcaggaagaccatagcataaacaaggagaacaacaattcaagggcaatcagagatgattcattggctattaattcaccacctatcagttctcagttgcaggatctttctaatagtcttaaaatgctatattcttcaaccccatcatgcatgcagataccaaaaacggaacccattccacttgatattgttgaaccaaaaactccaacaattgaacaaaacatgagcattaacagatgggatgcaatgaatgccaaaagtccctgggagacattcagcatgcgaggttctggaatgaagagttctcttgttcaagaatacctcaggtttttaaatacagctaacaaggaggaattaaaaaaattgaagggaatcggggagaagagagctaccttcatacttgaactccgagaagaatctccagagcctttcaagagtctggatgatttgaaggatattgggctttcggcaaagcaggttaaaggaataatgaagaaggaagtcggagagcttttcagttag

SEQ ID NO: 57405 - DNA, 717 bp, Glycine max
  Peptide Sequence Number=SeqID_174183
atgtcaatcctgtgtggccttcctcttgtggagtgcgtgtactgtctggcttgtgctcgttgggcttggaaaagatgtcttcatactgcaggccatgacagtgagaattggggctttgccacggcggaagaatttgagcctataccacgcctttgtcgctatattttagctgtgtatgaagacgatcttcgccaccccctttgggcacctcctggcggctatggaattagccctgatttgttacttctcaaaaagacatacgaagatacccgtggtagggcgccaccctatatactgtatcttgaccatgagcatgaagatatagtttttgccatcaggggtctaaatttggcaaaggagagtgattatgcggttctgttggacaataaattggggaagaaaaagtatgatgggggctatgttcacaatgggttgttgaaagctgctggatgggttttggattcggaatgtgaagttttgagggagttggtggcgaagcatccaaattacactctgacttttgttggacattcccttggagctggtgtagcagctatgctgacaatggtggtggtgcagaatcgagatagactaggaaatattgataggaagagggttaggtgttacgccattgcacctgctaggtgcatgtcactgaatctggctgtcagatatgcagatgtcatcaactctgttgtgctgcaggcaagttattga

SEQ ID NO: 57406 - DNA, 1599 bp, Glycine max
  Peptide Sequence Number=SeqID_174184
gtcattgagcctgatgttcaacctagtgatttatgtacacgtcgtgaatatgctcgctggttggtttctgctagcagtgctctttcaagcacagtttcaaaagtgtatcctgccatgtatatagacaatgctactgagcttgcatttgatgatgtcactcccgaggaccctgatttttcttccattcaaggcttggcagaagctggacttattgaaagcaggctttcaagacgtgatatacagttgtttggtgatggagatgatagcccattttacttctcccctgaaagtcctttatcacgtcaagatcttgtcagctggaaaatggccctgcagaaaagacagcttccggaagctgacagcaaggtgctgtaccaactttctggttttatagacactgataagatacatcctaatgcatgccctgccttagtagctgatctgtctgctggggagcagggaataatagctcttgcatttgttatttctagtctgattttggttttcggttttcacttatgcttatatttttggggttgtgcatggggttgggatattcaaggttatacaagattgttccagccagataaaccagtaacaaaagcccaagcagctatggctcttgctactggagatgcttcggaaatagttagtgaagagcttgcacgcattgaagcagaatctattgctgaaaatgctgttgctgcgcatagtgctttagtagctcaagtagagaaggatatcaatgcaagttttgagcaggagcttttcatagagagggaaaagatcagtgctgttgaaagaatggctgaggaggcaagacttgagttggaaaggttaagagctgagagagaagaagataaccttgcattgactaaggagcgagctgctattgaatcggaaatggaggttttttcaaagttaaggcatgaggttgaggatcaattacaaagcctaatgagtgacaaggtagaaatagcacatgaaaaagagaggattagcaagcttcgggaaaaagcagaagttgaaaacaatgagattggccgtttacaatatgagctagaggttgaaagaaaagccctgtccatggccagggcttgggcagaggacgaggccaaacgagtgagagagcaagcaatagccttagaggaggctagagatcgttgggagaggcatggaatcaaagtggtagttgatgatgacctccgcaaggaggcctcggctggagtgacatggctcaatgcctcagagcaggtctcggttcaaggaacagttgacagggcagagagcttattggacaagctcaaacaaatggctgcagatatcagaggaaaatctagagatacccttcacaaaatcattcacgtggtttcccaatttatatcaaaattgagggaatgggcatgcaaaacaggaaaacaggctgaagaatttggagaagctgccatctcaaaggtaggcaagtcagtcagtgagttgcagcaaaatgctcttgaagttggaattggtatcaaagaaggtgcaaagcgagttgctggtgattgtagagaaggggttgagaaaatcacccaaaaattcacacagaagttcaagacctga

SEQ ID NO: 57407 - DNA, 717 bp, Glycine max
  Peptide Sequence Number=SeqID_174185
atgagggatacatgtattccagaggagaagatgctcagagatcccaggagactctatgcacccggtcgcctttatcacattgttgagcggaagccttttagaatgggaaggtttcccccagtagtgaggacagcagtgccagtagatggaaggtttgagcatatagtcctttcttgtaatgccacatctgatcatgccatcatttggatagagaaagaagcccaaagagctctggatatgtttattcctaggcgaaaggggatgttgttattgggtcacccacattggtttacactccagatgtctagtcccaggcatgaggagggatgcaatttcgaaactagtgggactcatgcatggatttcaactcagaagtatattgaaaagagcatgttactggcactctttgatttgatgctggagaaagatcaacccatggaaccccctgccaagcaaaagatggagcgtcaggaaacgctaactagacacaatgacgaatataaagctgcattacaaagggccaaaacattagatgttccacatgcttatacaccgccatcagagtatggcacttttgatgatgagggagatgagaactcaacaagatctcagggtgagtcttctaataaaagttcagtggatgaaagctgggatgcattgattgagcgtcattttgataaggacgagcatggccacactgtgctcaagaaagaatga

SEQ ID NO: 57408 - DNA, 1518 bp, Glycine max
  Peptide Sequence Number=SeqID_174186
atggcttccctcacgtgctcccccacctcgctacagctccgattggccttagccgcccctaaattcccacacaccccgcaactgcgaatgcgcaacttcaagctcaaccgagttcgccctctacgcgccgcgcaagacggcgggcccgggcccgggcccaaactcgacggcttctcgggctggtccgacaccgacgccgagcagcggcccaacaacgccccaaagaaggagtcatatggagttgttggtgtggaaactttgaaactaggtctggttgttgctaccaattccacgttacttaataacacttttgaaggtagcttgctttcaggagttgtgggagtaggagtggctggagtgcttctactttcagggcttacctttgctgccttatctcttggcaaacaaactggttccagacctgagcaacacatgaagcccttgacttcacagcaggaggaacttttgtcttctgatgaccataataatgaaataactgaacaagggaatgttgacaacacggtggaacaaggaaatggtaaaatggaaggtcagatacatatatctggggattattcttctgctgagtctagtaatttttacagtgacaatagcattgttgatgattctgacataggatcccagttgatatatgatagcaaaaacccctccgatggtgttgacgatgccactaaacatatatctgttcaagaagatttacaggatgtgtcagcttttgataacaagttagtttttgctagtgaaagcccagtgccacttgaatctgaaaatactgtcgattcttttaatgcttatggatttagagattttgatagcaaccctaatgtagatacagtggaatctactcccaatcttaaagaaaacctattcaatgttgatccaggagacgtgcccaactatgatgatgctaagccactacaccttaatactgagcaacatgatgaaataaccagttcaagtggaagtgtaagttttggttttcctgaaacctattctagttcgggtgctgataatgagactggaattgttagtgttgtggtcatttctgagctaaataacatgatttcagatcctaagtttttcaatgaagctggtcaagagaatattctgtcagctttaaagaatgaaaaccttgacctgaacaaaattccacaggtctccgctgagggaaatgagccttcctttgaagagcggagcattcctggaaatgacctgtttgaaaaatcatctatttcaacatcagccaatacattggtagatgagcaggttagaaatgataattatgaggttgatgaagttaaatctgaatcttcaaattctggatcctttttctctgttcccggcattcccgctccattagtagtttctacagctgtaaaagtgcttccgggaaagattttggttcctgcagctgttgatcaagctcagggccaagcactagctgcattgcaagttttaaaggtagttatttgttcttattctcatgtatcaaggtga

SEQ ID NO: 57409 - DNA, 3141 bp, Glycine max
  Peptide Sequence Number=SeqID_174187
atgtcagaatccaaggaagaaaatcctgaccttcttctcaagtcaaaggcacaggaggaacatgggtttgtcatggattttggcattggcctggaaagtctgtggcccttggatcatatatctttggtctctaaccccatgcctccttttctcttttccactatctctgaacaacctttttctcctgtctgggctttttctgatgctgaagatgagaggcaaatcaggattgcagcttcaggtaatacaaatacaacaactgaaaatccaattgaaaatgatgacaacaaaaaaactgtgccaccccttgtagccatgacagcttcagaaaatccagatggttattgtctgatcaaggaaagaatgacacaagcgcttcgccacttcaaagagttgactgaacagaatgttcttgctcaggtttgggcacctgtgaggaatggaaatcggtatgcacttacaacttcaggccaaccatttgttcttgatccacatagtaatggactccatcagtatagaacagcttccctgatgtatatgttctctgtggatggagagaatgatgagatcctgggacttcccggccgagtttttcagcataaaattccagaatggactcccaatgttcagttttattctagtaaagagtatcagcgcctaaatcacgctcaacattacaatgtccgcggaaccttggccctgcctgtgtttgagcttgcaggacagtcatgtgtggctgtagtggagctgataatgacttcacagaagattaactatgctcctgaggttgataaaatctgcaaagcccttgagattgatcttgacaaaggtaactgccatgagattattggactcgggttaaatgtatctgattgcaaacattttttttacattcctgagttaccggcttacgcattagccgagattttggagatactgacagctgtgtgtgaaactcatagtttgcctctggcacaaacatgggttccatgtaagcatcggagtgtcttggcacatggtggcggtcttaagaaaatttgctcaagttttaatggttgttgcatggggcaagtttgcatgtctataactgaggtagcattctatgtaatagatgctcataaatggggtttccatgaggcctgtgctgagcatcacctacaacaaggtcaaggagttgctgggagggcatttttgtcccacaacatgtgcttctgtggaaacaatacccagttctgcaaaaccgaatatcccttagtacattatgctctcatgtttcatttaaacagctgttttgcagtatgcttacaaagctctcatacaggaaatgatgattatgtactagagttttttctgcctcctgggatcactgactttaatgaacaaaaaagattgctgggatccatattggcaacaatgaagccacattttcagagtcttaagattgcttctggtgttgaacttgaggggaatgcttcaattgaaattatagacgcaagaaatgaaagagttcatttgagatttgagtccattccaattacacaatcttctaagtcaccacctagacatacctcaccaaatatgggggaggggctgccactggagccatcagaaccgaaaataatggcatactttgatggtataaatgatggagggagtcttggtgataatgcaggcggacacattgatcagaacacttccttagagatcaaaaccaaaaagaaaccctcagatagaaaacgtggaaaagctgagatatcaattagtcttaatgttttgcaacattacttcacaggaagccttaaggatgctgcaaagagccttggtgtttgccctactacaatgaagcgcatctgtaggcagcatgggatatcacgttggccatctcgaaagataaaaaaggttaaccattccctgtccaagctcaagtgtgttattgaatcggtccatggtgctgaaggagcatttggtttgaattctctaagtactggttcacttcccattgctgctggttccttttctgaccctttcacttcaaacaagttccaccgccaaaccaccttgaccattaggccatcagaacctaagatcaacgaaaatgattttgatgcttttggagcatcagaaacaaaaagacaggttgcgatggaagatcaattccttggacttgaagcaaggacacgaagtcctgagaaagtgattaatgataaaggagtgtccattcaggagattggcactaaaggcacaaacaagtttagaactgggagtggctcaagtggcagtggaaatcctactcatgcttcatgccatggtagtcccccaaatgaaatctcacctccaaaagatacatttgtaacaggcaacagtgagcaatgtcttgtgttaagaggatcactggggtcaacaacactgcactcaactagtacaccaaaccgtgcaactgcataccctatgcttcacattgtggaaacaacagaacctcaagaaccatttggaggacagctacttgaggttgctggtagttctaaagacttgagaaatctatgcccttcagcagatgctgttttggaggatcaggttccagaagcttacaagatgaatcctcaatgttctgatttgcctcaaatgcaacacatggatacccttaataaaactatgacaccttttgcagttagaaaagaggtgaacagtgtgaccattaaggcaacatataaagaagatatcatcaggtttaaggtctctatggactgtggtattgtggaattgaaagaggaaattgccaaaagattgaaactagaggtgggaacatttcataacaagtatctggatgatgatcatgaatgggttttgatagcctgtgatgcagacctgcaggagtgcatggacatctcaagatcatcaggcggcaacataatcaggcttgtggtgcatgatatactgcccattcttggaagctcttgtgagagctcaagagattggaaaggctcttcgctatgcgaaggtatgggggagggatgttgtacgcagccttacccttgcatatgcaaagagactgtttccggattcgaacccataaccaacaagtcaccaaggcacaactttaccgctgcaccagggctcgccctccataacctttcaagataa

SEQ ID NO: 57410 - DNA, 1073 bp, Glycine max
  Peptide Sequence Number=SeqID_174188
atgctattacaggcgtccttcaactacgaacgtatgcaggcttccggctggctgtacggactattgccggcattaaagaaaatccacactaatccgcgcgatctggcacgggcaatgaaaggacatatgggcttctttaatacccatccgttcctcgtgacctttgtcatcggcataattctggcgatggagcgctcgaagcaggacgttaacagtatccagaacaccaaaatcgccgttggcgcgccgctcggcggtatcggcgatgctatgttctggttaacgctattgccgatttgcggcggcattggcgccagcctggcgctacaagggtcgatcctcggcgcggttgtttttatcgttctgttcaacgtggtccatctcggcctgcgcttcggtctggcgcactatgcctaccggatgggggtagcggcgattccgctcattaaagccaataccaaaaaagtcggccatgccgcctctatcgtcgggatgacggtgattggcgcgctggtagcgacttatgttcgtttaagcacaacgcttgaaatcactgccggcgatgccgtggttaaactgcaaacggatgtcatcgataagctgatgcccgcctttttaccgctagtttataccctggtgatgttctggctggtgcgccgcggctggagcccgctccgccttatcggcatcaccgtcgcgctgggcattgtaggaatcattttgaccgggcatggcggatttgccagcggcatggaaaaggcaatgaaacagatccttggcgaacagtcgcaattcattgcgatagattttcctgaatcctccacgaccgccctgctgaccgcacagctggagcaggcggtaaacgagctggatggcgaagaagatattgtttttctgactgatttacttggcggcacgccatttcgcgtcgcctccacgctggcgatgcaaaaacgcggacgagaagtcattaccggcactaacctgcagctactgctagagatggtgctggaacgagaaggattaaccagcgaagcctttcgtcttcaggcactggaatgcggtcatcgcgg

SEQ ID NO: 57411 - DNA, 554 bp, Glycine max
  Peptide Sequence Number=SeqID_174189
cagctctgaaaatccgaaaggagaatgccaaactgagagatgtaaatgtggctaccaccaaagccttggaacgagaaaccaagagggcttgtagggaagaacacggccggaacaagttccgaggggctctgtggggcagcaatagcaagcttaaactccgaagagaggaaagggaccaatcacgagtagacagtttgatcttgaaagatgagttgaaggcttgctcgaggtccaagagaagtttgtctcagtggttatgcgagacagagaccaacatgttagctatcatcaccaagtaccaagaagaactaaatctagccacggcccacgagcatagagtggcggacgaggtgatcgactcgctacatcaagaggcaacgatgtggatggaccaattcgctcttaccttgaacgggagtcaagagcttccccgattgctagccaaggccaaggaaatggcgaacacctactccgcccccgaggagatccacggacttctcggctattgtcagcatattatagatctaatggcccatataattagaaaccgctag

SEQ ID NO: 57412 - DNA, 150 bp, Glycine max
  Peptide Sequence Number=SeqID_174190
atggtttctctggacatattctgttataggagacgaaagactcatcataagatccacgagttgctcactccattgaatgtagttttgagttttgacactgtgcacgctctaatccgtgcggctgctctcgctttagtgccgaaaatgtag

SEQ ID NO: 57413 - DNA, 664 bp, Glycine max
  Peptide Sequence Number=SeqID_174191
atgaattcgattataacagtgttgtatttcaatggaagggtatatgaagataatgatggtgtaatatttgaaggcagtaaaaaagcgattcagattaaacgtggaattagtttcaatgctttgaagaaaaaaattggagataaggtaaagttacaaaataatgaaattatttctgctatcagctgtagatttttagtgtcaggaaaatatattgccttgcaaatttgtgatgacgaagacgttgagacgatgctggaaagttttaaacaacaacaagaaatgtcagttctagaattgtacatagaaaaggatgtggctggtggttcaatgtttcattctgcaaattcccttacatcatgtggaaattatgtatctaacgatgacacacaaccgccaacaaatatgagcaatttaaatcttgacgaagatgatgatgatgatgatgattatcttgtgtctaactcatacgttgaagagtctttagacgaagatgacagcgttgacggtatctctgatacagacgatgaagtcaccgacattcctcaaccagtaagaattgttcacccagcagaaggtgcacaacgaattgaaaatccattttggaatgatgctttacattataacaatatcaactggagttatcctgatgaggaggacatttgcg

SEQ ID NO: 57414 - DNA, 1038 bp, Glycine max
  Peptide Sequence Number=SeqID_174192
atggcaagcatgatgactgagtctacaaatcagatgatagataggtggattgcacaaatcaactccggaaaccccgaaatcgatgtggaaagagaggttgtagaaacggccggagaaattattgcaaaaacaagctttggcatgaaggggaaaaatgcaaaggaagtgtctgaaaaactacgtgccctacaaatgacactttttaagacaacaagatatgtgggtgttccatttggcaagtgtttcaacgtcaagaaaaccctagaggccaagaagcttggcaaagagattgacaagctcttgttatccgtcataacatctcgtatgaaatcaatcaaaagacaaactcaagaagacttgttgggattgttgttgcaaggaaacaatcatcaaggtgatggcaagttagggaagacattcaccactagagacttgttggatgagtgcaagactttcttctttgctggccatgaaacaacggcattggctatctcatggactttgttgcttctagctataaatgaagattggcaaatccagttaagagatgagataagagaagtggtcggtgataaagaacttgatatcaacgtgcttgcggggcttagaaagatgaagtgggtgatgaatgaagttctaagactctacccaacggcaccaaatgtgcaaaggcaagcaagggaagacattaaagttgataacttaacagtgcctaatgggaccaacatgtggatcgatgttgtggcgatgcaccatgacccggcattgtggggaaaagatgtcaacgactttagaccagagagattcatgaatgacgtcaatggtggatgtaaccacaaaatggggtacttgccttttggttttggagggagaatgtgtgttggtaggaacttgagctttatggagtataagatagtgttaaccctactcctgtctagatttagtttcaaagtttcaccaggttataaccatgcaccctctatcatgctctcccttaggcccacctatggacttcatctcatagttcagccactttag

SEQ ID NO: 57415 - DNA, 216 bp, Glycine max
  Peptide Sequence Number=SeqID_174193
atggtgtctccaagagaagtgttaggtataaatatagtaggagagggattagtagctatatcaagaggagttgctacagcacagtcaatgatagatgcattaaaattggaaggggaagatctagagtatccaagtatatgctccttacaagttacaacttctttcaatgcttatattatgattatgattatgtttttcactgttagtaatgaatga

SEQ ID NO: 57416 - DNA, 560 bp, Glycine max
  Peptide Sequence Number=SeqID_174194
atgaagacagaggaggccaaccgacttaaagataagtatgttttacattctgtaaattcagttaatgctaatgttgttgagtttgctgatcaacacaggtcaaaaggaaaagaaaaacgatttcagaaaaaaggacaaaagaaaacacacactaatatcaacaaaggtgataacaagattcagaaaagaaagggtgagtgctatgtttgtggcaaaacaggtcataaagcttatgggtgcaaactgaggaagggacaacaatctaacaactctaaacctgctgcaccatatgctcctcaagcacatctagcagaaaatgaagaagtgatagttgctgtggtagtggaggcaaacatggtcgacaacaaggtggactggattctagatactggtgcttctaaacacttatgcgccaacaaagagctttttcaccagattgaggatgctgatgacggagaatgtgttttcatgggaaattcagctacagctggagtgcttggtaaaggaaagattctccttaaacttacttcgggaaaaacattatctttgagtgatgtttt

SEQ ID NO: 57417 - DNA, 1029 bp, Glycine max
  Peptide Sequence Number=SeqID_174195
atggcagacaacacacgcatgaaggagcttacaggggatgtcaaaaggatcctgaagatgatggaaaaccgcaataaagaatatgctgctcggtttgagaccttagaaacaacactggagatgacactcaaggataaaactagagatcctgggagtatatcactggctatgaacaatcacccttttaaggttgtgccctggtaccaaatgatgactcgtgaaaattcattcaaaacatggattgcttttacgcgagccttagagacagaatttggcccatcaccgtgtgaatgtcctagatctcagttgtttaaactcactcaaattggttcagttcagtcatattacgtgcagttcacggctttagctaatcgagtacaaggaattacacaagaagctctattggattgctttgtgggaggattaaaacctaatatcagaatggatgtcattgcgcaatcacctacatcactcctcagaacagtttcgttggccaaactctatgaagagaaatatacacctaaactcaaacctttttcttcgagtttttcttccaaaacacaaacctcaaacacaaactcaaacctaaacacaaaccaaaacagccctcaatccctaaaatccacaagcttacccccactattacccacaccatacaccaaacctatcaatgttaagaaaatgacatcggcagaaatgcagttgagaagggaaaggggcctaagctttacttgtgatgacaagttttcccctagccatcgttgtcctaataagcaacattttgttctacagtgggaagaagaggatgatcctgcattacaaccagatccactagacgaggttgagacagttggtgaccccagtttgcaaaatcatcatttgtcttataatgctttaaaaggctcatcaggtcttggaataatgaagtttcaaggatcaataaatggattgggagtgcagattctagtagatagtgggagttcagataacttcctccagcctagactagctcaatgtctgaagttacct

SEQ ID NO: 57418 - DNA, 330 bp, Glycine max
  Peptide Sequence Number=SeqID_174196
atggaccaggctagagaggaaaggaagttgcaactaagtgagctagatgagatccgtttagtagcctatgagaattccaaattctacaaggagaagaccaagaagttccatgacagcttgagagctaagaaggactttgtggttggaaaaaaagttttattatataactctaggctcgaactcattagtgttgagatcaaaagtgaatccacagatacaagcttcaaggtcaatggacaccggctgaaaccattcctcacaaatccctccttagtggatgtagtggtggaggagacctccttacttatccctacttctttttcgccatga

SEQ ID NO: 57419 - DNA, 276 bp, Glycine max
  Peptide Sequence Number=SeqID_174197
atgaattgcgttttcgttcatgcgtcctccacacacgagtttggagccatgcgtagtgattgcttagagaaattctccattctcaaccctttttcagagccccatgaattgcgttttcgttcatgcgttttcgttcatgcgtcctccacccacgagtttggagccatgcgtagtgattgcttagtgcaattctccattctcaaccctttttcggagccccatgaattgcgttttcattcatgcgtccttcacccacgagtttggagccatgcgtag

SEQ ID NO: 57420 - DNA, 818 bp, Glycine max
  Peptide Sequence Number=SeqID_174198
atgggtctcgttcatagacacaaggaaagcccgatcgtcgcactattgatcttcggaggagtcctcttttcgaatgtggatgggttggtggacctagtagcgatcgacgcttttctcgcctatcataaccacaaggaaagcccggtcgtcgctatgttagccgacctatatgacaccttcgaccaaagatgtgaaaagagcagtacgaggattgtttgctgtactccaactctttatgtatggttggttttgcacctttttcgccaagaggtgaggcatgcttgcccgctagaaagccaccgttcatgcacagagaaaggaggggcaaattgggaccaactcttagcaaacaaagaaggagtgtctgtcaactggttccctcgatggaaagaaggaggaaccggagttcttatttcgtgcggaggatttccgaatgttcccttgatggggacgaggggttgcatcagttacaatcccattcttgctataagacaacttggctaccctatgagaggggcaccactagaggaagagctcacgcctgtcatttcacgaggtttcaataagaccaacatggagacacttcagaaggtccacaaggcatgggaggtggtgcgaaagaatgacaaagaactcaggggcagtaacaatgggcccatcggtggctaccgtaagtggttgagagcccacgtgcaaggtttggattggctcccgagtttgagaaccgcaaaaaggaaggaagttgaggcactggaggaagacgaagaggtgcaggcccttagggcagaactcgagcaagcccaaacagtcaaagaaag

SEQ ID NO: 57421 - DNA, 288 bp, Glycine max
  Peptide Sequence Number=SeqID_174199
atgccgatctccccctgcggaagtatcagttggtctgtgccgttccgacataggtacgatcgtgcccacaagacacccagtggacccggagaagtccaacagggccctggggtttccaactctggttacgggcctctgtcagtcctacagggtgcccgttccccccaacaagggatcgtgcctgcaagacacccagcggacccgaagaagtccaatagggtcctggggtttccagctctgattacgagcctctgtcagttttacggagtgcctgtcacccccagcaag

SEQ ID NO: 57422 - DNA, 261 bp, Glycine max
  Peptide Sequence Number=SeqID_174200
atgtattcattttacacaaaagcacaagatgacaaaagtacaatgcagaatagcggggtcaccctaagggctgaagctcaacacttcacaactttagttttagcaacctctaataaatctgagatttataaggaggaagcacagaatacagcacagaagcataaaccaaagagggtggagagtgtcaatgctgatgcagaagcctttggtgatcactggaaagttcagattggtctatgcattctgaagctgaagcactag

SEQ ID NO: 57423 - DNA, 264 bp, Glycine max
  Peptide Sequence Number=SeqID_174201
atgaagacaataaccagttcttttgaaggcatgtctaatcaaggtgcacctcagtgggttgaacccaagactaatgtgcaaagcggagggtttgagtgcggatattatgtcatgcactggatgtggtgcatcgtgactgccggtttgaagaatgactggcacaagtggttctctgatggctcatcgttaaacgtggaggccatcacatcagttcgacagaaatgggcaacttactttttatcttttaggaaaagcagttgctaa

SEQ ID NO: 57424 - DNA, 252 bp, Glycine max
  Peptide Sequence Number=SeqID_174202
atggcagagccatcaaagaagagaaagggatcatcttccaccgccaccgctgctgcccatcgccgtcacggcccatccggagcacccacagcacctattcctccttctttgtcatctccaagatcatcaacactgttttcatccgatgatcaacgtctacgtcaaggtgcaccttttgagggcaccattgttgatgattggaaattcgattattcgagtcatgatgctcgtcgcatggtctgcaatgattaa

SEQ ID NO: 57425 - DNA, 183 bp, Glycine max
  Peptide Sequence Number=SeqID_174203
atggaagagagagaatggaagatcttcagaccagataaattttcggcaagattgccattctcgactggcgatatcccaccccacatgaacaaagaggaaaagaccgaaacacccagcttcctctccaaaaacacttccctcgagaaaatcctattggtccgtgatcgtacgtttgatctttga

SEQ ID NO: 57426 - DNA, 624 bp, Glycine max
  Peptide Sequence Number=SeqID_174204
atggataacgtggtcaatctctggccgttacttggcattgccgcgattgtgctcggctttgtgctgcgcttcaacccggtgctggtggtgattgttgccggttttgtcaccgggctggcggcgcatatgccgctcggcgatattctggagaagctcggttccggctttctcaatacccgtaatctgccgctgatcctgctgttaccgctggcggtcatcggattgctggagcgccacggtttaaaagagcgtgcgcagacgtggatcgcccggatcaaaaccgccaccgccggccgtttactgatcgtctatctgttcgtgcgtgaactgactgcggcgctggggctgaccagcctgggcgggcatccgcagatggtgcgtccgctgctggcgccgatggccgaaggtgccactgaaaaccgttacggcagcgtatcgccggagattcgtcagcggctgcgcgccatgtcggcggccaccgataacgtcgggctgttcttcggagtcggcgggcatcagcaccgagccgttgcacatcgcgctgtggggcattccgaccgcgctgtgtgcgttcctgattcatgctgcgcgactggtgcggctcgaccgtcagctgtcgcgtga

SEQ ID NO: 57427 - DNA, 624 bp, Glycine max
  Peptide Sequence Number=SeqID_174205
atgctgcagtcggtgcgctgggccagcgcaaacgggcgtggcgattgggtgcgcatccgagctttcccgaccgggaaaattttggccggaaccgccatgcagctgccgccggaaaccgtgtacgcgcaggtgatctaccagattggtgccctgaaaagcctcgctgaaagtgaaggggcgaagctggtgcacgtgaagccgcacggcatgctgtataaccaggcggcggcggatgcagcgctggcggatgcgattgcgcgcgcggtgaaagccgtcgatccggcgctgattctggttggcctggcgggcagcgcctcaattgccgccgccgcgcatcatggtctgcgcacgcgcgaagaagtgtttgctgaccgcggctatctggccagtggcgcgctggtgccgcgcagccagcccggggcgttaatcgaagaggctgagcaggcgctggcgcagacgctcaccatggtgcagcagcgtcaggtgcgcagcgtcagcggcgaatgggtggcggtgaatgcgcagacggtctgtctgcacggcgatggtgcccatgcgctggaattcgcccgcacgctgcgcgccgcttttgcgacaaatcagattgctgtcaccagcgcctga

SEQ ID NO: 57428 - DNA, 972 bp, Glycine max
  Peptide Sequence Number=SeqID_174206
atgaccgggaggtgggttttgcaacgagcacgttgttatctgctgggtgagcgggcggtggtactggagctggaaccgccggtttcgctcgtcagccagcagcgcatctggggattgtgccagcggctgcagcagaatgagcagatcgcggaagtgattccgggcatgaataacctgacgctgctgctgcgcgatccgcagctgaaagcgctggatgctatcgagcgtttgcagcgctggtgggaagagagcgaggtgctgctggccgagccgcgtcaggtggaaattccggtggtgtatggcggcgcgggcggtccggatctggcggaggtcgcccgtgcggcggatctgacctcgcaacaggtggtggagctgcacagcagcgcggattacgtggtctatttcattggctttcagccgggtttcccttatctcggtgggcttgatgagcggctgcacacgccgcgtcgcgccgagccccggctggtggtgcctggcggttcggtgggcattggcggcagccagaccggcatctatccgctggccgcgcccggtggctggcagctgattggtcacacgccgctcaacctgttcgatccacaacagcagccgccgacgctgttgcgtcccggcgacagcgtccgcttcgtgccacaacgggagggcgatcgcggccgccacggctggcggcaatacggcatcagcctgagcggcgcactggatgagccttcaatgcgcacggccaatatgctggtcggcaatgcggaaaacagcgcggtgctggaaattgtgctcgccggtgtggaccggctggcgtctgccggtgaaaaaaggccaggtgctgagtctgtccatgcccacgcgcggtatgcgcagctatctggcggtgaacggcggtttcgccatcgatgcgatgctgggctcacacagcaccgatctcaaagcggcctttggcggctggcaggggcgtaa

SEQ ID NO: 57429 - DNA, 418 bp, Glycine max
  Peptide Sequence Number=SeqID_174207
ttcttgctacggagctcgtaaagggtttgtagatactgctgtacgaacatcagatgctggatatcttacacgcagacttgttgaagtggttcaacacattgttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgaacatctggatctgtcgattgtgttatggccaaagtcctactcatggtcacttggtggaattaggagaagctgtaggtattattgcggccaatccattggagaaccgggcactcaactaacattaagaacttttcatactggcggagtcttcactggaggtactgcagaacag

SEQ ID NO: 57430 - DNA, 105 bp, Glycine max
  Peptide Sequence Number=SeqID_174208
atgccgcagccttcatgtgcttatattgcaagcaggctaggaaaaggaacagattgtacgaaggttaaaggattcaatcttacttctgacgctgatggaggttga

SEQ ID NO: 57431 - DNA, 669 bp, Glycine max
  Peptide Sequence Number=SeqID_174209
ggcgaaggtttcgtattcgtcgatcgaggccgggtgcacgatgggcatctgccagccgatcagcgaggcctcgctggcgtgcgggatggaggaggagacggcggtgtggtcgtcgcccaccaccaccagcacgccgccatggcgcgaggcgccggcggcgttgccgtggtgcagggcatcgccggcgcgatccacgccggggcccttgccgtaccacatggcgaagacgccatcgacgttgcggtcggcgcgcatgccggcctgctgtgtgcccatgacggcggtggcggccatgtcttcgttgatgccgggcaggaacgagatctggttggcgtcgagcgccttctgcgccttccacatcgccatgtcgacgccgcccaggggcgagccgcggtagccggagacgaagccggcggtgttcagcccgcgctcgcgatcgacgcggcgctgggtcagcatgatgcgcaccagggcctgggtgccggtcaggaagatgcggccggtctggcgggtgaggttgtcggcgagctggtagtcgaggtccagcgcgggctcgggggcgggggtgccgtccatcatgaatgctcctgtagtcggcaccatgataggttcgcgaggcatcgggtttattgcgttttcggatcgtgctatccctataattcacaatga

SEQ ID NO: 57432 - DNA, 477 bp, Glycine max
  Peptide Sequence Number=SeqID_174210
atgaagcccgaaatttccttgaagatcaaagaagaggtgaaaaagcagttcgacggtagctttttggcagtggctcggtaccccgaatgggtggccaatattgtgctggtccctaagaaggatgggaaggtacaaatgtgtatggacaatcgggacctaaacagagccagtccaaatgataactttcctttaccacacatcgacgtccttgtagataacacaaccaatttcgctttgttttccttcatggacgggttcttgggttacaatctgataaagatggcatcagaggacatggagaagactatgttcgtcaccttgtggggaacattctgttataaggtgatgtcctttgggctcaagaacaccgaggcaacctatcagcgagctatggtagcattattccacgatatgatgcacaaagagattgaagtctatgtggatgacatgattgccaagtctaggactgaggagtaa

SEQ ID NO: 57433 - DNA, 398 bp, Glycine max
  Peptide Sequence Number=SeqID_174211
gtcccagctgacatggttgttaatgcaaccttagctgcaatggcaaggcatggaatgaaccaaaagccagatatcaatgtgtaccaaattgcttcatctgtagtgaaccctctagtcttccaagacctggcaaggcttctatatgaacactacagttcctcaccatgcattgactcaatgggtaggccaattcaagttccactgatgaagttttttagctccacagaagaattctctggtcacctgtggagagatgctattcagaaaagaggcatcacagctatggcctcctcaaaggcgaagatgtctcagaaacttgaaaacatgtgcagaaaatcagtggagcaagcaaagtacttggccaacatttatgaaccatacacattttatggtggaag

SEQ ID NO: 57434 - DNA, 273 bp, Glycine max
  Peptide Sequence Number=SeqID_174212
cagcaccagatcaagtgagaatctggtttcaagcccatccagaatttttgaaagttgctaatcctgagacttctttattcctcaatcagaagtctcaattagctgctttcctttctagttccaagtcaaaagaaattctggcacaaaatctaaaagaagtcctacagcttctccaacaagaagaagataaaggctcttcctcaaagaaggaagataacaattcttcaaaagaagatgacgaccctttctaccaaaatgaaaatgattgttttg

SEQ ID NO: 57435 - DNA, 378 bp, Glycine max
  Peptide Sequence Number=SeqID_174213
atggggatcctccagaagaggcacatcccctcctactatgaaatgcagcttatggacaagctccaaaggcttagacaagggattatgagtgttaaagagtatagacaacaaatggaactactccttttgagcgttgggcttaaggaggaggaaagaataagtattgcttggttccttagtggacttagtatggaagtgagggacaaggttgagatccttccatatagggacctagatgacctagtccaactttgcataagggtagagcaacaacttaaaaggaagcctacttcaaaatcttgtggctctcactcttggaagaggacacattacttctcaatgccccaccaagaaaaccatgattatgaagtgatgtag

SEQ ID NO: 57436 - DNA, 627 bp, Glycine max
  Peptide Sequence Number=SeqID_174214
atgagactacccaagaaatcacagaaccaaaaatcatcgtcgtcacaccaccgtacaatagcagcgacgtcacaccactttgggattgaggactccttggtttcctctgtgttgtcgccgttgagtgcttctgttgtcggcattgaggacgtctccactgatctttacagcttctgccgtcgaggaagagtcctagggagaggggataatcttgattcagatgatgttccccaacaccaaaggctcacagcatctgcacgtaggcaacgggaagttatcgctgttgctgaggatgctcttcacgtggatgacacagctgaagaggtattccaacatgatgaagaagttattgatgatgccgaaggttttccaggcgggcctcttgacacattagtgttgactacctatgctgatcatgttgttgtcattatttggaatgcagagttatcctcccatggaaggaaggttcagaaattcaggaggtctgctactgagattgaagggttggtcgttgtcacaggattaagttctttgattgcatgttcattggacactggcgatcgggaacttatatccgcttttatcgagaggtggcataaggaaacaagcagtttctatcttcagtag

SEQ ID NO: 57437 - DNA, 357 bp, Glycine max
  Peptide Sequence Number=SeqID_174215
atggatttgcttttgacaatatggttctttaagggacatccccaagaggggtttttggaggaagatgataaggatgctatggagaaacctcctttagaggagcaatgcatgtttaatcgttgtcctagggttaaaattatggagtcggaatttgaagagtggtgtgcaccatggaaaggatccctggttgtccatgttctagggaaatctgtggggtttaagatgttggagtacaagcttcaaaggagctggcctaaggtggggaaattcaggatcgttgatatgccagttgggtattacttagttcagtttacatctgaggagggctataaaaatgccatgtttaatggatcctag

SEQ ID NO: 57438 - DNA, 641 bp, Glycine max
  Peptide Sequence Number=SeqID_174216
tcgcccctgctgtaatcaacaagtacctgggcagaccaactgaaggagtggtggatattgctgtttctgagcatcaaattgccaaggaaatcactgccaagcaagtccagcattggccagagaaagggaagctttctgcagggaagctaagtgtgaagtatgcaatcctgcataggattggcactgccaactgggtacccaccaatcatacttccactgttgccacagaatcttttgctgtcaaattaccaattgccttcccaactgtattgtgtggcattatgttgagtcaacatcccaatattttaaacaacactgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcgttgatgatggagaagcagctgaggaagaagaagatgcagcagaggatacagaatcagatgatgatgattctgatgccaccccatga

SEQ ID NO: 57439 - DNA, 321 bp, Glycine max
  Peptide Sequence Number=SeqID_174217
atggatcaagctggtgaggaaagaaagttgcaactgagtgagttagatgagatccgcctagaagcgtatgagaatgccaagttctacaaagaaaagacccagaagttccatgatagcatgataattaagaaggatttcatggttgggcaaaatgtgttattgtataattctaggcttggactcatgagtgttgagattaaaagtcactccataaacaagagcttcaaggtcaatggacaccgacttaagtcattccttcaaggggatgatacctctagagaccatcaagagaaatatgaccaccttgggaattatcactaa

SEQ ID NO: 57440 - DNA, 300 bp, Glycine max
  Peptide Sequence Number=SeqID_174218
atggccaagaaacggaaccaaccacaagttgttcaagctgcattagatttcaggagcaacccttcctctacatcatctgaggatgcttacaagaatgaagacattggaggatattttgctagaagggtgcttagcatccaagtgaagctaactgttgagactatttctcaagccattagctttgggcgtcaaagaacaaagtccatgaacagttggggagatgaactggaagaccacattgggcactccttgtcgagaccagctgggctaagaccccaaggcgatatggattactactga

SEQ ID NO: 57441 - DNA, 1263 bp, Glycine max
  Peptide Sequence Number=SeqID_174219
atgaagaagagaactaagttgattgttgatatggatggtgaagttcaatatgcagcacctccatctcccacctaccttgatcgctttcgacatcaaggtccacttgcagtagaccccaacctctttgctgaagacattgaagttacatgtcctccgaccacccaccttgattctcaagctgcttctacttccattgaactagatccaccaacaaggatcaaggttcttcctccaccaaagtggaagcgacttcaccctaggtatccaagccttcatttatcatggatcagcacaaaaatgtctataagattccttctggggctgacagagaaaagctatcctcctggtattcacatcaaatgcaccaccaccatcaagttcatgctcaatcacattgctccaaggctaccaccattggatattagaaagaagaaaggcaagatcttgtgtccagccaagatctatcgcttcaacaattggcatatgtgtttcccgaggcaagaagaagacaatgtgttttatcaatgcttaatccatgatgctcctcctcttcaatctcgatttgtctttgacttgcacaagtactttgaagcagcaatgaaaagagcctttgtcactgcttgggtaaggtttcctgcacttaaagagcatccattatctcttgaccagaacccttgggttctaggtcaaggaatggcgactgaacttcaaaggaaacaagacaaactaagttgccaactaatggagatgcagaaaaaggctgatgttgttgaatctctgctgattcaagtcacttcacaacctcaaaccattgttgaagatgcattagcaactatcaacactgccagtacacctcatgagataactcccttgaccacctttgctccaactaccaacctggaagagactatggaaaaaaggttacttgttgaacacatggagaccaatctactgatcaaaaacaccttggaatcatcactcaaatccttcaacaaatttgttccattcaacatgaatatgctcatgcaacaaaggctccattcaccttcccaaccagctccaccaccatcaaccactgttgtgccacctcaacctctgcttcttgaaccaatggttcttgcatctaaggctacaataactgtcgatcctgtgcttgcgcctccgtctccatctctgccttcgtcaccaaaaccaccatcttccattcctcaaataaccaccaccttcgccaccatcttacacaaaaaaatatttgtgggataa

SEQ ID NO: 57442 - DNA, 291 bp, Glycine max
  Peptide Sequence Number=SeqID_174220
atgggcatagatgccgcagttttgatgtgtcttagagatattaggcacaacaaatttgaagattctttaatagagacagtagaaactagcctagggcaaggactagtctatttcaattattatccaaacaaaatgaatcaagagttaagcaaagttttcaagcaaaaattcaagaatcaagtttcaagattcaagaatcaagaatcaagtttcaagaatcaagaatcaagatcaagattcaagactcaagattcaagaatcaaaagaagactcaatcaagataagtattaa

SEQ ID NO: 57443 - DNA, 390 bp, Glycine max
  Peptide Sequence Number=SeqID_174221
atggccaagaaccagtccaggtttatacccaccggttcactggttcattcggaaaaccgaccaggtcacactggttcataccaggttgataacaagttcaatccaatagtctgctcaaaccggtccaatccagtgatgtgggactatgcacacctcacagacagcacaatgaaggtgccacaggatgcagtggaggcagaaattaagggagctgctagaagcatgactgagaagaatcaaggaaattctagaaactgcaacttgcacaacaagagctccaatggatggggagagaggctgatattgccagtggcagatccaggggaacctgtgaggaaggtcatgccttttgctcaatcaatgctgcctctcctttttaattccttttga

SEQ ID NO: 57444 - DNA, 882 bp, Glycine max
  Peptide Sequence Number=SeqID_174222
atgaatagtgcgaaacttctctatgtcactttgtctgggccgggaaaggcattgatttatgaaaacgaagaacatgcggacattgttggttatgcggatttagactgggcaagttctgttagtgaaagaaaatatactgaagtgctggtacgatttgctggttttggacctgaggaagatgagtggattaacattcgaaagcatgttaggccacgctcattgccttgtgaatcatcagaatgtgttgtagtcatccctggtgatctcatactttgttttcaggaaggtaaggagcaagccctatactttgatgcccatgtccttgatgctcaaaggagaaggcatgatgtacgaggctgtcgctgtagatttctagttcgttatgatcatgatcagtcagagcggcataactgcactgttaaaggtcaatcagtagatgcacattatgttgattcaaccagtatgtgttcttgccaggaaattgtgccgcttaggaagatttgtcgccggcccgaaaccgattatcggttacagcaacttcatgctgtgaatgaggcagcacctgtggatcagcagaagactggcatggatccagcagcaaatgttaatgccgtgagggctactactactgaaacagtgccaaagcagctgattgcagcaaacattcatatggagacgacgccagttccagttgtgcaaacaaatgttcctcaacaacctccacaaagtatggatatggatgtggatcaaaagaaagctgaaacaattgctgatgttcaagctggaaattccatcatcaccccaggcagtgttgttactaacatcattactacaagcagtgttcctgaagtctttagtcagactcagaacatggttgaataa

SEQ ID NO: 57445 - DNA, 231 bp, Glycine max
  Peptide Sequence Number=SeqID_174223
atgtatgtagggttttcttcgagccaggacaatgtgggttctgtggggttcgagcgacgacaatatgggttttccggcagtgtaggggggggttctgtgggttcgactgacgacaatgtgggtgtcgagggagcggtttccggcgggaggagaaagagaagagcgatttcaggcaggaggatgacaaagaaaagagggagggcaaggctttcgagcgcgcgcggcttgtga

SEQ ID NO: 57446 - DNA, 1395 bp, Glycine max
  Peptide Sequence Number=SeqID_174224
gttctggctgctgtcatcaaagctggtgcctccagagaacatgaaatacttgctgaaattagagatgctgttttctcatttattcgtaaaatggaaccaaggcgagtaatggataccatgcttgtttcccgtgttagaatcttgcatataagatctttgcttgctagatccacagagttgcaatccattaaggtattgtcagttgagtgctttcttgaaaaggccaacgctggacccagtagaagttctagccgagcaagcagtcctggaagatcttctatgcaatatgttgatgagcagatccagggatttaaagtgagtctaaagccagaaaagaaatccaaattttcatctgttgtgttgaagatacgtgggattgatgaggaaacctggagacagcaagtaactgggggaaagcttagggaaattagtgaggaagcaaaaaattttgcaattggaaacaaggctcttgctgcactatttgtacataccccagcaggagagctgcagcgccaaattagatcctggcttgcagagaagtttgattttctatctgttatgggaaatgatgcaccaggggggacaactggtcagttggagcttatttcaactgcaattatggatggttggatggctggacttggcagtgctctgcctccccaaactgatgcccttggccaacttttatttgaatattcaaaacgtgtctatacttctcaactgcagcacttaaaggatattgttggtaccttggcaacagaagaagctgaagatgcagcacaagttgcgaagttgcgttcagctctagaatctgttgatcacaaaagaagaaagattttacaacaaatgagaagtgatgtagctttgctgacattggaaaatggtagttcgcctgttcaaaatccttctactgctgccgaggatgcacgattagcatctctcgtttcacttgatagaatattgaagcaagtcaaggatataactcgactttctactgtgaacaccatccagaaaagtaagaaaggaacagtgctcggttctcttgataaactgacagaacaaatgccttcacttcttgaaattgatcatccatgtgctcagaggtacattgcagatgcccgcagaaaagttgagtcaattcctgaagaagatgaccgcattcaaaatctatcacattctcgcaagccatcaacggatacaggctctggatctggaactgatgtggcacagtggaacgtccttcaattcaatacgggtaatacctcaccatttataattaaatgtggagcaaactcaaattcagaactaatcattaaagccgaggctcgagttaaggaacctaaaggcggcgagattgtgagggttgccccaaggccgtccattttgcaaatatga

SEQ ID NO: 57447 - DNA, 792 bp, Glycine max
  Peptide Sequence Number=SeqID_174225
atgtcttcaatttcatgcacgaagctgacactgttcagcttagcagcggttgcgattcagttcatcggtctctccatcttcgttttcggcttcttccccgtcaaaccacttctctccggttacagtggctgcgagagtttccgacgaccaacctgcgataacgatggcgctgcaaatcagagctacgcgtctctctctccagatcgccgcaggtttttatatcaggaaggatccgagattcctcctttgtatgatcgacttgtcttaatggttattgatggtcttccagcggaatttgtgcttggcaagaagggtcagcctcctagcaaggcttttatggaagctatgccatatacacagtcattattggcaagtggtatggctgttggatatcatgcaattgctgctgctccaaccgttacaatgcctcgattgaaggctatggtttctggagcaattgggggtttcctggatgtggctttcaactttaacaccctggcttatttagatgacaatcttgttgcacagttctttaaaattgggtggaaaatggttatgcatggtgatgatacatggctcaggttatttcctggtttatttgcaagacatgatggagttagcagtttttttgttaaagacaccgtacaagtagatcaaaatgtgtctcgacatcttggtgatgaacttagcagagatgattggaattttctggtagcggtaaagttgtgccttggtgacttgttggtcatgggttcgaatccggaaacagcctctttgcatatgcaagggtaa

SEQ ID NO: 57448 - DNA, 1851 bp, Glycine max
  Peptide Sequence Number=SeqID_174226
atgaagcacgtcaattgtgagtactttacattcctgggaatgtttttatcaaacttgtacccaacatgggaatgtgatattcccaagtccacattcccgggaatcttgctcgataccttgaaacaaagcctcccaagtaatatattgattcagatcaattcacaacaccttgagctattgctctatattctacctctgccttgcaacaagtggttctttttttctggcagatcactcaagagttcctctattgttgtagtcagtgaccatggaatgactgagaatggtaatcatgggggttcatcctacgaggaaacagactctatagctctatttattgggccaaaaacccatgcctctggccattcatcatccaatcatgacacaatttttcaggttagatctctttttgtctatgcttgtctattgatcaaaagaatgaagcagatagatgaccaaaagttgagggcactgcagttgaactcatggcagttgttcagattacttcaagcacaattgcctggtttgtcctgtagaaattttccatgtgatgccttcgttactaatagtggacccacaatcagtgaatgcaaaggtagcaaggagaagttgttttgttgtttgtatttaaatgctgctactcttcatgatgcctggaaggctaaagtagtcaccaggtctaatagcacggaaggttataacagcattgttgcagcatataatgagtttctgagctctgcaagtgagtggctatcacacaaagcaactgacaaaccaattaatttacttgttcttggagttgctgctttggttgtatcatgcttgatacttttgggagttgtgtttgtcatccacaaagaagttcctgcttgggagacacaagaccatgacaattatgtgaagccatggaaaattgatgaggtgttcattttgtttggcatcctgatccttgtcatcagtatgggatcaagttccatgattgaggaagagcattatatttggcatttcctaacatccaccattaacttgttattttttcgtaaagcaatacagtctttggaatttaataaagcacatgattttctcaattcaatcaaggaacaaaagaatacatcagtatcccaaataagttccttgttccttattcttttttctggaagaattttgagaggctggcatcaaggtggtgtaaattggactaaccttcctgacatttcgaagtggcttgagcaggctggcaaccaatatataaacttgattcagatagcatcatgtgccatggtcatcataatgggaatatctgtattgttcttaatgcagtctaaaacaaaagtgttaacagggattgggctcagtttgttaatgtctggtttgtttgtattacaacattttatgaaacatccggacatgtctgcctcatacaataaggatgccaacttatcagtacaaatactctttgccgttctgggaatcaccactattgcagttgtattggttttgccatggattatgcctatgcaaactcccgacatatgctcaaggaaaaacttctacatgtctgcttctgttcctgttgaaattcagaactcgacaccaattttggtattgaaagattccttgtacatagttggatgcttgtacattacttcctggtgtcttctgcagttgttgcttcaacaatccatcaatgcggtgcctgtgttgttactctttattcaattcttggccagcatgcttactttttcttccaatgggtcatgtcataagcagtgggttgagcacattggttttgggtccaagagtgtggtgctaactctaaaagtgattgccctggaatctaaccaagggtaa

SEQ ID NO: 57449 - DNA, 498 bp, Glycine max
  Peptide Sequence Number=SeqID_174227
atggtgctgtatgtctctgtcaaggccacaatctatccactagttatcaagaaaggaaattctggagaaattctcaagacccttcttggatttccttgcttagtaccgctgaccataaattctgttctcatgactgtgtacacgatcatcttgctgttgatgaggaatcatttatttatttggagtgttttttctcccaagtacctttatgtttgtgctgcaactgcatgtgtctatgtcgggatctgcattgtagttgttactgtgatccatacatacattgtgcttttttggctgagaaagagtttctccataagtggcaaggcaaaagaatatagtttaaggccaagaaggaaaaatgtagcctatgcatattcaaatgatactgaaagtgattcaaacagtcatgaccaagattattcaagatttaggcctagaaaaccaactaaaagaaggaatgcaatctgtagaatgaagtacaaggagccaccattctaa

SEQ ID NO: 57450 - DNA, 660 bp, Glycine max
  Peptide Sequence Number=SeqID_174228
atggctttcattcgacagttagtacagggcatgcaacatgttcgaaattactataactcagatgctcaaatgataagaggtggcttccatcagacattcatatctaggacatacaaaaccagtttcttgaagccgagatcaaaggtagagatcaaactattggctgctaagaaacacagtgaagcagaaaagagacgtagaatgagaatcaatggtcaatatgaaaccctccgaaatatcctccccaacataatcaaaaaggacaaggcatcagtattggcagagactatcaagcaagtgaaggagttgaagaaaaaagtatcaaaactggaacaagatagttctagtaatccatcaaaggatgttgttaagtttcctaatggaacagataagttgaatttggaaagatgtaacaacgacgagggcatagtgaaggccacgctgagttgtgaggatagactaggattgatgtcatcaatatctggggcactagagcaagtgaaagccaaagtggtaaaggctgagatagtgagtgtgggagggagagccagaagtgtgttgtgggtgcaaggtcttggaaatgatggtacggggacgctcaagagcaaattgagggttgcaatgcaaaagccacccaagatgcagcgttttactcagtaa

SEQ ID NO: 57451 - DNA, 186 bp, Glycine max
  Peptide Sequence Number=SeqID_174229
atggctccaaaactttttgaaatggatgaagtggtgaagatgattcatataaatactttgcgaaatctagaaaatgatcaaaggaagacacttctgagtatgaagaaagttatttcatcaatgtattatttcgtgagagcagagatacattatatagaagaaaatgaaaaaggaaagaataaatag

SEQ ID NO: 57452 - DNA, 834 bp, Glycine max
  Peptide Sequence Number=SeqID_174230
atggatccgctcagaggatccgaacccgaaaaccctattgccacgtgtctctccatgctgtccctccgccgcttctccgcgtgccgcgacttcgcccgccgcctccccccctccgactccgtcccccgcgtcctagccgtcgccgacgtcctctccgccgccgacttctactccgtcctacagctccgcccctccgacggtggcaaccgcgacctcgcgcggcggcagtacgcgaagctcgcgctcctcctcgacccaacgaaccccgacaagctcccgttctccgacgaggccctcgcacgtgtccagaatgcctggcacgtgctctcccaccccgaacgccgcgccctccacgaccgcgagcaaaacgcaaacctaaacccgaaccctatgacggcgtcgttttggaccgcgtgcccctactgctggggcctcttcgagtacgagaagaggtacgaggatagagcgctgctgtgccacgtctgcgggaaggccttccagggcgtgccggtgaagccgccaacgaagacgggcgacgccgtcatggagggggaggagctccggcagtactactcttgtgaagctagtgtgccattgatgtgttacgaggttatgggtaacaatgtattgggtggacaaaatgctgcacaatatgtctacatttctgatgataatgataataatgatggagggtttgtgagaaatgaaggtttgcaaggcagcggtgagaagaggaggatgagggtgaagaccgtggcgaacaaggaagatggggaattggagttcactgaaggagatgatgatgtctttgttggtgtgaagtttgacaagtga

SEQ ID NO: 57453 - DNA, 1306 bp, Glycine max
  Peptide Sequence Number=SeqID_174231
atggagctcaaagatgaaaatctttctagcagggcatcggtgtccaaaacagagtctggtcttcatgaaattaatggaacacatgctggtatttcatcttccaatgattcgtattccagccttgatcctttggttgctgcaagaaaatcttttgatgataaccatcgcagcagatttgcaaaacctgtctgcaatgatactactgatgatacaagtgttgcttcccctcataacaaacaaacagttaacatgaaatgttctgagaatattgaagttaaggattcaagtgcaagtaaaagaagcaagtcaaatcatagtaacgctactgatgagactcgatttaaatcaaaatttcccaaaactcaatctgacacatctcatgatgaggcagcaaatttgggtagccatgaacgcagaagaaaagctgcaatagttgaaaaattagcaaaagatacttctaaatgcaaaactgtgccttacttgagtggttcaagtaagtatgttgtaattgatgatgtagaagaagaatctcatttgcccaaatacagagaagcacgaagatcatcatctagttctcgtgaacgactatcctcagctactaagggggattttccttcacagtccaagtgtatggaaactgacaattgtcataccttacccgcaaaagttagtgctgttccaaatctgcctcaaaatgtttgtagtggtctgaaaatatcaatgcagaaagttgtccagcagtttagaagctcaaaagagtcaagatccaattcaatatctgctgaaaatgaggcaaaagaagggatttctccactttcaccaattgggatattatctaagatacacaagattggaagccatcttgggcgtgggaaggaagaagacgctcatgaatttttgaggtgcgcggttgatacaatgcaatctgtttgtctcaaggaagttggtgtttcaagtcctttggcagaagaaacaactctagttggttacacctttggaggttatttacgatctaagataaagtgcttaagatgcctggggaaatctgagaggtacgagagaatgatggatcttactgttgaaattgatggggatattggaactttggaggaggctcttggacaatttacagcacctgaaatcttggataaagataacaagtataactgcagcagactgagtgcagaaccagatgtgttctcgcagtttgcaatttgtacagccaaaggtcagtgccaggtggtagcagcggtgcagggtggaggtggggtggttgcggatggtaccagaagcgagaagtttgagg

SEQ ID NO: 57454 - DNA, 123 bp, Glycine max
  Peptide Sequence Number=SeqID_174232
atggcgaccttcatcggcatccatggcgaccttgtagcggttccgacgaacctcggtcctggcgttggcagaaggtcgatactacttcgtgttggatttggattcaggcaaaagccttcgtag

SEQ ID NO: 57455 - DNA, 192 bp, Glycine max
  Peptide Sequence Number=SeqID_174233
atgctgaaactgatcctgatgcaaagcttgtgttgtcttgtgagaggggtcagaaagactttgaattcagagttatggcatgcttgtgcagggcctcttgtgtcattacctcaggttgggagccttgtgttttacttccctcagggacatagtgagcacgtgaatgaatctcttgttctctttccaaagtaa

SEQ ID NO: 57456 - DNA, 354 bp, Glycine max
  Peptide Sequence Number=SeqID_174234
atggtggagatccaaaagaaccgtagggaagagagtttgcagaagaagagatgcgagggtctccaatcgcaacagattctttcgtcacttcactctactgtaattgagaagaagatcaattcctatcatctttcagtaatttatttaacacagttactcttgtctcagtctgcgcagaatccgaatgttttaatttgcacacccaactttactattggctcaagtaggagttgcaattttgtgttgaaggatcagactataagtgcaaatttgtgcaagatcaagcacacgcaggttttgagccgttgtggggtggagtgtgaaggactcgagaccttgtgcattaaggattag

SEQ ID NO: 57457 - DNA, 614 bp, Glycine max
  Peptide Sequence Number=SeqID_174235
atggctttgctactagagggacgtgggaggagtttgttgttgaaagcacaagttggttttgtggtcttaacgcttacatctctttggtcgtatctggaagaccgtagtgaagaagggaaagtggaaaacagctatgggaaaatgacgaacgtgacttccactgatggcagtgagcttgtcgccacaactccaacttggattcaaaaaaatgtagatttagaagcaaattctcatgtctttgcacctggtgatactggtaatgaaagagagaatgtagatttagaagctaattctggtgtcttagaaggtgacactaatgatgaaagagaaagtttaatcaagaaggaatcagggaaatccaaaagagcagcagatagtatcagatcactcacaatggtatcttctgaagctatggatcacggtggtggccaaatcttccatgcagggccatctgtagaagcatcaaggataaccacctcttctagatatgagccttctatgagcaatgccagtttcatggagacagagtggacagagctagatgaacctggagtgcaccttgcaatcaggcaattagctgatggaacaagggagcttcgccgtatcagattcaa

SEQ ID NO: 57458 - DNA, 231 bp, Glycine max
  Peptide Sequence Number=SeqID_174236
atgagaaatgccagtgacatggagacagagtggacagagcatgacgaacctggagtgtaccttacaaataggcaattagctgatggaacaagggatcttctccgtgtcagaatcagtttatcaactctgtctgcaaccggaagggatttggggagggaggggcaaagaaatggtggaaagagaaccgagaaagaatacaagttcaatatctttgaagtcttgtggccttga

SEQ ID NO: 57459 - DNA, 507 bp, Glycine max
  Peptide Sequence Number=SeqID_174237
atgaccgaccctctcgatgagtcgatctcttgctttctcataaaggtggacccttgggtactagtacctatcacctttagaggaccatatgtcctcgccatcagaggactgcacgccctcgcctttagagggctacgtgtcctcattttcagtgtgctccatatccacaccttagaagaatataagcaacattctgcccagcgaccacaatgccaatctccccctgcagatgtatcagttgggatcgcgcccacaagacgcccaatggacccgaagatgtccaacaaggccctggggtttccagttttggttacgggcctctgtcagtcctacagggtgcccgttcccccagcgaggtcatgccatcgtgacatagggatcgcgcccacaaagacacccagtggacccggagaagtccaacagggccctagggtttccagctctggttacgggcctctgttgtcctacagggtgcctgttccccccgacaaggtcacgtcatcatga

SEQ ID NO: 57460 - DNA, 177 bp, Glycine max
  Peptide Sequence Number=SeqID_174238
atggaggtcggctttgtttatttgtgcgagctcaaccgaagttgtgtttcggccgacactggcattcgatgtcggccaggaaagatgaccattccaggtctaaaacagaataatcaccggatgacgtcgatcgaacatttcctaatagacatcgtccaaatatcatcgggggattga

SEQ ID NO: 57461 - DNA, 386 bp, Glycine max
  Peptide Sequence Number=SeqID_174239
atgccctgcaccaagaaatctagtcaaatgacgtctgaggcagcaaaggattgcctcacagggaagcttgtcacctatggacatcaggatgtactgattgcggccattgggcgactagaacaccctggtcatatccgtgctgacctcccacacatcttcgtccatggctcccgaagacctggagtagttgacgcaaaaaatcagggaccaggactcgcactacctactgagcctgaggttggtcttttcactacacgtgtcaggacaaaggagagttgtattgatccctcagggaacgaccttgacacggtcaaggttggtgatgaggaagttcgagatgtagatgtttgcattcctgtacccactcaagaggttcagttagtggg

SEQ ID NO: 57462 - DNA, 294 bp, Glycine max
  Peptide Sequence Number=SeqID_174240
atggtgaagttgatgtgtgggagtcacaatcatgaattggccaagtcattagttgaacatccatacacttgtcgattgactaaggatgagaagacaattattgctaatatgacaaagtcaatggtgaaaccaagaaacattttgttaacgttgaaggagcacaatgccaatagttgtagaacaatcaaacaaatatataatgcaagaagtgcatactcttcttccattaaaggtagtgatactgaaatgcaacatctaatgaagcttcttgaacgagatcagtatattcattga

SEQ ID NO: 57463 - DNA, 483 bp, Glycine max
  Peptide Sequence Number=SeqID_174241
atgactactcttacatggttatggatgacgttgctatttagcaacattctgcccagcctatacaatgccaatctccccctacagatggatcagttgggatcacgcccacaagacacccagtggacccgaagaagtccaacagggccctggggtttccagctctggttacgggcctctgtcagtcctatagggtgcccgttccccccagcaaggtcatgccatcgtgacataggaatcgcacccacaaagacatccagtggacccggagaagtccaacaaggccctgggggatcgcgcccgcaagacacccagtggacccgaagaagtccaacagggtcttggagttgccaagctctaattacggacctctctcagttctacggagtgcctgtcgcccccagcaaggtcatcaggccccctactaatcgagctttcatcaagaagtactgcgtccccaggcaggcgcagggcgaaacaccatag

SEQ ID NO: 57464 - DNA, 396 bp, Glycine max
  Peptide Sequence Number=SeqID_174242
atgatcaaggacgactgcgctgacagtggcatccctctactgaacgtgacgaggaagatcctaacaaaggaggagaacttcaacaccatcgttgtcgtcgtcgttgccatggagctcatagctgccaccatgactctcacaaagaaactctcaaattgtgatggctacaacatctcaagaagatctgcgtacaacgacatttttgccactccaatcaagctctgcgctccgagcttctccttcagttcgacaattaccacaagattttttgcaccatcgttggagcctcgattcagatcctcaaacttgtatagctcaatgatagaagaaacaaaaatgacgttcggagctccaagttcaatttctcgaatgcctttaacgggttcaaaaatctag

SEQ ID NO: 57465 - DNA, 330 bp, Glycine max
  Peptide Sequence Number=SeqID_174243
atgttcctttatggggcggaagacaaagtgttgcaactgcaaactgaattgaggatgatgaggtcttacttgcaagttgcagatagaaagcaagatgcgcttacctctttgtggtttttctgggaagaccgttgcgaactagggaaagtggaaaacaggttccggaaaatgatgaacctcgcttcaattggagcatttgccttgatggccttgagtttgttgcggcaacttcaaattggattcgatgttggcgtcactaacttcttggttggatgcttcttggtgacgttgatgaagatgaaccttaagttagctccacttgcggcatag

SEQ ID NO: 57466 - DNA, 1158 bp, Glycine max
  Peptide Sequence Number=SeqID_174244
atgatcagccctctcaatgagtcaatctcatgctttctcataagggtggacccttgggtactagaacctattgccgttagaggactacacatcctcgccttcagagggctacacgccctcaccatcaaaggactacacgtcctcgccatcagagggctgcacgccctcaccatcagagggctacacatcctcaccatcagagggctgcacgcactcacctttagaggactacacgtcctcacctttagaggactgtgcatcctcaccttcagagggttacacaccctcaccttcagaggactacacgtcctcgccttcagagggctgcacgtcctcaccttgggtactcgtaccctcaccttcaaagggttgcacgccctcacctttaaaggactacgcgtcctcaccttcagagggctgcacgccctcgcctttagagaacttcatgtcctcaccttcagagggctacatgtcctcgccttcagaggactacacgtccttgccatcagagggctgcacgccctcaccttccgaggacaacacgtcctcacctttagaggactacacatcctcgccttcagaggactaaacgtcctcgccttcagagggctacacgccttcgccttcgtaaggctacacgccctcaccttcagtggactacacgtcctcgtcttcagaggactacacgtcctcgccatcagaggactacaagtcctcgccatcaaaggactacatgtcctcagcttcagaggactacacgtcctcaccttcagagtgccacacgccctcaacttcagaggattacatgtcctcgccatcagaggattacatgtcctcagcttcagaggactacacgtcctcaccttcagagggccacacgccctcaccttcagaggaccacacgtcttcgccttcagaagactacatgttctcgccttcagagggctgcacgcccttgccttcgtagggctacacgccctcaccttcagaggactgcatgtcctcgcctttagagggctgcacgcccttgccttcagagggcgacacgtcctcaacttcagagggttgcacgctctcgcctttagagggctacgcatcctcactttcagtgggctccatatccacaccttaagagaatttaaggtctactgcccttaa

SEQ ID NO: 57467 - DNA, 159 bp, Glycine max
  Peptide Sequence Number=SeqID_174245
atggatgaggcaagttcgtcaaaccttgaagcaaatttagatgtattaattgaacatgaggcaaattctaatgtccctggacgtgatagagatgagtcaagttcttcggagcctgaagtcttaaaagatgggaaaagcattaccctgccccaatcctag

SEQ ID NO: 57468 - DNA, 326 bp, Glycine max
  Peptide Sequence Number=SeqID_174246
aatatgcaaatttcctacaccttgaagcaaattctgatatctttgcagatgataaggatggggaaagattaccagaccttcaaggccatgagacaaattctgatgtctctgaacgtgatacaaatgaggtagacattcaagaaacttctaatgtccttgcctgtggtacagacgagctaagttctcaagaccctgatcaaacaaattctggtgttctggaacatgagaaagacgtggtacctttgcaacatggtgaagcagaaaggtttagttctagtgagaatgatattcagaatacagagaaatcgattaagaagatgctctga

SEQ ID NO: 57469 - DNA, 1105 bp, Glycine max
  Peptide Sequence Number=SeqID_174247
aaactttgataagaagaatgtcccagaatttcttctcgtttatggtcaagaagagaccttcgaggcattttccaagttaactgtgtccccacacggagaaaacctgcctttccgcaagcgagggtatcctctgtttggcaaactgttaattcttttaaatcctcctcctaatttcttctcgtttatggtcaagaagagaccttcgaggcattttccaagctttgtctcaagcatagttggattcagctgttatgccctcagtccctctttccacaacatgttcggacactggaacgcgctgaagatcttcgtgtacactgtcgtaagctcacttttatctatcttcatgttcttcattaaaagatgtagctggggacatgggaggagtttcttgttgaaagcacaagtgggttttgtggtcttaacgctcacctctctgtggtctgttttcgaagaccgtagtgaagaagggaaggtggaaaatgcgcacggcaaaatgatgaacctcacttccagtggcgcatttgcattgatggctatgagcttgtcgcggcaactccaacttggattcgaagttggtgtgtttaacttcttggttggatgtttcttggtcacagtgatgaagatgagcttcaagttagctccagttgccgcattgttctgctatttgctcgtcaacattcgttccatttctgatttcatacttgaaatgcatgcacgtggtgccacacaagaagcagatggcagtaataccggaactgtctacatacgtaggagaagttccgaggatggttttgactactatggatatgatacagaagaaatagaagaccgcatgacagatgccatgtttgaaagtttaaattatgatacagattactatgatgtagagaagttgttcgtgttggtggaaggatatgactttgttaaaaatgcttattgcgtatctgaatgggcagcaacaagacctgcaagatatggtggaaaagattatgattttgtcgtggcaatggttgtctacaaaaggtgtcatttcatattcattagcttgttgacgctcaataagtttcaagatgggaaggtattcagcggttatgacttatga

SEQ ID NO: 57470 - DNA, 195 bp, Glycine max
  Peptide Sequence Number=SeqID_174248
atgttgatcgtgtttttgatgcagcccgctatcgtgcttggagctggtgcaagacactcacgtgtggatctatgtatctcggaaggggcaccgagtgtgctttctggattggtcacaaagtatgttgtgctcggtttgtgtcatatgctcctgtactcctgtacgaaggctgttttaggcggtggttgttgttga

SEQ ID NO: 57471 - DNA, 923 bp, Glycine max
  Peptide Sequence Number=SeqID_174249
atggaaaaggtgaaaaaggttggaaggagtgaggataataatatgccaactgtgtggttctctttgaagagatctctacattgcaaatcagagccatcagatgttcatgaccccaaaacaaggaagcagttggccacaatcttgaccaaaaagggaggttcaagtaggtcaggttgttcaaggtccatagccaatcttaaagatgtaatccatgggagcaagaggcatctagagaagccaccaagttgcagcccaagatccattggtagcagtgagtttctcaacccaataacccatgaggtgatcctaagcaactcaaggtgtgagctgaaaatcactggctatggagggttccaagaaggaggggttggaagtgatggtggaggaggtgccaataatcgaagtgccacaagtggtgacttgagtacctttgtgggcactttaaggcctggcactcctggccctggagggcaccctacaatgcactactttaatccttcttttaggactacttccactcctcctaggaaatctcctttccattcatcggataaagaagggtcaggtttgcatggtgttggagtacttggacttcattctagcacaagggtacctcttgagactgattcaaatgtgtcttccactgtcacttgccacaaatgtggagatcaattcaacaaatgggaagctgctgaagctcatcatctctccaagcatgctgttactgaacttgtggaaggagattcatcaaggaaaatagtggagataatatgcaggacgagctggttgaagtctgagaaacaatgtggtagaattgagagagttttgaaagtgcataacatgcaaaagactctggctaggtttgaggagtatagggagttggtgaaaatcaaggctagtaaactccccaagaagcatccaag

SEQ ID NO: 57472 - DNA, 615 bp, Glycine max
  Peptide Sequence Number=SeqID_174250
gctatcgacaaagaagcttcttgcaggcaagtttttttcccttttgctattgtgcatgtttgttccggtacttcatgtcagggtaagtcaacagagaagcaatgtcccattgtaatgaggcttaaacgatgggagcggaaggagtgtaaaccaaacagtcttcctatcttgcacaaaatgcatgttaaacttggagatacggtgcaagtcatatctggacgagaaaggggtaaagttggggagattactaaaatcttcaagcataacagcactgttatagtgaaagatttaaatttgaagacaaagcatgtgaagagtagagaagagggtgaaccggggcaaattattaagaatggagttataagattgactcggtggttaaaggaagaagggagaggggaaggttgtattgaaggtcctatccacagctcaaatgtgatgctctactccaaagatcagaaggtagcaagtcgtgtggggcataaagtcctagataatggtaaaaaagtccgctaccttataaaaactggagaaataattgatagttcagagaactggaagaaactgaaggaggctactaagaaatctgaagaagctgctgctgctgctgcctag

SEQ ID NO: 57473 - DNA, 213 bp, Glycine max
  Peptide Sequence Number=SeqID_174251
atggcaggacaaacaggctttgattcattggctgggaaagttggtctttattcaaatattgaggagctttatttgctcaattctagaggtcttcttccttgttttgtggtgaaatcagagagcctgtgtgactttagccttaacagattaatggacatagaccgtcccataaactgtgacagccctgctagtaccttgagcaaatattgttaa

SEQ ID NO: 57474 - DNA, 1014 bp, Glycine max
  Peptide Sequence Number=SeqID_174252
atgtcacccgatgacacaccacctccaaagcctgccacagcaaaagaccaagagactcaaagttccggtggtggcagaaaaagctcctccacaaggccccaagagcaaggtctcaagtgtccacgatgtgactcacctaacaccaaattctgctactacaacaactacagcctcacacagccaaggcatttctgcaagacatgtagaagatactggacaaaaggtggggctttgcgcaacgtccctattggcggtggttgtagaaagaacaagaaggtgaagtcatcaaggctctcatgtgactccaaagactctggttcctcctcttcagaacttggtggcctcaaattccttcattctctttctccttccatggactttcaccttggagggttacccttccctaggcttcaccatcatcaccctccaaccccttacaaccacttttcctcttttggagacacttctagtgcttcttcatgtttcaaccttgatccttctcctggcaccaccccatcaagttcttttgctgctctcaataattaccctttttcttacaatggtgcaatccaaggtatgagctctttgaatgttcatagtggccttgcctcttccattgagtctttgagttctataaaccaggacttgcactggaagctgcagcagcagcgattggcaatgctctttggtggagacaacaacaaccagaaagatcatagtggtgttaaccagattgagaacctggcacagaaaccacaacccattatgtttcagaaccttgagatttcaaagccagggactttcccagttgggaactccagaaaagaacaaggttcaagtggggacacacacacgccttcaaccgagtggttctttgggaattcttatgcctcagtgactcctacacctacaactagtagtggtggcccagggaatgataatgcgagcaattggagtagcggtggtgtccatgcttggggtgatgtgccgcagcaatatagtgctttgccctag

SEQ ID NO: 57475 - DNA, 203 bp, Glycine max
  Peptide Sequence Number=SeqID_174253
aattcactaagcgcaatagtcagtggctaagcgcgaggaagaatctagaagaagatgagctatcatgttcgctaagcgcactgctccagatctgcgctaagtgcacaagcacgaacaaggccacctatttaagcctgaaatcagatttgcaaggggagtttggcacttttcttgagaagctctgcatgcacgaaggttcttga

SEQ ID NO: 57476 - DNA, 1168 bp, Glycine max
  Peptide Sequence Number=SeqID_174254
gaactctaaactgacacatttacttcaagactcactaggaggtgactccaaaactttgatgtttgtacaaataagtccatcagaccaggacgtaggtgagacactgagctcacttaattttgcaactagagtgaggggtgttgagttaggtcctgttaagaagcaaattgatacaagtgaagttcaaaagatgaaagcaatgcttgaaaaagcacggagtgagtgcagaattaaagatgaatctatgcgaaaacttgaagaaaatttgcaaagcttggagagtaaggccaaaggcaaggatcaaatttacaaaaatctacaagaaaagattcaagaacttgagggacagattgagttgaaaagagccatgcaaaatgactcagagaaaaaaatctctcaattatctgccaaattgagagggaaagaagaaacctgcggtactcttcaacaaaaggtgaaagagctagagaaaaagatgaaagaacaactgcagtcagagtcagcaagttttcaacagaaggtttgggatctagagaaaaaactggaagatcagatgcaagggtctgagtctgaatctgccattttgaaagataagatcaaggagcttgagagaaaactgaaagagcaggaacaaagctcaatgtccttgcttcgtcaacagatgaaggaactggaggacaggtaccgagagcgagagcaacagtggcaacaaactcattcttttgtggatgcagtaaaagcagccacaccagatgtatgtaaaagctgcatgagggaagaatgtccaagtgagattgagactggcattttaaggtgttcagactcggtaaaccgccagataagtcaaggttcttctttgttcaaagggaatgattccactcataagataagccaaggttctttgttcaaagagaatgattccactcataagataagaagcaaaagaagcaatgatgaaaacaactttgtcatgccatcatcattattacatgatagaagagtcgcaaggaaatctgatccaccaaaaatagtaaggggtgtgaggccaacaccaaggccagtcactgctaatccagccccagtgtctcacaagagaggtagcacaagcagagatcaggttcaaggaatcaaagagagggacactaagacgaaaattcggtcaagatag

SEQ ID NO: 57477 - DNA, 693 bp, Glycine max
  Peptide Sequence Number=SeqID_174255
atggtgttatcaataccattgttggcagatttgcagggagcaccacacatcaaaaaatcacttcctccaataacattcacagatgaagaatttacgggagttgacttagagcaggatgaaccaatggttattgcaattggaattgctagtttaagacaattccatactcgtggtgttatagaacttgagactacctttagagttgggaaattgtctaagcgctcgtccaatatgtctttagtgatgcaaacacatcctacaacatacttattggattaccttcccaatgctttgggaggcaatgtttccatcccacatcttgtcatgaaatttcccaactccgaagctcccattaaagggcaattcttggttgatttcatagttgagctccctcctagtgaaggtcacaacgaaggttggaggacattatatgttgatggagcttcaaataggcaaggtagtggtgctggagctttgaacaatcaagctgaatacaaaacccttatcgcaagtttgaagttaccaagagaggttggtgtcaaaaaattaaagtgcaaaagcaactcaaagtgcatcaccaatgatgcaatcctccctaggaagggaccactcaccagagccatgaacaagaggctccaagaggatcaagctagagctgttgaagaaggccttagggttctcatgaaccttagg

SEQ ID NO: 57478 - DNA, 129 bp, Glycine max
  Peptide Sequence Number=SeqID_174256
atgtcaaatgtaggaggtggagatgcaaggctgatatttgaagccaattcaagtgtcctttcggtgaaggacgcgccatgcagactgtcttcacccacgcatgttgttttccaaggcgatttgacttga

SEQ ID NO: 57479 - DNA, 168 bp, Glycine max
  Peptide Sequence Number=SeqID_174257
atgaaggaaggttcatcaagccaattcctcacggtcactatttcactcaagcacaagtgtttagtcacaaacatgcaaattgaatccgaaggacttttcttggcttgtaatgaggctgggctacaaacaattcatggtttttctaggatgcaaaagcttaagttctag

SEQ ID NO: 57480 - DNA, 405 bp, Glycine max
  Peptide Sequence Number=SeqID_174258
atgtggttgcagtcacggaagcgcaggccagtttgcgacaaagacgaactcatgcagaaggagaaagaagaagaacgccctaggagtcttaaggccaaccacaatggacttccaaaatcgattcccaccctttccgggactctttcctttcctacttttcttcgagctgcaaaagacgtacctcaatcgataagtggcagagacgaactccacaaagacgaactccacaatgtggttgtagtcatggaagcgcagaccagtttgcgacaaagacgaactcaggcagaaggagaaagaagaagaacgatagggttcaagcacgcggggttgtgcaatttcagatttttagtatataatgataacaacatcgatttttcaaaaataaccgatgttaacatcaactag

SEQ ID NO: 57481 - DNA, 210 bp, Glycine max
  Peptide Sequence Number=SeqID_174259
atgaccccagcgagtggtgcgggtgcatttgaagcagcacacacccttgaattcctgcttccaccaacacccttagaaagacccaaaaagaagaagaaaaaaatgaacttttttggaacatcacctccacccacaacgagcgagagagaaaagcttaaactttggagcaagaaagggccatttgggaagaacaacgaaatggagagatag

SEQ ID NO: 57482 - DNA, 246 bp, Glycine max
  Peptide Sequence Number=SeqID_174260
atgacaatcaattcatggggctctggacttgatggtggaggacgcacgaacagcgctaggcaatcaattcgtcgggctccagactcgatggcaatcaattcgtggcgctctgaactcgatggtggaggatgcatgaatgacaatcaattcatggggctccggataagatttgttggaggaggatgcacgaacagcgctaggcaatcaattcgtggggctccagactcgatggtggaggatgcatga

SEQ ID NO: 57483 - DNA, 186 bp, Glycine max
  Peptide Sequence Number=SeqID_174261
atgaaagaagaagaagaagaagaaagaagaggaaacgaagctgaggcgctgccgaatcgtgactgtgatcaatgtctacattgttcattgtccggtgttcttcgtgcgactgtcggggtcccccttgttattatgtgcacattcatcttctccatctatcatcggcgatctcatttttctttataa

SEQ ID NO: 57484 - DNA, 1737 bp, Glycine max
  Peptide Sequence Number=SeqID_174262
atgcatgcacctatcaatcatattgatgatacttatgccacttggcacttacacttacacacagagtttgtaccttccaatgacacacagaaggaggagacaccagagatggttgctgaagaggcaattagtgctgatgataaagacacagaaactttggcccaagagaaaactgaagtatctgctgcaccacctgcattgcaagagaaaaatggccacgggagttcgagttcgaggtccccaagtccacctccatcaaaagggaattcccaagctacaactggtgaaacattcaagactcctgtgagtggcacacgtgacaaggctcagccaaatttgaatcatcagaatgctccaaacaccagtgagaaagttaaaccaaaggagaacaccattccggtgtcagaatgcatgactaatgaaaacaagggtggtttgcatccaagtttcagggagatcagaaaatccttggctagggagctcataatcttgcaagaaaggcttgattctataatagccaagaaacgtcagcagcagatgccggatgctgatgttcaggaacacgttgaaatcactctaatgaacatgcagagtgaagaacatgtgcaaaagcagcaagaagaaaaggttgctgtaccagaagattcagctgaaggcactagggatgatgtaaaaggtccttgtgctaatgatggtggaagtgaatctcagtcaccagttgatcctccatcaaatgagggagcagagtctgttgcacttccaaatggctcagataatgaggacaccagccaagtggttgcatctgatgcattgaattcttcaagtgatctgtctgagagtgacaaaatggctgtggaatccgaagctaaatcagaagcgaaagacaatccgattgcggaagacattcccattgaggttgataaattggacaagactgtttgggaagaattgcctgtgggagttattgatgaagatatcaatgatgttagtattgagagggaagaacatgatgacgttagatctggaagtctcccagccatggtgaatgattcggcacaagaaggatcagattcagagaactatgcaatgatggaactgccattgggattacatgaggagcatgaaagggacaatgaaatgaatatttctaatggagaaacacggtctgagaatgagatatttattgaggagcttcctgtgggactgcacgatgaggatacagcaatatctaaagataagagggatgatcaagctaagcctaaaacatataaagaggttctactagctcaagaaggggaatgcaatgcagatgaggaaacaagttcttccacagatgacactgcgaacgaaactcaactagagcaacagcagaagctgaaagagcaagagaaggtgcattcttctagggtaaaaattgagtacccggaagaaggtgaactcaatggtgatgcaccaatggatataagagttgagtgcaagtcaggtgaggaagctggaactgatactaagttgcttcctttgacaacacaagtcagtgataatgaaccagaaaatgaagatgtattctcagaagcaaattatgtaaataacaaattaaccgagccaatggagtttgtaccttccaatgacacacagaaggaggagacaccagagatggttgctgaaggggctattagtgctgatgataaatactttaggtgcttttggtatagtcctctaatcagaattggcgtttaa

SEQ ID NO: 57485 - DNA, 309 bp, Glycine max
  Peptide Sequence Number=SeqID_174263
atggaaaaatctgacaagagaactttcaaagaaaagaaagcatacatcacttggaaagataatgacatggattcttcaagtgattcagaaaatgaaatcataaatctaggtctcatggccaaagaatatgaaagcgaagaagaggtaatgtcttctaactatgacttatctatttcttttgatgaactccaagatgcattcaatgatttgcataaagaatctattaaacttgccaaattagttccatattctaagaaacctatttcaagtttagaaaaggaaattttgaaattgaaatttggaatttga

SEQ ID NO: 57486 - DNA, 264 bp, Glycine max
  Peptide Sequence Number=SeqID_174264
atggatacctcagagccctacactggggcaatgaaaggcaccatgcatgagcctcaggcgaacctaggggcagggttacaggtcttcacctttagagagctacacgtcctcaccttcagagagctacacgtcctcgccttaagaggactgcacatcctcgccttcagaggactacacgtccttgactttagagggctgcacttcctcgccttaagaggttttcatgccctcgccttcaaagggctacacgccctttgccattag

SEQ ID NO: 57487 - DNA, 357 bp, Glycine max
  Peptide Sequence Number=SeqID_174265
atggaagtatcaattggtctgtgtcgttccgacatagggatcgtgcccacaagacacccagtggacccggagaagtccaatagggtcctggggtttccaactctagttacgggcctctgtcagtcctacagggtgcccgttccccccagcaagggatcacacccagtggacccaaagaagtccaacagggtcctggggtttccagctctgattaccagcctctgtcagttctacgaagtgcccgtcatccccggcaaggtcatcaggcctcctactaaccgagctttcatcaagaagtattgcgcccccaggcaggcgcaaggcaagacaccacagcaacattgggatggccggtag

SEQ ID NO: 57488 - DNA, 549 bp, Glycine max
  Peptide Sequence Number=SeqID_174266
atggatggggattcaatcatacacaccgtggcttatgcaaatgattttgtaagggatgcagaaattattccgcacaaagtggatgcagatggagataagccggctaatgtggacgcagatgatccaatgcgtggcctgataaagtacaactttgatatttacgacaagccagtggaattcaaatttgatgggagtaaatttggaattgtagatgcaccttcatccatattcctaacatattctgatgttagtgaaataatagcaggagacaaaagtttgaacatatctatacaacaattatggttgatgtatatgcatgagtggagtgaaaccttgggtcaaggttccagctatgcattccttgagcaacggtcgttggtggtttcaaaggatacatgtggcgaatgccaacaatatcttgaaagatggctgaaggaatctgaccgagaggtgtacgttggaccttacttccatcatgtaatgaccaaattaaagacgggtttgtctcctgaaagtaaggcagctgcacctaagtggattgaagttaag

SEQ ID NO: 57489 - DNA, 357 bp, Glycine max
  Peptide Sequence Number=SeqID_174267
atgtctgagccaaggaaaagtcatttgatggcagccaagagaatgttgaggtacattaaaggcatacctaagtatgacaggaagaacactttaggttacatattcaagttcttaaaggctccaatttcatggtgttttaagaagcagccaatagtggcactatcaacatgtaaagctgagtatatttcttatcaagctatatggcttgattcagtgttgaaggaattgaagagtaaagggaagaagccaatacaattttttgtggataacaagtctgctatcaatttggctaacaacccggattcccatggcagaagcaaacacattgagacaaagtttcattttctaacaatataa

SEQ ID NO: 57490 - DNA, 393 bp, Glycine max
  Peptide Sequence Number=SeqID_174268
atggaagaattagaaagaatagcagactatttcagtggcatgttaagtctcacaaatgcgatgaagggttgtaatgaaccgatcacagatcaaatgatcatagacaagatcatgcggacctttactcagaattttgatcaaatagtggtggtgattgaagaatctaaagatgtagagatcatgaagattgaggagctggaacaagatcaaagtggcagatcaagctttgcaggcacagggcataaggattggctcatcgatctagatacaagaagatcctcaaaggtcaagctagcaaatagaaaaaactggaatgctgagggagttggcaatatactgattagaagaaaggatggcaagacaatattgattgagagtgtgttgtttatgtag

SEQ ID NO: 57491 - DNA, 162 bp, Glycine max
  Peptide Sequence Number=SeqID_174269
atgaaagtttcaaaaaaagctgagggaagtggacatagcctggaggtaggtccacacggcctgcttcacgaggcagtttcagatggacacgtgctggtggtggtggtggattgcggcaatggtggcggagaaaggaagcatgtctttgagggaagtgtatga

SEQ ID NO: 57492 - DNA, 603 bp, Glycine max
  Peptide Sequence Number=SeqID_174270
atgttgggggatttcattaatcgaatccttattctcattctggggtatgcataccctggattcgaatgctataaaacagtggagaaaaatagggttgatattgaggaacttcgcttctggtgtaaatactggatcattgtggcacttttcactgtactagaaaagtttgcagatatatttgttggatggctgccaatgtacggagagatgaagctggtgctctttgtctacttgtggtatcccaaaactaaagcgatactttatacacctttcttgtttgagggggaaaagcatgattatatgtccactgggacgggatatgtttaccagactctgttgaggccttacatatcaaagcatgaaaatgacattgacagaacattaatggagtggaaggctagaggatgggattatgtcatattttactggcaatattgtgccaaatttggacaaactgcatttgttcaggctcttcagcacttggcttctcaatcttctagattttctgccaaccctactacacagctcaacgtcattaacaaagtaagttgctggcaattaaagcttagaaaggttaagatgacgctggaattttatatttga

SEQ ID NO: 57493 - DNA, 484 bp, Glycine max
  Peptide Sequence Number=SeqID_174271
cctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgacgcgcatgaatggattaacgagattcccactgtccctgtctactatccagcgaaaccacagccaagggaacgggcttggcggaatcagcggggaagagaccctgttgagcttgactctagtccgactttgtga

SEQ ID NO: 57494 - DNA, 342 bp, Glycine max
  Peptide Sequence Number=SeqID_174272
atggaacaatgtaggcaagggaagtcggcaaaatggatccgtaacctcgggaaaaggattggctctgagggctgggcacgggggtcccagtcccgaacccgtcggctgtcggtggactgctcgagatgcttccgcggcgagagcgggtcgtcgcgaaccggtcgggggacggattgggaacgggcccttcggggcctcttagccgggcgcctccaaatcaccaacaaaccctgtcccccccaaaaaaccaatcaatccggtatccctttcttcttctactatgtttggccaaaagaggctaccgttcgtcggctctctctcgttttgcctgcctggtgctaa

SEQ ID NO: 57495 - DNA, 102 bp, Glycine max
  Peptide Sequence Number=SeqID_174273
atggcgtatgtgggttttcactggtggagtgtcctcccttctttcattagaaaggacctcttccgtaatagatgtggtttgcctttctacagttttagatag

SEQ ID NO: 57496 - DNA, 297 bp, Glycine max
  Peptide Sequence Number=SeqID_174274
atggtggtgcgatggtggtttaggcaagtagatctagtgaaagggaggttggtggtgggaggtattggtgtttcagtggtggtttggacaaacaaatatggtgaatgggaagttggtggtggcccgggggtggttttggagagtcgatctggtgaagaggaggctagtggtgctgcggtggtggtttgggcgagcaaatctgatgaacaggaggctagtggtggtgtagtggttggtggtggcacaatggtggttttggtgagtggatctaatgaaggtagaattgtgagagtgtaa

SEQ ID NO: 57497 - DNA, 153 bp, Glycine max
  Peptide Sequence Number=SeqID_174275
atggatgttggtgtggaactaaaggatacaactttgtctaagttaatcactactggaagagaggaagttggttgcagtaccttcctatgcagggttgttattgcacttgttgttgtaggcaaggaggaaaagattgtagaagagaaggagtaa

SEQ ID NO: 57498 - DNA, 171 bp, Glycine max
  Peptide Sequence Number=SeqID_174276
atgttttctaggttggacctgaatcaggagggagaggccctgacgaactcttcgaagtctaggccttgggggcgcctgacatggtttttcactgacaagatggttaggtggatggctatggagaacctcgtgttagaggatgcgagaacacaatgctctgataggatgtga

SEQ ID NO: 57499 - DNA, 1903 bp, Glycine max
  Peptide Sequence Number=SeqID_174277
caaaggtcatttgtacgccctgaacgtgaacggcaagaaactctggagcgccatcctgagtagcgaagttcagggtcagccccgctactatgatgggacggtcattgtacgtaccagcgatcaccatatttatgggattgatgcagcagatggccgtcgcaaatggtcctatgagcgcgcgaccccttcactgtccctcaagacgcaggcaggaattgttgtggatggcggcgcagtctatgccggctttcctggcggaaagctgatcgcaatccgtgccgacaatggcaaactggtctgggaaaccaccgttgcccagcctaaaggcgtgacagaaattgagcgtatcgccgacattaccagcctgccattcgttgatggcccattggtctatgttgtggcttaccagggtaaagtggctgccgttgaccgccagcgtggccaaatcgtgtggaaccgtgacatctccagttatgttggcctgaccgctgaaaataacaaagtctatttaagccataccataggctcagtctattcacttgacgccagcaatggtaaaaccttctggcgccagggcaatctgggataccgcaacctgaccgtgccactccccctgagtaatgtcgtagctgtgggtgacttggaaggctatattcatttactcagccaggatgatggcagttttgttggccgaacacatcacatacaaataatgttacctaccatcgtacttgttggccggccaaatgtcggcaaatccacattatttaatcgcctgaccaaaacgcgtgatgcgctggttgccgatttgcccggtttgacccgcgaccgccactatggccgtggcctaggtgcaagccagccatacctggtcattgataccggtggctttgaaccaaccgcggacaccggcatcctgaaggaaatggccaaacaaaccttgttggccattgacgaagccgatgtcattatctttctcgtcgatgcccgcgcaggattaactcctcaggaatttaccattgcgcagaccctgcgtaaggcacaacgccccgtcctgctggccgtaaacaagacagaaggcatgcgcaaagccattgtcagtgcagactttcacgaactaggcatgggcgaaccgctgtccatttcatctgcccatggtgaaggtgtacgcgacctaattgagctagcactggaaaccatcagcgacaaagaaatagaaaactctgaaccagtcaatccagacaatccaagaatcgccatcgtaggtcgacccaatgttggaaaatcgactttggtgaatgccttacttggtgaagaccgcgtgattgcatttgaccagcctggcaccacacgtgactcgattgaaattgcccttgaaaaaaatggcaagcaatacacgattattgataccgccggtgtacgcaagcgcggtaaagtttttgaagcggtagaaaagttctccgtgatcaagaccatgcaagccattgaagatgccaatgtggcgattctggtggtggatgccaaagaaggtattacggaacaagatgcgcatgtcgccgcctatattgtcgacgctggccgcgcattagtggtcgccatcaacaaatgggacgggcttcaggatgatgaacgcgagtggatcaaacgagagattgaccgcaaactgcaattcctggattttgccaagttccactacatctcagctttgcgtaaaaaaggcttgaatgaattactgagctcggtagatgttgcattcaaagcggccatggccaaattggcaaccccacaactgacccgcgtgcttggtgaggctaccacacaacatcagccaccaattagcaaaggcatccgtcccaaactgcgctatgcacatcagggcggtaccaatccgccaattgtggtg

SEQ ID NO: 57500 - DNA, 309 bp, Glycine max
  Peptide Sequence Number=SeqID_174278
atggaacacgcatcccgcgagtctcgcgtcgccctcccgccgaagggtaggttgcgacacagtgacggtggtgctaatttttgtaatgctcagctacaaaaggtgttaagccagtatcatgtgactcataaggtgacatccccctaccaccctcaaagtaatgggcaagccgaagtatcgaacagggagttaaagaagatattagagaaaacagtggcttcaaccagaaaagattggtcaaccaaattggaggatgcactgtgggcttatagaactgcatacaagacctcaattggcttatctctgtag

SEQ ID NO: 57501 - DNA, 279 bp, Glycine max
  Peptide Sequence Number=SeqID_174279
atgctcaatggaatgccccgaggcttctccatgacgagcacacgttgcgttcgagtcgtatcctcgaaaaaatggagattgaggaaacctagcagggtttatggctaccactgcattatcgagtggacatgggagcaagtcaacataggacaccgaaatttgggtgaattctacaggttttttttttcgctgcaaaactcatttcttggcggctgtttttggattgtgctaaaggtgatgttcgtcattggaagtgcggtagacatactttgtggttga

SEQ ID NO: 57502 - DNA, 642 bp, Glycine max
  Peptide Sequence Number=SeqID_174280
atgcagagaagtggcacaagctgcatttgtccaattaaaagctgcaatgaaattttacccaatcaggaagtcccaatcttctccaagtcattcgtggtagagactgatgcatccaacaatggaatagaggtggttttatcacaagaagggatgactatagcctttttcagtcttgctcaaggactttcagaaagggtgcaaaataattcagtttatgaaatggagtttatggctttggtttatgccatgcagaatggaggcattactggagcagcagatgcactctcaaggaaaatgaacttttcagctatcaccactgtgaatgtcaaggggttggtgtattggagaaaggaagttcattcagatgctaatttacagaaaatcataaaggatttggtcctaaatccaaactatcgtgacaggctaaggggctttatcattgaaaaaataatcaagacccagaagaagcccagaaaatcaacgattataccagcatacatagaacaacgagtagcatcaaccccaccagaaattcaaggcaaagaaatgcaaaacacaacacagacagcaccgatgagtatagcatacattgttcgcatcaaaatatacgctgtaagaagccgcacgacacctgtagcgtga

SEQ ID NO: 57503 - DNA, 714 bp, Glycine max
  Peptide Sequence Number=SeqID_174281
atggacattaactcggcctacagttgcttgttgggccaaccgtggattcactcggtgggggtagtcccctcaacgctccaccaaaaactgaaatttgtggtggaagggcacttagtcattgtttcggggaaggaagataatctgggacacgttcatcttgggttttggcgagacttaccaaggagggaccttgggtttgtcgagccttttgagatgcgagactcaccaagggtgtaccttgggtttgatgagcctttggcagagcgagactcatctagggtggaccttcagtttgacaagcctttggagaaacgagattcaccaagggcagatcctgggtttgacaagtctttggagaaacgagactcaccaattgcagaccttgggtttgacgagcctttggagaagagagatttaccaagggcagacctcaggtttaatgagcctttgctgaagcgagactcaccaagggcggaccttgggtttgacgagcctttggcgaagcaagactccccaagggaaaaccttaagtttaacgagtcattgatgaaacgagactcaccaacgacgaaccttaggtttgatgagcctttggagaaacgagactcaccaagggcgaaccttgggttttggcgaagtgagactcatcaagggtggaccttgggtttgagagcctttggtgatgcaatcctatcccgcaagggcattgggtag

SEQ ID NO: 57504 - DNA, 3756 bp, Glycine max
  Peptide Sequence Number=SeqID_174282
atggatgatccaaagggtagttcctcgtggttaaaaagtctaaatataagtgacatatttggctggaaaggtcatggagaatatggagctctggcagctatagtcataagcattcttgttcctgtcttgttttcagctttgttctttggaaagaaaaaaggaaaaataagaggtgtgccggtagaagttggtggtgaggaatgctttgcagtacgtaatgctagaaaaactgagttggttgaggagtttgttacatctagtgatggcaggaagtttgagaaacttcatttaggagactacgaatgggaaacctatggagaggtatttgctcgtgtgtccaattttgcatctggtcttcttaaattgggccataatggagatagccgtgttgccattttctctgataccagggctgagtggctcattgcccttcagggttgcttcaggcagaatgtaacagttgttactatttatgcttctctaggtgaggatgccctgatccactcactaaatgagactgaagtatctactctgatctgtgactccaagcagtcaaagaagttggatgcaataagatcaagactaacatctttacaaaatgttatttactttgaagatgataacgaagaagatgctttctctggaagttcaagcggctggacaattgcatcttttagtgaagttgagaaacttgggaaagaaagtcctgttgagccaagcctgccttccaagaatgctattgcagttatcatgtacacaagtggcagtacaggtcttccaaagggtgtcatgattactcacgggaacattgtagcgactacagcagctgttatgacagtgattccaaatctgggtagcaaggatgtgtacctggcatacttgccccttgctcatgtttttgaaatggcagcagagtctgttatgctggctgcaggttgtgcaattggttacggctctcctctgactttgactgacacgtctaataaagtcaagaaaggaaccaagggagatgctactgtgttaaagcccacacttttgacagcagtaccagctattcttgatcggattcgagatggagttgtaaaaaaggttgagcaaaaagggggccttgtgaagaatcttttccattttgcatacaagcgccgactgggtgctgtaaaaggaagctggctaggagcttggggattggaaaagttgatgtgggataccattgtctttaaacaaattcgtactgcacttggaggccagctccggtttatgctttgtgggggagctcctttatctggagattcacaacacttcatcaatatctgcatgggggctcctattgggcaaggatatggcttgactgaaacatttgctggggctgccttctcggagtgggatgactacagtgtgggacgtgttggtccacctcttccttgttgccacattaagcttgtttcttgggaagaaggagggtatctgacatcagataaaccaatgccaaggggagagattgtagttggaggatttagtgtgacagctggttactttaagaatcaagaaaaaactaaagaagtgttcaaggttgatgagaagggaatgcgctggttttatactggcgatattgggcaattccatcctgatggatgtcttgaaatcatagataggaagaaagatattgtcaaacttcaacatggagaatatatatctcttggaaagattgaggcagcactatcatcgtgtgatcatgtggataatataatggtttatgcagacccctttcacaattactgtgtggctctagttgttgcttcgcatcagtccctggagaagtgggcccaacaagctggtatagattaccaagattttcctgatctgtgtaacaaacctgaaactgtcactgaggttcttcagtctatttccaaggttgcaaaatctgcaaagctggagaaaactgaaatccctgcaaagattaagttgctgccggatccatggactcctgaatctggattggtcactgcagctctcaagataaagagagagcagctgaaagccaaattcaaagatgagcttcagaagttggtagtagccttgacaagtgggagggtcgcgagttcattgagccccaaccatggacaagtgttgtctgatgtcgagagtagtaacctcgacaaatgtgagagttacaggtctgtcaagcttgtcaagccctctagcctggacaagtgttgttcgggttggttctgtcaagttgtccaaggtggaggtggacatgaggtcatcccaatcggtggctcctcgaaggaggagacacgtcatgaagcctctgatagcaagtcctcttccttggagagattgaggtctcacgtcgtgttggtggaagagcctctcgcctccataggatggcacaaccttttgctgcttctctggacagggaacctattccagagtagtggcaagaacattagggcttcccctcgtgtacatcatagccacaatattgggccgccatcgtactttcttcttgttgttggctatgagtggatgaaattgacaaggaaaataggttgggtatccttgaacatcgtgtccaagaagttgttcgagtttgacttgaatgtgtttcgcttcttcaaggatcgtttcttcaagtccctagctactgatgtcgtggttgataggttgccattgatgttcaatcgggacagagaatcccacttcccatactactggcagttagaccttactagggttgacaaggccatcttggagcaacagtcgaccttgctggatgcacaaacaattttgtcttctccttcggcaaacgatcctctcgttgccttagatgagacctatagtgttgtgccaccttctgtcgatcgttctgttggagaagggggtcaacctcctgctagggttagccctaatgatgaagttgttgaggtctccctcaacgtgtcttcctctattttgattaagagtaagcatgatgacgatgctggggtgttaggccacaagaagttgaggggccctttcagcctccgagctatgaggcaggctgctaggtttgggttgcccctgtggtttgcagggtctaccttcagctccgatggctatctaggctattgctccttctactattattgctcctgctcctctaactctttcttatgcgcttgtttaggaggtttctacttctcctgctattgtgattacgacgttggtttcttcggttgccactgtctctacaccattgttgagtgttggtttgatgaccacaagtgttccagagatgtcgcctcctttttcgtcagctttgccggttccccttcaactgtgttggcatcagcgtcgccttcctcctcttctcacctaagtgtctccttaaaccatatctacacttctcgtgatattaattcactttggggtcttccttcaaagaagtctggcgattctggaggagaacgacaccatgaagctctgagcaaggtggagagcactacggtagacaaggatgagcttgccaaggtgattgttgatctcctggcccggttgagggagtccaagctagaggagtccgagttgagggtgtcaaaggagagggaggccaacaaagagcttgaagaggaactgctggcagtcatgcaagctgggttctttgccaaggatctttacttgggtctttttgaccctttcagggatgtgaaggatggtgttctgcttgacgaagaagagatagctactgaggaggaggatgctagcgaggagtag

SEQ ID NO: 57505 - DNA, 240 bp, Glycine max
  Peptide Sequence Number=SeqID_174283
atgtctcggaacttcacgtattgtgcaacaaagggtgccaagtacctcgaagcggaatcgatcagaaaaaaaccatatttccccgtcaccgaaggctccgcgcttgataacgaaggacacatgaacaacgctaggcaatcaattcatagggctccgaacaagatggtggaggatacacgaacagcgctaagcaatcaattcgtggggctccgaactcaatggtggaggatgcatggatga

SEQ ID NO: 57506 - DNA, 363 bp, Glycine max
  Peptide Sequence Number=SeqID_174284
atggaagatgaaggtcccacagcccaggaaccccgacaggtacatgatgcttcctctgggaccaccattccagagccatttacttttcaacaggatgcaggtgaagagcaggttagactagagactgccaccattcctgaaagatctcttgagggcacttcagagccccctacttcagtggtagacctctcctcaccacagcctacagctgacccctctactcatgtacttgacataccagaggatcagaccacaccaatcctggcactgaacacctctcctccagctactccagtacttaatctgacagatgaggaggatgttcagacgcaggatactcaggacatgtctctggaattttaa

SEQ ID NO: 57507 - DNA, 907 bp, Glycine max
  Peptide Sequence Number=SeqID_174285
agctagagtaatgggtgaaatagagaaggtgcaagagcggataaaggccgacatggaggccatgaaagagcaaatggccacaatgatagaggccatgatgagcatgaaaaagatattggaggtcaatgcaattgcagttgacgcggacccgactcccccatctagcctcaaccaaataaatcatccaacctcgaatatggtaggtcaggggggaaaagaattgagaagtacgggtggcccccattttgtgcaagttcaaaacaagcatgtcttcccaccacatggcttgcctcccaactatacaccacccattgtggtgcacactcctgatgagaatgtcaataactccacccccattctcgttgagagccaacaacctcaagctgatcatgcacatgtctctcaacccatgagggaggcacatgaaataccccaccacaatctagccaacttcaagccttgcctcggatacgccactaaggggcaagcagttggtggtatacccctgccaaacactttggagggccctcagtttcacccacaaccacaacccttgcatttcgtagtaggggagtccctcttgctatgggccattgaaggaggtggagattgtgctttcgctgacatgcatgaatctttcaaagaatatgcccaacaatggagggatctggcatctcaagtagtgctcccaatgacggagaaggagatgataacaatgatagtagacacgttaccggtgttctactatgagaagatggtgggttacacgccttcaagttttgctgatttagttttcaccgatgaaaggatcaaagtgggtctaaaaagaggaaaatttgatcatcctgcattgacaaataaaaagcctggggcaaatagagaggatgagaaggaggaaggaacctaa

SEQ ID NO: 57508 - DNA, 267 bp, Glycine max
  Peptide Sequence Number=SeqID_174286
atgaagtcagctgacaagcgtgagtaccatattgtcatccgaacctttcatcaaccaagggcaaacgagtccggtgacgcgcagagactaatatcgtcttctgcaccttctgtcatcctgacccatgaagtcaggtttactttagtcgtccgaagatattcaagcacaacgacgcacgagattcttctctgctgggcggggacgatcaagttcgatagcgcgtggaaacgtcgtggttatcccattttatcgctttcaagacactaa

SEQ ID NO: 57509 - DNA, 516 bp, Glycine max
  Peptide Sequence Number=SeqID_174287
atgggcagcggcaagtcgacactcgtgcgcagcatcgcggccggtgcggtgatcgacaccgatgtggccaacagtgatcgcctcggcgccgacaaggcctccaccaccgtcgcgctggactacgcagacatcgacctgcccaacggcgagcgcctgcgtctctatggaacgcccggccagcagcgcttcgatttcctgtggccgatcctgctgcagggagcacgtggcgcggtgctgctgctggacgcgcgccgtgccgggttggccggcgagctggaggactacctgcaggtgctgcagccgttcgcagcgtcattggcgctggtggtggcggtcacccatctcgaccaggcgccgcacgctgcgctggacgactgggctgcacgcgccagcctggatgatcaaccgctgcctttgctggcggtggatgtccgcgaccgcgaacagggattgctgctgatggatgtactgatgagcgaaatggaagcgcacgcactggtggccgcgcatggctga

SEQ ID NO: 57510 - DNA, 1205 bp, Glycine max
  Peptide Sequence Number=SeqID_174288
gcacgagccaggcgtgtgatcgagtcgagcaggatcaccacgtccttagagtgctcgaccaggcgcttggcgcgctcgatgaccatttaggccacctgcacgtggcgcgcggccggctcgtcgaaggtcgagctgatgacctcgccgcgcacggtgcgctgcatttcggtcacttcttccgggcgctcgtcgatcagcagcacgatcaggtgcacgtccgggtggttggtggagatggcagtggccaccagctgcatcatcatcgtcttgccggccttcggctgggaaacgatgagcgagcgctggcccttgccctgcggtgccatcaggtcgaggatacggccggtgatgtcttccgacgaaccgttgccacgctccagggtgaagcggcggcgcgggaacagcgcggtcaggttctcgaacagcaccttgttcttcgacgcttcgatcggctcgccgttgatggtgtcgacgatgttcagcgcgaagtagcgctcgccgtccttcgggaagcggatgcggccggagatgtggtcaccggtgcgcaggttgaagcggcggatctggctgggcgagatgtaggtgtcgtccgggccggccaggtagctggcttcggccgcgcgcaggaagccgaagccgtccggcaggatttccagcacgccatcggcggcgacgccgtcaccgtggcgggtcagcaccttcagcagggcgaagatcacatcctgcttgcgggcgcgcgccacgccttcggagatctgcagctgctcggcgatttccagcagcttctgcgccggcatgcgcttgaggtcgctcagcgaatagaccgggaagccctcgggcacgttggcgtgcgggcgcggcacgaacggctgttgctcgccgccatcgttgggcaggccgtcgtcgcggaagcggttgttgcggtcacggtcgcggcggttgcggaagcggtcgcggcggttgccctggccttgcccctggccctgctggccgttctggttgtacgggttctggccctggttctggccgcccatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 57511 - DNA, 1371 bp, Glycine max
  Peptide Sequence Number=SeqID_174289
atggcagatgatgatcaatttcaagcaagtgggaactggtgggaaacatcaagaagcgtgaggtatgagagcggggcatcccagtcatcttcctcagccatcaccaacacaggcaacaactttggttggcaaggttcggatatggcagacatgaagccaaggtcttccatggattcttcttctgtggttttccatgacacacagaataataagcttcaacaaccagattctgccacttccagtgaccccaacttgcatatgatgggcctaggcctctcatcccaagccatggattggaatcgagcatctttgttaagaggagagaagggtacggagaacagtttccggtcgatgctgcaagagaatttgagctcatcaaggaccaattttcagcatgaaactgggaatatggagttgtcacaacaagttcaatggaggtcagagaagatattctcttcagagtcttcaaccaatgagttcaagcaagtgaataggggtggtggcttctctttggatcaaagccagtttagtcctcaatatagctctggggacagcacagtgacaagccaagggttaccctcttctaactttcagattgattcctcagccttatatgggacctcctcaatcttgcaaggactattgggacctgatcacaataaccaaacccaacaacaacctatgagttttccatatcatacaacaagctatggattaaactctaatgaattggttccttcttggtccaaagttcctcaattcttgagagcttcccctccaaaaccaccacccaataaccagttgcatttcactaaccccgcaaccttttggaatgcttctgaggctgcaaacatcaaagatgttcgccccagcttcttcccttcattgcaaccccctttctctacgccaaattttgaagtacagtcaaagaatatatctgaagttagggagtcaggtactgtggtaaagaaaagtgggaatgagccagcacccaaaaggacccgtaacgaaacaccatctcctttgccagcttttaaggtgagaaaagagaagatgggggacagaatcactgcactccaacaattggtgtcgcctttcggaaagactgatacagcctcagtgctctctgaagccattgaatacatcaaattcctccacgaacaggtcaccgctttaagtaccccgtatatgaaaagtggagctccaatacagattcaacagaattctggtaaatctaaggaagctgagggtccaaagcaggatctaagaagccgagggctatgcttggtgcctgtttcaagtacatttccagttacccatgaaaccacggttgatttttggacaccaacattcggaggaactcccagataa

SEQ ID NO: 57512 - DNA, 526 bp, Glycine max
  Peptide Sequence Number=SeqID_174290
atgacaattggtatgtttggcaaaagtcttaacacaaagctttcccaagacttctttcaggtctgcctcgtgttgggctattctctgagacttgacgaccatgttgtcgccataaacctcaatgtttcatctgatatgctgcttgaaaattcagtccatcaatctcttagggtatgcatctttggggcacgtcatgttcagatcagtataatcgatgcatattcaccatttggcgttggccttttttaccatgacgatgttggcgagctaggtaaaatatttgacttctccgatgaagttggcattgaggagtttgtccacttcttctctgatagctttgcagttgtcgcaacctaccctttggtgcgagggcgacgtggggatcacgggtgcgtcttccaagaaaggaaaatgggcggagtcgccaccaacgtttattcgaggaaaacgtcggaaaaactggaaaggtgtggtctacgaactttaatcgtgaaaggttcgggagttgtttttatgcacggagaag

SEQ ID NO: 57513 - DNA, 464 bp, Glycine max
  Peptide Sequence Number=SeqID_174291
ttggtggaactactattagttgggagaaagttttcttggataaggatggggaaggagctatgagtaggttggatagggcaatggtatcattggaacggctacaaatgtggccaaatgctactcaatacatatttgatagatccatatctgatcagggacttcgaccattcaaggtgtttaactattggattgagaaactggaatttgtgaagaaagcatatggatcatgtgacattcaaggatggggtgcctatgtgaaattcaagcatttaaagaaagacattaagaggaacaattgcattaaaggtttgaaagtggggaatgaatggtgcgatgagcctaggaaagtgaagcaagaaattaaagagtacttccaaaaaagattctttgaagagggaagcatggaggttgtgttggagggggttggctttaaatccttatcggaggatgataatgtgcttctg

SEQ ID NO: 57514 - DNA, 261 bp, Glycine max
  Peptide Sequence Number=SeqID_174292
atgtcgcaacctacccttcagcaggagggcgacgtgaggctcatgggtgcgtcttccaaggaagggaaatatgcggagtcgccaccaacctttggtttctggcataccctaatttcgtccggggactattgtttgatggcatgcaacctatggttgaccgcttcgaggtacttggcaccctttgatgcacaatacgtgaagtttcgagacatgccggaaatcaaaaggaagcattgttacgcaatccgtgaaattccgtaa

SEQ ID NO: 57515 - DNA, 153 bp, Glycine max
  Peptide Sequence Number=SeqID_174293
atgtttgttccaagatggagaagattaagaatgagacagctttggtggctagggctaaggggttggccaaaatcttctctgaagcattggatgaggaaaggacttagaaaaaattccagtcatccaactcgctcagctcgccatccgcgctaa

SEQ ID NO: 57516 - DNA, 297 bp, Glycine max
  Peptide Sequence Number=SeqID_174294
atgctgagtatacatgatttggctcagcataggcctatcatgagcatggaggcctttatggctcaggtggccaggccaggagtccagccttcttcttcggggggagccacgcccatggaggccactgatgaggacggcgcagtagagaccaacgttgatactgattatgtagtgggcgtcactatggtgcaaggcacctgggatccatggcccactctagctcaggaccctccgatgccagctcaggatgcccccacatcacctcatgacgacccaacaccgactcaagaggagtga

SEQ ID NO: 57517 - DNA, 396 bp, Glycine max
  Peptide Sequence Number=SeqID_174295
atggcctctagaaagagaagagcgtctacctcccgacctcaggagccttatgacatatctaggtttgtgtctgaggtcgcatgggagcattacgagaagaacgtgcacaccaggaacatcctcccagagaggaatgttgagttatccatcacacagtggaaccgagccttgaccaggcagccagataaccacattgatgtggccccagtcaaggaattctatgctaatctttttgatccggaagataaatctccaaggaagtccagagtacgggggaagctgattaagtttgatgctgcgacattgaacgagtttctagagacaccagtggttctggagccaggggagagatattcagcatattctagattctatcatacacaccccgacccttag

SEQ ID NO: 57518 - DNA, 387 bp, Glycine max
  Peptide Sequence Number=SeqID_174296
atggtactaacagaaaaaacaacaagaattttggcagtcggaactccgaaaaaggtggccagaacaccgacggtggctcaaacgatggctccggtactagtggcggacgtggaaaccaccaacaacagtggcagcctgggtcttggatgtagtgggctctatggacttgccctccttctccatatccttcctacaacaattgggccaaacccactttcagtcctagaccaccacagcctggtcttcttggaccaaagccttagcaagcagcttacaatgcaaatgcacccagcccaactaatattgaagcagctcttcatactctcagccttgctcaacctgatccgtcatggactttcagacagggatgacactaatgcgatgtga

SEQ ID NO: 57519 - DNA, 162 bp, Glycine max
  Peptide Sequence Number=SeqID_174297
atggtggatggcaacatagagaaaagaaagaggaaggatgaggaggaagttatcatttaccagcagattatgaaaaggacaagttccaaggtccttgaacctccagggtttagaggcttcccacaacagaagcagcggctagccaccattatgaggtcttga

SEQ ID NO: 57520 - DNA, 721 bp, Glycine max
  Peptide Sequence Number=SeqID_174298
atgaaggttcatatcaggttctctcagagcaagtctgacaactctctcttcatctacaagaaaggtttggagatggcttacattctcctttacgtggatgatatcattctcactgcttcttctgttgctcttcgcaagtctatcatgttacttctcaactccaaatttgctatgaaagacttgggaccactaagttattttttgggaatcgcaatcactcaacatgttggtagtctacttttgtcccagaaaaagcgcatcctgcactacgctcagggtacacttcactttggattgcatctttatcccgcatcaactacttctttgatttcttatacaaatgcagattggggtggttgcccaaatactagaaaatctacttctggttattgtgtgtttcttggcgataacttgctctcatggtcttctaaacgccaacccatactatcttgctccagtgctgaggtcgaatatcgaggtgttgccaatgtggtttctgagtcatgttggttacgcaatcttcttttggagttacattgtcctgtccatacagttacattggtctactatgacaatgttagtgtgatatatcttttcgaaaatccatttcaacatcaccgcactaaacacattgaaatggacattcactttgttcgtgagaaagtttcccgtggacaaggacagtctcagcatacaacaacctcttgcttcaactgccagg

SEQ ID NO: 57521 - DNA, 363 bp, Glycine max
  Peptide Sequence Number=SeqID_174299
atggttgaggctcttgcaaaatcaacctccagagtgaaggattttaggagaggggcaacgatggcaatgaaggatgacacgatggaagacgatggtggagacgcaaaggggaagggtttagggaaagtggaagcgaaggggaagaggaaggggaagtgtttctggagtggcagtggaagggggcactacttggttaaggtagtgagaagtcgtattagaaagggagagatcagtggatgtagggatttggacttgagatcaaagttgacgaaggaagtgaaagagagggggagtggcgaaagagaggcaggatgtgtcgttgctataaaagagggagtgtgtcaaagaaggaagaatgtttga

SEQ ID NO: 57522 - DNA, 174 bp, Glycine max
  Peptide Sequence Number=SeqID_174300
atggaaaaatacgtggagcaaccaagggagtgggaaatgaaaaggttagaaaagaagacacctggaacaatatgtggagcaaccaagggagtgggaaatgaaaagtggttacaattgaagatagtagtaatggtggcggtgataattataatggtcatggtggtgactgtgtaa

SEQ ID NO: 57523 - DNA, 204 bp, Glycine max
  Peptide Sequence Number=SeqID_174301
atgaagagaagcgcgtggggaaaccctagaagaggatctgtcttagatgttcgcgctcagcgtgccgtcagctcgctcaacgagtcgtttgtcctttctcgcgtgatgagaatcctgaaactggccaaatgcaggctaaaggcccaagtggagaaggacaaagcccccaagtggagaaggatgaaggcccagaggcagagatag

SEQ ID NO: 57524 - DNA, 225 bp, Glycine max
  Peptide Sequence Number=SeqID_174302
atgaattctgacaattcatttggtggtcaattgatgaagggagtcaggaagaacaagcacgactataccacgagggagcaactagttgtttctaatgatattggtacattttgtcttcccactgcacatcatattcagcttctctttgtgaatgctataagagataatatcatcaatcctattaaagaagaggtacttggtcctcttaattcttctgaaaaataa

SEQ ID NO: 57525 - DNA, 318 bp, Glycine max
  Peptide Sequence Number=SeqID_174303
atgggtgaacctcactgtgagagaatggatgattctaaattactgatttatgagggattgacgaccatccacaatgtccctttgtgtagtgatcaagtgaaggtcggtgttgaggaagttcgagatgctgatgcttgtgttcctatacccactaaagaggttcagttagtggggcagacacttaacacctttcttgcttggccggcacatcttctacaacctttttcagaacaaggacttgagggaccgctgaaacctgtagataggtcggatcttgatgtcgatcccctatacctgatgacattgaccattgcatag

SEQ ID NO: 57526 - DNA, 102 bp, Glycine max
  Peptide Sequence Number=SeqID_174304
atgactgatgataatgccacctctagcaccaccatcgacaagatgagtgatttaagtgataagctaatgataaagtttctgtggggatgtaactgtgtttag

SEQ ID NO: 57527 - DNA, 1008 bp, Glycine max
  Peptide Sequence Number=SeqID_174305
atgatcttaaggtatatctgccctaaagatctcataagaatccttgttaagaaggatcaaagaactgaaagtgctaatatcctgccaagtttagttgattgcagagtttcttctcaagaggaggctataaaacagaaggatgtcctggctacagaagtttcctctcttagaggagagttgcaacaagtaagagatgagcgagaccgacaattatctcaagtacaaactttaagttatgaattagagaaagttaaagaatctaggaaacactcctccactgaattggacagcttgaccttaaaagctaatgatatggaggaaaaatgttctttcaaagataatcagataaaggcattggaagagcaactagcaactgcggagaagaaactgcaggtgtctaatatatctgcatacgagacaaggacagagtacaaaggacaacaaaaatttgtgaatgagttacaaagacgcttagcagatgcagaatataaacttatagaagaggagaggctgaggaaaaaattacataataccattttggagttaaaagggaacattcgtgtattctgtcgagtgaggcctttattagctgatgaaagttgtagcacagaaggcaagattttcagttatccaacatcaatggaaacttctggacgagccattgacctagcccaaaatggccaaaaacattcttttacatttgataaagtttttacaccagaggcatcacaagaagaagtttttgtagaaatttcacagcttgtacaaagtgctcttgatggttacaaggtttgcatctttgcctatggtcagacatggtcagggaaaacctatacaatgatgggaaggccaggacatccagaggagaagggcttgatacctcgttcattagagcaaatatttcaaacaaagcagtctcaacaacctcaaggctggaaatatgaaataattgctgataaggttttccttgcaaaatttacaggtgtcaatgttggaaatatacaatga

SEQ ID NO: 57528 - DNA, 306 bp, Glycine max
  Peptide Sequence Number=SeqID_174306
atggttgttggagaccatggaaccagtaacggactaggttggcctacctctctgagtgatacgagcactgccttgaggggtcgaattcaaagaagaagaatattagaccggagttacggtacgccagctgaaagaaccatcaccaaaatggttggaacagttgagcttgtgttcaatcaaacgtgcgacgaagatgaggaaatggagatttgggggttcgaaagccaaaacctccattcgattatctcacgtaagtcgctaaggaagacacccatatattcctcctctaacatcaaaggaacttaa

SEQ ID NO: 57529 - DNA, 480 bp, Glycine max
  Peptide Sequence Number=SeqID_174307
atggattttatcacaagcttgccgaaatcacaaggatatgaagttatattggtggtggcggatcgcttatcaaaatatgctcatatcctgtcccttagacatccttttacagcaaggaatatgacaaaaaaattcatccaggatgtggccaagttgcatggatttcctaagttaattataagtgatagagaccctattttcctcagtaaattttggggcgggcttttccgacttcaggggacaactttgagaataagtaccttctatcacccccaaactgatggtcaaacaaaggtggtaaatcgctgcttggagactttcctcttttgtatcaaatctgaacaacctactaagtggcacttgtggctgtcatgggaggaattatggtataatacctcttcacattcagcaatagggaagactcatgttgattttgtagccacagtgttgatagatcgtgatgaggctcttcgcccctga

SEQ ID NO: 57530 - DNA, 219 bp, Glycine max
  Peptide Sequence Number=SeqID_174308
atggacatgcgccgcaacttcgtactcgcaacgtggcggccaccaatatgttattccacaacgccaactgtagaggccaaacttactaggaatgcctgtgaggagaaggcaatggatcttgacaccactctctcacacaaaatcaacgacctcgaggctctcactgtgggatctagtttaggttggggtttggttcgagatctaattttggcttcttga

SEQ ID NO: 57531 - DNA, 708 bp, Glycine max
  Peptide Sequence Number=SeqID_174309
atggcctgcctcgctctagactatcgtgctttggatccttgtgagttagcacgatccaaaaccattaaacttgaaggaacattggtaggttatccgattcttcttctcgtcgatagtggcaccagtcacaactttattgctcgagaaatggtagtcattgcttatcctaaggggtttgccaagctctaccagtcagaattggcgagtacattattgagggaaaaaccaattttcaccaagattgatctcaaatcaagcttccttcaaattcaggtgcaagaggaagatatctataagacaacattttggacacatgatgatcattacgagtatctcgtcatgccctttggcttggtgaatgcctcttcaaccttccaagtcaccatgaactcaatatttcacctacttttgcgaaggttgtcctccattgattacttagaacatgttatttcggaaaatggtgttgagttggacccttcaaaggtgcaagcaattccggattggctagtcctacttatagaaaaggacgttcatggattctttggtctaatcgggtattatctcgtttcatttgggattatggcaagattgcccagcctttcagcacgctcaccaagaaggatggtttctattagggatcagaataggagcaagcctttatgcatctcaagaagtgtttgtctaccttcccgattcttgctcttctag

SEQ ID NO: 57532 - DNA, 1686 bp, Glycine max
  Peptide Sequence Number=SeqID_174310
atgagagaacaagaggattggaggattacgacagcgctgttaacgttgttgttggtgtttgtttcttcttttccggcgttgagctacggagttgttcctcctcgtactctgctcaataagctgtctcagggcagttatctcaccactcaggagcaatggttcaatcaaaccctcgatcacttctctccctatgatcaccatcaattccgtcaacgttacttcgagtttctagactatttccggattcctgatggaccaattttcttggtaatcggtggtgaaggtccatgtaatgggataacaaatgactatattggtgattccttaaatgcaaagcttaatagaacaaaaactgaaaacccctggttcgtttttggtggctcatatgctggagcactcagtgcatggttccgtctcaagtttccccatttaacatgtggaagtctggcaagttctgcagttgttcttgctgtttataacttcacagaatatgatcaacagattggtgagtcagcaggtgctgaatgtaaagcagtattacaagaaactactcaactcattgagcacaaacttgcaaccaatggaaaggaactaaaggcatcttttaatgcagatgatctcgaaaaagatggagactttatgtatttaattgctgatgctgctgctgtagcatttcaatatggtaatcctgataaagtatgcaagcctatggttgaagcaaagaatgctggagaggacttggtggcaaccaagtggaatgtgacggaggttattgagaggatttctagtttcgtgacatcttgtgtggctgctaactcccgcagtgatatacttgttgacaacagtggcagcattcatgggactcacgacattagatgggaagctctagatgtaggacaggtggctcttaattgtgatgctagtgtgatggatcatggtgccaaggcttcttgtggaggggttatttgtgataattttggtaccttcatttatgggttttccgcaaagctgggatcatgtaccattctcatggctgcgctttgggctattttccatggccttaagcttgcttgggaaagagggttttgtagtttcaactatcaagatgcttatgccaaatacgtcaaagagtactacattggaacctttggtgttaatgtgcagacttatgaccaggagtacttgaagaaaactgctatcaatgaagacagttctactcgattatggtggtttcaagtttgcactgaagttgcattctttcaggtggctccatcaaatgatagtatacgctcctcagaaattgatgcaaagcaagttcctcatcctcactacaataacattcttgggagggcgagccctggtgcagcggtaaagttgtgccttggtgacttgttggtcatgggttcgaatccggaaacagcctctttgcatatgcaaggttgcttgaatgttagctgcatgatgttgggtttggctcagatgggatctgtgccttcctacaccatcacatgtagcaattgtgcccattgtactgattttcgaggatgtcctcaatctcctttggtccttgaaggtaatgagaagaactgctcctcacctgatgcagttcacaaagtaaggcaacagattacagaacatatggacttgtggctatctgagtgccaagaaggcagcagttatatatga

SEQ ID NO: 57533 - DNA, 351 bp, Glycine max
  Peptide Sequence Number=SeqID_174311
atgtccttgtttgtgcttcataggactcgacgtcctctgtttctacacgttgaaaaaaaagagaagaaaagaagaacttcagatgtcttctgctctacagaacttcaatgtcctcatgttttctcagtttcacttccttggtttttgcctgttgcccggtcgaatattgaattgagttgttcagcaccagttaccacgcaagacgaaagatcattcgatgtttcggtaaagaatatgaaaatacccaaaagggagggcaaaaaggtcattttaagcctttttctaaaccctagctcgcccaggctagcctttggctcacctgggcccccaaaagacttaggggtgaagtaa

SEQ ID NO: 57534 - DNA, 243 bp, Glycine max
  Peptide Sequence Number=SeqID_174312
atggtacggatgaggattggatttccaattacttgtcatggtcaggagagtagaaatcgagctgcttgccaaagaattcctcacagggtatggactgatgaggaaggtgttgagcatgtggagttagctcgggctgggataattagagaaataaggcatttgcctctaaataagaaaaaaggcacagagaatcagagaggaggtggtgggaccttatcaagttggaaacatttggactcttag

SEQ ID NO: 57535 - DNA, 915 bp, Glycine max
  Peptide Sequence Number=SeqID_174313
atgcccattgatatcaaagagattgaggctgctttgtgtatacccggccgagggtttgttttaaatgctgaaggccatcctgggaagatcctcaggaaatatctggatctgacaactcttgctcaggtttggagtgttctctcatactccaacctgtctctgacttcccacacctcagatttgatttcagatagagctaggttaatctttggcctagtctctcagctggacatgaatgtaggatctctcatctctggccagatcacatcaatggcccattctaactcctctagacttgggttccctgctcttatcacatctctatgtaggtccagaggggttgcttctgatagcctagtcttcgaacgcttgagcccattcattaacttggcctatatcaggaagaactgttggaaccttgccgatctgacagttactattagaggggctaggagagcgagggcaaggccagctaaggctccttccacatctacagctcctcctccagcacgtaccttagcagctccttctaccccatcttctgtagactttcaacgtcttgaagccatgcttcaaagcatacatcaagggaagattgttttattacaaagtttacagctggtagcacctccagactctatcccttctgttgaacaatttaatgaatgggtagcctggcccgggactcagcctccccttcacagggaagacgaaggtctcactgctcaggtaccacagcagagggaggatgagtcatccgagacttccactctagagcccctgatcaaaaggaagagggtagttgaaacacgagaagctgcaaccacttctgagaaatctcttgaggccacttctgagccttcagaaccagtggcaggcttcaattcagcaggcaatagacccctccactcctaa

SEQ ID NO: 57536 - DNA, 951 bp, Glycine max
  Peptide Sequence Number=SeqID_174314
atgtctcgaaagcgttacggaagcggctcggcttggatttttcccacagaaacaattttcctcactaatttcgagagaatcctaaataccacaagggctgaacatttttactttgccctctttcccctaattataggagaaaagagggaggtggttgctgcccagctcgcccaggcgagctgggttgcttccatcaaaaggcactgccttctgttggaactccctagaaggcccaagtgggcctggttcagacatgcgcaactatgcaaagtttggaatcaagccatgctggattggcccgtccccacgacacccaagtcattatgtggattcttgggccttactggcttctaccactattttgtcaagaattatggccaactcgcttttccattgacccaacttttgtgcaaggatcagttttcatggtcccctgatgctcaaatgaccttcgataccctcaaaagggcgatgactcagacacaggtattatccctccctgatttcaatattccgttcattctaaagatgaacgcttccgaggaattcacctccctactcaattttgttcgcaacgagccacagaaccaccctgaattcaaaatcagggacgatcttcttctctacaaaagacacatttggctaaacaaaggaaactcattcgtcctgttattacaagaggaatatcataagtcccctctaggtggccacatgggtttggcaaaaaccttgagtagacttcagcaaaactttttgtggataggcatgaaacaagacatttggcagtacatcacacaatgttcatatttccaacaaaccaaatacatcccgcagggcaggcatgctccaaccaattcctcctccatcaagcctttgggaggacatggccctcgattttatcaccgggcttcccaattaccagggcaccaccatcatcctgacagttgttga

SEQ ID NO: 57537 - DNA, 375 bp, Glycine max
  Peptide Sequence Number=SeqID_174315
atggcctcggaccagtcattaccaccaacagctttggacaatcagcccatcatcgagcctctcattatcttgtaccataagtgggacaattcagacccacctcagttgcatgtccttgtccaatggttgggcttgctgccagaagatttggcttgggaaagttggactgagttacaagccaactaccaccttgaggacaaggtgattctagaagaagtagggaatgatagcaaccctgaatcagaggctaattgtaggcccaaaagaattaccaaaaggccacaagggtgggaagagtttattcactatatgttatcagatcatcaccagaattttgttagtagtggatcaatatctattagtggtatttgttag

SEQ ID NO: 57538 - DNA, 333 bp, Glycine max
  Peptide Sequence Number=SeqID_174316
atggagaaggtatcctggccaggaacccggccttctcttgagagagaaggtgggggtcccagtgctcaggtacctcagcaggtacaggatgcatcttttgaggccaccatccctagccattcatttttgaagcagctagtagaccctcctacaccagtgcatgtgatgccagcagacctgtctacaccattacttgatcttccagaggacccttctacaccactcctgggattgactaccactcctctggccactcctgtcctacatcttatagatgaggaggacactcaggatgaggatactcagtcacaggacctgtcacaggaattttaa

SEQ ID NO: 57539 - DNA, 301 bp, Glycine max
  Peptide Sequence Number=SeqID_174317
ttcattggttcgttgtgaacggttaggtgcggtgaaggtgacggtgcgttgcggtgatcggcgacgacaaacaaggtatgcagaaggtggttgctttgttgcgaacatggacgaagatgagtggatgtatgaaatattgtctgaacgagcggatatggattatgaaaatgcagaagcatgtggtgcgaatgaaccacatgttgattgttcagatgcgttcaatacttctcaggtgtttgagtaccgagaggatgtcttgcgatgggctcgatccgtggctcatgaaaatggatttgtggcg

SEQ ID NO: 57540 - DNA, 380 bp, Glycine max
  Peptide Sequence Number=SeqID_174318
gtagtgggtgtgagtggcggcatgatggtggtgtcggtgtcggtgacaataatgatggtggcagtagtagcgatggaatgatgatgacttgttttaatacctggatcaagccgattgttaaatcaatgatccatagacttaggtcgggtcacgtccaagggaagaaacacgttgggtcatggggtggcaacaatgacgataatgatgatggatgcagtagaataatgacaatgatggtgacaaagcaatggtgggatgaaatagttagtgatgacaaaaataatgatgaaggcgatgaaatgatgacaacgacaatgataatggtgatggtagtgataacaatacttggtggtggcggagactatggtggaatagtggtg

SEQ ID NO: 57541 - DNA, 639 bp, Glycine max
  Peptide Sequence Number=SeqID_174319
atgccaaacctagtaggcagtgaggaaaggattcttgtttctgttcgtgtgagacctctgaatgaaaaggagctcataagaaatgatctttctgaatgggaatgcattaatgacacaaccatcatgtacaggagcaacctttcagctacagaaaggtcactgtatccaacagcctacacattcgatcgagtttttaggactgacagccccacaaagcaggtgtatgaagaagcagctaaggaagttgctctttcagttctcagtggcatcaactcaagcatttttgcttatggacaaacaagcagcggaaaaacatacaccatgagtggtataacagattttgccatagcagatattttcaactacatagaaaagcacacggaaagggaatttgttttgaagttttcagcattggagatctataatgaatctgtcagggacctccttagtgtggacagtacacctcttagacttcttgatgatccagagaaaggtacagttgttgagagactcacagaggaaactttaagggattggagccattttcaagaacttatttctttctgcgaagctcaaaggcagataggggagactgccctgaatgaagtgagctccagatctcatcagattctcagactg

SEQ ID NO: 57542 - DNA, 2040 bp, Glycine max
  Peptide Sequence Number=SeqID_174320
atgaaaagtaaggggagaaatggacatattcctttcagagattcaaagctaacccgcatactgcagtcctcattagcaggcaatgctaaaactgcaatcatctgcaccatgagccctgcaaggagccatgtcgaacaaacaagaaacacccttttatttgcaagttgtgctaaagaagtgacaactaatgcaaaagtcaatgtagtggtgtctgataagctgttggtcaagcaactgcaaaaagagttggctagactggaaagtgagttgaaaaattcagggccaacccgccttaaatttgattctgcagcattgctgaaggaaaaagacctccaaattgagaggctaaagaaagaggtaatggatgtttcgatgcagcgggaccttgctcaatctcaaattaaggacatgctacaagtggttggagatgatgcgtcctcaactgagctggacagtttaggtcatcaatatcccaaattacgtgtgcgaagttcatttgactttgaaaatcaaacagccgaacgaccaaatttatcaaattttgactgcattgagagtgtcagatcttttgatgcatctcaatattcagatggacacagtattagttctgatgataactatttccaactccctgatttgcaaaagaacctacccgtcaggatttcttcacctgcgatttctattgtaagtggtgatgctgcaaagaatgatttggatcagaaaaacgttgaagatagtttaggggaccgttgtagggaagttaggtgcattgagtcagatgatctaactacaaacacacacacacactctactgcatcatctccagcagtctcaggattaactgaagttgataatagagacaaagaaaatctagatttgtgttcatctgggttaaaggacaacaaagaaataaacggcttgcaagaacgttttgttcttccctctcctgagaaaatatctccatgtccgacacaaagtagtgcatctagttctaaaaccatgaaattaaccagaagcagaagttgtaaagcaagtctcatgagagatccattttcagattggtttgaccaagaagaaatgattcagaatacccccccaataggaagacccgggggccttcaaaggaagacttatacactcaattataatcccaatgctgagaggttatcatgggctggttacgagaattctctgggaagagcttctgatgcacagaatatgaaatcttccacctataatggaagttacaaagataattctttggcacctgtaagaaaagaaaagaatgatcttgaaagttcaaatatgcaagcgaatcttgaggttcaagagacaggaatggagtccgatgttactacaaagaagttcaaagatgttggtttggacccattgcaatctgaggaagaaaaacagttggaatggccttcagaattcaagcggctgcagaaagagattattgaactctggcatgcctgtaatgtttcattggttcacaggacttactttttccttctgttcaaaggagacccttcagattctatctatatggaagtagagctaagaaggctgttctatctcaagcaaacttttgaccaagggaatcagactgtggaagatggacttacccctgaatcaagcaagaggtatcttagaggagaaagacagatgttgagcaagcaaatgcagaagaagctgtcaaaatctgaaagagagaacctgtacaataattggggaattcgtttgagttcaaagaacagaaggttgcacttggcccatcgcttgtggtcagaatcagatgacttagagcacattagagagagtgccaccattgttgcaaagctggttggttcagtagagccagatcaggcttttaaggagatgtttgggctcaactttgccccaaggcgcacaagaaagaaatcgtttggttggacagccagtttatcaaggatgtgcaatcccaaggttacagatttcttttgtacaatgtgcttgactaagaacaactgcacttactgtgctcaaaagaatgcacaataa

SEQ ID NO: 57543 - DNA, 471 bp, Glycine max
  Peptide Sequence Number=SeqID_174321
atgaaagtgagtgggctaggtagtgacttgcgccacaaggtgcaaacccacgccgatcttggtcatggtggaggtggtggcggtggaggtgacgacgacagatacggtggtcgtgggagagaggcaagagaggaaaccttcccgaggatggtctacggtactctgttacctacacttagcccgttaaagggaagacgagtaccacggtggatgttgttgccgctcttgagagccggtaagggtgcggggtgtttcggtatgagtgcggggtgtggtggcggagttggcatgggtggcggagtaagcatgggtgacagggttggcttgagcggcggaggcagtattggagtgtgtgtgaggaatgtcttcacagaggaagaagatggagctggttggaagctagcttggctatggcttcttcaatgtgttccattctggttttgggtcgagttgcttcagccatggtggtag

SEQ ID NO: 57544 - DNA, 621 bp, Glycine max
  Peptide Sequence Number=SeqID_174322
atggtaatcctcgaggattatcattgtcagggccctaatcagcccaataacttcactcatggaaaagaatatcttcaagataagcagttggagtcagacatcacatttcatgttggaaagcaagaagctgagcttgctttgacggtcaataatgcagctttcaatagggatctgtatcagctaaaaggtttaattcgcgctagagctgatcccaacaagacagattatgatggacggtcacctttgcatcttgaagcatctagaggatatgaagatatcacacttttccttatgtcccaacaccttgaggacaaggtgtttttggatgggcataggaatgttatgaatcagcccaaggtggagcaattcagcacagaacaatccaacacaaaagaagaaatagcagtaaacaaggtggagacaggcactaacctcaagatcaaaatgaaaatatgcaggccgcactacctaaaggattttgtgaccaatgcaatcctaaatgctgagctggttgcttctcattgggtgaaggagattcctctgtcggctaggatctcttctccattgccattcttttattttctttcgtgctccttaggtcatggagaggaaatagaataa

SEQ ID NO: 57545 - DNA, 1611 bp, Glycine max
  Peptide Sequence Number=SeqID_174323
atggattcactggtcgttcctgacatcgacatgctgcgtcgctggctggatcaacaaaatatcacctggttcgaatgcgatgcctgccaggctttgcatctgccgcatatgcagaattttgacggggtgtttgacgcgaaaatcgacctggtggataacgttatcctcttctcggcgctggcagaagtaaagcccaccgcgctgatcccgctggttggtgaactgtcgcaaatcaatgccagttcgctgacggtgaaagcctttatcgatatacaggatgacaacctgccgaagctgattgtctgccagtcaatcagcgtaagcgccggcatcaccttgggtcagttcacccacttcatgaagcagagcgaagaggggatttcgatggtgatcatggaagcgttcgccaatcatctgctgatgatgggcgaagacgaggagcgaatcaggggggctattcttgcggggctgtctgatacgtgcaactacggcgcagctataggtgtgctgatggctgcggccgtgggcgctcaggcagaggataaaacgctgcacgtttataactggtccgattatatttcggccgacaccgtgcccaattttgaaaagcagaccggcatcaaagtggtctacgacgtgtttgactccaacgaagtgctggaaggcaaactgatggccggcagcaccggctatgacgtggtggtaccgtcgtcgagcttcctcgcgcgtcagctgcagtctggtgtgttccaagagctggataagagcaagctgcctaactataaaaacctcgatcccgatctgatggcgaaagtggcccagcacgatccgggtaacaaatacgccattccttacctgtggggcaccaccggtattggctataacatcgataaagtcaaagcggcactgggcgccgatgcgccggtgaacagctgggatctggtgctgaagccggaaaacctggaaaaactgaagagctgcggcgtttcgttcctcgatgcgccagaagagatttttgccaccgtgctgaactacctcggcaaagatccgaacagctctgacgcgaaagattacaccggtgcggcgaccgatctgctgctgaagctgcggccgaatatccgctacttccactcttcgcagtacatcaatgacctcgccaacggcaacatctgcgtcgccatcggctggtctggcgatattctgcaggcgaaagatcgcgcggtgaaagccaacaacggtgtccatctcggttacagcgtaccgaaagagggcgcgctggcgttcttcgacatgatggccattccaaaagacgcgaaaaatctggatgcggcttatcagtggctgaactacatcatggatccgaaagtgattgccgacgtctccaacaagatgaactacgccaacggcaacaaagcgtcgctgccgctgatcaatgcggatgtgcgcaacaatccgggtatcttcccgacgccggaagcgatggccaaactgtttgtgctcaaggtccaggatccgaaactggatcgtgcgcgtacccgtgcatggactaaagtaaaaagtgcggctggctgtgccgcgctatcccgcttagcgccggagacatgtgagtga

SEQ ID NO: 57546 - DNA, 264 bp, Glycine max
  Peptide Sequence Number=SeqID_174324
atggggaatcaaaataagggaaaagttgttggagctattgagtatcaagggttagatcgcttccaacgaaacaatctacctactttcaacggaagatacaaccctgatggtgctcagaattggataagggagattgggaaaatctttcgagtgaaggatgttaggaacaagaaggaaatggagttcctagagctcaagcaggggaacatgattgtggctgaatatgcagccaagtttaagatggtgaaagttcaaaatatgtga

SEQ ID NO: 57547 - DNA, 183 bp, Glycine max
  Peptide Sequence Number=SeqID_174325
atggaagaagcggaaagggagatcttagagaccttcaaaaaagtagagtgggcaaagcgtgcatccaccgctaagcgtagctttagcgcgcttagcgcgacagaagaacctggcagagcatcaataccaaggctacacgctaagcgcaacagttgtcttcagccaggcccagcgcacgattga

SEQ ID NO: 57548 - DNA, 207 bp, Glycine max
  Peptide Sequence Number=SeqID_174326
atggccaccatggtggaggccatgataagcatgaagaagataatggaggtcaatgcggctgcagttgccgctatcagcatcgttgctaaggtggacctgactcacccatcgggcctcaatcaagttgaaaacaagcattctttcccacaatacggcttgcctcccaatgatatgccacccaatgtggcacacactcccgatgaggac

SEQ ID NO: 57549 - DNA, 564 bp, Glycine max
  Peptide Sequence Number=SeqID_174327
atgtcactcgtggttgatatggacttggtggtggacttagggatgagatctgacttgtgtgatagcggcggtggcaacggtcatgttggtgacaacgatggtggtcatgttttcgatcatgatagtggttgtagtgacgatcttaatgtaaatggtgatgtgatcgcggtggcagtggtagtggtggtggaggtggcgaggcaaatttcccagtttggggctgtattacaaactttttcccgaaatagggtcgtttgcaaactatttcccagggggtgctgtttttgcacgtacccaacatgcaagtcgcaattgggagtggcgacttcatgcatggttgacacgtggcgagcactggagggacgtgccaacctcgttggcaatttcagcctagaagcgccagtactgttggcaccacagtggaagcgccagtactgttggcgatttcagcctagggcaggcagcttttcagcagctagggcatcttttcagcagctttgcagatggggtagcgctactccctttggcgatttaggagaagtaagaaaacgccactccctttga

SEQ ID NO: 57550 - DNA, 249 bp, Glycine max
  Peptide Sequence Number=SeqID_174328
atgggttgcataactcattttgtttctactctgaagaaatatcatcctgcaagggaacttaccctagtggaactagcaacatcagggaaagggggacttggaccttatattggtatatgtgtgcttgttgcttgttttggaatagcagatgctcaagtcaagggtggcatgctaggagatttgtgttttatgtgccctaagtttatccagttttgtcttccatataatatattcaatatcctacaatga

SEQ ID NO: 57551 - DNA, 195 bp, Glycine max
  Peptide Sequence Number=SeqID_174329
atggcatcttcgtcgtcatgctcatcaagtatacaaactaggtctggtccaattgatggtgacgttttgtggatgcaacccaagcatgttttagaacatgtttggaatgaggaaccagacagaaaattacacattagacgagcagtcccgacgtatcaagatgggatacctaaagataaatgcgaccttaattag

SEQ ID NO: 57552 - DNA, 748 bp, Glycine max
  Peptide Sequence Number=SeqID_174330
cgatggtggtggtgacaaaggtggtattagtggtactggtggcacttctagtggtggtagcaatgtcgatagcaatggtggtggtattgacgttggtggagtggtggtggtagcgatgttggtagtagagtgtggtggtggtggtggtagcgatgttggtagtagcagtgtggtggtggtggaggtggcaacgttggtggtgattgtgatggtgatgatgaaggtggtattgttggtagtagtggtgacaatgctagtggtggtggcattgatggtgatcatggtggtagcaatgtcaatgtgtggtggttgtgacgatattgatggtggttgtggtggtggtggtggtgacaatgacaatgacaatggcggtggcaatgacattgatgatggtggtggtggtggtagcaatgtcaatggtgatggtggttgtggtcgtggtcgtggtagcgataatgacaatagttatagcggtgacaatgatggtggtgttgatggtgtggtggtgaatagtaatggggcgagggcgggagcggggatcagcatactcgaccccatccccaaacttggctttctcagtcgtgaaaaacccaaagccaaacccgatctccacggtgataacaaaggtggtattgatggtggtggcagtgataatgacgatgatagtagtgatggtgacagtagtggtggtggaaacaaaaaaaaatgtcattatcaaattgagaaatgcatgttttttttaaactaa

SEQ ID NO: 57553 - DNA, 3402 bp, Glycine max
  Peptide Sequence Number=SeqID_174331
atgccaacctttctcatcctcgtgctattgtgcgcacgcttcttatcatgcgcccagtgcggctccgtgacggagatccaagccttaacgtcgttgaagctcaacctccatgaccctcttggcgcactcaacggttgggatccgtcaactccgttagctccgtgcgactggcgtggagtttcatgcaaaaacgatcgagtcaccgagttacgcttgcctcgccttcaactcagtggccaactcggtgaccgaatttcagacttacgcatgctccgaaggctaagcctccgttccaactccttcaacggcaccattcctcactcgctctccaaatgcacgctcctacgcgccttgttcttacagtacaactcgctctctggccaacttccgccggagatcggaaacctcgccggcctccagattctcaatgtcgccggtaacaatctctccggcgaaatctccggcgaacttcctctccgtcttaaatacatcgacatttccgcgaattctttctccggcgagattccgagcactgtggcggctctttccgaacttcagcttatcaacttttcctataacaaattctccggccaaattccggcgcgtataggagagcttcagaatctgcaatacctttggctcgatcataacgttcttggaggaaccttaccttcgtctctcgcgaattgttcctcgctcgtgcatttaagcgttgaagggaacgcgctcgccggcgtgttgccggcggcaattgctgctctccctaaccttcaggtgctgtccctcgcgcagaacaatttcaccggggcaattcccgcttccgttttctgtaacgtctcgctcaaaacgccgtcgctccgcatcgttcagttagagtttaatggtttcaccgacttcgcgtggcctcaagccgccacaacgtgtttcagcgttctcgaagttttcaacattcagcgcaatcgcgtgggcggcaagtttccgctgtggttaaccaatgtcaccacgctgtccgtcctcgatgtttccggcaatgcgctctccggcgaaattccgccggaaattggacgcctcgagaaactggaggagttgaagatagccaacaattcattttccggggagattccgccggagatcgtgaaatgcaggtccctgcgtgctgttgtttttgaaggtaacaggttttccggtgaggttccttcgtttttcggtagccttacacggctgaaggttctgtctcttggtgtgaacaatttttctggttctgttccagtgagtattggtgagcttgcgtctcttgaaacgttgagtttaaggggtaataggttgaatggtacaatgccagaggaggtgatgtggttgaagaatttgacaatattagacctcagtggaaacaaattttcgggtcatgtttctggtaaaattgggaacctgagtaaattaatggttctgaatctgagtggcaatggcttccacggagaaattccttctactttggggaatcttttccgtctcgctacacttgacttgagcaaacaaaatctctctggtgaattgccctttgaaatttcaggacttcccagtttgcaagtcattgctcttcaagagaacaagttgtctggggtgatccctgaagggtttagcagcttgaccagtttgaaacacgtgaacctaagctctaacgatttttctgggcatgtccccaagaactatggctttcttcgatcattggttgttctttcactatcccataaccgcatcacaggaatgattcccccggaaattggaaactgctctgacattgaaattctcgagcttggatcaaattacttggagggtccaattcccaaagatctctctagccttgcccatttgaaaatgcttgatttgggtaagaacaatttaactggagctttgcctgaggatatctccaaatgctcatggttaactgttttgttagcagatcacaaccaactctctggtgctataccagagtcattggcagagttatcatacctaacaatactggatctctctgccaacaatttgagtggggaaatcccaagtaatctgaacacaatccctggtttggttaacttcaatgtctcgggtaacaacttagaaggtgagattccagcgatgttgggttctaaattcaacaacccttctgtatttgcaaacaaccagaacctatgtgggaagccattggataaaaaatgcgaggaaacagacagtggggagagaaataggttgatagtgttgatcattatcatcgcagttggaggttgcttattggcactatgttgctgcttctacattttcagcttactaagatggcgcagaaggatcaaagcggcagtgtcaggggagaagaaaaagagtccaagaacgagttccggaacaagccagagccgtagcagcaccgacacaaacggtccaaaactcgtcatgttcaacaccaagatcactctcgcggaaacaatcgaagcaacgaggcaatttgacgaagaaaacgtgctgagcagaacaagacacgggttggtattcaaagcctgctacaacgacggaatggtcttttccattcgcaagctccaagatgggtcattagacgaaaacatgttcagaaaagaagcagagtccttgggcaaaatcaggcaccgaaatttaacagttctcagaggctactacgctggttcaccagatgttagactcttggtatacgattacatgcccaatggaaacctcgcaacgttgctccaagaagcttctcatttagatgggcatgttttgaattggccaatgcgacacctcattgcactaggaattgctcgcggcatagcgtttttgcaccaatcttcacttatccacggtgacatcaaaccccaaaacgtgctttttgatgcagacttcgaagcccatttatcagatttcgggcttgacaagttaacagttaccaacaacaacaacaacaatgcagttgaagcctctacttcaagcacggcttccgttggcacgttgggttacgtgtcaccggaagctactttaaccggggaagccacgaaggagtgtgacgtgtacagcttcggcatcgtgttgctggagcttctaaccgggaagaggcccgtgatgttcacacaggacgaggatattgttaagtgggtgaagaagcagcttcagaaggggcaaattacggagttattagagcctggtttgtttgaacttgacccagagtcttctgaatgggaagagtttctgttgggtgtgaaagtgggcttgctttgcacagcaccggatcctcttgatcgtccaaccatgtctgatattgtgttcatgctcgaaggttgtcgtgttggacccgatattgcttcctccgctgatcccaccacccaaccttctcctgtctaa

SEQ ID NO: 57554 - DNA, 522 bp, Glycine max
  Peptide Sequence Number=SeqID_174332
atggcaattggtaccacagtagcatccatcactgctcctgagaaggaagagagtttgcttgaatgtgcaaagtatgtgggatcatactgtggaaatgaagtgcttgacacattaagtaataaaaagtctaatgtttccacagattgttgttacaagattattcaaaccggttattcttgccacaccaagctcaccctatttgttctccaaaatgattcggagtttaaacatgcaaatgtaaccaacgttctagaaaaaaatgatagaatttttgacatgtgcgacaaggctaccgaaccagaaagaaccgaatgtggagaagaagtgttcgacaacctaaagcataacaaaaacaacgtcactgattgttgttgtggcaggcttgtggaaacgggcttgccttgccacatcaacatggcgaaggctttgattcgcactcctgagatgaggaatgttgatgcaattgagtttctgaacaagggcaagaaattatttgatgagtgtcttgaggatcaggaataa

SEQ ID NO: 57555 - DNA, 346 bp, Glycine max
  Peptide Sequence Number=SeqID_174333
taataatgatgatcgtgacagtggtgttgatgacattggtagtagtggtgatgatgtcaatgtcgatagtggttgttggcaaattggcaatggtgtttgtcgtggttatgttgataacattctcgcagtgctagtggtgatgatggtgttaatagtgacaatctgggagggaagtgatcttggtagcggtgttggaaatcccttagatcttgtggccttctatgttttgagccctggtgtggtggtgcggttgcctgaccaatggggcagggtagcagtgctacaacaatggcaatcagggaggtgggggtgtgcaatggggagaaaggaggttgtgacacactga

SEQ ID NO: 57556 - DNA, 192 bp, Glycine max
  Peptide Sequence Number=SeqID_174334
atggcatcatcaggctcaggaggggtgaactcatcgtccccctctgttgctactgatgttggctgctttagtttaggctcctgggctgcgaaggccccaccctctccagaaggagaaggctgggctccttgccagaccacctgcgcatcgaaatcatccatgctcataatggatggcaagcccaagccctga

SEQ ID NO: 57557 - DNA, 1047 bp, Glycine max
  Peptide Sequence Number=SeqID_174335
atgaccttcttacatggagacttggaggaaaccatttacatgaggcaaccagaaggaggttatctatatctcatgttgtatgtagatgacatcttggtggctagctgcaacaaatgtatgatcaatgacctaaagtcaaggctgcactcagaattcgagatgaaggatcttggggaagctagacgaatccttggtgttgatattaaaagagatcagctgaaaggaactttgctattatcccaacaagcctatatgcagaaagtagtggagaggtttaggatgcatcagtccaaacctatgagcacacctttgtggcaacacatgaagctctcgaaaagccaaggtccaatatcagatgatgataggaagaagatggatgtagttccctacactagtggggttggaagcatcatgtatggaatggtctgtacaagaccaaacttggctcatgttgtgagtgttgtcagcaggttcatggtggaacctggtcaagcacactgggaggctttaaagtggatattgagatatataaatggaactttggactcaggcttactgtatcagaaaaactctcaagatggaacagtgattgaagggtttgtggatgcagattttgcagggtgcttggacacaaggaaatcattgtcaggatatatgtttactttgtttggaactgcagttagctggaaatcaaacctccagtcagttgtagctctatccaccactgaagctgagtataatgccttggctgaaggagtgaaggaaggtatatggctgaaagggatgttgcatgaattggggattgaacaagagactatccagatacattgtgatagccaaagtgctattcatttggccaatcatcatatgtaccatacaaggaccaaacacattgatataaagctttatttcattcatgaagtggtggaatcaggagtaatcaaaattgtgaagattgcatctaaagacaatccagctaatatgttaactaaatccctgccaagggataaatttgagaagtgcttaggcttggtaggatttggctga

SEQ ID NO: 57558 - DNA, 327 bp, Glycine max
  Peptide Sequence Number=SeqID_174336
atggaggtttggagtggaagtccagcaaactactctaacctgagagtgtttggagccttggcatatgagaatgtcaagaaggataagttggatgctcgagctgtaaaatgtctatttcttgggtatgctgaaggagtcaagggatacaggctgtggaggttagatccaaaaccttctaagctcatcatcagcagagatgtgacatttgatgggaatgaaaacactcagataaatccaactactgacctagacagtacagtagaggaaactggacactcagcttcaaatttaaggagatcagatcacgccattaatgattaccaactg

SEQ ID NO: 57559 - DNA, 198 bp, Glycine max
  Peptide Sequence Number=SeqID_174337
atgtatgccaacaacagcaatgtgcttttggttttgggtttcatgatgaaattgtgtgtagaacgtttacgttacatcgttttggtgttggacgtaaacataaacattgatttggttaagatctcatcaaataggcaaaagcatacgggagctgtgttgcagcgaaggttccagacattgagcgtgatatgtgtgtga

SEQ ID NO: 57560 - DNA, 161 bp, Glycine max
  Peptide Sequence Number=SeqID_174338
gttttttcatggaaagttggtccctttgatactctcattgatccaaccactgattcaataagtgaaggccctatcatagctattcggccagaatcagaaagtatacttggattcttttggacagatagtcaacagtgtgatattgttcttgttaagaccag

SEQ ID NO: 57561 - DNA, 210 bp, Glycine max
  Peptide Sequence Number=SeqID_174339
atgaatcctattaaagagatggatgacaagtattggatttgggtgtcattagtgacaaaggcaatggccggtgagggaagccttcaaactaagattgaaaaacaagtaagagaacaaaatggaaaagaaaatgataaaatgaaaatggcaaataagagttcttacatccacatcaaaggatacgtgatggttgtggcaaaggcaacctga

SEQ ID NO: 57562 - DNA, 1167 bp, Glycine max
  Peptide Sequence Number=SeqID_174340
atggagtcatgtatcccaccggggtttcggttccacccaacagatgaagagcttgtgggttactatctgaggaagaaagttgcttctcagaagattgatcttgacgttatcaaagagatcgacctatatcgtattgaaccatgggatctccaagagacatacaggattgggtacgaggagcagaacgagtggtatttctttagccacaaagacaagaaatatccaactgggacaagaaccaacagagccaccatggcaggattttggaaggcgacaggaagagacaaatcagtgtacgaaaggaccaaactcattggcatgagaaagaccctcgttttctacaaaggaagagcccctaatggacaaaaaactgattggatcatgcacgagtataggcttgaaactgttgagaatggacctccacaggtctacgtaacaagcaacatccaatatggccaatattttctaagaggaagaaaactctacagagcaaaaattctttctcctgaggaaggatgggtggtgtgcagagcattcaagaaaagaacaactaacggccaaacgaagactattgaaggatggcatcgaaactgcttatacgatgaacaacaacaagcatgtggtagtgtcagcagcactgtggtggaccctaatattgaccttatgttaaggcaacaacctcagaggttttcaggagctcaaaatttcatgtacaagcaagaagagatcatagaagcagataataataatttgagcttcatgcatgcagaacaacaattggtgcagcttcctcatctagaaagtccttctttgccactagcaaagaaacaaagctcagtagtgtccccaatatcagacaatattaataacaacgaagatgatgataatcctcaaaagggtttatccaacactacaaagaaagtgaccactgattggagagctcttgacaagttcgtggcttctcagttgagccaagaagagaggcatgaaatagaaggggtgtcaagctttgcaactcatcacactactactagctcggacatggcattgctgctactgcagaataatagtagggaaaatgaaaggaacaacaagttcaacccgtttttcaatacaagctcaacaatatcagactgtgacattgggatatgcgtatttgaaaaatga

SEQ ID NO: 57563 - DNA, 342 bp, Glycine max
  Peptide Sequence Number=SeqID_174341
atggagaaagagctacgcgtttggatggaagcagaatcgcgtttggatggaagcggtgatggaggggctatgggggctcgcagagtaccacgagaggggctatgggaaatagggaaagtagtgaagtgcctcgaagccatatgccaaagagatgtgtcgtttttacctgaggtgtacaacttgctcagccagtgttaccatctcgtcgaagctattccactgcaaaaacatgtcttgcacaagggaatcgagctcactgcgtctgttggatacgagtatgaagcagcagctggaactcgccttctaatagatggaaggacttgcttgcttcaggtgaaatga

SEQ ID NO: 57564 - DNA, 498 bp, Glycine max
  Peptide Sequence Number=SeqID_174342
atgcacgccagagctagaatgatgagcgaggtagaggaagttcaagagcagatgaaggccgacatggaggccataaaggaccaaatggccgccatgatggaggccatgttgagtatgaagaaaataatggaaagcaatacggttgtagtttccactaccagcaccgtaaccgaggtggatccgacccacccatctggcataaatcaaataagttgtccaatcccggacgtgggaaatcagggaccccttacttcagccttcccacacctatttatagcaaaacaaggcatttgggataaaggtagttcacccaggcgagctggttacttcattatgaagcaaccctgctcgcccagaaaaaagggtgtggatgaccatgatggtctccgcatgccatcagacttgattgcctctggatggaaaaggaagcggatgaccataatttgtttctgtgtgccaacggacttgcatatctctggaaggcaaatgagactttaa

SEQ ID NO: 57565 - DNA, 333 bp, Glycine max
  Peptide Sequence Number=SeqID_174343
atgcgaacatgctttagtaaagagacaaaacttccaactgatcagagcaacatatgctttttggatgaaaaacaatgtgtctatcggggaaggagaggattgacattctcaccctgggtcaaggtttatggtaagttgggattttggctcaaggcttgtagaacggctggtcatgatatatgtcagggtttggccagcggtttggggataaaggagctctacactggagcaatgagaggcaccatgcataagcctcaagcgaacctaggggcagatgaaaatttctcacccaataggttgaaaacccggaagggtggcctaagcaaaaattaa

SEQ ID NO: 57566 - DNA, 204 bp, Glycine max
  Peptide Sequence Number=SeqID_174344
atggcgggcccggtcatcagcctaggtggtaggggtgcatacatagagaaaggggatgtactatatcgacagcaaaattctaaggagagaagaagggagaaaggcaaagatgaaagggaaggaatgagaggatacctgcagactcttcctccttctttgactgcagtgccaaacgaaacttgtcctgatagaattagggtctga

SEQ ID NO: 57567 - DNA, 183 bp, Glycine max
  Peptide Sequence Number=SeqID_174345
atgtttgcggggatgaaaattctgatgaccaatacttcaacaccttatcataaaggaggtatgatgaatgcatcagggcatacattaccatggtgcccaatgcatgcaactaagaaggtgatgcagactttccagcttctcatgacgaagatgatgaaaacaaatgcaagacatgagcaatga

SEQ ID NO: 57568 - DNA, 213 bp, Glycine max
  Peptide Sequence Number=SeqID_174346
atggggcagttgcaccaagtgctcgactcagttcttgacgatgatgactttgtcaccgtagtcgtggagcttgctttatggtgtgttgcggtagataaggacgaccatccggacgtgagggaattagtggaggagctgaagtgggtagcgagtacacatggtaccacacgtcgcagacctacatgtctagttaacggtcacataagcatataa

SEQ ID NO: 57569 - DNA, 339 bp, Glycine max
  Peptide Sequence Number=SeqID_174347
atgtgtggggtctcgcttctggtgtttctgcttctgctatccctttgcgttgaagcttctgttcacgactacaaaggggagaaatttgctgccaaatttgtcgcccatggaggcatcaaaggaatttatgcttttgttcccaacctcagtgatgcttatccactgccaaatctcgactcttacatacgaatggcagtggtgactaaaattagaaggagtaaggaggcaaacaaggaggaactcttcgaggaagccgagaatgtctatctggcaggtggaggaggactagttagtgttggagggggagtggtggttggtggaactgtagtcacaaagtag

SEQ ID NO: 57570 - DNA, 711 bp, Glycine max
  Peptide Sequence Number=SeqID_174348
atgataaaagtgagagctagactttcaaatccgctgcctaaaacacaggctgtcaaaggtggtatgagtggtgggttccgaataagtcatgctaggagtggagccttttcaagaccaggaagggggtttgggcggggaagacagcccttcaacaacaggggaaatttcaacaggggcaggagtttctatcgcggtggacacagtcaaattggaagaatgggttttcgggatgaccatgattttagtatgcatccggatttccgtcaaaggcaatttggtccacaaggagctgtgaggggtggacattatgcaggtagccgaggtgctgcatttgcgggaccatctagaccttatcatgatagagcatggtacggtatccctgatggaggccctagtgagcctattcctccaaggaggccctactccccaggtggacagtttgacatgccttttatgggaaggcattttgatgatccatatctatacgatgacaatatgcaaggaatgaaacggccattttatatgactgaccctgagcctgattacatggggcctactagactacgtcctcgattggattatgcagatccacctatatttcctggaactcatcaccatgattcttttggggctggcagcagacagtacccgccggactattacggttctgatgtggatctggaattgtgggatagacatcttcaaatataa

SEQ ID NO: 57571 - DNA, 2006 bp, Glycine max
  Peptide Sequence Number=SeqID_174349
tggagcaggaatcgttaggcagtgctagcagtgcaaaatttgtgaaaaagaagactccggggagaccgagaagtaaagcaattgatactccaaattcggaagagcaatgtgaggcagtaactgatgaaactctgattgaagatgatactgaggtggtagagaaagtggaagatgttggagtggttggtgcaggtagtgttgagggtgagaaggaggggggacaaggtgttgggtctgttggattatctgacgagacggaaggtaagtcgatggaagtgaatgaacctgttgttgaaaaggtttgcgaattggtggaaaagggaaatgatgtaatggaagttgaagtagctgcttcccaggatgcttctgtttctttcaagcgactggggcgacccattgtggatctcaatatatctgcggataatgaagattgtactggtgaaaaggagggagaaaaaggaaaggaagagttgaaagatcaagagggggaccaagggaaggaagagttgaaagaacaggaaggagagaaagggaaggaagagttgagagaactggatgcagagaaagggaaggaagagttgagagaactggatgcagagaaagcaaaggaagagttgaaagaactggatggagagaaaggtaaggaagaattgaaagaactggatggagagaaaggtaaggaagaattgaaagaactggatggagagaaaggtaaggaagaattgaaagaactggatggagagaaaggtaaggaagagttgacagaactggaaggacagaaaggtaaggaagagttaacagaactggaagggcagaaaggtaagggagagttgacagaactggagggacagaaaggaaaggttgagttgaaagaacaggaaggagacaaaggaaaggaaaagttgaaagtgcaggagctggagaaagcaaagggagaggaaacatacctttctggacataaagagaacaccaagtcttttggtgtagaagttaaagcccagatgcaaaaagaagatgctaatcccattaaagatgatggtgaaggactacagagttgtgaaaagtacgatcttggagaacaagggaaggtggaacttgttgaagaggatcctgaggaacctccagaagaaactttggcattggaggaggaacatagggaattggaggctattgcaaatcagcgaaagattaaaaaagaacatgaaatttttgttggtggattggatcgtgatgctacagaggaggatctgagaaaggtttttcagaggattggggagatagttgaagtcaggttgcataagaattcttcaacaaataaaaacaagggctatgctttcgtgaagtttgctaataaggagaatgcaaagaaagctttgtctgaaatgaagaaccctgtcatacatggtaagcggtgtggcactgcacctagtgaggataatgacacattattcttgggaaatatttgcaatacttggaccaaagaagctgattatggcattgaaggtgttgaaagcattacacttgttccagatgttcagcatgagggcttgagccggggctttgcattcctagagttttcttgtcatgctgacgccatgcttgcatttaagaggctacaaaagcctgatgttatctttggccatgctgagcgaacagctaaggtagcctttgctgaacccatacatgaaccagacccagagataatggcacaggtgaagtctgtgtttattaatggtctccctccacattgggacgaggatcatgtgagggagctgtttaaagcatatggtgaaattgtaagaattgtgctagcacggaatatgtcttcagctaagaggaaggattatggatttgttgatttttctacacatgaagctgctgtagcttgtgttgatggcgtaaataaatcagaattgggtgatggggcatcaaagaattattctcttctttccattgctttcccttctgccggttttcagcaatgtaagaagagtggaatcctataa

SEQ ID NO: 57572 - DNA, 225 bp, Glycine max
  Peptide Sequence Number=SeqID_174350
atgaatgagttctttgagagattcctcagacttgaggagtggatcttagacaaggcaaggcctaccttgattcctgaagctacaactatgcaacatgagccaccaccacctctaagagctaccaccatgccttcctcatcagaaaactcctctcctaccaagcttgaaagatttgtcatctttgttcctcccttctatttttttcttgatgacacatggggataa

SEQ ID NO: 57573 - DNA, 888 bp, Glycine max
  Peptide Sequence Number=SeqID_174351
atgacatatgcctatgtgagagtcttgaatatcttgcttatctacaccatgttgcctgatgatgtttttatagtagttggctcactttggcctagatgccaaagatgtcttgttgagattgggtatttaatgcaagaggcattccactcgacacatgatactgaccaagataatggaattgatgcaatcattggcttatcatgtgtaaaagacaatagtgaaactgatggaattacaggtcctgatagagtggttgccttatcagtcagaaaagaaaagaaagaggtcagaaatgaggttcctactattttctctgacaaggcattgaaggagaagtttgacataatctactcaaggttggtgaaggccttctttgttgttactgaggtggataacaacaacttcacattgaaggctacattaaagggaactaagattttgatcttagaacaactcttggaagacttcaagtctaagtctttgacttcttttggaaggattgtccactgtattaacatgcttctagtgttgcaatgggctggtaacttccaagagactaccaagcctatcaagtctacctccaatgttccttatgggatgctgatgaccttgatttttagacactttagagtgtatatggaggatgaaccctttttttttatcattaatcacatgattaaggctaccaagcctatcaagtttatcaagcctagatatgatgatgttttttcttggggagccaatgatgttgctgctttgaggttaaaccctcaaccaaggatggagaccacttgcacttgttctaatgaagaggatgctcagaacaaggagaaaaaaaaagaaagagaaaaaggagaagaagtagagatcctcaccccttctcactaa

SEQ ID NO: 57574 - DNA, 640 bp, Glycine max
  Peptide Sequence Number=SeqID_174352
tagtagcaaagagaccaatcagatgttgacacgcggtgcaaacagagctagggcttttggtttcagaatccacaacgaatgtgagccgcacgatgcggctctaatggacgtctcagatctagcgcgagtgaccggagcggcgaagatagagtcagatcggaagcggaagaaggcgtcgacctcggcggcggagaaggagaaccggaataagcataagaagtcgaagatgtcgtcgtcgtcgtcgaagggtggtggcggtattgaggttagggcttcgcacatattgataaagcacgaaggttctagaaggaaggcctcgtggaaggatcctgaaggtcgcatcatcaagagcacaaccagagaaaacgcggtttctcagctcaaggccctccgcgacgacatcgtttcgggcaaggcctccttcgaggacatcgcctctcgcttctccgattgcagctccgccaagcgcgggggtgatctcgcatcactgaactgtggacgtgtcacacttgaaggtccttttggtcgtggccagatgcagaagccttttgaagaagcaacttttgctcttaaagttggtgaaattagtgacattgtggatactgacagtggagtccacattattaagagaacaaaatga

SEQ ID NO: 57575 - DNA, 534 bp, Glycine max
  Peptide Sequence Number=SeqID_174353
atgacgccaattgctcctggttgggcaagtgaaactcgacctacacttagactagatggttctcttggtggactattacatcgagtcatcgacaagcagccattgttgcgcactcttcttctcacttctctcttcggtgccatattttctttggttccttggcaacggttaggttcgatgaaggtgaaggtagcggtgttcagtattgcagtggtcatcgtcggcggcatacaaggtgtacggttgatcgtgcggatcaagttgatccgtaaagcaccaccaccacaccgccaaacgccagttgaggagaacgcgcgaggaagaagcagagcagagcagcacaacagcaccaccaccacgccgccaacaatggtgaagaagcaacccacgtcaccgacaccaacagtccactcgaggtcgcggaatcgcgcagaagaagaagaagtctggtcacggcagaaggaagaagaaacggcatggaagaagaagaagaagaagaaacggctgggcgctaggtgtagagtttttaaataa

SEQ ID NO: 57576 - DNA, 204 bp, Glycine max
  Peptide Sequence Number=SeqID_174354
atggtagttattaaagtctggtctgctcttgagatggaacctgcactccttcccacatcttgtgcaatgcaggaactcatccctatgaaagttgtgtttcctcattgcagagtctttccgaggtgtcttccagagtggaactttgtcttcgttttcacaatgaacccagatgtttctcttccaccttccactcccttcccttaa

SEQ ID NO: 57577 - DNA, 477 bp, Glycine max
  Peptide Sequence Number=SeqID_174355
atggcagaaccatcgaaaaagcgaaaaggaacctcgagtcggagtcagcaacattctgggtcacaggaagccccaattcctccctccattccctctggatcattattttcatcagaggaacagcgtacacggtacacaaacctcttttcctctcgttccattgtagacccaaaattcatagatatggagttcttctctaatgagaattttgaatgcttccaagcatttgaaaacttcaatcttattccatttatgtctctgaaattacctgtctactctgaattagtcaaagccttttattctaatttagaaatccatgaaggtactctaaactctgaagtttatgggatcaagatggtcattgaccaatccctattttatgatttaaccaaattgcctagtgaaggtgtgccttttgagggtgcactgatttatgactggaaattcgatttctctgtgcctgatgcccgccggttg

SEQ ID NO: 57578 - DNA, 588 bp, Glycine max
  Peptide Sequence Number=SeqID_174356
atggcagttccagcagagaggaaccacaaccatttctcagttttgatcgtactctttcttttcctcgtccacaatgctctctgcattaggttcccggatcggatcgcccaacccgccctcgacccgctcgaccaacaccgcctgcgggtcgccgtcttcgccctcggaagcttctggagatccgaagcggtgttcggttgtttaccgggcgttgttcgcaccaccgtcggctacgccggcggatccaagtccaaccccgaataccgaagcctcggtgaccacgccgagtccgttaagttaatggcagaagaagaagggaatggaggagaggttgagtatgatccgcagctgattagctttagggaactcctggatgtcttttggtcaagtcacgatcctaggcaagtgtatggccaaggtcctgatgtgggtagtcagtacagatctattatttttgttaatggaaccgaagaatcaagaatggctgctgtcagcaaagaacaggaacaaaccctgtcaagaagcagcattgtgactacacaaattctgcaacttggaacattttaccctgcagagccagagcaccag

SEQ ID NO: 57579 - DNA, 1239 bp, Glycine max
  Peptide Sequence Number=SeqID_174357
atggtgatatgtgttgggaattctcaccatcaagtggtgcttcaagcatgtggaaagataaaatttgtgaaagtgcttattgataatatttatgcactgtgtgataatgagaacaagaagagactttgggaagaattgaaagctatcaaggctagtagtatggtgtgctcatgttgcatactaggaaaaggtggtattggtggtggaaatggggatatgagaatgtttaatgcattgatcagtgaaatgaagttggaaggcataccattggtggggaggaaatttacttggtataaatctaatggaacgatgagaagtagaattgatagagtcctagccacaagggattggcttgagtcttggcctcaatgtgctcaatgggtccttgatagaaatgtctcgaatcattgtcccattgtggagagattcaccgaagggggaggaagaaggccaaaactagatggtgttaaatttaataccattgatgatcatgacaatgctagcctaccaggtacatttgaggaagaggaagtcaaggaagcagagttttggagcatactaaaaagtgacttcatgcaattcctaacgaagttccatcaaaatggagtcttccctcaaggtagcattgcttctttctacacgttaatttcaaagggggagaatcctcaaaacctaggtctaagacgaggggacccaatgactccatttttattcaactttgtggcggaggggttatatggcatgatgagggaggcaattgagaaggaactatatacgagttacttggtgggtgatgatagtgttcaagtaaatttctttaaaagccattttggggatattggagtggacaaagatacttgggagagaggtctaggcattaaggatctttttgcttttagcaattcacttcttgcaaaatggagatggggtcctttggagggcgagggtgagctttgggatctaagaaggatatgtgatgtgaaatgtgtggaaaagtggttcgacaacatgtgtgagtggaggatgggaaatggtgagagaataagattttggcaagacacatggattgggggatcaacctttggaaaaatcatttccaagattattcctcaattggttgcaaaaacaggtgactttgagaaggcttggttcgcttgggaggaaatccatgtgacacttatgcgtgagagtttggatttggtaaggttaaggaaggatgtatctgataagtggttctag

SEQ ID NO: 57580 - DNA, 1299 bp, Glycine max
  Peptide Sequence Number=SeqID_174358
atggcggcaccaccacctcctcctccttcgacgccgtcgtttttgtcgccgacgcagaggtacgcggcgggcgcattgttcggcctggcacttcacgaggcccacctcaaccaaaccaacccgttaccgttacccgcttcggaggactcgctctctgaggaacaacgaaccagcagtagcagtggctccagcagcgactccgtttcggaagacccggatctttgggtccacagcaattcgggtttgctccgccccgtttttaagtttctagatattgattccgctgcgtggtctggactggaggaaaccgctggttcttcttccgctacgcatcatgtgggacccttcttgagattactttcgcaagaattggatgatggttcttctcaaaggttagatcaagaacgtgctttgtcaagtgcggttgatggtatagcacttgacatgcggagaaactcagagtcttccgagtctaaaagagagaagcttcgcgaatatgagcatcaatgtcgtgagaagttttcaattgatgatgttcagcctcactgtgaaaaggtggatgcacatttggaagttcagaaggagatggatgctgctcctttacttgactgtaaagagacacagcagggatctgttgattggaaaattgatgagagaccgattgaggaagtaaggatgctgagcgatcagaggaaggtgacagttctgtatgaacttctgtctggttgtctatcaaatttaggtgaagatgtcgggcggagaaggaagggctatgatgctcggcatcgtgtggctctgcggttgctggcaacatggcttgatgtcaagtggacaaaaatggaggccattgagaccatggttgcttgttctgcgatggctttgattaaagagaaagaatcgaagaacgaagaaactcaatcaaaagaaagcaagtgggctaaattgaagcggggtggtataattggtgctgctgcattaactgggggaactttgttggctattactggtgggttagctgcaccagccattgctgcaggtcttggtgctttagctccaactttgggtactctgatccctgtaattggtgcaagtgggtttgctgcagctgctagtgctgcaggaactgttgctggttctgttgctgttgctgcatcatttggagctgctggagctggacttactggaagcaaaatggctaggagagttgggggtgttgatgagtttgaattcaaggctataggagaaaaccataaccaaggcgtaggttttgatatctttcacatccctgttttcttgtga

SEQ ID NO: 57581 - DNA, 306 bp, Glycine max
  Peptide Sequence Number=SeqID_174359
atgttccttgacctaaagctagttaaaggaggaacaatttcctttagaggcatgggtaagggaaagattaatggaatagaagttgccactactcctaaagacatggaccttgctgaaagggaagcttttgaagaagccatgcttcagtcaatcattgaagcatctcttgtggaagcaaacgaggatatcattgagacagatcctagagctactcttatttgtcctaggccaatgtctgatgttgatgaacaactctttgctgctcaatttgatacaacaaatgaatacaagcttagatggttataa

SEQ ID NO: 57582 - DNA, 270 bp, Glycine max
  Peptide Sequence Number=SeqID_174360
atggatctcatttgtgccctcaatgttgttcttcctttggatcacaccaagtttggagagacgtttcagatagaggagattgtcttagagtacaccatgaagaggttttacagactaaaagaatgttactctggtctacggcctgatgagaagccacctctggatgcagttcaccatgaaatttggggatgctatcagaccacgaaccacacttgcttcactcaagaaacttctttcaacatggtttgggatccgaatcctctctcgtaa

SEQ ID NO: 57583 - DNA, 366 bp, Glycine max
  Peptide Sequence Number=SeqID_174361
atggatcctatcattgaagaagtcaaatctaatgttgaggctgaagctgcttctgattccatggttgtccaagtgtatgatcctccatcctctcgcacttatgttagtttgcttgaagctgaacttgccagaacaagaaaagctcttgctcaagccttgaaggatcatgctcatgctaaaaaggaggcttgcagatggttcatgattagggactacttctataagatcactggctggaaacctcctagtcctcctacgcccccaagtagccctattcatctctcatatgattttgatgactccgatgatgagtttcttaagaagcttgatgaaaaagttgtcaaacaaaagggagagaaaaagtaa

SEQ ID NO: 57584 - DNA, 249 bp, Glycine max
  Peptide Sequence Number=SeqID_174362
atggtcgtttcctctcaacgcaccaacatcatcaagcaagatgcttttgctaacactggaaggagcacaccactaccaacacccattgtgtcttcaacgaagacaaatcaaggcctagaattactctcaatccctaggcatgaagaggagtgcaaaaaagtgtggcaaactcaagttcgtatcgccctgagttggattatgaagccattgactcttgattccctacttatgagaacacatatcccatag

SEQ ID NO: 57585 - DNA, 795 bp, Glycine max
  Peptide Sequence Number=SeqID_174363
atgaatgggaaagaagcatgggatttcatcaaggattttgacaaaagtgagctaaataatcttttatttgatgagttcaatgtcaattacaatgcactagagtcgatattccgccaagggtcttatgttctgaagataatcgttgaagatattgtgaagcacacaaataatgatgttccaattaaaaggcgcagaaggttttctgagatacatgaatttgtgaagccaaatgatgatagaactcttaacttgatgaatttgtgtgcagtcgttgtcttagaaaagttttgggaggatatagtctttgcctatggggttagtgatgagtatagctttattcttaagaaggccactaatctttatcaaaggagagctaatacaataatttcagctattgtgtctttcttcacatccacttatgtgatgagatggaaaaacttcttcccacaaagtgagttaaagaacccttcttcctttgatggacgagcgttgtgcaattcatctactgagattctacgggactacctttcatggagacaagtggattgccacatcaacaatcattataactcttgtttctggaagttagttgcatctagaaaaagcaaaaggaaagcccaaaatagtttaaagggtgctcagttggaaaagaaaattgaggaattggctattgactacaataatttaccagtcataatgcttgtatccctttacatcccccttccaatgagcgagtttgattacaccattgccccatgcaacaacaggtacctagctaattctaaagaagtctaa

SEQ ID NO: 57586 - DNA, 264 bp, Glycine max
  Peptide Sequence Number=SeqID_174364
atggtggtggtggcagaggcgttgctggttttcgccattgatcaggataactatgaactccttctctttgggtgcatcaaagaggatttggggttcaaaaatggtaaacctctggcagcaggatatgtgagacaacttccacaatatccaaggcaacaatttgttgctagatttccaagcatgtctcctggtgttgttgatttgttagagaagatgcttgtccttgatccaaataggcgcatcacagttgtaactgaaatctga

SEQ ID NO: 57587 - DNA, 288 bp, Glycine max
  Peptide Sequence Number=SeqID_174365
atggcgagtttccctgcaacgcgccagtgggaatggcgagttcctttaaaggatgaagaaggacagcctctgggagtcagtatttcaaatcttttaattgcgaactctagcagtgatttacctgtcattgatcttacaagagtgtcacaggagcttgcttaccttgccagcgatgcagaacttgtcatcttagaagggatgggaagttcttccttgtactccctcttacctacttataataagatcctttttaaaaatttgtatgtggctttttataagattttttaa

SEQ ID NO: 57588 - DNA, 1053 bp, Glycine max
  Peptide Sequence Number=SeqID_174366
atgtcatcttcgtcgtcatgttcatcaaatatacaaattaagtctggtccaatagatgatgacgttttatggatgcaagctaagcatgtttcagagcatgcttggaatgaggaagaagacagaaaattacacatcagacgagttgtccccatttgtcaaggtcaagaagaaatactagaggaaattattcctctacttcggcaatctggtctgcgtgttgatgaggcaccattaattggtccaacaaatcttggttgggctgatttatgtgaagaattgttaagagtcaaaccacaggaagggatccttagattcataggaggtgtcctatttgttgacaaaagtagtaacaaagtttccctaaggtacctgcaatttttacgtgactttggacagtgcagcacgtatgcatggggacctgctgtgcttgcttttttatatatagagatgtgcagcaccaccgtttacaaaactaaatcaatcggagtttctgtgggagtcttacacaacaactgttatgtcagcgttgcctccaatttctttggttggaattgtagcgtggagggcctattgagttttaactccgactacatggtctggtataggcgaaaaacgaagatgtttatcgacccaaagaatgcaaacacaactacatcggctgaagttgcagagacattacagtatatggtgtcaccacaagggaggaacacatggacaattgatgatctcgtgccttatgtggagaatataacgattttatctaaagagcaagagagaatcactgaggctgaggctattgaagcggaagaattttcccaacaaatggaggagcgtggccatggaatgtattacacgccaccaacattttctcagtatccttcacagatatatcagtatcctttcgaaggtcatcacactgatatgtctgcaagcgaacattcactcggtggtgttgcaaaaacacatcctcatttttcatggccgactatgaccccttcacaacaacatgatgccccaattgcaacacctaacgccccattagctccgcaatag

SEQ ID NO: 57589 - DNA, 363 bp, Glycine max
  Peptide Sequence Number=SeqID_174367
atggagcaagaacccatggaagaaggcaactttaacatgtataaagagatacaagttatcatattttttgataactctggtgcagatatcattttgggtattatgccatttgcaagagaagtacttcggcctaggagtcaggttgtattggctgctaatgacttaccatccatcaatgatgtgacttgttctgagctagttgaaattatatcaaagccggtcaaactggcaagttccaagcacaggaggcgtaggctctcagccattcaggcttttcagttggcaggcgctttttcagttggcaggctaaagggaagtagccactggcattggcgagttaggctaaattggagtagccactga

SEQ ID NO: 57590 - DNA, 197 bp, Glycine max
  Peptide Sequence Number=SeqID_174368
atgtcatcgttgaatatgcgaaaaggatttgaaggccaaaggataaagagggaaatatccaccttgaagttgctgaagcatccgaacgtggttagattatacgagaggaacttagatcaattggaagacttactcaagaaggttaaattgaagaccataaggactgaaccaccttctgcatctattgctggcacaag

SEQ ID NO: 57591 - DNA, 231 bp, Glycine max
  Peptide Sequence Number=SeqID_174369
atgagtcaaccattttatcttatctcgctttactatggcataatggtggtgacgatggtgacagtggtggtggaaagtgacaacgaagacgacaataatgatggaagcgatagtaatggcaataacagtgatggaatggtgatggtgccaataacaatggtgaggagtagaatagtggtaacggagacgacaacaatgatggaagcagcgacgatggtggtggtggtatga

SEQ ID NO: 57592 - DNA, 240 bp, Glycine max
  Peptide Sequence Number=SeqID_174370
atgcattatgtggcctattgggctctcaaagaaagcccattaggtcaaaaggggacaacagtgcataaaaacggaaaaaaaggaagttttccggttaagctcgtgccaccactacgatgcctcttttgtgccgccaccaccatcctcgtggcggcctttcgtcacgatgtcatgcaccagtggcgttggggaggcgtgccacccttcgtggtggcttctcctattgcggtgctgttttga

SEQ ID NO: 57593 - DNA, 282 bp, Glycine max
  Peptide Sequence Number=SeqID_174371
atggttcctcctttggccgaaactctcaaaatgaatgttgatggcagctgcttatacccttctctaaacattggcactggaggggatgctttgaaggctgaaacgttggctctttgtcatggcttgcagttagcatggaataatgttgttagcaatctttgtttggaatctgataatcttcaacttgttgaaattataaattccaaagtttatcttcctttccacctatatgattctctcttgttggtgattctagactacatagagggacgtccctcgtga

SEQ ID NO: 57594 - DNA, 798 bp, Glycine max
  Peptide Sequence Number=SeqID_174372
atgtatcagattttcaggatactttaccaccaagaccaagaaactgtccccgagaaattgaaagaactcatttttgaacacattcgggagaagtctaagggtgcaaaacacattaaggcatgtaaaaacttttgcgctcacaggggtgatcaagttcttaacaaatggaagtgccgttccattgcctggagcactgaggtggagtttgatcaaagccttctgatttggcatattgctacagatctttgttgttattcagataaagattgtgacaagctcaaaaattatgaaataagcagattgatgtcagattatatgttatatctccttgttaaatgtccttttatgttacccaacggaataggacagatcagatttgaagacacgtgtgccgaggcgagtgaacttttgcaagaaaggaagtacatatcgcaaacagatcaagtttgcgaagtgattggtggagtgagtgtagatgaaaagttcctaccgtcaaaggttaaaggagatagaagcaagtctgtgctgtttgatgcatgtaggcttgcaaagtcgataaagtctttagaagaggaaaagaaatggtcgaaagaacagaaatgggaaatgataagtcgtgtttgggtggagatgttgtgtcatgcagcaagccagtgtagagggtttcatcatgccaagcagcttagcagaggtggcgaattgcttacccatgtctggtttttaatggctcatttaggtataactgaacagtttcagatttcacaaggtcacgcaagggcaaagttgatacacagctaa

SEQ ID NO: 57595 - DNA, 506 bp, Glycine max
  Peptide Sequence Number=SeqID_174373
gccacttgtctaacaagaatgtagaaatataccatacggagttggatgagttcaaggctgaattggagaggcgtaacttccataagcgcctcaccaatttagttgacagcagcatcgacctagccttggtgaaggagttctatgccaacctctatagccctgaagggccttcaccaaaacaaggagaatccttacccgcttactctagatactgcaagatgcccactgatatcagagagattgaggttgctttgtgtatactcggtcgagggtttgttttaaatgctgaaggccatcctgggaagatcctcaggaaagatctaacaactcttgctcaggtttggagtgttctctcatactccaacctggctccgacttcccacacctcggatttgactctagatagagctaggttaatctttggcctagtctctcaactggacatgaatgtaggagctctcatctctggccagatcacatctatggcccagtctaactcctcttaa

SEQ ID NO: 57596 - DNA, 558 bp, Glycine max
  Peptide Sequence Number=SeqID_174374
atgttcgagcagtatgcgctgttcgagcagtaccagcaacgattaagtgcattagtgggagcagcgcaggctcagcgaatcgtgaatggggcactgttcctcatgacacttggtggtaacgatttcgttaacaactactttctcactcctgtgtctgccaggtctcgccaattcactgtccctcagtactgtcgttaccttatctccgagtatcgtaaaattctcatggtgtcggacactgacatggacgcgtgtcaaacaccggaatcgacaaggagttggagtaggttgtatgagttgggagctagaagggttcttgtgaccggaactggtccattgggctgtgttcctgctcagcttgctactaggagtagtaacggagagtgtgtacctgagttacaacaagctgcacaaattttcaacccacttttggtccaaatgacaagagaaatcaactcccaagtgggctctgacgtatttgttgctgtcaatgccttccaaatgaacatgaacttcatcaccgaccctcaaagatttggtctctcaacatttgcttga

SEQ ID NO: 57597 - DNA, 243 bp, Glycine max
  Peptide Sequence Number=SeqID_174375
atggcttccatgatggaagccatgttagggatgaagagagtgcctactcctacggcttacccccaactttaccccacaaccttgcatgataacatggatcatgcccctcctgttgctttcgaagggcagcctccccaacccatcgggggcaccaatgaaaatgctcgggagcgcacccacggggacgccgactcctatccccctttcaccaccaagggaccggtgcccaacacactaccttag

SEQ ID NO: 57598 - DNA, 426 bp, Glycine max
  Peptide Sequence Number=SeqID_174376
atggagctggtgacgatgtcaagaacaagagtggtcctcatgaccctcaccctggtggtggtgacagttctgaacaacacagagagtgcagaaagtgctcgcactttctatgtgttcggggactctctagttgacagtggcaacaacaattacttgccaaccacagcacgcgctgactctcctccttacggcatcgactatcccaccggtcgccccactggtcgcttctccaatggctacaacctccctgaccttatcagccagcatattgggtctgaacccacgttaccatacttgagccctgaactcaccggacaaaagctattagttggggccaatttcgcttccgcggggataggaatccttaacgacactggcatccaatttgtaactttccccctcctttccctctatctatatgtataa

SEQ ID NO: 57599 - DNA, 543 bp, Glycine max
  Peptide Sequence Number=SeqID_174377
ggtacatctacttggattgttgtaactgagaacaagagagggtacatctcttgtggatcagttcaagtggaggatacatccacttggttgttcaaagagaacaagggagggtacatcccttgtggatctttgcttgtaaaagattttacaaggttgaaagaaatctcaagaactggtagttgcttggggactggatgtaggcacggattgttgctgaaccaggcgaggcattgttcgattgagtgtcgcggggttcctccatggtacgcgcaggttactttggggttataccacttcggaaagagagactggcaaatctttcctggggtcaccaccgccatgtggttggcaagcagtgatggcaagaggtccccgtatgacatggggatcggggaaaactccggagccctcattaccggagggccccttggtgatggtgtgggcgcccttagttggatgagtgctgaaggggcagagcttccagcgcgggccaaaaagctcagttgttctgaccctcctattgttggtgccggtgggagagac

SEQ ID NO: 57600 - DNA, 570 bp, Glycine max
  Peptide Sequence Number=SeqID_174378
atggctgctgcttgtgttttgtatcccactcaaacttggaatgtttattttcatatagtactatggaagctcaagtacactatactcgtggcagtgcttcttcttctggaagcttctctggtgggattcattgcacttgatagtgattgggaaaaggatattccactcgatccaaccggtcaacttgacgagcttcgagctttcattgaagataatatagatatctgcacatgggttggcattgctgtgcttgtggttcaggcattatctctactactggcattaattttgcgagccacagtttctgctaggagagcagattttgattatgaagatggatatgatgttaggggtagaagttgggagcccctactgaatcctcaacctggccaaccatctgggtctagcaaaggtgataatagtggaaatcactctgatttttggagctcgcggatgagacagaagattaccgttgagcatgctgctaccaaccatgaattcgaggcgatgagtgctactatactagtcatcaagcaattcaatgctgtgctgacatctgagtacatgtga

SEQ ID NO: 57601 - DNA, 1548 bp, Glycine max
  Peptide Sequence Number=SeqID_174379
atgatgacatcagataataagggtcatcaagaacaaaggcaagcaaggaaaagctctaccttgggtgagatgctttctcttacccacaaaaagaaatctgtaacatctgaggttgagagtatcaatgaggaccaagaacctggcaaatctgtttcttgtagtcattctttcaatgcagaaataagcattgagggttctcctaaaaatctccccaggtcaaattctgtgcctgcatcttctactgtatatgaaaatggcctcacagttaaagtaaatgatcataagaatactggcaaagcacaaggctccaaggagcagaaaaagcctaagagtatgagatcatcttttaaagggaaagttgctactttcttgttctcaaggagtaagaaatcaaccaaggaaaaaccaagttcatctcaatctaaagatgcatcccaatctacttccactgtcactgcaacattagttcttccagcaaattcacctggagtccttaggggtgatgtgtctcaaagcatcaatgtggatggttttgaagagtgttctcttgcagcgctatgtgaatcatcagggaaaaattcaacagattcagtctctaacggacatgaagaagacatgattacactagagcctggattgactatgccaaggcccatggtgccagagattcattcaagcgaaaacccagatcagccaagtccaatctcagtgttacaacctccatttgaagattataataataataatgcatcacatgagtccttgaactgtatgaagagtggtgaccaggggtcacaggtgccactgaagtccaatttaattgacaaatcaccacctatagaatcaatagctaggaccctatcatgggatggttctagtgcagaagtggcaagttcctatgcattaaaacccttaatggtttcttccttggactccaaggtagaggatcaagagtggcttctcttggtccacaaactactatcagcagctggacttgatgatcaacaccaacatgactcatcttacactagatggcattcccttgagagcccattggacccatcactgagggacgcattatacgccaatctaaatgagaaggagcctcagccaattatgcatgagcgcagaagaaggaagatgagatcaaaccacaaacttgtgtttgactatgtcaatgctgcactattggaacttgttggttatgggtcagaaaagtgcttaaagagaagtaagagccactacagggtccaagtccaagagggtgcatcagcagcagcatctcccttattggtggaccacattgtggcccaaatgaaggaattaatagcaagtggggtgaggtgtgagtgggaaaatggtggggccagcaccagcctggtggtagaaaatgttgtcagaaaagaggttgtgcaaatagggtgggttgagcttatggaattggagattgatattttggggaaggagattgaaggggacttgattcaagagcttgtggagaatgcagtggttgatttgacaggcagggcctctgagtccctctcttga

SEQ ID NO: 57602 - DNA, 1452 bp, Glycine max
  Peptide Sequence Number=SeqID_174380
gatttggattctggtgcagatacaggtccaaaaacttctgagtttgctttctttaagaaattgaagaaggatgcaagcgccggatttcgttcacgcccaatgcaaaaggattctcgcctgtcatctaagaagcctgaatccagtggctattccagggagaagaatggtgatatcagggttggcatcaagggtgacacctcttcaaggatcattgagcacgtatcaactgtaaggacagactcatttttctcaccttctgttgaagcttggaataaatcagacacagagaagctctgttcaaaagggctcctcagtcggctgttccctatgggcactgaggcaaataaatatgtggatacacatccaggaaaattagggaatgctacaagatatgatttacccgattctcaagagacagatgatcaatttaaggagcactatcagatacctaaaaggaaacttcttgaactagaatcaagtccatacttaagcaatgatatgccgtctcctatgtttctcagattagatgagagaattaatctgcactcggagtttccaaccaatcattctcacaattttccacctctttacagtataacagaacctgagtgcaaactaagtgcaactccaagtttcagtgccacagccaagagtggtgtaactcttgaatctctgtttagcaaagcagcaaatgctaccagatatggtttacatgattctcaggagttagatgttcaatttgcagaacaccatctgatacctaagaggaaacttcttgaacatgaatcaagttcatccttcagtgatcatttgttgtctcctgtgtttctccaatcagttgagataatgaatccacatgttgactttccaacttatccactcaagtttcaacctctgttcagtatgacagaagctaaaagcaatttcggtggaattccaagtttcattgacaagggttatgtaactcgagaatttctgagtaataatcaagagcatgaaatccttgcactgaatcatttcaaagagctggggaaacttgagagtgagtcgtttcctcttatggagaatttttttgactatactacagatgagacaagtttgcctatcacttgtaagtatacaaagccaaatatagcccctgaattaccaattttaggctacggtgaagagcagatactaaataatacattagatgaataccacgttagtccttcatccttgctacttgacaagccacaggtcttcaattcaatattggattctggtttcttaagatgtcaagaattcaagtttggaaattatgtctatgaagacatggacacaaattttaacccgacagcattgtccttcattgggttggaaggacagtttccggtgcctaccatcatcgtcctaatccggaaacctggctaccatcttcaccagatgaatgtcagaggtgcttatccctaa

SEQ ID NO: 57603 - DNA, 887 bp, Glycine max
  Peptide Sequence Number=SeqID_174381
atggggcttgaggcccttccaaggggagagcctcatttatctatggaaagaagccacagaagagactattctcaacaaatgtatggtcctgtaggcttaccattcaagcattggcaacaggaagataggtttatggatagggaaatgcttcatgaagttcatccaagcacagaacaggttgcttacaaagatatgtatgaaatatggcagcaatctcagagagcaagccatgacagaggaaagtggagtgaagatgttgatgagaaaagaatggctctgattcgacagaaattcatggaagcaaaacgtctgtcaaccgatgagagactgcaccaatctgaacaatttaaagatgccttggaagttttaagctccaatagtgatctcttgatcaggttattggattctcaaaatgtttctgatttatactcaacttcacctaatgagacaaagcgcattactcttattaaacctttgaagatggttgacaacgacaaatctgccagaaaggagaaaacgaataatagaccgattaagaaaccatctagtgttgatcaagcaaatcctggaaactctccagatagtcagaaagttgatgaatctccggtccgaaccactcgaatagtgttactaaagccaagcccagggaggacacctgagcaaaaggctgttgtttctccaacaacttcgctgaatctgaaaagcagaaatttccatcatggacctgaatatgatgatgtactagaatccattagagtggcaaatgagatcacacagcaaatgcataaaggcccgaggagctatcaaaaggataaaactctgtattcctcagtgttttccaatggctattctgatgatgagagttcattcaacaaatcatatcatga

SEQ ID NO: 57604 - DNA, 522 bp, Glycine max
  Peptide Sequence Number=SeqID_174382
atgaggcaagccattgagaaaaacatcttctttaacttcttggtgggaaaggacaaaactcaagtgaatcttctccaatacaccgatgacactttttttttggtgagacaaccttatcaaatggttgaagatgattctttggagagatttgctaccattttgaattgtaagatcaccaaactaccatttttgtatctcggtattcctatttgggaaaatcctagaagggtagagacttggaagccaatcgtggacaaagttgcaacaatgttgaactcttggaagcatagaacattgtctatgggtggtcagggaggtgtggggatcaaaaaccttagctatttcaatgaggctttaccaggcaggtggagatggaatctcttcaaccacgatgccttatgggtaaagattctagaatcaaagtatgagggggtagtgaggcatctaattgatttgtgtctgattgcaagtggaagtttgggagtggcgaaaaggtgcggttttggcatgatatatggttga

SEQ ID NO: 57605 - DNA, 309 bp, Glycine max
  Peptide Sequence Number=SeqID_174383
atgtcttcttcttttcacacaggagttactcctggaaactctgtcgtgggttccggtgaagactcgcatgcgattcagaaagagaaacacaagtatttgtcgacgccaaacagtctcattgaagtcccttctgaccagccttctcttaaggttttgaaggggtgttggcgtctttttaaccatcgcaggaaaacccattttgttgtttggctagtgagggagcttggagttgataattcttggattcaattgttgaaagtaagtcttgaccatcttcaagatcttggctatccgcgctttccaacctaa

SEQ ID NO: 57606 - DNA, 444 bp, Glycine max
  Peptide Sequence Number=SeqID_174384
atggaaaagaagaatagaatttcagctattttggcaatatttattttggcctttgcctctccaattgcttcagatgtttaccctgaattcgtaaagtggcatgtgtacattgtcaatgggctaaggaacaaccaaaacctattagcccattgcaaatccgcagatgatgatttgggtgtccgcaacctatctcaagggtccaatttcacttggagttttaggacagatttcgcccactcaacactattttggtgccatgtgaagaaggacaacaacaatgcttgtgaaagtgctacatttgatgttttttggtacgatgaacgtctttttcaaaagtgtgattggaagaagtgcatttggagtgctagggatgacgggatttacctaacaaatattcatcaaaacgttgatgatttgtattattactgggatgctggagagtga

SEQ ID NO: 57607 - DNA, 1059 bp, Glycine max
  Peptide Sequence Number=SeqID_174385
atggctataacgttcggtttagtgactcctaactccaacactttgtgtctcactctcaccacaccacccctcatcgccaatcatcgtactactaatgttgtgttctctggtcaaagtgtcttcagctatggacacactaatctttcttattcacaccaaagggcttcttcctttgccactattgtctgttctgctgctaataaaccatcctcttcttctgaaattagttttcatgacagtgtgacacgaagcctgaaaaagaaaagaataggatcaaatgagtatgccaagataaggagcgaggttctctctccctttcgttcagttaggatgttcttttatattgcttttgttgcaagtggtgctcttgggggattcatagcaaccacacaactaattggtgcactggctaactcatcaagagcatctgaagtccctgagattctgaagggccttggcatcgaccttgcagcagtgtctttatttgctttcttgtatttcagagagaacaaagcaaagaatgcacaagtggctcgcctatcaagagaggaaagcttatcaaatcttaagctccgtgtggatgagaagaagatcattcctgtgaactcattgagagggattgctcgacttgtcatctgtgctggccctgcatcctttgtaaccgagtcttttaagcgcagtgagcctttcaccgatagtcttttggatagaggggtgcttgttgtgccctttgtaacagatggaaattcacctgctttggagtttgaggagactgaggaacttgccactagaaggaagagactctggcaactggctccagtttacatcaatgagtggtctgagtggttagatgagcaaaagaagttagctggtgtaccttctgattctccagtgtacctatccctacgcttggatggtcgtgttcgtggcagtggtgttggttatcctccttggaatgctttggttgcacaattaccacagatatgctttagtggctctaggtcaaatgaggactatttatattttgggcaaattacgctctcaagccttaaggattaa

SEQ ID NO: 57608 - DNA, 570 bp, Glycine max
  Peptide Sequence Number=SeqID_174386
atgggagaagtgaagctactgggagtttggcctagtggattcgtttacaggatcatatgggctttagagctgaagggcgtaaaatatgagtatatacaaggagaattcaacaagcctgatttctctgatttgctgttgaagtataacccagtttacaaaaaggttccagttcttgttcttgaaggaaagccaatcgctgaatccatggttattcttgaatacatagaggaaacatggccacagccacacttgcttccacaggacccgtatgagagggccgtggcaaggttctgggttagttttgcagaggaaaagagcgtttcttttatgtcattctttgtgagtgttggagaagagtttcagaaggcaagaaaggaagtcagagaagtgctcaaagtattagaagaaaccattggggacaagaagtattttggtggtgaagaaattggactgttagacataaacttgggatggatagccttgttttttggagtcattgaagatgttgttgaacttcagggagcaccccgctatcaagacaaacttcccaagtcaccaagagttgtttga

SEQ ID NO: 57609 - DNA, 1272 bp, Glycine max
  Peptide Sequence Number=SeqID_174387
atggagaacttgtttcgcctagttgactacgaggacatgttctcaaaacgttgcatttgggtcaacggacccgtgatagtaggagctggtccttcagggctagccacagcagcatgcctcaaacaacaaggggtacccttcatggttctcgaaagagcagaatgcatagcttccctgtggcaaaaacgcacctacgacagattaaagctccaccttccaaaacagttctgccagctccctaaccttccattccccaaagacttccccgaataccccaccaagaaacacttcatagactacctcgaatcctatgctcagaaattcgagatcaacccacggttcaacgagtgtgtccagtgtgctaggtacgatgaaaccagcgggctgtggcgggtgaagaccgttgccacgtgtggctccgccaagagcgagttcgagtacatttgccggtggctcgtggtggccaccggcgagaatgcggagtgtgtgatccctgatattgaagggcttggtgaattcaaaggtgatgttattcatgcctgcgagtacaagtctggagaaagcttcaaagggaagaaagtggttgttgttggttgtggcaactctggcatggagctctcacttgacttgtgtaaccacaatgcttctccttccatggttgttcgtagctcggttcatgtgttgcctagggaggtgtttgggaagtcaacgttcgaattggcggttttgatgctgcaatggttgccactttggttggttgacaagattctattggtgttgacatggttggtgctgggtaacatggagagattcgggctcaaaaggccttcagagggtccattgttgctgaagaacacaaaggggaagacccctgtgttggacattggtaccttggagaaaattagatccggtgacattaaagttgtgccagagattaagaggttcagcaatggctacgttgagtttgttaatggtgaaaagcaaggagttgatgcagttgtgcttgcaaccgggtaccgcagcaacgtcccttcttggcttcaggaaggtgaatttttctccaagaatggtttcccaaaatctccatttcctaatggttggaagggaaatgctggactttatgcagttgggttcacaaggagagggctctcaggtgcctcatctgatgctatgaatattgctcaagatattgaccaagtttggaaacaagagactaggcaaaagaaacaacgcaccactgcttgtcatagacgttgcatttcccagttctga

SEQ ID NO: 57610 - DNA, 495 bp, Glycine max
  Peptide Sequence Number=SeqID_174388
atggcattggcattgggtaacgctattcctctctcaaacttgaaaccttgtccaaagttatcttgttgttgtatgaagaaactctttttcactcactcagtccccatttctcgcatcccaacaacgccaaagcgtactcccaccaccgtagttcgagccacttcctctttcgggtctcgcctcgaagacaccatcaagaagactgtagccgagaacccagtggtgctttattccaaaacatggtgctcctattcttctgaggtcaaaatcttgttcaaaaagctcggcgtcgacccattggtcttcgaattagacgaaatgggtgggtcctcaaggcccacagttgcacaaggtattggaaaggatcacagggcaacacactgtgccaaatgcggcaagcacattggcggctgtacagatacactgaagctgtatcggaaaggagaacttgaacctttgctatcaaaagctaatgctaaaaaaacagggagctaa

SEQ ID NO: 57611 - DNA, 4536 bp, Glycine max
  Peptide Sequence Number=SeqID_174389
gctgccaccgccaatcctataattggttcccatgtttgggtggaggattctcaagtagcttggatagatggtgaggtcttggaggttaagggagaagaaatcaaagttctttgcacttcagggaagacggttgttgttaaagcttctagtgtttatcataaagataccgaagcccccccatgtggagtggatgatatgacaaaacttgcttatctacatgaacctggtgtcctggataatctgagatcaagatatgatatcaacgaaatttatacttacaccgggaatatattgattgctgtgaatcctttcataaggcttcctcatttatacgatagccatatgatggcacaatataaaggagcaggttttggtgagctaagcccacatccttttgctgttgcagatgcagcatatagacttatgattaatgagggaatcagccagtcaatattggttagtggtgaaagtggggctgggaaaacggaaagcaccaagttactcatgcgctatcttgcttacatgggagggagagctaataatgcttctgaaggtagatctgttgagcagaaagtcctggagtccaatcctgttttagaagcctttggcaatgcaaagactgttagaaacaataattcaagtcgttttggtaagtttgtggagattcaatttgaccagaggggaaggatttctggggctgctatcagaacttatctgctggaaagatcacgtgtttgccagttgtcagatccagagaggaactatcactgtttctatatgctctgtgctgcacctccggaggatattcagaagtacaaattaggaaatcctagagcatttcattatctgaatcaaacaaattgctttgagttggaaggggttgatgagttaaaagaatatcaggatacgaggagagcaatggacgttgttggaataagttctgaggaacaggaagcaatatttcgagtggttgctgcaattttgcatcttggcaacattgaatttacaaaagggcaagaaattgactcatctgtgcccaaagatgaaaaatcttggtttcatctacgaactgctgctgaacttttcatgtgtaatgcaaaggcacttgaagattctctttgcaagcgtgtaattgttactcgtgatgaaactataacaaaatggctggatccagaagctgctgcactcagccgagatgctttggctaagattgtgtacacgaggttgtttgattggctggtggataaaataaataattcaattggtcaagaccctgactcaaagtccttaattggtgtgctggatatttatggttttgagagtttcaagactaacagttttgagcaattttgtatcaatttgaccaatgaaaagcttcagcaacattttaatcagcatgttttcaaaatggagcaagaagaatacaaaaaagaagagattgattggagttacattgagtttgttgataataaagatgttctggatctcattgaaaagaaacctggtggcattattgctcttcttgatgaagcttgtatgtttcctagatcaacacatgaaacttttgcccaaaagctgtatcagacattcaaaaaccataaaaggttcagcaaacccaagttggcacgtagtgacttcacaatttgccattatgcgggtgatgtcacgtatcaaactgaattgttcctggacaagaacaaagattatgttgttgcagaacaccaggaacttctttatgcttccaaatgcccctttgtgtctggtttgttccccccttcacctgaggaatcgtccaaacaatcgaagttctcttcaataggttcccggtttaagcaacaattgcaagcactacttgaaactctcagtgccactgagccacactacattcgctgtgtgaaacccaataatcttcttaagccagcaatttttgagaataaaaatgttttacagcaactgcgatgtgggggagttatggaggcaattaggataagctgtgccgggtatcctactaggaagacttttgatgaatttgcagaccgatttggacttcttgcacctgaagctttggacgggagttctgatgaggtcactgcttgcaaaaggattctggagaaggttggacttaagggctatcagattggtaaaacaaaagtgtttcttcgagctggtcaaatggcagatctagatactcgtagaagtgaggtcttaggaaagtcagcaagcattattcagagaaaagttcgtacctatttggcccgccgtagttttgtcttgatacatttgtctgctatacagattcaagctgcatgcagaggtcaacttgctcggcaagtttacgagggattgcagcgggaggcttctagtgtgaagattcaaaggtatttacgcatgcatgttgctaggaaggcatataaagaattgtgtagctcggctgtttctattcagactggtatgcgagggatggctgctcgtactgagctacgcttcaggaagcaaactcgtgctgctattgtcattcagagccactgccggaaatacctggctcaacatcattttacaaacttaaagaaggcagcaattgcaacacaatgtgcatggagaggaaaagttgctcggcgagaattacgacagctcaagatggctgcaagagaaactggagctctccaagctgccaaaaataagcttgaaaaacaagttgaagaccttacattgaggttgcagctggaaaaacgcctgaggattgacattgaagaatcaaaaacacaagaaaatgaaaaactacaatctgctttgcaagcgatgcaacttcagtttaaagaaactaagttgttacttaaaaaggagcgtgaggctgcaaaaagagaagctgagagagcgcctttcatacaggaggttcctgttgttgaccatgctttgttggagaagctcactagtgaaaatgagaaactcaagactttggtgagttcattggaaaagaaaattgatgaaacagaaaaaagatacgaagaggcaaacaaagttagtgaagaaaggttgaagcaggctttggatgccgaatcaaaaataatccagttgaagactgctatgcaaagactcgaagagaaattctcagatatggaaaccgaaaaccaggttcttcggcaacagtctctgctagactcatctgcaaaaacagtgtcagaacacctttctacccacatatctgagaagttggaaaatggtcaccatgtggtggaagatcagaaaacttctgaagcacagaatgtcacacctgtgaagaagtttggtacagaatctgatggcaaattgaagagatccttcattgaacgtcaacatgagaatgttgatgcacttgtcaactgtgttatgaaaaatattggtttccatcatggaaagcctgttgctgcatttaccatttacaaatgtcttctccactggaaatcatttgaggctgaaagaacaagtgtatttgatcgccttatccagatgattggttctgcaattgagcaaagtctaaaatccggtggtgcagctgatgccactcctgtaaaaaaaccaccaaatccgacatccctctttggaagaatgactatgggttttcgttcatctccttcttctgccaaccttcctaccccaccattggacgttgtacgcaaagtagaagctaaatatcctgctttgcttttcaagcaacagctcacagcctatgtggagaaaatatacggtatccttcgggacaacttgaagaaagaattggcatcaatgctttcgttatgtatacaggcaccaagaacatccaagggagtgctacgatctggccgatcctttggtaaagattctcccatgggtcactggcagagtattatagaatccctgaacactctcctctgtactctgaaagaaaactttgtacctccagttcttatccaaaagatcttcactcaaacattctcatatattaatgttcaactcttcaatagcaatggggaatatgtgaaagctggtttagcagaattggagttgtggtgctgccaagcaaaggaggagtatgcaggttcatcttgggatgagcttaagcatataagacaagctgttggattcttgttaagcatgtctttcagagtctatatgtctcatgcctttttcccttgtgtccccacccccttcctgcatcagatcatgagtgtccagcagctatacagaatatgtacactttactgggatgctaactacaatactcgaagtgtatctccagatgtcctttcaagcatgagagtacttatggctgaggactctaataatgctcagagtgattctttcttgttggatgacagttccagcatccccttctcagtggatgacttctctacatcactgcaagagaaggatttctctgacatgaaaccagcggatgagctgcttgagaatcccgccttccgatttttaaatgaggatatttttaggattagtgagcttgcgttgtatgtccatttttgttgtcctggtcaatctggtaacaaaaccgttagaaagtga

SEQ ID NO: 57612 - DNA, 276 bp, Glycine max
  Peptide Sequence Number=SeqID_174390
atggtgaaacccaagcagcccaatctccagaacatggattgtgggaccaaaatgcaaggattatccctcaatggtagaccggcaattgacaattctaataaaagtgaattcaacgtatttttggatttggatgtaaatatggatatgctttgtgcggcaagaaagattgagagaggagtctttgtccttagttataattctttctggtccatgccatgcaatggaaaattgagaagtataactccacaagggtcacctgatcaatgtgcaatttaa

SEQ ID NO: 57613 - DNA, 540 bp, Glycine max
  Peptide Sequence Number=SeqID_174391
atgaaggaaggcataggtcgcatcttagacctcactcccataggagagaaaaggaaagaaatcctaaagaggctaacattaacctcccatacttccatgggaaggacaataggacacattacttctcaatgccccaccaagaaaaccatgattatgaggggccaaggtatttatagtagtcaagatgaggctactacttcaccttcctttagtgaaagtgaagaagcaaaaggggaagaatctagtgaagaaatctacccccaagaagaaggacaaccattaatggttaaggaggagtgtaaagaggtaagtgtatcctccaagaggttagctaagaaggaaagtcattttacaataaacacaaacattaaagaaacatcccctcttagacaacctccacattttctcctttgtaaaaagacacttgttagcattgtcacacctcttggtcttgagtttattcctcaagtaaaggagttgttggataagggtttggtttgcaagagcttaaatccttgtgctttgttggtgccaaaatag

SEQ ID NO: 57614 - DNA, 452 bp, Glycine max
  Peptide Sequence Number=SeqID_174392
gattaagtcctttgatcgcgtgttcgatagacatcaacaatcggggacttatatcctcctttgtcgagaggtggcactgggagacttctattttccatcttcctgtgggggaggttttgatcatgctggatgacatcgcgtctcttctccatttgcatatcgttggcgcaatccatgacttccagcctctacgcactgacgaggtggtggggctgttggttgagttattgatggtctcagtagaggccctacgtgatctcactcttgctgggtggtatgcatggggagctgctggcctcatccatatgtatggtcagcttaatgatgtcagtctcagcaccagccgacagcttgctaattacatcaccttgttacagtgttggatatacgagcacttttcgtcagttgcggagtgcaatgctaatccggactacgacgaggtgtcaccacat

SEQ ID NO: 57615 - DNA, 207 bp, Glycine max
  Peptide Sequence Number=SeqID_174393
atgtccttgggggtaggattgcatcattacctcctcctagaaaaggatttgacctcaaattcagaggttcttgaaattatgaacttcttcccacaacacctggtaaggtctgaaaatccctttcatgggcatgttccctcatacatggttcctcaccaactgagtggtgctacaagtataaaagaatatgagacaaacctttcgtaa

SEQ ID NO: 57616 - DNA, 607 bp, Glycine max
  Peptide Sequence Number=SeqID_174394
accaactgaaggagtggtggatattgctgtttctgagcatcaaattgccaaggaaatcactgccaagcaagtccagcattggccaaagaaagggaagctttctgcagggaagctaagtgtgaagtatgcaatcttgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcgttgatgatggagaagcagctgaggaagaagaagatgcagcagaggatacagaatcagatgatgatgattctgatgccaccccataa

SEQ ID NO: 57617 - DNA, 267 bp, Glycine max
  Peptide Sequence Number=SeqID_174395
atggctgatttgaatgaattcgacttcaagcaacaattgaatttgtttctccaattcaactttctggctatgggggtgaatgtgatgggagatagggagaggtggagggagctgggtagcctcgatgaaaatttgagcatattggaaaaggagtgtggtgagttctggtggttctatgtgttggtcaaggctcagggaagtggtaatcgggcccagttggcgaagccagtgtaccccgagaacaatgtcagctccactgatgggtag

SEQ ID NO: 57618 - DNA, 492 bp, Glycine max
  Peptide Sequence Number=SeqID_174396
atgatgcctgacgctttgcccggctggcgccgttatctgttcaacagcagcctgcgctacctgctgcgcatcttcttcgcgctggccggctgtgccgccgttccctggtggctgcagcagattgagtggaccattccgctaacgctcggcgtcgtggcggcggcgctggccgatcttgacgatcgctggaccggccgcgtgcgcaacctgctcatcacgctgctggggatttattctgctgggcgcgctggggcagcgctacgccaccattgcgtttggtgccctgctgatcgcggtgtacaccatgctgggcattggcctgtttccgcagtggtggatgcagccggcgctgctgctgattggcgcgctgtggtacaacctgctgacctttatcggccacctgatgtttccggtgcgcccggtgcaggagcagctggccgccagcttttcccagctggcgcgctatctggaagccaaggccaatctgtttga

SEQ ID NO: 57619 - DNA, 453 bp, Glycine max
  Peptide Sequence Number=SeqID_174397
atggcatctacactcaggcgagtgaacaaggagaaaaacatgaacgatcaaacgattcgcgatgtcctgacgcaaactcaacgcatcgcgctggtcggtgccagcgatcgcactgagcgtgccagctatggcgtaatgaaatacctgctcgatcagggttatgacgtggtgccggtgagcccgaagctggcgggacagcagttgctgggccagaccgtgtatggcacgctggcggagatcccgggcaagatcgacatggtggatgtgttccgcaattccgaagcggcatggggcgtggcgcaggaagcgattgctatcggcgccaaaaccctgtggctgcagctgggcgtgatcaatgagcaggcggcggtgctggcgcgtgatgccgggctaacggtgattatggatcgctgcccgaagatagaaattccgcggctgggcgtaacgcggtaa

SEQ ID NO: 57620 - DNA, 1059 bp, Glycine max
  Peptide Sequence Number=SeqID_174398
atgaagctgtctctggctgttacgggtttgctgttgctgctcgtatcggcaacctgccatgccatcaccctgaagctcgatccgcagatcgacctgctggtgctggatgggcgcaaaatctcaggttcgctgctgaaaggcgcggacagccttgagctggagcgcggtcagcatcagtttctgtttcgcgtggataaaccctgcgccgatgccacccacttccgctcagaactgatgatcgtcaccttcactgccgacggccattccgtagcgattcgcctgccggcgctgaataaccgccgcgaacgcagcctgtttgataaatcgttaaattttcagctgattgatgagcgtggtaatgaaatagccagcattcgcgatcggttgccgggtgagagcagcggcaatgttgaacaggcgatgatcaattacaaccgtacggcgcaggcggccagcgtgccgcgctttgcgctgcaggcggccagcgtaccggacgccagtcatagtctggatatggtatggcaggacgccagtaatttgcccgcgctgcaacgctggctgcagcgtgttgatgccgccacgcggcagcgaagccccatggagcagaccgttcgtaccctgaaagttcagaaacacatcgccctcgttgcccacgaccactgcaaagcctcgctgctggactgggtgaaaatcaatcaaaatgcgctgcaacctcacgtgctatacgccaccggcaccaccggcaacctgatcaatcgtcacaccggactggatgtgaatgccatgctcagcgggccaatgggcggcgatcagcaggtcggcgcgctgattgcagaaggcaaaattgatgtgctgttcttcttctgggatccgctcaatgcagtaccgcacgatccggacgtcaaagcgctgctgcgcctcgccaccgtatggaatatcccggtggcgaccaaccgcgccaccgctgatttcattatccattcgccgatgtttgccagcgaagtgaccatccagatccccgattatcagcgctacctgacggaacgcctgaaagcctga

SEQ ID NO: 57621 - DNA, 954 bp, Glycine max
  Peptide Sequence Number=SeqID_174399
atggcggcgggaatcatcgtccacgtcgccgaaaatgaagccgggccattgctgcggcaacgcgtagcggtcgcgcttgacctggaagctggacagcaggcggttgccggcggccggcgcgccatacagatagtcgccctgcacgtcgacggtcagggtgtcgtccggcgacaacacgtcctggtcggaggtcagcgccatcttcatgcgttcgggcaggaattcctcgacctggaacttccaggaggcatccggcgcgcgcgaagcgggatcaacgcgcaattccagcatccaggcgccggtctgggcgtccggcggcagatcgatggcgcgttcgacgtagccctgcaggtccttggcgggctgccacagattggtcgagaccacgcggccgtcggggcgcttgagggtcgctgtcagcggcgacggcggcatcacgcggccgtcgaggtcgcgcggcagcaccgacacgtggaaggtttcaccggggcgatagaggttgcggccggcgtagacgaacaggttgttggggcgggaaatgtggccgccggtatcgaattcggacaggtccagcgccggttcggccagcgccagcacggtcatttccttgtcgcgcgaggcgcggatgacgcgggcgttggtgaagctgccgtcaaagcgcacgtggccctggccgtcggcctgggccttggccagcaccttgccggcgccgtccaccagttcgaacagcgcgccggagatcgcctggccgctcttgagcgacaccgagtaggcctcgatgcgatcgctgtagcggcgcgcgtgcaggccgatgtagctgacataaaaataggtgacctggtactcatagcggaaacggccgggctggctcatcaccgcgacgtagatgccgggttcctgcaattccttgatgccttcgaccggcaggaaggtgacgtggcggcggttcggctg

SEQ ID NO: 57622 - DNA, 774 bp, Glycine max
  Peptide Sequence Number=SeqID_174400
atggccgctactacgagccggcgccggggcgcagcgtgggcgtggggctgggcgtcatgtaccgttattgaggtggcatgcccggccggctcaggcggccctggccgagccgtagcagaagccatgatcctcacaggcagcgcagcccggcgcggcggcgagcggcaggccggcgtgttcacaggcggaatacgccaggaacttcttccagcgcaggttggcggtgttgcgcgccaccaggcccgggtagtggcgcgtcagcagcgcggtgacgtcctcgcggccggtcaggccgaggtcgcgccacagatggtccgggcgcaggcaggcgtgcgccaacacgctggtgacccaggcggtggtgggcgcgggcccgccgcaggcctggagcagcatgcgcagcaggcgcgtgaaatccggttgcggattggccaggccgcgcgccgcgtaggcgagcaattgtgcccgcaggtcggcgagcgcggtggtcgcgccgccctgcgcacccggaaacacgctggccagcacctcggccagctcgacgggcgacaggccggtgcgggccaggtcatggtgcgccaggctcttgccgatcacggtggcgaagaagcgggcgtccggatggccgggcgacgcgtggtccagcagggcgcgggccagggcatcgatgtcgccggtggcaggaggggcggtgagaagggcatccatggcggttggcgagggaaggatcgaagaaatcgttataagccggaatatatgacgaatgccggatga

SEQ ID NO: 57623 - DNA, 604 bp, Glycine max
  Peptide Sequence Number=SeqID_174401
atggacatcccactgagaagcactaggaagtaccttttcaaaaaaacagacctgttgagattaagggagctagcatctttagtaagtgatccagttgattttcaagctcatcatgggaagttgctcaaaattcttaaagtaaatgttgaggaaggatgcctagagaccctggttcagttctatgacccgctctaccattgcttcacatttcccgattaccagcttgtccccacacttgaagagtactcctacctagtaggtttacctgtgccaaacaagatacctttccatggttttgagcctacccctaaaccctccgacatcgcagccgccctccatcttaaaacctccatcatccaagcaaaccttacctctaaaggaggcctccaaggtcttcccacccacttcctctaccaacaagcctccatatttgctgaagcagctagtatacttgccttccattctatcctagccctccttatatatggccttttattcttcccaaatgttgacaacttcatcgatatcaatgccattaaaatctttcttacaaagaaccccgtacccactctactcgccgatacctaccattctatccatgacc

SEQ ID NO: 57624 - DNA, 309 bp, Glycine max
  Peptide Sequence Number=SeqID_174402
atggctaagtttgaccctgaggtagtcctagagttttatgctaatgcttggcccacagaggagggagtgcgagacatgcgttcatgggtgaggggtcagtggattccttttgatgcagatgccctcagccagttcctaggtgacccgctagtgttggaggaaggccaggagtgtgagttcagtcagaggaggagcagggccgacgagttcgacgaggaggccattgcccagctattatgcacaccggggcaagatttcgcccagaccgctgcagggaggcgggtatgccacccaccaggcaccctctag

SEQ ID NO: 57625 - DNA, 610 bp, Glycine max
  Peptide Sequence Number=SeqID_174403
ttcgaaaccgggggaccgtcgccgcgtcctgccgcgccatctgcgtccggcgacggcacccgacgtgttctcctacacgatccgtcccgcgcgagccgctgatctcccgcacatccgggagatctacaaccacttcgtgagcaactccgccgtcaccctcgacgagaagcgcagcagcatcccctactggcgtgagaagttcgcgctgctcgctcgtttggaactgcccttcctcgtcgccgtgtctccagccggcgcggtgctcgggtacgcgctcgctcagccgtgggcggggaagaacgcctacaagtacacggtcgaggattcgatctatctgggtccaggagccggcggcaaggggctcggcgccgccctgttgcaggcgctcatcgacgcgtgcgagcagatcgggctgcgggagatggtcgccgtgatcagcgatcagggcgcggaggcatcgatcagactccacgagaagctcggtttcgtcgaggccgggcggatggggcgcgtcggctacaagttcggccgagacctcggcacggtctacatgcggcgcgtgctgcgcccgacggggcgtcgacggaagctcttcggctcggggcggtga

SEQ ID NO: 57626 - DNA, 798 bp, Glycine max
  Peptide Sequence Number=SeqID_174404
atgagcctgatcgaagcgcgcggcctgcaacgcgacttcttcgtccccaagcgcacccccttcgagcgcacgcggacacagacggcactggccccgaccgacctcgacgtcgtcgatggctcgtcgctcggcatcatcggcgagtccggatcgggcaagtccaccctggtgcgcctgctgctcggactggaccggccgacctccggcaccgtgaccgtcgacggaaagctcgtcgatgcgcgggcgtccgcgaaggccctgcactggctgcggcgcgagacgggactcgtgttccaggacccatacgcctcgctcgacccccgcatgacggcaggtcagatcgtgcgcgaacccctgtgggcgctcggcatcccgggcgagcaccgcacgcgggtgcgcgaggtgctcgcacaggtcggcctcgagcccgagatggccgaccggtacccgcacgagttctcgggcggacaacggcagcggatcgccctcgcccgtgccatcgtgcaccggccccggatcctcgtcggcgacgaaccgctctcggcgctggacgtgaccgtgcgcgcacagatcctcgacctgttgagagatctacgccgcacgaccgatctcacgctgatcctggtctcgcacgacatcggcgtggtccagaacctgtgcgacaccgtcgccgtcatgaaggacggccacatcgtcgagcacggcgcgatgcaggacgtgctgatgcacccggcacaggactacacgaagaagctgctcgccgcgatcccggtgatcccgaagacgccggatcgctga

SEQ ID NO: 57627 - DNA, 370 bp, Glycine max
  Peptide Sequence Number=SeqID_174405
gcaaagttatccaaatcgaggccatcattgaccaatttgcaattgctgtgcagaaaaaacgcgaaaatggcacaagactagatgcccagaaacaggcacatacccttctgctcgagaaagcccgagctgctcgacatgaagtcgaacgtctcatcaaagaggcgaaagaagggcagaaaattgtgacagagcaggccaaacgcaaggaactccaggagaaggccgctaactcgatccagaaactggttgacgaaaaagggagggaaggcttgaaggcctttagcgcatctcaggctgtagcagatgaggcaaaagttatggagagtgctgaccaggtcttaactaaagagatagcctccttgaaaaagct

SEQ ID NO: 57628 - DNA, 594 bp, Glycine max
  Peptide Sequence Number=SeqID_174406
atgtcacgcagagacaaattatggtcattctgcacccttttgtcatctagaggcggcgggcccgatgacatgcggagacaaattatggtcattccgcacatccttttgccattcagacacagtcgtgttcgatggcacgcagagacaaattatggtcattctgcgcccttttttcatccagaggcggcgggtccgatgacatgcggagacaaattatggtcattccgcacaccccttttgccattcagacacagttgtgtccgatggcacgcagagacaaattatggtcattctgcgcccttttgtcatccagaggcggcgggcccgatgacatgcggagaaaaattatggtcattccgcacaccccttttgccattcagacacagtcgtgtccgatggcacgcagagacaaattatggtcattctgcacccttctgtcatccagaggcggcgggcccgatgacatgcggagacaaattatggtcattccgcacatccttttgccattcagacacaattgtgtccgatggcacgcagagacaaattatggtcattctgcacccttttgtcatccagaggcggcgggcccgatga

SEQ ID NO: 57629 - DNA, 531 bp, Glycine max
  Peptide Sequence Number=SeqID_174407
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataaatgacgaggcatttggctaccttaagagagtcatagttactcccgccgtttacccgcgcttggttgaatttcttcactttgacattcagagcactgggcagaaatcacattgcgtcaacatccgcagggaccatcgcaatgctttgttttaa

SEQ ID NO: 57630 - DNA, 903 bp, Glycine max
  Peptide Sequence Number=SeqID_174408
atgtacacagtggagttccaaaaacgaggacttcctcatgtccatttattgttatttttacacgccaacaacaaatatccatctccaaacgatattggtcatattatatcagcagaaataccttcacaagaagatgatccagaactctataaattagtgcaaaatcacatggttcatggtccatgtggaattttgaggcctacatctccatgcatgaaggaaggcaaatgcagtcaattttatccaaaaaagtttcagcccataactcttatagatggagatggttatcctgtgtattgtagaagaaacattggtcagacaataaccaagaattggattataattgataatagatgtattgtaccctacaatctaaaattgctgaaaaaataccaagcacatataaatattgaatggtgtaaccaaaccacttctatcaaatatttattcaagtacatcaataaaggatctgatagagttaccgttgccatcgtacatgatgacaaaggaacacttccccatgcaaacactctgaatgatgaaatcaaggaatatctggattgcagatatgagccaagtttaatatcttggatgaatacaaaccaagtttttcttgaaggtcaaaagctgacttattttgaatttgtaactaagttcgtgtataaccagaaacagagatgttggcaacttaggaaaaagggttatactattggcagacttcaatgggttcctccaactacaggggaattattttatttgaggatgatgctgactgtctgtagaggaccaatctcatttgaagatatcagaaaaattgatggtgttgaatattctacatatagagaagcatgttttgctatgggttttttacaggatgatagagaattcattgctgcaatctag

SEQ ID NO: 57631 - DNA, 321 bp, Glycine max
  Peptide Sequence Number=SeqID_174409
atgttagaagacgactgtcggtatctgatggtaagtaagatacctacggtcggtatatctttgaaagctcagacggagataaacggactcctcgagggctacttaaggcactttagtgcaaaccaaccagaaggactggagctgttggatgtagctcagtgctgctataaattaacaaccaaaaagctctgcgtcgaacttcagccccttcgagttggccacggggcaacagcctctgacgccccacaccattgcggcaggaggaggcttgcccatcagcctacttttttgccaagacgtggcaggagcgcaacgacctag

SEQ ID NO: 57632 - DNA, 318 bp, Glycine max
  Peptide Sequence Number=SeqID_174410
ggatcgcaaccacagagacacccagtggacctgaagaagtccaacagggccctgggctttctagctctggttacgggcctctgtcggccatacagggcgcccgttccccccagcaagttcatgtcgtcgtggcatagggattgtgcccgcaagacacctagtggaccagaagaaggccaacagggtcttggagttgccagctctaaatacgggtctctgttagttctagggagtgcctgtcgcccccagcaaggtcatcaggccccccctaccaatcaagctttcatcaagaagtactgcgcccccaggcaggcgtag

SEQ ID NO: 57633 - DNA, 906 bp, Glycine max
  Peptide Sequence Number=SeqID_174411
atgccgcagcactcgcgccagtttgttcatgacatattcccggatggccggggtgacgtcgagaggaaaaaatggtgcgcggaaggcgcggtggggtcgttaggcgttctccttgttcgaggggttcgtttgatactagtgtatagactcgggccgataaaacaagctgacctagcgcaagttcatggcattttcatggcggtcgcccaggggcgtgccccaggggccgccatggaccctgggattttccccaatcggggtgttacatgcggaagtgttcgcccaggcgcggtcgcagatgcccagcgtttcgcgcacgttgtggtcggtgatcagcacgccgatgccgcggcctttcaggaatcgcacgatgcgctggatctcgatcacggcgatcgggtccacgcccgcgaagggctcgtccagaaggatgaagcgcgggctggtggccagcgcgcgcgcgatttcgacgcggcggcgttcgccgccggaaagggagatggccgcattgctgcggatatggccgatctgcagttcttccagcagggcttccatctgctcgttgatcttgggcgtggacagcggtcgtccatccggccccaattgcagttcgagcacggcgcggatgcccatgtgcgcgcgcttgtggatcggcatcgaggtgatgacggaaccgtcgatctcgatgcggcccgcatccgccggcaccaggcccacgatcatgtagaagctggtggtcttgccggcgccgttggggccgagcaggcccacgacttcgccgctgatcacggacagggacacgtcctgcaccacggtccggccgttataggtcttgcgcaagccggttgcgcgcaggctgccctgcttgacgcccgagggggcggaggttaccggagtcggcactga

SEQ ID NO: 57634 - DNA, 1680 bp, Glycine max
  Peptide Sequence Number=SeqID_174412
atgcatacgctgattctctccgccgccaacaacccgtttttcaatcagtcactggaaattatctctgtgatttttcactcgcattatcagtgggatgaaagcgaccttaagcagcgcaacatcgtcgcgctggaggagcatatggcgattctcaccgcgctcatcagccgccaggatgtggacgcgctgcagccccttagggcaggccgtttcgctgccgcaggaaccccaagactgataacgataagtacccgaacctgggaggttgcaatggaaaatacatcaacgcgcggcggcaccaccgcgccagcacccgagcacgccgggcaggattatgtgccggcgcgcgccgatgtggtgcgctctccgcgcatccgtaagattcaaatcaccgccatgctgctgctgctgttcgccgccatcatcaactaccttgaccgcagctcgctgtcggtagccaacatgaccatccgcgaggagctgggtttatcggccaccgagattggcgtgctgctgtcagcgttttcgctggcctacggtttagcccagctgccgtgcggcgcgctgctcgatcgcaaaggcccgcgcattatgctggccatcggcatgttcttctggtcactgttccaggcggcggccgggctggtgcataacttcacgcagtttgtgctggtgcgcatcgggctgggcattggcgaagcgccgatgaacccgtgcggcgtgaaggtgatcaacgactggttcaacatcaaagatcgcggtatgccgatggggatgtttaacgcggcgtcgatgattggtctctcggtggcaccgccgattctggcggcgatgatgctggtgatgggctggcgcggcatgtttgtcaccatcggcgtgctgggtatgtttctcgccattggctggtatctcacctatcgcgaccgggataacaacaagctgagcggcgaagagattcactatctgcaggcgggcagcgtggcgtcacgcaaagagccgctgagttttgccgaatggcgggggctgtttaagcagcgcaccatgtggggcatgatgattggcttcagcggcatcaactataccgcgtggctgtacatcgcctggctgccgggctatctgcagtcgacctatcatctggacctgaaaagcaccggcctgctggccgccattcctttcctgttcggcgcggcaggcatgctgctcaacggttacgtggtggatgcgctggtgcgtcgcggtttcgacgcggtgaaagtgcgcaaggtgtcgattgttagcggcatgctgctctccgcggcctttaccacctttgtgacgcgcgccaccgacaccaccagcgcggtgacgctgattggtatggcgctgttctgcattcactttgccggtacctcatgctggggcctgatccacgctaacgtcacggcgcgcatgacggcgtcagtgggcagtatccagaactttgccagcttcgttttcgcctcttttgcgccagtaattaccggctgggtgctggataccaccaaatcgttcagcctcgcgctgatgatatgtgctggcgtcacggtggtcggcgcgctggcttacctgctgctggtcagaaaaccgatcaccgatggggttatgcgcacccttgcttcatccgcccgccacacctattccagccgccgcgttatcgcctga

SEQ ID NO: 57635 - DNA, 945 bp, Glycine max
  Peptide Sequence Number=SeqID_174413
atgagcagagcgcgccgccagcactcacttcagcgtgccacattccgccacggcgagataatcggtatacagctgcggcgaaccggaaaaggacgccagctgcttccactcttcatacatctgtttggtatcccggtgcgcgtgcgcaaagtcagccgcgctggcggtggcgatatcaggctgcggataaaacacattcagcgccgcttcactctcaatctccatcatcaccacatagccgtccagccggttgccgctgtggcctttcagcagatgaaacttccagccgggataatcaacgatacgcgcggcattctgcgcgatgaattgctcaaattcctgcggctgcacgcccggccgcagcgccagatagtgggtaccgagaatgcgcgcggtgccgctgcgggcatcaaagcgcgggccacccggcagcgtactgtgaggattctctgccagcagatcgaaatgggtgaaaattgtcgggcgccgcgcgaaggttgccagctggcgccattcgctgagcagcgcgtccgcgtcaggatgcagatgccagaagtgctctgcctcggcggtaagttcaccgtcatcctgcataaagcgcgcgcgctgtgccgcatctttcatttcaaacagcatcaggtattgatcgacgcgctcgccgcgcagaccgcgaaacagcgtccagcgccagccgggatagcaggggagatgcacgcctttttcgcgcacgaaggtttcaaactgttcagcggtgacgcccgcttcggtgtcgatggcgatataaaaaaagctataaacagactgggacataacaggctccaggcacgccgtcgcgtgccgttgagaggtaagggcggtttagtcgaactgggtattgatgatggcttctaccagcacgcggccggcgggggtgagcgtgacgtagcggccatcgctgtgcactaa

SEQ ID NO: 57636 - DNA, 427 bp, Glycine max
  Peptide Sequence Number=SeqID_174414
atgggggaggaggtttctgcccagctcgcccaggcgagccaaggcttcctcaagaagtttcctgatgcaccctccaaattgataagttcatccccctttttcggttatgaaaatgttatggaagcattacaaaagcctcagatgccatttttcaacaaaatgggggaggtggttgccgcccagctagcccaggcgagctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 57637 - DNA, 558 bp, Glycine max
  Peptide Sequence Number=SeqID_174415
atggcagaacggcgtgggagccactggctgaacctgaagattgatgccatcaataccggtatcagactcagccgacttgatatgttcttcggcggcattaacacgtttgtggcgacgtgcgatcaggtgactattctgtggctgggcatcagtctggttatggagaaccaaatgactatcggcatgtttgtggcatttggcgcattccgcgcgcagttttctgaccgggtaggatcgctggtcaacttcttattacagctgcgtatgatgagcctgcacaacgaaaggatttcggatatcgctttgaatgaaaaggaagaaagaaaaccggatttaggattaaaggcaaccatgtctccggctagtctggagattaaagcgctaagcttccgttacgacagccagtcagcacccgtctttagcggccttagtttcaggatccgagccggcgagagtgtggccattaccgggccctcaggttcggggaaaaccacgctgctcaaagtactgtgcggcttgtctgaaccgatatcagggactgtcttaatgaatggatga

SEQ ID NO: 57638 - DNA, 321 bp, Glycine max
  Peptide Sequence Number=SeqID_174416
atgtcaggatttacacacgattctcctcaaatttcagccagcccgcatcaattagaccttgcaccttacgcttcaggcccttacaacgctcaatggaatgccccagggcttctccatgacaagcacacgttgcgttcgagtcgtattctcggagaaatggagacagactttgtggttgatttagggatggcctttgtggataactgggtggcgggtgtagctgggggtgatactgagggccttccgaagtgttttcaagggctatccaacaactgtttgccctttagtggcatatccgagccaaggctcgaagtcgactag

SEQ ID NO: 57639 - DNA, 861 bp, Glycine max
  Peptide Sequence Number=SeqID_174417
atgggtggccgtgaaaatgcattggggcttcaaagtgtttcagaaacgacagtaattagttctgtgtctatggctatgccttcaggagtcgtggctaacccttttcttgcttcttctgcttgggatccacttgttccattgagtcaaactttgggaggctctcttatggtttctcatagtgagtttgccaattcagcttacccttctgttttggaaaaccagggaatgaactgtgactctcactttgttcaatatgtatctgactcaaattttgagcacatggcccttaaggttccctcctttggccaaaccggttcttatgatatagctaacacagggtatctgccaaatcataatccgagtaatgagtctggaatggaaaggagtccaataaacaatgagcaatctaagctcgaaggttcaacttctgaagaaggagctgcacctgatgaacacaaaagaaagcgtggacttgactataattttactttcagttcaaataagaatgctgagggggaagcacttaaagattcttctgggaagagctgtgatgatgatgtgaaagaacaatgtgaaaagaagcctagagttgcacaaaatagtactgctaacttatgtggaaagcaattgctgaagcaaaagaaagatgactccgagagtgaagaaggttccaaagaaaatttcattcatgtgagagcccgaagaggtcaagctacaaacagtcacagccttgcagaaagggtgaggagagaaaagattagtgagcgaatgaggttacttcaagaacttgttccaggatgcgataagtcttgcactcttacaaatagcagcttttctgtatttttctgggaatggtgctga

SEQ ID NO: 57640 - DNA, 285 bp, Glycine max
  Peptide Sequence Number=SeqID_174418
atgcaaacattctccaaggataatcaacaattccaaattgatggcgctagcagcaaggagcacgtttttccggaaatcttccggaagaaggttcttccggaaactttccagaagaaccttcttccggaagaacaatttgtgttctaccgaaaaaatctttttccggaagctttccggaagaacaaattgttgttcttccggaagaaagttcttccgaaaagtttccagaagaaggttcttccagtagaacaatttattcttccggaagaaggttcttccggatga

SEQ ID NO: 57641 - DNA, 953 bp, Glycine max
  Peptide Sequence Number=SeqID_174419
tgccaatgcgagctaccagaatcttatgaagcttacaggaaacagcagcatagatggcattctgggccaatgcaactgttccgtctttgtttgcctgatatcatcagggccaagataagtgtgtggaagaaattcaacatgatattcctcttcttccttcttagaaagctgatattgccattctattcattcaccttgttttgtataatcctgcctatgacaatgttcgtgccggaggccgagcttcctgcgtgggttgtgtgttacatccctgctgccatgtcttttctcaacattcttccagctccaaaagccttcccctttatcgtcccttatctcttatttgagaacaccatgtcagttaccaaattcaacgccatgatctcgggcttattccagcttggtagtgcatacgagtgggtggtcaccaagaaatctggtcgttcctcggagggcgatttggtttcattgattgagaaaggaccaaagcatcaaagagggtcctcagcacctgatctagaggaaatgaaagaggaacttcgaaagcaggagcagcaaaaggcctctaagaagaagaaaaaacataacagaatatatatgaaggagcttgctttggcttttcttcttctaacagcctcagcaaggagtcttctctctgctcaagggattcacttctactttttgttattccagggaatatcattcttgttggttggtctagacttgattggtgaacagcacaaaggtgcgaaagccaggccttatgaaattactgaagacacttatttgggggcaatggagagtgtagaggaggacggacccataatgctgctttttcttgctcatgctcctccctccaagctcggcaaggtagcggtggcaaacggttttgtgacgttgtgtggcttatcaagttgggagcttgtggcgcgtttggaggccccactacaatc

SEQ ID NO: 57642 - DNA, 1137 bp, Glycine max
  Peptide Sequence Number=SeqID_174420
atggcaccaccgttgttcaattggggggtgaaggacactcacaggggaacccctgtggtggtgaagatggagaacccaaattggtcgatggtggaactcgagggtcccgaagaagaagacttaatgctaacaaattcaccttcttcgggcgtttcaagagacaaagggaggggcaaaaatgccaaacagctcacgtgggttctcctcctcaaagcgcaccgcgccgcgggttgcttaacctccctcgccccggcattggtgggcctcgtcgccgccgtgaagcgccgcgtcgccgccggaaaaaccgacgccgacaccggcggaggcagggagaacgaaaaccccgccgtgaagacgcgcttctattcctgcatcaagctcttcctctgcctctccgtggtcctcttggttttcgaaatcgccgcgtacttcgaagggtggtatttcggcgcggcgaggtttcagctggagcatttgctgtgggcaccgtccttcggagttaagggtttcttcgattggctctacgcaaggtgggttttcgttcgcgtggagtatctcgctcctcctctgcagttcttgaccaatgcgtgcatcgtgctcttccttatccagagtatggataggcttgttctctgtttggggtgtttctggatccggtttaagaagatcaagcctgtccccaaaggtgggggtgtcgtagatcttgaatctggagaagaaaagggtttctctttttccccaatggtgctcgtgcagatccccatgtgcaatgagaaagaggtttatcagcagtcgattgcggcggtgtgtaatttggattggccgaaggggaagttgttgattcaggttttggatgattcggatgacccaacgacgcagtcgttgataaaggaggaggtgcaaaagtggcagcaagagggtgccaacattttgtaccggcatcgtgtgattagagatgggtacaaggctgggaatttgaaatccgccatgaattgtagctacttgaaagactacgagtttgttgcaatttttgatgcagattttcagcctaccccggattttctcaagaaaaccgttcctcattttaaggtaggcaatttaatgatttcattcaatgtcgtttgcgtgagtttgtaa

SEQ ID NO: 57643 - DNA, 719 bp, Glycine max
  Peptide Sequence Number=SeqID_174421
atggtggacctgtacgtgctcggatggatcatatgcgccgtgctcagcctcgctgcgcttcgtaatttcgctttcacgcggaagaattgttgcgcttcgtcggagaccggtgccactcgccgcgcggtaaatgttaccaccgctgccggagaatgcagatcctcaagtcgcgatggcgccgttgacatcatcattgtcggagccggtgttgccggctctgttctcgctcacactctcggcaagatggtggtgctgcatttgcatagcatctttgcttctaatctaaagctgctggttgtttccatgaataaacagtttgatttagatttagaggatgggcgtcgggtacttgtcattgaaagagatttgagtgaacaagaccgaattgttggagagttgctacaacctgaaggctatctcaaattaattgagctaggacttgaaggtagtgcaaacttaactatgtgcatttggcatatgatatttttttctagattgtggctgatcatgggtgctggaaatactcataaatttgttggtgcagattgtgtggagaaaattgatgctcagcaagtgtttggttatgctcttttcaaggatgggaagcacacacgactctcttatccgttggaaaagtttcactcagatgttgctggcagaagctttcacaatgggcgttttattcagaggatgagagagaaggctgcctcccttcccaa

SEQ ID NO: 57644 - DNA, 708 bp, Glycine max
  Peptide Sequence Number=SeqID_174422
atggatgttgttttccttttgttattatgtctccttaccttgccgtgccgtttggagtctgtgagcagggttgaaggatgtcaatatcctaccatggtttatggacctgttattgtctgtttaggtgattatttgtgtgctggagaggtcctacgagcaattcccattttgcagaaagcatatggtgatagcttacataaagttttgcatgttggtcctgatacttgctatgtggtctctaaattgctaaaggaggaggaaactgaagcctggggtatagaaccttatgatatagaggatgctgatggtaattgcaaaacacttatcggcaaaggcattgtgcgtatggctgatatcaagtttcctcttccatacaggccaaaatctttctctcttgtaattgtttcggatgcccttgatttcttatctcccagataccttaacaaaactcttccagatttggcaagggtatcagctgatggaatagtgatatttactggttttccagataatcaaaaggctaaggttgcagatgtttctaaatttggaagaacagctaagatgaggagttcatcctggtgggttcggtttttcctttcgattaacttagaggagaacgaaactgcttccaaaaagtttgcacaggcttcaactaagagttcatacattccaaattgccagatattccacctgaagtctctccattga

SEQ ID NO: 57645 - DNA, 546 bp, Glycine max
  Peptide Sequence Number=SeqID_174423
atgtgtgcgactggagcaggaacagctacttccctaattgaagagaaggggataattaaaggcatgcgctacaaaacgaaggataataaggaattttcagcttgtgcaccccttaccattgtctgtgatggcagttcctcaaatttgcgtcgttctctgtgtaatcctaaggtagacgttccctctcgttttgttggcttagttttggagaattgtccttgtgcaaatcatagccatctcatattgggagatccttcgccagttgtgttctatcctataagtagttcagaagtccgttgtcttgttgatgttcctggtcagaaagttccatccatttccaatggtgaaatggcaaagtatttgaagacagtgatagctccacagattcctcttgagcttcatgacgctttcatagccgcagtggacaaaggcaacataaggacaatgcgaaacagaagcaagccagcagcttcttatcctactcctggagcccagctgatgggagatgcattcaacatggggtggaatgaccgtggcattatctga

SEQ ID NO: 57646 - DNA, 564 bp, Glycine max
  Peptide Sequence Number=SeqID_174424
atgataagggggaaattcatgcagattcctcccgagcttcatgacgcattcatagccgcagtggacaaaggcaacatcaggacaatgccaaacagaagcatgccagcagctccttatcctactcctggagccctgttgatgggagatgcattcaacatgcgccatcctctaacagggcctgtggcatccacaataaatacgttggcaagagccctttacaaggttttttgcgcatcacttgacccagcaaggaaggaaatgcgccaagcttgcttcgattatcttagtcttggaggtctattctccgaagggcaagtctctttgctttcaggattaaaccctcggcccttgagcctggttctccatttctttgctgttgcaatatacagtgttggccgtttactgctcccatttccttcacctaaacggatgtggattggagttcgattaatttctagtgcatctggaatcatcttgccaataattaaggcagaaggagtccgtcagatgttcttcactgcaactgtaccaacttactacagaatccccccggcggatgcataa

SEQ ID NO: 57647 - DNA, 555 bp, Glycine max
  Peptide Sequence Number=SeqID_174425
atgaaggaggacgcagagaaagataaaggcaatgacaacaataagatttggggagctattctcttcggcttcattggcgccaccgtcactacctttgcggtcggtcagctgcggaggagtgctgaatggttctatactcagttatcgaggacacagtcatcgtggaaaggagagagtggtggttctttccgatcagcttttcaggaagaggcatggaggaggcacaataagcgcatgcaagaggagttagaggaggagatcgaaagagtggaacgaataaggcgcatgcaaagtgtgtttaacagagaaaggaataagtacaaaagaagctatgagagctggagggaaagtggtcctggtgcatatcatcagcattcccaaagagaagattggtactggaaggctgatacatcctttagagacaagaggactaattatcgagaaactccaagagagagtggaaactatgcattatcacatcactactcagttttgggtcttgacagatgtgagctggattggttgctgaattgcgactctgtgagatcacagtga

SEQ ID NO: 57648 - DNA, 312 bp, Glycine max
  Peptide Sequence Number=SeqID_174426
atggtttttgataaaaccgttgtgcttagctttaaaccaaagattgttttgcaaaaaccgacaatatctagattgagggcccaattggtggctagaaccacggtgttgctagcagagttctatgtcatcactgacaacaccatcatcgtcacccaacgcatcatcaagaagcttccaatagaggccaacttcaggctcacaaattgcaagtccaccctcgcaaagcctccaccctacaccctcgcaaatctggttgtcgatgtagaggcatccatcagaggaagagacagtggtgcacagtgtcagggttga

SEQ ID NO: 57649 - DNA, 207 bp, Glycine max
  Peptide Sequence Number=SeqID_174427
atgcgtctaccggggaaggagagtctgctgatgaaattccccattaccataaatgagattttggatgttagcatttcgtttctaaatgaccatttagaggaaacaccgggttcgacaaaaatagaagaaatcactcaaagtgtatcaatctcgcacagtgcggggcgagaaaaaagggtcgctagcgcacgggattttggttggtaa

SEQ ID NO: 57650 - DNA, 303 bp, Glycine max
  Peptide Sequence Number=SeqID_174428
atgggtcaaagaactaaagttaccagatggctatgcctccaatttaggtcgggcttcaatacagtaagtgaaattgaacaagaggctccatacaaagatgatgagcttgtagggcttcaagaagtgttggaacttgaccctgatgtcattaatgaatctcttgcagatgttgatggaggtggagaagagatagatgcagatttactcaaacaactaggcttgatcaaaccagacaaggatgaatgcatgttaagtgagaatgacatcgagagtgattttgatgatacaaatacttctttgtga

SEQ ID NO: 57651 - DNA, 148 bp, Glycine max
  Peptide Sequence Number=SeqID_174429
atggtcttcctcgcgattttgggcttccgtttcagtggaagtcatcgtcacttgctttttgaacgaggggaggtgtggaaggtttgtgactttgtgcgcatgagcatcacgataatcgtaaggagatggaacgccaatacttttgtag

SEQ ID NO: 57652 - DNA, 825 bp, Glycine max
  Peptide Sequence Number=SeqID_174430
atgggatgtggaaggaaatttgtgatgcagctggtgactggttacttgccaagtgcgattttggttttatttttatatgctgttccaccagtgatgatgctcttttcaacagtggagggatctgtttctcgtagtggaaggaagaggagtgcatgcaccaaatttttgtacttcacaatttggaatgtgtttttcgttaatgtttttgccgggtctgttatcagccaactcgcagtctttagtagtataacagaattacctgcccaacttgccaaggctgtcccagtgcaggctaccttcttcacaacgtatgttttatcatctggttgggcaagtttggcatttgaaactatgcaactctatccacttttctgcaatctgttccagagattcatactcgggtataaggaggatacgatgaatggcaacctaacttttccataccatacagaagttccaaggatcttactgtttggattccttgggttcacctgttctattctggcacccctaatattgcccttcttattgttttactttgtacttgcgtacttcgtttaccggaaccaggttcttattgacatggatcggagagatgaacggtgtgggagaatggatcagatttatgaacaagtgcaatcagcatactgccaggccactcattctactcaatccgaatgtttcagcagtcatcaaggagacagggaacatgttagaactccagaagaattggagacaggcaaggaaattagccaaaaagatttgtcatggccgccagttcttcgtagtttgagtttggataattcggtacttggcgggaagtaa

SEQ ID NO: 57653 - DNA, 570 bp, Glycine max
  Peptide Sequence Number=SeqID_174431
atggacattgctgctcttttaacttctgctggagttaacattgctgtgtgcgtggtgctcttttcactctattcagtattgcggaaacaacccagcaatgtccgtgtgtactttggaagaagggtagcatctcggtgttcaaaaagccgtgatctttgtttggaaagatttgttccctctccgacttgggtaatgaaagcatgggaaacaactcaagatgaaatgctgagtactggtggcctggatgcggtggtttttagcagaatggaatgtgcagctgctttcgtgttctttaaaagtcggtatgctgctcttacggttgcccaaaatcttcaaacatcaaatcccatgttatgggtcacagacctagctcctgaaccaccggatgtttactgggccaacctttgcataccatacaggcaactttggatccgtaagatatctatatttgtggcttctgtcaccttcgtgcttgtattccttatccctgtcacattcgcacaaggcttgactcaactggacaagctagagagaatgttcccttttctggcaggaacacttcaaaagtaa

SEQ ID NO: 57654 - DNA, 1173 bp, Glycine max
  Peptide Sequence Number=SeqID_174432
atgtcgtatgctcgtatatccttggacatcaaggggtcagagtggagtggagtggactcaaaaaagacaagggttatctcaaataatcaatctaagctagctgaaagcaacaacaacaacatggggagggcaccttgctgtgacaaatcaaacgtgaagaaaggcccttggtcgccagatgaagatgccaaactcaaatcctacatcgaacagcacggaaccggagggaactggattgctttgccacaaaagattggcctcaaacgatgtggcaagagttgccgtctcaggtggctaaactacctccgccctaatatcaaacacggtggtttctctgaagaagaagacaacatcatatgcagcctctacgtttgcattggaagcaggtggtcggtcattgcagcacaattgccaggaagaactgataatgacataaagaactattggaacacgaggctgaagaagaagcttctagggaagcgccgtaaggaactacaggcacgaaacaaaggaaacggtgtcgttgagcacgagaacaattcctcactcttgcttcaggaaaacagtgctcaacaattacatccatgttggccacagattcctgcagtgttgccactttcaccctacacaaaccaaagtccaagtttcaacgaccaagactctattagaaagcttctaatcaagcttggagggagattctccgatgattatcaacgcatccttgacgggttgaatcttcagttcccacatggttctctctcatcaacacagcttcttcaagaggagcaagtccattttgtttcttctgcagggtgcatgaactctattggcaacaaccaagtacagtttggtcagagcaatgagtaccgtgctgagttggtgcaaggacaaagcagtttcactaccactacaattggggaaatggtttctgctaatgattattctcaaaggttattaggtgggtcgttggagttcttctatggggaggaaatgattaccgataagataatgggtggtgcttgtgcttcttcaagttgtggacaaagtactgattggggtgaaaccagttctctgatttatcctcctcttgttgcttcgaattacgagggtgtgcgtcaagagatgccacgagaatgtgtttttcaagagttaagctacccgggggcacaatag

SEQ ID NO: 57655 - DNA, 637 bp, Glycine max
  Peptide Sequence Number=SeqID_174433
atgaagcaagctttgcttgacaggtatggagttgaaccaactaatcaaatgcaattgtattgtgccaagcaaagggtgcaccaaaccactaaagggggtccacttggagggacattattatctgttgttgtgcttgacagaaataagggcatattccctattgcattcacagtggttgagattgaaaacaaggattccttgaagttttttctaactttgttgagggaagttttacaattagttcctgaatggaaggatgattttgtcactatcatgtcagatcaacaaaagggtttagaccgagctatagcagaaatgtttccatatgcaaaacacaagctcatggttactttccaaaaaagatatgaaagggtaaccacttgtcaaaatctcatgccacctagagtgaagacctacttggataaaactttgcaggcaacgaggtctttggttgtgacatttgctggaaatgatgagtttcaagtgatggatgtgtatacaaattttgtgcccttacaaattcttaagttattggttgcttatggtgaagttatccgtcctgtgcctgatgttgatgctaattctgataggggaggttatcctaatattggtcctccaactttgaaaagacaaccag

SEQ ID NO: 57656 - DNA, 300 bp, Glycine max
  Peptide Sequence Number=SeqID_174434
atgccgataatcggaacgaacaattgctttgcttctcagccctcccctcttcggagtcacagcagtgatgacgagtatgctgatgtggactgggacagtcttggatttggactgatgaccactgattatatgtacattactaaatgttgtgagggccaaaattttggacaaggacaactcagtcgttatgggaacattgaactcagtccatcagctggggtcctaaattatggtcaggtgtcaaatcatatatggttgttgaatatggacgtataccagttaaagacttcaagaaattaa

SEQ ID NO: 57657 - DNA, 269 bp, Glycine max
  Peptide Sequence Number=SeqID_174435
atggcttcagcaaaacccaaaccaaggaaaaggttaggagaatttctaaaggagcaacaagagcctttcatcctagagctttacctcttagaaaaaggttgctcaacaaatattggagaatctggaaagagcatagagagatgggactctgacattatagacgaacatgttaatgttaatgttagtgtccctcgtgaagttgagagcactgatcaaacaattgaggacacagatcggttttcattctcaacagctaccaactcaaccgt

SEQ ID NO: 57658 - DNA, 114 bp, Glycine max
  Peptide Sequence Number=SeqID_174436
atgggaaacagcagactcccgcaactccaagagctcaagcctaaagccttagtaacgcgcatcctcattgctcgcgtaaagcaagcgtataagatttgcttgtgtcgaacctag

SEQ ID NO: 57659 - DNA, 435 bp, Glycine max
  Peptide Sequence Number=SeqID_174437
atgaaagattgcaaaaatacaagtggtgaagatgtctccttcacctctaggatctcacaatcactcataaactcatctcaagctctcagaacggcttctgctttgagcggtgcacttgatgacctggagtgtgaggcctccacagcccaggtgcctcagcctgtgcaggaggatgtttctgatgacatctcaaagccctctccatcagagtcttttattgttgaggatggtctagctactccacaggaggacactgcagcaattaccccactggtgactccacagcctccaccagagcatatcatttcagagttagacctgtcatctcctcagcctgagcctgagccatttgcactagtgctagacttgcctatttctcaggatctaccatttacaccaggattggacctgaatgacgctgcacaggatgattaa

SEQ ID NO: 57660 - DNA, 294 bp, Glycine max
  Peptide Sequence Number=SeqID_174438
atggaacgagatgagaaaagatttgaataccgtttctactgttcttcggaagaaaacaatgtggaagaggataatgagggtggaattggtgctgtggatgcgctaatttcaatcggtgaaatcaaaagaaaaatgaaaaagaagaagattgcaatttatgggagtcgatttgatgaagaaatgagtgagattggaagatttggaggtttgggaatggaggaacgtcgcaaggaggaaggggctgtgcagggatttctggaaaatgtgatatttatagagcaggacgcgtggtaa

SEQ ID NO: 57661 - DNA, 528 bp, Glycine max
  Peptide Sequence Number=SeqID_174439
atgaatcaggatgtttcgggaatggaagagagaatgagcagttgctgtgtctttgtaccgaagaaaatcacggaggattcgctgctatcggtggctctgtggagttcgcttattcaatcagccaagagagaaaagtgtagcaaggagttgcgagagttccttggggcaaatccagatgtttgccacgtgttgaagtctaaaacgttgttgcataaggcaaagcaacttttattttattgtgtgagagagattagtactcctataaatctttcgagaaaagattgtagacaacaacaatgtttgaaacaattgactaggggacccgaagagctggggaagataatatgggaaaggacaagggagttgggtggaaatgagacaaatctaataacaaagttactgagtttggattcgatggatgaatggagtgagttgaaaccgcaagtgagacatatttgcgttgaggttgctgaagcggttttgggaacgcgtgactacgaaaattgtagcagagatgattcaagttta

SEQ ID NO: 57662 - DNA, 564 bp, Glycine max
  Peptide Sequence Number=SeqID_174440
atgttgctgatcactgctacacggagtttcatatcattgttaacttggaataacaaccacaaaaggaataatgttgttatcttaggcacaccacaccaaatttttccaagtctctcccaacaatctctcccgcaattgctcgctgttatcggatatcgctcaccgtcaccagagacgttatcctacagcggcacttctttctactttttttattctctctccagccttaatccgaaatcctccaccttaatttgtatgtccctctccaaaataaaacaaaaatcatcatatttcaaactaagatatgcaagtgctccattatggttccgatcaggatgtacttggtggagaacgcgacggaggagtggagttgcagagttgtgtcagacgaccgccgtagagttgcgcgaggcaaatcgaatcgaacctactgtcgccgtttttttgcttgcaatagttttgcgtgacgattgcggtggcggcgagtggggacggaggcttgcagtggttctgcttgatgaggtttcgagagtcgtctttcttgttggccacaatggtgattga

SEQ ID NO: 57663 - DNA, 312 bp, Glycine max
  Peptide Sequence Number=SeqID_174441
atgaatttcaagatggattccgatagcgcgaagctgttcgtaggaggcatttctcgcgacactaccgaacacgttctcaaactccacttcgccaagtacggcgtcgtttcggactccacaatctccgtagaccgcaccacccgaagccctagaggttttggcttcgtcaccttctccgacctctccgcagctgataaagccctccaagacacccacgtcatcctcggaagaacggttagtttcattgcacgtttacgaatttcaagaaattgttttcttggtagaagtgaaaaaagcaattcccaggagtga

SEQ ID NO: 57664 - DNA, 429 bp, Glycine max
  Peptide Sequence Number=SeqID_174442
atggagcatagccttaaaaacgatgtttattttcaagaaaaagtaagcgtacccttctcatgggaacacgagcctggtctctccaaagtcaatcatcagaaaaatgactcaaggcacagtaatttagtgttacaacctcctcctccacgatcatcatctaggaatggacgcaagaaacaacttcgagttgaggacgcagagaatcctaattttattctatgtgcagttcaaccttcttccaggagaattagatcgttccgattggagagtgatcagaaaggagatccttttgtcaaagcttacaagaaatgcaccgaaacccccaaagatccctttatgcataaagggtctagtaataagagtaataaaaacaatggatcttggcttaacatagtgagctgtaaccgcaaagccattgagaacacttaa

SEQ ID NO: 57665 - DNA, 658 bp, Glycine max
  Peptide Sequence Number=SeqID_174443
gtcgactctagaggatcccaaccgtgcgctccccgatcgccagcccgaccgtcatgcccacgcccgagtgcatcaccgcgaccgtggtggcggcgtccaccggcatcaccgagaacggcgccggcccatgcgtgccatagacgccctgccagcgctccagcacccgcagccgcgcccccagcgcctgcgacgccaggtccagcatggcgttgtcgatggcctcgtcgttgaacgggaaggcatcctggccgtagcggtgcgaatcgccgatgatcagttcgccatagggcgtggggctgatcagcaggtggatgccgttttccagcagcatcggcgtgcgcgcctggatctgctcgcgcagcgccaacgccgacggcaggtccgagaaggcgccgtagtgcacgcaggacaggccagtgagcagcgggcggtccagcgccatgggacgcgtctcgaaagccgcgcgcaacatttgcaggcgcgtcacttccaggttcagcggcgcgaaccgttcgggcagcagcgtcagatagtcgtggccggggcagacgaagacgtgcgcaccggtgaagtcgcccgcggtggtcgcgacctgcccttgctcgacggcgcgcgccagggtgccggtgacgaattcgacgcccagcgattcggccag

SEQ ID NO: 57666 - DNA, 276 bp, Glycine max
  Peptide Sequence Number=SeqID_174444
gcgtatggttgctggtaccctgtgggtggttatggggggaatggatacgcagttccttctgatgctcctagtaacctctggattggaatagtaggtagtggtgctggatcttgggggtacactggcattatgggatctgcaacaaattttaaatttgatcaagcttttaatgccaatgaatttgttcctggcaatgtgacatcacctcatggtgtaaagcaggatgttattgactcttcaagtttgaaaggaagcaatggtggaatttctagttga

SEQ ID NO: 57667 - DNA, 186 bp, Glycine max
  Peptide Sequence Number=SeqID_174445
atggtgggtgtatgcacacaggtggttctatcagcttgcaggatcatgccatttgcttggtatttagaggagcttggtcaatttgtatatgtagatgaggtctttcaacaaactcatttacgaaaggatattggtcaatttgtcaatgatagatctaggcggacacatgtgagaccattaccttga

SEQ ID NO: 57668 - DNA, 117 bp, Glycine max
  Peptide Sequence Number=SeqID_174446
atgccgtcgggaaaagaggtttgggtactgcctgcgcctgcgcctgcggtgacaatcgtcaaatcaaatcacgcaccgtcgcaccctaaccctacagctatgctttctactctgtag

SEQ ID NO: 57669 - DNA, 184 bp, Glycine max
  Peptide Sequence Number=SeqID_174447
aatgaccaaacttggtctctgcgtgccaacggacatgactgtgtctgaatggcaaaggggtgcggataaccgtaagaatgaccaaacttggtctctgcgtgccatcggacacaactgtgtctgcctagcaaaggggggtgcagataaccgtaaggtatctccgcgtatcatgggtgcagaatga

SEQ ID NO: 57670 - DNA, 303 bp, Glycine max
  Peptide Sequence Number=SeqID_174448
atgattcaagagaaaaagatgaaaagtgaggagagaacacaacaacaatgggagaagtgctcacaagtagaaattcaacaagaaagtattctccaagtcaatacccctcatcatcaattgattgtcaatgaagaaaggaatagagaatgggataaatctttaagcgacattctctccttgatcactaacacttctcttacattgatatggaatgcgtttctgggatacatgagtttcatgagtctccagctaagaggcaaaaatgcaaaagatgtgttctatatgaccttaatgccaccttga

SEQ ID NO: 57671 - DNA, 270 bp, Glycine max
  Peptide Sequence Number=SeqID_174449
actgtgagggaacgatggagacaatttaagtttgatttgacatcgaaatgggcatttgaagccgacaaggacagtgccgatgacactgatgtgcggaaaaagtcacatgccattcagaaacaaaacattgcccctcacatgttgtctcgtgggggttatgaatttctagaaaacaagttgatggaggagaagaaaaacaaacaattggaggaacctactaaatctggaagcactgacttcgtcattaatactccatctctcatcagatga

SEQ ID NO: 57672 - DNA, 177 bp, Glycine max
  Peptide Sequence Number=SeqID_174450
atggagaaaggtacaagtcttcctatggagaaagaggaggagccaatgtggttgtcccaaaaggatgtcgatcttgagttagaagataaggagttttgggagagggaaagtgcaaaggaattgtttgtcaatgtgacaaagagatgtatggaatgggagaaggtcaaagaaatgtag

SEQ ID NO: 57673 - DNA, 516 bp, Glycine max
  Peptide Sequence Number=SeqID_174451
atgtatgacacattcgaccagagatgtgaaaagagcggcgccaaaattgtttgttgtacaccagctctctacgtatggttggtctcacacctctttccccaagaaggtaggcccggctgcccactacaaggtcaccacttgagtgacgagaaaggaaaggcaaattgggaccaactcttggctagcatggagggggcatccataaattggttccctcattggaaggaaggaaggatcgggattctttgctcatgcaaaggatttccaaatgttcccttgatgggaacaaggggttgtattaattataatcccatcctctccattagacagcttggctaccccatgagaggagtgccatcggaggaaagcatcgcgcctttcatcgcacggggtttcagtgaccccaacgcaagggtacttcaaggagttcacaaggcatgggatatggtgcaaaggaatgacaaagagcttaggggaagtagtaatgggatcattggcgctatcgtaagtgcctga

SEQ ID NO: 57674 - DNA, 681 bp, Glycine max
  Peptide Sequence Number=SeqID_174452
atggggaaaaatccaaacggaaaaagattctatcaagtcaagattaagggcctagatgtcaccagccttaaggagttgggacggttgatgggacccctccaaaggcaagccttccgcaaagtgtacagaaagattttagatttgaccacagcggaggtatttacggaagccgttgtatccctcgcccaatactatgaccagccgttgagatgcttcacgtttggggacttccaaatagtaccgactgttgaagaatttgaggaaatattaggatgccctcttgggggaagaaaatcgtatcttttctccgggtttcttccctccttgagcaagattgcagctgtggtcggggattcggcgagaggtttggatcgtatgaagcaaactcgaaacgacatagtgggcctaccgcggaaatacatggaaggcaaggcaagggatatggcgagtcaagaagagtgggtcctatttgcagatatactagctttgctaatctttggggttgtcttttttccaaacgtggacagtttggtggacctagcctcaattgatgctttccttgcatatcaccatagcaaggagagcccggtggaggcagcacaatcaactggtttcctcgatggaaggaaggaaaggagggagttctcttctcatgtggggactacccaaatgttccgttga

SEQ ID NO: 57675 - DNA, 294 bp, Glycine max
  Peptide Sequence Number=SeqID_174453
atgaaagctatgccaagcaagccaacaagaaaaggaaagaagtgctacttgaacccgacttatcaaggtaatccttgtggcgtcatccaaatcttcgtagcctgtatcaagcgatctgctcctagtgaggatcatgtcatcagtgatgaggacacaactaaggacaaggaccatgaagcacttgaagggcccatgaccagaggcagacttaaacaggcccaagtggagaaagatggaggcctagaggcagaggcactaccaagactattaattgttgctgaaggcccaaattaa

SEQ ID NO: 57676 - DNA, 468 bp, Glycine max
  Peptide Sequence Number=SeqID_174454
atgtggttttaccaccgcaaccagcgggtacaatcgctggtcatagccatttttcttcacacccgcattgctcagtttgtgcagtttccaactctgaacagtcagaaacttctaccccctcttagtttttttttttttttttcatatcctttcccactgcacattggatatgccctccatcctctcttcaccaaattttcacgctgcaacagcgtgctccaccagagagactctgaatttgggtccaacaccgcattgaaagtcatcgttgtgactcacaatgcccagtgtggcatcaatctccagtggcatgtccatggtggcaaggtgggagaaatgggatatgtacgagaacatgagatacagagaagagagaaaggatatacgggaaccgagaacgtgatcactaaggagagagaaataggatacatgaattatggaggagagaaaattgagattttattttaa

SEQ ID NO: 57677 - DNA, 408 bp, Glycine max
  Peptide Sequence Number=SeqID_174455
atggcatcgaagcaaggtgtgatgaaatcgaggaggttcggattgagtggctctaaaggtgcgaattcgccttcgtcttccaccacgtcgtcttctaagcagtttcaggagacatcggccgatggcctgagctcgccggcgtcttcgtcggctcggagtaagccgcagcattttactccagaaactgcggttgcgctacctttggatggaaagagagtgaaggaaaatgtcacagtgacgattcctgttaatttgattgaggtctgtgcgtgggacagtccaagggaaattcgtcaaggagaggagattgcttggtatgcagatggagaaactatattgcgaaatgagtataatccatccatagcatatgcatacggtataatatgcaaaactgacatttatggatag

SEQ ID NO: 57678 - DNA, 1020 bp, Glycine max
  Peptide Sequence Number=SeqID_174456
atgaatgagaaatttgaaggaggatctaaaacaaaaagtaaaagatacttctgttcgaaaatattttggatacagggtcccaaaaagaaaccgattgagagtcttaacataggacactgtactaagaaaaggccatttgaggacttgcagggtaatgatcacaaagatgtcatgatcctatttgagatgaaaagatttcaaatgtcattaaaatatcgtgtctttggtcccacaaccacaactcgtcaggtctatgatgttgctgctcagcatgttgttagtggttctatggagggcatcaatggtacggtatttgcatatggggtaacaagcagtgggaagactcatacaatgcatggtgatcaaagatctcctggaatcataccccttgccgtgaaggatgcttttagcattatccaagaggtggttaatgacttattaaatccagcaggacagaacctaagaatcagagaggatgctcagggcacctatgttgagggaataaaggaagaggttgtactctcccctgctcatgcactatcccttattgcagctggagaagagcacaggcatgttgggtccacaaacttcaacctactcagcagcaggagccatacaatatttaccctgactatagagagtagtccatgtggtgaaaatagtgaaggagaagcagtaacactgtcacaactgaatctcatcgatctagctggttctgagagctcaaaagctgaaacaactggtatgagaaggagagaaggatcttatatcaataaaagtcttctaactcttggaactgttatttcaaaattgactgaagataaagctagtcacataccttacagggattccaaattgactagagtacttcagtcttcgctaagtggtcatggacgtgtttctcttatttgcacagtaaccccttcatctagtagtactgaagagacgcataatacattgaagtttgctcaccgggcaaagtacattgaaatacgagcagcacaaaacaaggcaagttaa

SEQ ID NO: 57679 - DNA, 1713 bp, Glycine max
  Peptide Sequence Number=SeqID_174457
atggttctcaattttaattatgtaaagttagaagatggtcaagttaggttgcaatccagattggaacaagaagaagaagctaaagctgctttgttaggcagaattcaacggttgactaagttgattttggtctccacaaaagcatcaccgtccacaagatttcctaacagacctggtcctcgtagaagacattcctttggggaagaggagctggcttaccttccatacaaaaggcgggatttaatcttagacgaggaaaacattgatttgtatgttaatctggaggaaaatgctgcaacagttgatgattcttttaagggcgagaaaaagacgaagaaacatggactactaaattggttgaagttacgtaaacgagacagtgccttgacaggcacaagtgataaatccagtggagcaaaatctactagcacaccttctacacctcaagcagaaagtggtaatcatgtggagtccagactttctcattctcaacctgcagaaagctctccctctgctgatcttgcatcagaggcaagagaggataaatatattcatgtggatagtttattgggacaggagactcctttgacaagcatcaaatcggttgatcagattgatcttctgagggagcagcacaagattttatctggagaggtggcacttcattcaagtgctttgaagaggttgtcagacgaagcaacaagaaatccccagaatggtcaggtggagatgaaaatgttgaaggatgaaattacagcaaagagtgaacaaatagatttgctggaaaagcatatttctaattctttcattgcttcagataagacagaagagtcaggagcattgcagactgttgctgagctgatggaacaattaaacgagaaatcctttcaacttgaggtcaaagcagcagataatcgtgtaattcaagaacagcttaatcagaagatttgtgaatgtgaaagccagcaagaaacaattgcctctcttaaacagcaacttgcggatgcattggagttgagaaatttcagccctgtagtcaatcattcacaaaacttctctggaaccaaagactattgtggtgaacttcaccttgacagggggaatgtgacggtaaacaattccaatgaagggattcatttgcaagcacagataagtgagatagaagatctgaagcagagagtggcagaactaacagaatcaaaggagcagttagaatttagaaatcagaaattggcagaagagagttcctatgctaaagggcttgcttcagctgctgctgttgagcttaaggcactgtcagaagaggttgccaaactcatgaaccagaacgagagactagctgctgagctagctgcatccaagaattcacccgctgaacgtagaactagtggcacagtccaaaatggacgaagggaaagtcatgttagagttagacgaaatgatcagggtgcatcaaacgccaatatcaagagagaattagccttgagcaaagaaagggaactttcatatgaagctgctcttttagagaaagatcagaaagaggccgaacttcaaagaaagattgaggagtcaaagcaaagagaagcatacctggaaaatgaacttgccaacatgtgggtccttgtggcaaagctaaaaaagtcacaaggagctgaaactgatgtttcagtgtcaactaaagagagtttgcagttggatggttttgacgtttga

SEQ ID NO: 57680 - DNA, 249 bp, Glycine max
  Peptide Sequence Number=SeqID_174458
atgtttacacgtgcatggatcctaagattcattggaggtgtcttatttgttgacaaaggtagtagcaaagtttcgctaaggtggctgcgacggggaaatcaacatatcgccaatgatgatttgatacttttttgtcacaaattagatattatgaaacgacatgagtttgtgtgggagccttacacaacaaatgttatgtcagtgttgcctccaatttgtttagttggaagtgtagcgtggtgcgcgatg

SEQ ID NO: 57681 - DNA, 403 bp, Glycine max
  Peptide Sequence Number=SeqID_174459
cgtgactcaaatgtcagtatgacagatcttgtgagcgcggaagatgacacagcaaaaaagaatgtttatacggaaaaccactcgggtatctccgcccgtcagcgtgactcaaatgtcagtatgacagatcttgtgagcgcggaaaatgacgcttttcgtcttacagacaacaagaagaatgtttatacggctaaccactcgggtatctccgccggtcagcgtgactcaaatgtgagtatgacagatcttgtgagtacggaagatgacgtaaatctccgcgtgtcaacgggcttgtcggccgcgattgacgaagggcgcagaagacgatgtcagtcttcgcgtgctatcaggcttttcgtcttacagacagcaaaaaagaatgtttatacggataaccactcgg

SEQ ID NO: 57682 - DNA, 493 bp, Glycine max
  Peptide Sequence Number=SeqID_174460
atgtcagaaatgcgggtatctgagcttcacttgaagaaggaactcacccaaatccgcaaggctgctcgagtgctcagagatcctggcaccacttcttcttggaagtcacctctcagttcatcaagatctgtggctgcatggaacaacgacactgccagtagaaggctcactactatttcacaactgggtcccaacaacaccaatgacaaggacaagagggtgttcttgtacaactggaagaactacaaatcttccagtgagaaatacaacgatgaggaggaagaagaagaagatgatgatggatcttcttcgcttctcggggacagagacagagatagtttgagtgatgctcgcaatggttgtgactcaaagagtgatacttacttggctgctgccgttggtggtggtggtggcggtggcactcgctcttccattttccgatgtggggatgccaatcttgtttccagaagaacggttcccgttaagaaaaaga

SEQ ID NO: 57683 - DNA, 588 bp, Glycine max
  Peptide Sequence Number=SeqID_174461
atggacagttggtcaacggtctccgtcggcctgcagcagcacactcagcagctggagcagttcacccgcctggcgaacagcagccatacgctggcgttgcagatcctcgccgaggcgctggagccggcgcattactacacccgtcagcatctcaagttccaggcgaacaattaccatcaatttgaaccgcttaaccggttggccgatgcgttaccggctgagagtgacaccgtacgcagcctgaaccagtgggcggagcggctgatcagcgatgccgaggatactgagagcgccgatgcgctgcgccacgtctttacccgctggcagaacaacagcggcgatgcgctggcgctgaccgacaataactatcagctggcggcgattaaaccggtggtgcagcaggttgataagctggcgagcctcgggctgcgcttgaccgatctggtggcgcggcagggaacgctggacgataaagagtacgcctcaatccaggcgcagctggatacggcggcgaaaacccaggatgagctggtgattgcggcggtctatccgctggagaaactgctgcgggcaacgaagataaaatag

SEQ ID NO: 57684 - DNA, 747 bp, Glycine max
  Peptide Sequence Number=SeqID_174462
gactgcacgtctacctttagagactacacgccctccttcagaggaatacacgtcctcaccttcagaggactacacgtccttgctttcagagcattgcacgtcctcaccttcaaaggactacacgtcctaacctttagaggactacaaatcctcaccttcagagggctacacgctctcaccttcagaggactacacatccttgcatttagagggttgcacaccctcacctttaaaggactgcacgttcttacctttagagaactacacgccctccccttcagagggatacacgtcctcaccttcagaggactacacgtccttcccttcagagggtttcacgcactcacctttaaaggactacagctcctcaccttcagaggactacacctcctcaccttcagaagggtacacgctctcaccttcagaggaccacacaccctcacctttagagggttgcacgccttcacctttagaggacagcatttgctcaccttcagaggactacacgtcctcccctttagagggctacacatcctcacctttagagggctacacgccatcaccatcagagggaaacacgtcctcgccttcagagggctacacgccctcgccatcagaggactacatgtcctcgcctttagagggatacattccctcgtcttcagaggactacacgccctcgccttcagagggctgcacctccttgccttaagagggctacgcgccctcgcctttagaggactgcac

SEQ ID NO: 57685 - DNA, 327 bp, Glycine max
  Peptide Sequence Number=SeqID_174463
atgtcaatgaaccggcaagcaatctgccgttcatatccgcctgatcattgcagaccatacggtgggcatcaagactggagtaatcaaacttctagttgtcaacaatggtgccctcaaaaggtcaagatatttgagatcaagaattggacgagattgaagagagaggagtattggatacgctgttcattagatgaaaacagtgtagaggatgacaaggaaggtggaattggtgccggggatgctccggtggctccaggacgtggtgttcgagttgccgcaacggaggtggatgaacccttacacttcttggataattcttccatttga

SEQ ID NO: 57686 - DNA, 1977 bp, Glycine max
  Peptide Sequence Number=SeqID_174464
atggtgaagaacgccgaggtcatgaactttctgatccacggcaccatcggcgtcggcaagtccacgctcatccgctggctgctggactatatccgccggcgcggcgaccgcgcgatcgtatacgactccggcggcaccttcattgagacgcactacgacgagcgcctggacaaaatcctgaacgcgcacgacagccgctgtgaaaactgggtgctgtggcgcgaggcgcgcgacgtggtggactacgagaacatgacggcggcgctgatgccggtggagggcgactccgacccgttctgggtgtcttcgtcgcgcaccatcttcagcgacacggccatgcagtttgcctcacgccccgatcgcagcattgagacgttcctgaagacctgcctgtccatcgacctgaaaagcctgcgcgagtttctcaaaaacacgccgtcggccaacctggtcgaggagaaaatcgagaagaccgccatctccatccgctcggtgctgaccaactacgccaagtcgctgcgctacctgcaggggctggataaagagggcaagccggagttcagcatccgcgagtggatgaccgacgcgcagtacgacagcagctggctgtttatctccaccacagcccgccaccgcaaggcagtgcgcccgctgatatccatgtggctgtcgctggccaccctgctgctgcagagcatgggggagaacagcgaccggcgcgtgtggttcgtcggcgatgagattgccagcctgcagaaaatccccgagttcaacgaaacgctggccgaggcccgcaagttcggcggctgcttcgtgctgggcattcagaacatcccgcagctggtgcacatctacggccgcgagatggccaaagccatcctggacctgctcaacacccgcgcctacggccgctcgccgagcgccgaggtggccaaaatggtggaagaggagctgggacatcagcggcggcgcgaggcgcgcgaacagaacagctacggcctcgaccaggtgcgcgacggtatctccatcagcaaggacaaggtcaacgagcccatcgtggactacgaccagattatgaagatgcccaacctgcgcttttacgtgcgcctgccgggcgaatacccggtggtgaagctgagcctgaagtaccgcagacagaagaaatatcatccggcgctgatggagcgcgacttccgtgaccggctgagtcccgaactcgagcgcatcatcgaaaacaacgagcgcagcgcccgggcggcggacatttcgttcccgaccggagaggagtggctggaaggggaggaccgcgcttctgcgcccgcaccggttaaacctgcggctgcctcgccgtccgccgcgccggcaaaagctgacgcccccgtgacgaggccggagccggctaccgtgagagaggtgaagccgtctgtcgcaccgggccagcctgctgttcccgctacgcctgcccccgacataagcgcatcgtcaggggcttctaacgtgcgaccgttcccgcgccgcgaagtggttccgcgcgtcactacggttccggctgaatcatccacacctgccattgtcccggagggcggtaccgccacagcaccgtcggaaatcatcagggttgtttccacgccggcaccggccaggaaagaggcgggttcgccgctttctccactggagaggatgagaaggctccagaacagcacatcaggtaatgcagaaaccgacagcgaagcccccgcaggtgaagcccccgaactgcacatgcagatggagaaagacgacgggggccggctgaccgtgcggcacatcagcccgcgtaaaaccgaacagcagcgtgaggaggagcgcgccgcactgcacggcgacgccaacgagcgtatggccgacgacgaaaaaaacatcctgcggcaccgcgacgactacgcggcgtaccaggagatgagtgacagcctggacccgggaggatatgaacgatga

SEQ ID NO: 57687 - DNA, 1212 bp, Glycine max
  Peptide Sequence Number=SeqID_174465
atgcccacccagtggctgggagagggcgcgcgcgagctggggctggaaggcccggtcgatctcgatactttcaccggaattctgcacggcagcctccccaacggtgtggtactgggtaaggacgttcagggtgcacacgtgcaccgccccggtcatgactttaccttctcggcacccaagagcgtttcgatgctgatcctcgccggcggcgacaagcgcctgctggaggcgcaccacgatgcggtgaaagaaacgctggccatcatggaacagatggtgagcgcgcgcgacacgaaggagggcgtcacgcgcatcacgcctaccggcaaaatggtcgctgcgctgttcacgcacgacacttcgcgtaacctcgatccgcagatccatacccacgcagtggtggccaacgtgacggagctggacgggaagtggaaggcgctggctaccgatgcgatccacggcgccggcttcatcgaaacggtgtaccgcaaccagataacgtacggcaaaatttaccgcaacctgctgaaaggtaaggcggaggatattgggtatgaaacgttgcccaccggcggccggcacgacctgtgggaaataaagggctttaccggggaggtgctggacgaattctcatcgcgccaccgtgaaattcatgcgcgcgcaggcgaagacgcttcgctgaaaagccgcgacgtggcagcgctggatacgcgccagcgcaagcaggatatcagtcagtatggcgcagacgaaacggcaccgttacgcacccggcaggaaccgcccgcctcaccagagctggctgtgaatgcgtctgacagagtccctgaagcaggcactgaggcgacgttaaaatctgcagtccgggagcaggaagagccgatcgctaagccagaaaccgcagacggacgggcccgtctgcgcgatcgctggcagcggcagatggacgacgtcggttttgatcttcagggcgtcatgaatgaagcccgcgagcgtgaaaaatcccggcctgatgccggtgaggtgcaggacgcgccagtgcaggcgatggaggcggtccgcaccgccatttccgtgctgagcgacaacaaaatgcggtttacctatggggacatcctgctgaccgcacacaacgccggtgaactgcagacagcattccgacctgcgcaggcgctggatcagcgattcatacaacctgctcggcctctcgac

SEQ ID NO: 57688 - DNA, 273 bp, Glycine max
  Peptide Sequence Number=SeqID_174466
ggtccgctcttgatggtgaagaacacattggagaatggaggaatccaatcgggaaaataacaaagatcacatttcctagtcatgaggggtccgctcttgacggtgaagaacacattggagaatggaagaatcccatcgggaaaataacaaatatcacatttcccagtcaagagggtccgctcttgacggtgaagaacacattggagaatggaggattcaatcgggaaaataacaaagatcacatttcccagtcaagagggcccgctcttgacg

SEQ ID NO: 57689 - DNA, 840 bp, Glycine max
  Peptide Sequence Number=SeqID_174467
atgattgatagcaataacaatgtcaacatgagccaccacaatcctaatttcacaggaacaaaggaagttgttgttgaagacgaggaatcaccattgttggcgttgccactgctaagaaacagagaggaagatgaacaagggtcagggtcaaaggcatcggttactggttctgtgttcaatctctcaacaaccatcatcggcgccggaatcatggccttacctgcagccatcaaagtcgtcggcgtcggcgtcggtgtcgtcgccatcgttttcctcgccttcctaacacacacctctctggagattctcctcagattcaccagagttgccaaggcttccacctacgccaacctcatgggtgatgcctttgggagttctgggacattgctgtttcacctctctgtacttatcaacaactttgggatacttgttgtctacgttatcataattggcgatgtcttgtccggaacatcatcgagtggtgttcatcattttggggtacttgaagggtggtttggtcagtgctggtggactgcacgtacttttgttcttcttctcacaaccctcttcgtgtttgctccattggggttctttaagaggatagattcattgagacatacttctgccttagctgtggctctggctattgtgtttctactcataactgctggaattacattcgtcaaattgttaaatggcagtatagctagtccgaggttgcttcctaatattactgatgttacatccatatggaatctctttacagcagttccagttcttgtgacagcttttgtttgtcactacaatggtaaactacccgattgtattctgcaattttag

SEQ ID NO: 57690 - DNA, 306 bp, Glycine max
  Peptide Sequence Number=SeqID_174468
atgaaaggtttcaagtcattcaagaataatgattatttgcaaaagaaagattgtgttgtcctcaaatctagagaaatcagctccataagagaaggaaaaaaaagctcctctaaagctcttaaagtgcagatggttgggtttaatggatcagacaactctgaagggtccacaaatgacaaggtggctcttgtatccaagaagttcaaacaaatgatgaagaggaaaagaaaataccaccatttctctagaagaaaggacacaatattgaaaaagaaatacaatgaggaaagaaatgaaatcatctag

SEQ ID NO: 57691 - DNA, 231 bp, Glycine max
  Peptide Sequence Number=SeqID_174469
atggagatgcagcggaagataaaggagaagaggctaaaaccctatactactagaatggccaaaatacaaggcccaaaagaaagaaaaacctattctaatatttacaaagaagaatggatccaaccttggcccatgggctcaaaaatttaccctaaggttcttgagaaccctagggccttctttagcagctctagcccaatcctcttggagtcttctattcaatacccttag

SEQ ID NO: 57692 - DNA, 260 bp, Glycine max
  Peptide Sequence Number=SeqID_174470
attgccacaagagagcacaaagctgataatcaagtttcttccactgctcacgtttgtcttctgaaatcttttctgaggattactctagatgttcatgataaccttggccaagaaaccaaagttcaacagaggctgaccatgtctgaagccatttcagcacttgtcaaagagttttctaatcgaagaactgatcacctaggaaggaagaggagaggccggcgatttttggtgagggtgaccaaggcggccttggatagtgg

SEQ ID NO: 57693 - DNA, 306 bp, Glycine max
  Peptide Sequence Number=SeqID_174471
atgcttaggtggcataaggcattgggctcatacttagcccatggacccgaaatctgccctaaggctcatgagaaccatagggcattcgcttgcatctctggcccaatctacttggagtcttctatccaatgcccttgcggggtaggattgcatcacattggtacgaaagttgttgagggtaatgatggcaatccaatgacacctgagacattaggtggacgcctagccatttttatagtaccaaactgcattggagaggggccaaaggcttcaatgcctgtcacaggcccaatgaccataagttga

SEQ ID NO: 57694 - DNA, 249 bp, Glycine max
  Peptide Sequence Number=SeqID_174472
atggagtggttccataggatatctcaacccttcatgacagcgcctagggagccttctagacattcacctatggtgcatgatgatacatttattatacaagatccttctcagcagggcatcgatgcagcagctatgccaaaaccaccttcacatgtagctgctgatgacgcttgccaacggataacaaaaaatttggaaaacatgatcaacatgaggatggttactcctaaactgaatcatacactttga

SEQ ID NO: 57695 - DNA, 198 bp, Glycine max
  Peptide Sequence Number=SeqID_174473
atggaggagatgtggcatctccaatcatctttcttccttctccatttcgctgtcattgatcttcaagaagcaaatgactccattgatgaagaatatccaaagcctacaagctccacatggaggcacatcactaaggaaggtgaggttgggaagtttcaggattctaaacaagttgaggggatgatggtaaaggtttag

SEQ ID NO: 57696 - DNA, 711 bp, Glycine max
  Peptide Sequence Number=SeqID_174474
atgggcaaaaaatccaccctaaggcttatgagaaccctagggccttctccagcatctttggcccaatcttcttggagtcttctatccaatgcccttgggggggtaggattgcatcacttaccccttccttcccaaccaatgcttaagtttgcttcaccccctcccagcaaagccgaagttgttgccattgctaaggcaaagcaattctatcatgttgatgctaagaaaagagcaagagcaaactacgtccgaaaaagagctatagaagggtttgatgttgcttctaaatcggacattgttgaaacagaccttggggttgcacccttgcaccctcgtccagtcacagttgaagatgaagttattgttgatgctttgcttgctcaaccaatgttagaaatatacatctctagactaaaaagcatctatggagctactaagtatgtttctttcaatgctatgaacgttagattggaaatcaggaagaaggttgacactaccgctgcacctaaactcttaattgatattttcaacaaattgcatccacgtctaagcataacaaacatagactcaattaattggttgttgcattcaagatctcaaccttggacaaaacctgagctagtgcttgtttcaaatggaaatattagaatttatcatggctttaggggatacggattatctaaagggcaaaccaacaaccaagcatggtga

SEQ ID NO: 57697 - DNA, 171 bp, Glycine max
  Peptide Sequence Number=SeqID_174475
atggccggtgtcggtcgttatatggccccgactgatatctttcagccgacattgcgcaatttcctttacaaacgctggccgataatgacggctaggtttttcggtgcgagctcaaccgagggttcgttccgaccgacactggcatgttgttcttctcatttaggaggataa

SEQ ID NO: 57698 - DNA, 1266 bp, Glycine max
  Peptide Sequence Number=SeqID_174476
atgaatctaattaatgtgctagatataaataacttttctaagtgtcctataagtgtggaagctaagtatgcaaagaagccttttaaacctgtcaaaaatagaactacggaactgcttgaattaattcacacggatttggctgacttcaaaaacacagtaagtagaggagtgcctttacatttgcatacttcttcctctgtaataaatgaacaagttaatgaacctagaagaagtaaaaggaagagaatagaaagtagttttggaccagattttgttactgccttcgtggttgaaaacaatgatgtcgataaaataaatgatgtttttgtatctacttttctcattgaggaagatcctaaaacttataatgaggctgtaacttccattgatgccaatttttggaaagaggcaattaatagtgaattagattctatcatgtataatcatacttgggatttagttgacttacctaagggaagtaaaccaattagatgcaaatggatttttagaaagaaattaagaactgatggaaccattgataaatttaaggctagattagtagttgttggttacacacaaaagaaagaaattgactattttgatacatattctcctgttactaaaatttccacaattcgttctcttgttgctttggctgctattcatggacttatagtgcatcaaatggatgtaaagacagcttttcttaatggtgacttgagagaggaaatttatgtggaacaacctgagggctatgtgattcaaggtcaagagaacaaagtgtggagtgttatgtttctcatgaattgtactagacctgacatagcatatgctgtgagtagactaagcagatatactcacaatccaggtggaggtgccatatcatggaagtcttccaagcaaacttgtatagcacgttcaactatggaatcagaatttattgctcttgatttagcaggtcaagaagctgaatggttgagaaacttgttggcagatgtgccattgtgggggaaacggtctatactagtttctcttcattgtgactctgaagcagctattggaattgctaagaacagtgtttataatggaaaaaggagacacatatgcattagacacagttcagtcagagaattgttaaaaaatggtgtgatctcattacagtttgttagatcagagaacaacttggcagatccgttcactaaaggtctaacaaagaaagttgtacttgaatcgtcgagggggatggggcttaagcctttgtgttga

SEQ ID NO: 57699 - DNA, 247 bp, Glycine max
  Peptide Sequence Number=SeqID_174477
atggtggttcgtgccttcgacggcacccgccgagaggttaggggagagatcgacctcccgatacaaataggccctcacacctgtcaggttacctttcaaatcatggatattaaccccccttacagctgcctgttgggacgccccgtggatccattcggtgggagtcgttccctctacactccaccagaaattgaagttcgtagtggaagggcatttggttatcgtatcgagcgaggaagacatcttg

SEQ ID NO: 57700 - DNA, 309 bp, Glycine max
  Peptide Sequence Number=SeqID_174478
atgcagtttggtgttgagaaacttgtacgatcgaactacaagtattggcgactgtgcatggaagcttttctccaagggcaggatttatgggatctcatggcaaaaaatgatatgaaaatgccaccagatacaccggacacgatggaggcccgacgaaaatggaaggtaaaatatgggaagatgttgtttgttctgagaatgacggtcaacaaggaattaattgatcacattagagatcttgacacaccaaaggatgtatgggagacactagaaaaactcttctccaagaaaaatgttgctcgattgtag

SEQ ID NO: 57701 - DNA, 300 bp, Glycine max
  Peptide Sequence Number=SeqID_174479
atgcacaacaccgtgctcgtttggatattagaatacacgttttgtcttcgactcaaccatatgcatatacgcagttattgctcaaggcatcaatgccggagatgtgatgaagcttcaggacgcagggatatatacttgcaatggcttgatgatgcacacgaagaagtcatatctgatccaggaggtggcgtgttcgtaactgatccaaagaaaccagcaggagggcatgtgctagtccatgcagccacgagttacgtgttccagataacagcaggggggattgcagacgctaaggactaa

SEQ ID NO: 57702 - DNA, 314 bp, Glycine max
  Peptide Sequence Number=SeqID_174480
atggcgcaaaagcttgtatccccaatgatcaagggtttctctttcccccttgccattctccacttccaaatccgcgaaccctatcggagccaatgcaacttgttcactccgacgaacccgcgccagagcgccgcgactggccggagaaacccgaagatcctaaagccgacaacgattctctcgactccggataccgacgacggcgccgctctcgacgtcaccggaaaaagcgtcgagtttctggctgcggagtacgccgaggactccgcggagtgcctttacgtgtacaagaacgtttacagcttgattccgaa

SEQ ID NO: 57703 - DNA, 872 bp, Glycine max
  Peptide Sequence Number=SeqID_174481
atgaagactttgccggcggagattacttatttgaaaggcttgatatcgatgaaggttgcgaataataagttggtggaactgccggcagcgatgtcttctctgtcaaggttggagagtttagacctgtcgaataataggttgacttcgttagggtcccttgaacttgcctcaatgcatagacttcaagagttaaatcttcagggaaatgatgaagctagatacaaagatgattgcagttcttctgttgaaatggatctttacgaaagcaactttcaggaaaatgatgaaaccctttctgatggtgaggcttataatgcatttggccctcataatacctcatcaagcatgttaacaagcccctcatctagcagcagatgttttgcttcccggaagtcaggcaaacggtggaaaaggcggtattatttacagcagaaagctcgtcaagaacgtttgaacaacagtaggaagtggaaagctgtagatcatgatgacctattgttgagcaagaagattcacagaatttctgaatcaggaaatcatgatagtcttgcttctgaaagttgtgcagaaattgaatcagagaatgggagcctggatgataataataaaagaatattctctgaacgagcagtaaatgacaatgcaattgataatgataacaatgatgaagtaattactgaaaaacagttttctggagaagattgctgcactactgaaagcaaagatgaaaaagatgcatccttatgctccttagagaagaggcaaagtgaacaggaagaagcatcttgtttagaacttttggagagtgtttctaaatcaaagagacatttagatcgtgatcttgataatcctaaaccatgcaagtctagaaa

SEQ ID NO: 57704 - DNA, 420 bp, Glycine max
  Peptide Sequence Number=SeqID_174482
agctatctggagaagctgtcagaagctggtgaaaagcatgttcctgtggagttggctttgcttattgccaaagatgtctcttgtgcattgtcagagctgcactctaggcacataattcatcgtgacataaaaagtgaaaacatactgtttgatttggataggaagagagatgatggaactcccactgtgaagctctgtgattttgatagtgcagtgccactaagatcaactttacatgcgtgctgtattgctcatgcgggaacacctcctccctgtgtatgtgttggaacacctcggtggatggctccagaggtcatgcggactatgtataaaaaaaactcctatggattggtaagatcctcctcctaccaatcagccatttattttgagtttatcactaattgtgttgctgacatttaa

SEQ ID NO: 57705 - DNA, 555 bp, Glycine max
  Peptide Sequence Number=SeqID_174483
atggaggccatgaaagagcaaatgaccacaatgatggaagccatgatgagtatgagaaaaatgatggaggtcaacacggctatagtcgttgtcgtaagtatcaccactgaggtggacccgactcacccacctggcctcaatcaagtccagagcaagcattccttcccaccatatggcttaccccccaatgctgcacatgctcttgatgagaatgtcgataactctgctgccatacccattgagagccaacaaccccaagctgggccccctgctatggtggaaaaggataaatttgatcatatagaggaaaggctgagggtcattgaaggaggcagaaattatgcctttgctaacatggcagagctgtgcctagtgcccgacgtggtcattcctccgaagttcaaggtgtcagattttgataagtacaatgggactactttccccaagaatcacctgaagatgtactataggaaaatgggggcatacacgaaagatgaaaaattgttgatgcatttcttccaggaaagtcttactggggcagccatcacctggtaa

SEQ ID NO: 57706 - DNA, 1698 bp, Glycine max
  Peptide Sequence Number=SeqID_174484
ggccagcaggcctatctggtgcaaaacaccgacaagcgggtgatttttatcaatccctatgagggtgataaagcgttaatcggcaccaccgacattccctggcagggcaaagcggaagatgtcagtgcggatgatagcgagcagcagtatctgattgacgtggtgaatcgctacttcaaggttaagctacgcgccagcgatgtaattacccgcttctccggcgtacggccgctgtttgacgacggcaaaggcaacccctcggcggtgacgcgggattatgtgttcgacctggataatcaacaggatgccccgttactgcacgtgttcggcggcaaaattaccacgttccgcaagctggccgagcatgcgctgcaacagctggcgccgtttttccccaacatgggcgcggactggacgcgcagcgccacgctgccgggcggcgagatcgcccatgccgattttgacagcttcctggaggagatcaaaacgcgctggccgtggctgccgcagccgctgcgcaagcactatgcgcgactgtacggtgcgcgtatgagcacgctgctgggcaccgccggttcgctgagcgatctcggtgagcattttggcggccagctgtacgaggccgaggtgcgctacctggtgcagtacgaatgggcgcagcagccggaagatattctctggcgtcgcaccaaacatcagctgcacctgagcgctgcacagcgcaccgcgttcagccagtggtgccgcatgccattaacgctttcgctgaataccaatccgctggtgaaccgcttcgccgatcccggcgatttaattcacaccgtggcgcagcagatccgcatccgcgatctgcagctgacgcatgagtttatcaatcccggctggcctgctgccacgctcacccacatgacgcgccgcatgcagcaggcgctgcgtgccaccggcgtgcgcgtcacctccggcatgaccggcccgtatggccgcctcaaccattttggtcatccggatgcggcggtacgtcgctactacattgactggttcaaaacctttgccgacatcaccgcggaactgggcggcgtcgcggtgggctcgcagtttgccatcttcacccagcgggattttaacgatgcagcgcggcgtgaagcgctgattgccatcgccattgactgctgggcggaagtggcggaacacgccaaagcggccggtctgcgttacctgttctgggaaccgatgagcgtcggacgcgaatttggcgaaaccattcccgcctgcatggcgctgcagcagcgcctgagcgcggcacagtttgccctgccgatgtggatgatggcggatatcgatcatggcgatgtcacctctgccgatccgcgtgattacgacccttacgcgtgggctgaagcggtgccgcgcgtttcgcccatcatccatataaagcagagcatgatggataaaggcgggcacaggccctttacattgcagtacaatgccggcggtcgcattcagccgcagccgctgctcgaggcgctggcgcgcggcggcgcgcaggataacgagatttgcctcgagctaagcttcaaagagcgcgaacccaccgacagcaatgtggtggcggagattgccgaaagcgtggcgttctgggccgaccatattgatactcggggtgcaggatttgcatctcgcgtgagcatgccgtgctga

SEQ ID NO: 57707 - DNA, 282 bp, Glycine max
  Peptide Sequence Number=SeqID_174485
atgcccgtcgccggcggcgacttcaactacctccgcgtcacctttggtgcatgctttccaatgccatggtcgctagagatcggaatctcctccgccaaatggcgcctcacggtgccgtctcttcccaaaggcttcaacgaaatagacttcgtcgttgtcgccgtcattttgctcatcactctcgtcatcgctacagaagcgttaggtgtggcaaagccttcagtagctagttaccttagccaggagatactggcagagcaagaagttgatagagtgcactga

SEQ ID NO: 57708 - DNA, 114 bp, Glycine max
  Peptide Sequence Number=SeqID_174486
gatcatgagcaactaggtgtgtcctactattacttgagaaacaaaggtgatataacaagcacagatgtaaaagatactaggttgcctcctagtagtgcttctttaacgtcttga

SEQ ID NO: 57709 - DNA, 345 bp, Glycine max
  Peptide Sequence Number=SeqID_174487
atgtttgatcaacaggcagctgtgtctccaggaaaacctccaaaaagcccagatcatgaggtcaatgatcccctgcatctgactgagacaagtatgcgagtggggaattccgatgtgtatggattcctcgagccacagtccattcagagatatgggcaatcacaatttgaatcggaaagttacatcaagagttggatgcagagttcaaaacgcgatgtctaccttagagcctacctgaatgggccagacaactaccttaagggaataattaatagtgctttgaaaggacttgatgatactccacaacctaaatccaaggctgttgctaggtggattgttgttaag

SEQ ID NO: 57710 - DNA, 429 bp, Glycine max
  Peptide Sequence Number=SeqID_174488
atgtcattggaaagtgcattgttggaaacatcaaacatggcaacccgctgcgctctacgccgtgccaaccagcctgatgacttttccctaaggcgtgttccaccttcaacgactgagaaactcggtccagtccaccatgcagctaacgacattgtcgcagaccagaccggacaacatcatcagttctgcgaatcgaaacgagtcgatcccaaagtcgtgattcttctcgaaatagatgccctggcaatgcagcaactcaacatagtcatgggtgtgggcgtcacgtgcgacgtcgaaatctctgaagttgaattcccagatgaaggcgttggaggtgccgagggtgggaagatttcccgcattgtcggaaagggtgaggctgatttggatcaggtggaggcgatcacgttggctttgagcacgacatag

SEQ ID NO: 57711 - DNA, 330 bp, Glycine max
  Peptide Sequence Number=SeqID_174489
atgaaggaaccatcgaaaaagcggaaaggaacttcgagtcggagtcagcggcattccggggcacaggaagcaccaattccttcctccattccctctggatcattattctcatcagaggaacagcgtatacggtacacaaacctcttttcctctcgttccatagaagacccaaaattcatagatatggagttcttctcaaatgagaattttgaatgcttccaagcatttgaaaactccaatcttattccattcatgtctctgaaattacctgtctattatgaattagtcaaagccttctattccaatttagaaatcatgaaggtattctaa

SEQ ID NO: 57712 - DNA, 135 bp, Glycine max
  Peptide Sequence Number=SeqID_174490
atgatctctaaggttatggttggtgtaagactagggagacgaccaatggcagtaagccagccatcacttagtgtactagcctatgtatatggtagtgcctcgactcgacgggagatgataccaaacataacgtaa

SEQ ID NO: 57713 - DNA, 420 bp, Glycine max
  Peptide Sequence Number=SeqID_174491
atgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 57714 - DNA, 249 bp, Glycine max
  Peptide Sequence Number=SeqID_174492
atgccctttggcgaagctctgcagcaatgcccactctactccaaatttttgaaagatatgttgacaaggaggcacaaaagattgggagagttggagattatgcccactcaaatgactctacaattagctgaccgctccattaccaagccctatggagtaattgaagatgtattggtcagggtcaagcatttatcttcccagcagactttgtggtcatggatatctctaaagatactgacatccctataa

SEQ ID NO: 57715 - DNA, 669 bp, Glycine max
  Peptide Sequence Number=SeqID_174493
atggcggtaggcagtacggcgatgggtgcactggtcgcgccaatggccgccgatgcggcagcgtcgtcggccgctgcgccgcagcaggcgcgcgagtatcagccggtgtggtttaccgccgaagagtttgccttcatcaaagccgccgtggcgcgtctgatccccaacgatgaacgtggtcctggcgcgctggaagccggcgtaccggagtttatcgatcgccagatgaatacgccgtatgccaccggcagcaactggtatatgcagggaccgttcaatccggatctgccaaaagaactcggctatcagctgccgctggtgccgcagcagatctaccgtctcggcctggccgatgccgatggctggagcaaacagcagcacggcaaggtatttgctgagctgacgcccacgcagcaggacgcgctgctgagcgccttcgaaaacggcagcgcgcaattcccgcaggtgccggccaaaaccttcttcgcctttctgttgcaaaacacccgcgagggctacttcagcgatccgatccacggcggcaatcagggcatggtgggctggaagctgatcggcttccctggcgcacgcgccgactttatggattgggtagagcgcggagaacgttatccgttcccgtcagttgatattcgcggcgagagggcgtaa

SEQ ID NO: 57716 - DNA, 2022 bp, Glycine max
  Peptide Sequence Number=SeqID_174494
ctggtggctgaaggcagcacccaggcggatgcctttggccactggcaggtggaaatcgcccgactggatggcggtgccggcccgtatcacttccaggccagtaacagcccgacgcgcgatcccgctgcgccgctgttcgacctgtatgtgtcagataacggcacccgcctgaagcccaccattgacgcggcacacgataatgtcgggcccgagcagggcaaattaatcaacggcgccaccaccgatgacatggcaccgacgctgcagggcaaagccgaagccaacagcatggtgtatatccatgcgcggcatattgatggccactgggtggtgttaggcagtgttaaggccgatgcctggggcaactggataacggaagtgcgcgcgctgcgcgggggatacggcacttatgagtttcaggctgccaaaacccccgatcgcgacaccagcgccgaggtgttcagtctcaacatggtgccggaaaaacccggcatcgtttctgcctgggataattttggcgcgcagaccggcgtgctgcatcagggcgatgtcactgatgacctgacgccaacgctgaaaggccatgctgcagcaaacagcgtggtttatatctatgcccgccacgtgaacggggtatgggtgacgctcggcagcgccgttgcggatgctcatggtcactggcaaagcgaagtgcgcgcgttacgcggcggctttggcaaatatgagttccaggtctcagacagcccggtgcgtgacgccgccgccgatgttttcgacctgacgataatctccggcaagacagagattatttctgcgtgggatgacagcggaccaaagcagggccagctgaaaagcggtgatatcaccgatgatatgacgccaaccctgaaaggcacgtctgcacccaataaggtggtgtacattttcggctgccatattgagggccactgggtattaatggactcggtcacagcggatgctacgggtaactggagctaccagtcttacgatcgctcgccgtggaaaggactgacgcaatttcaggtcagtgatagcgccattcgtgatgtgaatgcgccaacctttctgctggagatcaatgtcgatccgccgaaggtcgatcacaaggggctagtgtggaatttcaacgacggtacccagcagggctggatcgccagcggtctgtatcacaaaaatgacaacatcggggttaagcgctggagcgcaggcaattcctcttatgagttgggttccatgaccaacggttcaaacaccaacgggttcaaaggagaagtggtttatcgctatattcaggtcgaagcgggtaaaacctaccagttcgattttgatggctaccgtattcctggcggtagcctgaaaccaaaaatcggtctggatgttaatggacagaaagtgattcccaacatggggctggatgctgcctggaatcatttcagcggactgtataccgccagcaaaacagaagtggttcgcgtggcggtaaccaatgaggttaataacggtaacggcaacgatttcgctatcgataacatcggggttaaagaaatcagccgggttcgtggacaacctgatctggtgaaagacgctaacggtcatccgcgctatatcgattttaaaaccggggtcagttataccatcgacgacagtctgaaaatgacgctgattaaaggaccgaatatcggcggcgagcaaaaaacgctgaagcatggcgaaatcattgttggccgtggcggccagatgaagctggatttcgacggcgtggcggagaaagtggtgctgaaatcggattatgtgcacagcaaaggcaattacatcgatttctatgacacgcaaggtaaattgctgcacagctatgagctgaaggcgcatcctggcaccctgcgaagcgacattgtcgagtaccacgccccggccggtaagctgatcggatcagccgtggtgcgcgtcaatccggctgaagtggattcggtgaacaatccggggcggcgtgcgcatcagtga

SEQ ID NO: 57717 - DNA, 429 bp, Glycine max
  Peptide Sequence Number=SeqID_174495
atggcgatttcgtcgtcgacgcgacaactggcaccggtgtcgccatcttcaatggcgtgttgcaccaagcttggactcgccagtttgactggcgagttgagggtaggggtttgcagttctcaggctacgtgcagcagctttgcaggaggagggacagctttttggtggaaaacgccagtgctactggcgatttgtgctgcaggttcaaggtacagctttaaggtacacgatgaattcgattataacagtgttgtatttcaatggaagggcagtaaaaaagcgattcagattaaacgtggaattagtttcaatgctttgaagaaaaaaattggagataaggaaaatatattgccttgcaaatttctgatgacgaagacgttgagacgatgctggaaagttttaaacaacaacaagaaatgtcagttctag

SEQ ID NO: 57718 - DNA, 372 bp, Glycine max
  Peptide Sequence Number=SeqID_174496
atgaagccacacaaagaagagacagaaatcgtaaacttgggtgttggtgaggaaaagaaggaggtaaaggttggcacgggcatgaccacacctacccgagatggattggtggctctactacgagactaccaagacatctttgcttggtcgtaccaagataagcccgacttgaaccccgatactgtgcagcataggttgcctttgaattctggttgctccccggtgaaacaaaaactaagaaggatgaagcccgaaatgtccttaaagataaaggaagaggtgaaaaagcaatttgatgttggcttcttggcagtcgctcgatacccagaatgggtcgctaacatcgtgccagtccctaagaaagatgggaag

SEQ ID NO: 57719 - DNA, 171 bp, Glycine max
  Peptide Sequence Number=SeqID_174497
atgttggagaaagagagtgacatgggggtatggaagagtagcaaacaagatgggcctagtcaatttgatgactggtttgaagggcccacaacagaatcaaatcctcctcaaacgcctgagcaagatttgttgaacggagaagcaagatatgacacaaaatatagtgcatga

SEQ ID NO: 57720 - DNA, 222 bp, Glycine max
  Peptide Sequence Number=SeqID_174498
atgttgaatccaactcaaaagagaaggtgcaaaatgctgctgatgaactcgcttagtgaggcagattggctaagcgaggctcatccgcttagcgaggcatccagcttgcttagcagatgggaaaccctagaagaagataagtcagagatctacgcgctccatgcgcagccagcctgcccaacattgtctcttctcacgctcagcgcacctactctcgcttag

SEQ ID NO: 57721 - DNA, 207 bp, Glycine max
  Peptide Sequence Number=SeqID_174499
atgggatcttcgttagcaatgggatgttcatatcagcttgatgtttgcgtttgtggtagttgtggaggtggcgtaaagggggatgaaggatggttgttgtatgaagatactggattattgaggtctatgttgttgtacgataattgttgtggaggcggtagttgtagttgtggacatgagggttgtggagatgatggttgtggttga

SEQ ID NO: 57722 - DNA, 141 bp, Glycine max
  Peptide Sequence Number=SeqID_174500
atgtggcaagaatatgaaggagatctgtggggtcctgatccaacgaaaaagaggactgcaaagggacgtcctgtttcaactcacattcctactgagatggatgaagacgaaaatgaacgatcaaattattatacaaaataa

SEQ ID NO: 57723 - DNA, 216 bp, Glycine max
  Peptide Sequence Number=SeqID_174501
atgaagaaagcatgtggtgcgaatgaccacatgttgattttccgatgtgttcattacttctcaggtagtagaggaaggactacgtttatgttaactggctgtgaaaggagcggcgagtataggtgtaggaaaaaagaatttatcaaaagagagactaggaaatgtgggtgtcccttcaagcttcgttgcaagcaagtggttggaggagaaggctag

SEQ ID NO: 57724 - DNA, 531 bp, Glycine max
  Peptide Sequence Number=SeqID_174502
atggatcagatcaatctgatcgataaatacaaacactggtttcatgaaaaccaagtgatagccactttgaatgttgacgattattctctgcaatcgctggcgaatactcactttgccgaaagaattaatgccatgcgctgtattcatttcgagatcagcgagaattcaacccggctggtgaaagatcgcgtgcacggcgatccgtcattgaatagttattcattttggctcgatgattttggttctggctatgcgggtttttccgcgttgtacaacagccagttccgcttcgttaagctcgaccgttttctgctctgggacttcatgaaaaagtccggcggcgagggcttgatgcgcgcattactgcgcttcttttaccttaatcattacaaggtaattatcgaaggagttgaaactcccgaacacaagaaatggctggatgaaatgccatattacgcactgcagggaaagctgtggaaggaatccagcatcaaggatttgaactcgcttcttacagctgaatacttttaa

SEQ ID NO: 57725 - DNA, 249 bp, Glycine max
  Peptide Sequence Number=SeqID_174503
atggtgccgctgatggcgctgctactggtgatctcccgtcactggccgcaatttctcgcgctgtttggggccggcaatgaagcgccccggcttactcttaatctgcgtgccgatccgttgccgcagggcaatccggtatcatcatcgtcatccagcggctcttcgccgggcacctgcgcatcatcaggcagcggagtgacatcatcgggtcgttctgacataagcacctccataccccacattgggtaa

SEQ ID NO: 57726 - DNA, 177 bp, Glycine max
  Peptide Sequence Number=SeqID_174504
atgaaggggcaacttcaggatcaagacagttctttccttgtcagagatccactccttgaggcaaaggaacctctcaaggaacttattcatagtcctctaaaggttgtcaatcttggagaacaaaaacttctagtcaaaatgaatcttcttgacttgcttctgcctactctttactga

SEQ ID NO: 57727 - DNA, 435 bp, Glycine max
  Peptide Sequence Number=SeqID_174505
atggtaggcaaagatttgggaagtacggatgaccccatgatgtgcaaattcaaaacgagcacgccttcccatcatatggcttgcctcccaaactatacaccacccaatgtggtgtacattcccaatgaggatgtcaataactccactcccatactcattaagagccaacaacctcagtctgatcatgcacatgtctctcgacccatggaggagacacatgaaattccccaccacgatctagccaacttcgagccttgcctcggatatgctgctgaagggcaagcagttggtggtatacccctgcaaaacactttggagggccctcagtatcacccacaactgcacctcttgcattccacagcggataaaaaccctcatgactatggcaggaatgggaaagttggatcatctaaaggaaaggctcatggccgttga

SEQ ID NO: 57728 - DNA, 273 bp, Glycine max
  Peptide Sequence Number=SeqID_174506
atgaggttcatgagaaccctagggccttcttcagcagctctagctcaatcctcttggagcctcttgctcatggctctagtgactggtcccttcctagggaggattgcatcatacgggactgtgggccccacgggctggtccatggactcaagcccatttacccacctttatatgttgctaaaccgtaaaacatggtcagaaagtgtggggcttgggaaaacatctcctctaatggcaatgcctaaagtgaaacaagatataactcaatattag

SEQ ID NO: 57729 - DNA, 424 bp, Glycine max
  Peptide Sequence Number=SeqID_174507
ctttgcttctactgattcttccgagtttccaccgattaaacttgctatagaagcaaaaggggaagaatctagtgaagaaatctacccccaagaagaaggacaaccattagtggttaaagagaagtgtaagggggcaagtgtctcctccaagagtttagctaagaaggaaactcattttacaataaaaacacttgctaaaaagacacttgctagcattgccacacctcttgggcttgagtttattcctcaagtaaagaagttgttggatgagggtttggtttgcaaaagcttaaatccttgtgctttgttggggcccagaataggtattattaagcaccaagtccctaaaataggtggtatgatgaatgttttgaatggtgcaaccctcttttgtaaaatcactcgtgcacccaacatcttcatg

SEQ ID NO: 57730 - DNA, 660 bp, Glycine max
  Peptide Sequence Number=SeqID_174508
atggagaaggccacaccgtctgatccccgacccgctccaattattgaggacattaaacaggataactccggaaaggtagaaatagccttcaataggagaaattccttctcatcaaggataaaagcctctaggtctgaatacgagtcagccagaaggtctttttcagttagaacctgttcaataccagtaggactaaccagatctgagttacataaccagttccctactgtatacctccaaggactagataccacttctagcataccaagaatgacctacaaccaacatcaggaggacgaccaaaagaaagattttgattcttcggtgaatgatcctcaaaggagatggtttttccagaattacaggggtacaaacagaaaacagatccaagacaagttctacgaatttgtcgaaagagtcaaagttaatgtccttttctttgattggttccatgcttacagcatcaaaaaagatatagattacccatggaagcaagacatcataggtgatccatcaacaaacattataagcaactggcaagtaagagatggtgagatgatccaatcggaattacctcccacgaccaaatatcaactcccgaatatcaaagacagtaacaacaaacctgtaatggcaaccccatttaaaacaagatattaa

SEQ ID NO: 57731 - DNA, 369 bp, Glycine max
  Peptide Sequence Number=SeqID_174509
atgtcagtcttcgcatgctatcaggctttttgtcttacagatagcaagaagaatttttatacggctaaccactcgggtatttccgcctctcatcgtgactcaaatgtcagtatgacagatcttgtgagcgcggaagatgacgtaaatctccgcgtgtcaacgtgcttgtcggccgcgtttgacgaagggcgcagaagacgatatagcaagaagaatgtttatacggctaaccactcgggtatttccgccggtcagtgtgactcaaatgtcagtatgacagatcttgtgagcgcggaagatgacgtaaatctccgcgtgtcaacgggcttgtcggtcccgattggcgaagggcgcaggagacggcgttag

SEQ ID NO: 57732 - DNA, 732 bp, Glycine max
  Peptide Sequence Number=SeqID_174510
atgggggagcagtggagacaattcaagtatgatttgacatcgaaatgggcatttgcagccgacaaggaaagtgtcgacgacactgatatgcgcaagaaggcacaagccaaccagaaacataacattgcccctcacgtgttgtctcgtgagggttatgaatattcagaaaacaagttgatggatgagaagagaaagaaaaaactagaggaagctgctcaatccggaagcactgacaccgtgattgatcctctatctcccatcagacaacacatgaaatggaagatggcccgcacaaagaaaactgggcaaatgacgtctgaggcagcaaaggaaattgctgagaagattgaatcgttggaggagcaggcgtcatacggtttcttcgttgccattgggcgaccagaacaccgtagtcgtgtaggtgttgttggagttggtgtcacgatcaagaaatactttggactggctccaaggacctcccgtatgtcttcctccatggctcccgaagacctggagcagctgatgcaacaaattagggaccagttggaggagtcgatcactgaaaaatgctttgaaggacttgacgatactccacaaagtaaatccaaggctggtgctaggtggattgttgttaaatatttcaatgatgtcagaccattggaacctgagagattgaaggcgcttcgcatccagtgggcaaagtattatttgaaagttagaaatgaaacttag

SEQ ID NO: 57733 - DNA, 243 bp, Glycine max
  Peptide Sequence Number=SeqID_174511
atggctggtacattctttcttttgaaaaagcaaaatagtttagagattatgagcggtgagaaagaaatgactccgaatagagttgtgaactggccattcaggactctgtatactattaaaccagtcattattttggggatgccacagaaggtgcttctagaatacatgactttcatggagtctctagctaagaggcgaaaatgtaaggaagttgtgttctttgtgaccttcatggcactttga

SEQ ID NO: 57734 - DNA, 276 bp, Glycine max
  Peptide Sequence Number=SeqID_174512
atgggtcgatcccggagatgcggatgctcaaacttggagagggccaagcatgggtcagattcggggtttgtgtgggatatgatgttgggtgattatacatcggcaaaaggagatgatggaagtgggggaggttggtggatgaaggtgttgtttgcggctgataggaggagaatagcggtgctcggtagtgatgggcggccgcaggccaatgcaggggtcattggaaactgtggagaggaagggagagtaaaatttggtggggaaggtgtacaatag

SEQ ID NO: 57735 - DNA, 1506 bp, Glycine max
  Peptide Sequence Number=SeqID_174513
atggaagctcaaagctacttgttgcttattggcttgttctttgtattgcattggcttgccaaatgttacaaaagtagtgtctctcagaaacttccaccaggaccaaagaaactacccatcatagggaacctgcatcaactagcagaagcaggttcacttccacaccatgctctgagagatcttgccaaaaaatatggacccctcatgcacctccaacttggtgaaatttcagcagtggttgcatcctccccaaagatggccaaggaaatagtgaaaacacatgatgtttcttttcttcagagaccccatcttgtttttggtcaaatgatatcctacgggggattgggcattgcttttgctccatatggtgatcactggagacaaatgaggaaaatgtgtgccacggagcttctgagcaccaaaagagttcagtcttttgcttccattagagaagacgaggcagcaaagtttatcgactccattcgcgaatctgctggttcgcctatcaatctcaccagtagaattttctcattgatatgtgcctcaatttccagggtagcattcggtggcatatacaaggagcaagatgagtttgttgtgtctttgatccgaaaaatcgtagaatccgggggaggattcgaccttgctgatgtctttccttcaattccattcttatatttcctaactggaaagatgaccagattgaagaagttgcacaagcaggttgacaaggtcctggaaaacatcatcagagagcatcaagaaaagaacaaaattgcaaaagaagatggagctgaattagaggaccaagattttattgatcttcttctcagaatccaacaagatgacactctcgacatccaaatgacgactaacaacatcaaagctttgatattggacatatttgctgctggaactgatacttcagcatcaacactagagtgggctatggcagaaatgatgagaaatccaagagtgagggagaaagcacaagctgaattgagacaagcttttcgagaaaaggaaataattcatgaaagtgatctagagcaacttacttatttgaagttggtgatcaaagagacattcagggtacacccacctactcctttattgctccctagagaatgctctcaaccaaccatcattgatggctatgaaatacctgccaaaactaaagtcatggtaaatgcatacgcaatttgtaaggattcccaatattggattgatgctgataggtttgtccctgaaaggttcgagggtagttctatcgatttcaaagggaataactttaactatctcccttttgggggaggacgaagaatatgcccaggcatgacattgggtttagctagcattatgcttccactagctctactactgtatcacttcaactgggaactcccaaacaagatgaaacctgaggaaatgaatatggatgaacacttcggattggctattgggaggaaaaatgaattgcatttgattcccaatgttaatttatga

SEQ ID NO: 57736 - DNA, 846 bp, Glycine max
  Peptide Sequence Number=SeqID_174514
atggaagacatttgtaagaggtggactgagtatcttgacagcacacgatcaagggtcaatcacccacaatcgataaattgtgatttttgtggagaagagcatttcaatgacaactgtcatctctactccatgaaaaattcttggtggggacaagagttatacccttacaatcaatatgaagaaagaactcctaatcttgaaagtgtgttcacgaaattcacggcataccatcctagctctactgccaatcaaaactcaatgcaaaatcaggaaattcaggttggaaacagctactccatggaaaattatcaatgggagcaagagttacaaccctacaatcaatatgaggaagaaagaacttctaatctggatactttattgatgcaattcaaggaggtcactgaatatactcaacaagcatttaaaagtttagaaattcaagttggtaagctagcagaagaagtgactaaatttatggccagaagagaagaaaactttataaaggttgaagctcaagaggaaagccctgtacgaaagcatgattcaaaagaaaaagatgaagataaaagtgaggagaaagcacaacaatgggagaagtactcacaagtagaaattcaacaagaaagtattctccaagtcaatacccatcctcatcaactgattgtcaaggaagaaagacatggagaacatgagaaagccttaagtgctattctttccttgatcactagcacttctcttgcaatgatatggaaggtgcttccagaatacatgactttcatggagtctctagctaggaggcaaaaatacaaggaatatgtgttctttgtgaccttcatgccaccttga

SEQ ID NO: 57737 - DNA, 497 bp, Glycine max
  Peptide Sequence Number=SeqID_174515
atggatagggccaaagaggaaattcaaagagctttcaataacaatgaagggaagtataaggatatccttgcaatcattgataaaagatgggattgccaacttcatcgccctttgcatgcagcggttgaagttcacaaacaattgccagtgtatagaagggcgggagagaggtttggtatgactgtagcaatgaaagcaaggactgaaatatctcctgctaagtggtggaaattgtatggagggaaaacaccacacttgcaaaccattgttattaaaattcactcaaagaagagaagtaggcttgagcaccaaaagcttcaagacttggtttatgttaagtataaccaagatcttctagatcgctttgagtgtcatgatgtgattgatcctattgctttaaatgatattgatgataacaatgagtggttattgggagaattggaaggagaagaagctggtaatgatttggtttttgatgaagatgatgatttgaattg

SEQ ID NO: 57738 - DNA, 585 bp, Glycine max
  Peptide Sequence Number=SeqID_174516
atgttagagaaagtggaggagtttaacatggataaagttatacaagagtttgaattattgacaagggatgcagaaagagttcagagggaaacactcaagaggattttggaggataacgcatcagcagagtacttgcagagtttgggtctcaatggaagaactgaccctgagagtttcaaggcctgtgttccaatggtcacccacaaagaattggaaccttatatctacagaattattgatggtgatgcttctcctattctcactggaaaacccatcacaaccatgtccttaagtttttggatgatattcttgcagttctggcactacccaggggaaaccaaaggagtttcctataatgttgtggtgacagtgaagcaggatgagattgaaattagtggtttgatcactggttttggtgatgctatgcataaaggattcgtgcttgattggatgagagctcaggattgtgtagtgtgcgaggagtctaatggctattgcaaattcgaccaagccactaagcaatcgaggtgcttatgctcagatggtagaactgaagccaaaagttgcaaaaaaggtgcaagataa

SEQ ID NO: 57739 - DNA, 213 bp, Glycine max
  Peptide Sequence Number=SeqID_174517
atgaaagagaatttaagagctggagagtcacgctcaacgcgccagcccccctcagggcgtgaggaccatttagtgccaaaaagtcacacaggaagccagctatcatgtgctaagcaaggagctagggcacgactagtggggagagagccattcatttggagcattccatctgcattcttcgccatcttcctccattttcttcctcatccgtag

SEQ ID NO: 57740 - DNA, 474 bp, Glycine max
  Peptide Sequence Number=SeqID_174518
atggtttatgacaaagcagccattgcctttagaggctctaaagctctcactaatttcatcaagcctcctacaagggaagatctttgtgattgtggccctaatgaaactgaggctagtgtggctgtgagtggtgagaatgattcaagtgaagagtctcatttgtcttcacctacttctgtgcttggacttcaatctgtggaacttatgttggatgaggtttctgaaacagatcttccaagcaaagaagagtcaagttctcaagacagcttcttgtttttagattcacattcaccgtccattgattgttatttcaattttgaaactcttccaccagtgtttcttcatgaaactagcataacacagcagcctgatttccatgacaaattcagtgacatttcccatcttgtcaatgaggattttcaatcatggaattgggatatagatagttacttcagtgatcctttgttgatctga

SEQ ID NO: 57741 - DNA, 144 bp, Glycine max
  Peptide Sequence Number=SeqID_174519
atggctaatctcccagacatcttgcggttctccattaactcagtggagagggcatcagacatagagagggataagtttggcaatactgcaaagtgcaaattagcttcttctccttccatcacaggtaaacacggattgttgtaa

SEQ ID NO: 57742 - DNA, 1479 bp, Glycine max
  Peptide Sequence Number=SeqID_174520
atgccgagggaaatcatcactcttcaggttgggcaatgtgggaatcagatcggcatggagttctggaagcagctctgcctcgaacacggcatcagcaaagatggcatcctcgaagacttcgccactcaggggggtgaccggaaagacgtgttcttctatcaagccgatgaccagcattatataccacgggctctcctgattgacttggagccaagagtcattaatggaattcaaaacagtgactaccgaaacctctacaatcatgagaacatctttgtctcggatcatggaggtggtgcaggaaacaattgggccagtggatacgatcagggacaacacgttgaagaacaaatactggacatgattgacagagaagcagatggcagtgacagtcttgaggggttttgtctatgtcattcaattgcaggaggaacaggctcaggtatgggctcatacttgttggagactctgaatgatcgctacagcaaaaaactagttcagacatacagtgtgtttcctaaccaaatggagacaagtgatgtggtggtccaaccatacaattcacttttgacactcaagagattgacacttaatgcagattgtgttgtagttcttgacaatactgcgctaaatagaattgctgtggaacggcttcatttatcaaacccatcatttgctcaaacaaattccttagtttctacagttatgtctgccagcacaacaactcttcgttatccagggtacatgaataatgacttggttggtcttcttgcctctttgattccaacaccaagatgccattttctaatgacaggatatacgcctttgactgtagaacgtcagaatgattttggagcatcgaagcttttccataaatttgtgtcttcacttgtgaagatttctgttggtaaattgttgaactggaaggctaatttaattcgtaagactactgtacttgatgttatgagaagacttctgcaggtatattcttggcaggcaaagaatattatggtctcttcttatgctcggaccaaagatgctagccaagcaaaatatatatcaattctgaatatcatccaaggagaggttgatccaactcaggttcatgaaagtttgcagaggattcgtgaaagaaaactggttaactttattgagtggggtcctgcaagtattcaggtcagtggccttatgctggcaagccatacgagcatccgtcaccttttcagtaaaacattgagccagtatgagaagttgagaaagaaacaagcctttatagacgtctacaggaagttcccaatgtttgctgataatgacctctcagaatttgatgaatcaagggacataattgagagtttggttgatgaatacaaggcctgtgagtccccagattatatcaaatggggaatggaggatccaaacaacatgctaacaggagaaggcaatgctacaggatcattggattcaaaatcagtagcgtga

SEQ ID NO: 57743 - DNA, 1074 bp, Glycine max
  Peptide Sequence Number=SeqID_174521
atgtcaccaacgcataccaataccaattccgatacgcaattgaggatacaagaacgagctctttccgcagccggtgccgccttcgtgtctgctatcattgttaatcccctcgatgtcgccaagacaagacttcaagcacaagctgcaggtgttccctaccaaggtgtttgtcaaatggctccttttcaaacgaacacgacgccacacgatattagatgttctgcagtttctagctctgagccaccgctgccttgtccttccgtgtgtaaccgctataaaggaacattagatgttctttacaaagttacacgtcaggaaggctttccgagattatggagaggcacaagtgcaagtttagcgttggctgtgccaactgttggaatctacatgccttgttatgatattttacgcaacatggtggaggattttacaactcagaatgctccaaatttaacaccttatgttccattagttgcgggatcagttgcacgctcattagcttgcatttcttgttatcctgtggaacttgcaaggactcgcatgcaggcgtttagagcaacccaaagtggcaagcctccaggagtgtggaagacattgcttggagtcattcaccctgacaagggcacaaatatttttcaaagcttacataggtatcgtttttggtggactggtcttggagcacaactttctcgtgatgttccatactctgctatttgctggtcaacccttgagccaattaggaaaagcattcttggcctagcgggtgatggagcaagtgcagccactgtccttggagcaaatttttctgctggttttgttgcaggaactttagcatcagctgccacatgtccactggatgtggcaaaaactcgacgacaaatagagaaagatcctgaaagagcattaaagatgacaacaagaacaacattacttgagatttggagggatggaggattgagagggctatttacaggtgttgctccccgtgtaggccgcgctggtccatcagttgggatagttgtctctttttatgaagttgtcaagtatgtcttgcagcttagacatcccacttaa

SEQ ID NO: 57744 - DNA, 591 bp, Glycine max
  Peptide Sequence Number=SeqID_174522
atggatagtcatgcattagagctgtctaattatgtgattgctaacagttgtgaggtagtgttgtttgtggaatgttttggtgataatgaggtggttgtggatgacaatttttctaaagacgacaatgatgaatcactgaagaatgcatatgtttatgttcataaaaatgatgacatacctaatagtcaacgtgtgaacaaagatgttgatggcaagaaggttgttgttggaggtaaaaagcctgatggtaggggtaagcagggtgctggttggggtaaaaaggttgttgatagggataacaagggtactagtggaggaaacaagcctactggtaggggtaagagggttgaacataatttattgaatgtcaatggcagttttttggtgtcacccaatttgcctaaagatgatattgaagatggttatgttagtgaacaattgtgcaatgatgattcagatgaagacgttttgaagaaaaagtatgaaagattcaaccccaagttgctttgtaaggaatttaaatggaggttgggattggagtttgtgttcgaccgattggcaagtccaccaatttgtccaagtagtaattaa

SEQ ID NO: 57745 - DNA, 168 bp, Glycine max
  Peptide Sequence Number=SeqID_174523
atggaattttcgcagagtcacagggtagagatgataagcatggcagttgctcttgttgccattgttggtggcaccgcttactattactacgtcaccaagaagccaaaagaaaatatttccaaaaatagtaccccatgtagggaagaaaacagaaagggacatttttaa

SEQ ID NO: 57746 - DNA, 333 bp, Glycine max
  Peptide Sequence Number=SeqID_174524
atgtgcaattaccgtatagggtgtctccgcatgctacctgacttctcacagagacgagtcttgcacgtcatcgaacttggaggtctctggatgacaaaggaagggtgcgggcgaccatatattgtctccgcgtgtcatcggacttgtcgtctctggatgacgaaatgtgcggataaccataaggtgtgtccgcgtgctaccggaccctcgggccacgatagcagaattgagactttttcacggtctcgacggaaagatgttgacatctccgagaagggtgtagatgaccacattggtctctgcatgtcaacaggcttgcttgcctttagttga

SEQ ID NO: 57747 - DNA, 213 bp, Glycine max
  Peptide Sequence Number=SeqID_174525
atgccggccggtatcggtcaacaaagtctctatgtgtgggtgacctggatcataagtctgataaaggtcttggacgccccgaatgaatcggggcgaacacgatcagaacgcccagcgccaagtcagcgtggcgccgtggttccgattgcgcgagctgaactgtccggcatagtgaaagccggccattgcgttgcggcctgtgcgtgcctgtaa

SEQ ID NO: 57748 - DNA, 383 bp, Glycine max
  Peptide Sequence Number=SeqID_174526
atgcattggtttcccttcaagcgcctgttccgtcgcaagcgcgacacgcggaatgcggatctgtacggccagatcgcggccatccacaaggcgcaggcgatcatcgagttcgacctggacggccatgtgctcatggccaaccagaatttcctcgatgccatgggctacacgctcgacgaactgcgggggcagcaccaccgcatcttcgtggcgcccgaccggcgcggctctcctgaataccaggcgttctgggacaagctcaagcgcggcgagtacgacgcgggccgctatcgccgcatccacaaggacggcagcgacgtctggctgcaggccagctacaacccgatcctcgacgagtccggccggcccttcaaggtggtcaa

SEQ ID NO: 57749 - DNA, 513 bp, Glycine max
  Peptide Sequence Number=SeqID_174527
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaaagatgaaaaaggactttgaaaagagagtcaaagagtgcttgaaattgtcgggagggaagcggatgggggccggcgatgtgtcccggtcggatgtggaacggtga

SEQ ID NO: 57750 - DNA, 837 bp, Glycine max
  Peptide Sequence Number=SeqID_174528
atgtcccgagtcgatcggcggaccggctctcaccgttccacatccgaccgggacacatcgccggcccccatccgcttccctcccgacaatttcaagcactctttgactctcttttcaaagtcctttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 57751 - DNA, 645 bp, Glycine max
  Peptide Sequence Number=SeqID_174529
atgggagttggtactaaacggtgcattcgagcgcgtgtttatctagtctctctgcgtggatctgcagaagtggaagaagaagaagatgcagtgggaatactaaccaccctctcgcaaagtaaaggagagtacaagtatgattacgccacggtcccatttctcgccgagattttcaagcttgcggtgtcaagtttgttactgtggaaggaatgcaaaaagtcacctttgccaaagatgacaacggagtggaaaacggtgtctctgttccccattccctcagttatatatctgatccacaacaatgttcagtttgctacactcacttatgtggacacttccacctatcagatactgggcaatttgaagattgtcaccactggaattctatttaggttgttcttagggaggaggctttctaacttgcagtggatggctattgtgctgttggctgttgggacaaccacaagtcaggttaggggatgtggagaggcttcttgtgactccattttctcagcaccaattcagggctacatgttaggagttctatctgcttgtctctcagcattagctggaatttatactgagttcttgatgaagaaaaacaatgacagcttatactggcagaatatacagttgtacacgtag

SEQ ID NO: 57752 - DNA, 447 bp, Glycine max
  Peptide Sequence Number=SeqID_174530
atggcacaagaactagagaaagaaagagagaatgagatagagatagacatgaacatgatggaagagtatgaaggggaagaaaataatggtgcattgactcactcgcatctgccaaatacatctctagctgagctaaacatgttgcttgtgttgctttctttattctacttttcaagcgatgagtgcatagaatatcatgaggagagccaagagaagacaaaaaaagatgaggttgctgtaactaaaacatgcatagcaagattacaaagcaagagacgagagaaacatgagcctaagcttgggaggaaaccaatttcatcaagatttcaaactaccgcatggaagaaaaatgtgaagcaaaatcttgctactgcggagtattgcacaaatcaacataaagattgtggagatatgatgaagcaagctaaagcgaagcatttgttttaa

SEQ ID NO: 57753 - DNA, 867 bp, Glycine max
  Peptide Sequence Number=SeqID_174531
atggcttcggagacgaaggtcgtgaatctggctgaggaagccaagctcgccagagaaggtgtaacgactccctcatatgcttttaccaccatctgcaagtccctcgtcgctggtggagtcgccggaggagtatcacgaacagcagttgctccactggaacgcttgaagattttgctacaggttcagaatccacacagcattaaatacaatggaacaattcaaggtctaaaatatatatggagaactgaaggttttcgtgggctgttcaaaggaaatggtactaactgtgcgcgaattgtcccaaattctgctgtgaagttcttcagttatgagcaagcttccaaaggcatactacatctgtaccggaagcaaactggaaatgaggatgctcagctgactcctcttttacgtcttggggctggagcatgtgcgggaataattgccatgtctgcaacttatccaatggacatggttcgaggcagaataactgtacagacagagaagtccccttaccagtacagaggaatgtttcatgccctgtcaactgtactcagggaagaaggtccacgtgctttatataagggctggcttccttcagtcattggagttattatgctttcactattggctttttgggaaattcatattgcatctggtagtaacaatgtaggacctgtaggctgcagttgggggagggggagaacctatacagcactaaagatttcaaatttgtcgagtgctagacaatgtctaccctccttaggggacaatttaataggattgctttctaaggctgcttatagatgtgggatagatagcgtctattcagtaagttgtgcagaacataggatccacatgggactgtag

SEQ ID NO: 57754 - DNA, 237 bp, Glycine max
  Peptide Sequence Number=SeqID_174532
atgggtgccaagtacctcaaagtggtcaaacgagggtcgcatcccaacaacggatggtccccggacgaaattaggggaagtaaagataagacactaatttcgttcgggcgaaacaccattcggccggtgaatcttcctgccagcggaacccgcaaaaattttgaaaatgatcagtaccgacacatcatcgtaatactgtcgaattcgttcctcttggttgacgaaaggcgcggatga

SEQ ID NO: 57755 - DNA, 102 bp, Glycine max
  Peptide Sequence Number=SeqID_174533
atgtgggcatttgaactccctgatgagagggcaatggagcaaatcgccggcgataatggagacgatactcagaatgttcctcatcagcgcaaatcttcttga

SEQ ID NO: 57756 - DNA, 210 bp, Glycine max
  Peptide Sequence Number=SeqID_174534
atgacaagtggtggtaatgttggtggtgtctatgacgatgatagtagtgatgacaatgaaagtggtggtcgtgacattagtggtggttgtgatagtgatgacgaaagtaatattagtgatagtgacaatgatggtgttagtggtaatggtgatgacgaagatagtattgatgataatggtgatagtgacatcaacggcatccatgagtga

SEQ ID NO: 57757 - DNA, 276 bp, Glycine max
  Peptide Sequence Number=SeqID_174535
atggcttcttctgtatccaccacaccacctttgtactttgatgagaagtggaagctgtcaaagaaagaaggatccaccagaagcaggtcctcaagcacccctttcatcaagaattcttcctcacagagaaggtgtgcttttgctagcaagtgtgcgaggcttgtaaaggagcaaagggcgcgtttctacatcatgaggcgagaagaagaagaagaagaagaagaagaaaaagggtcggtgagggttgttctgagaaatcccatcaatggagggtag

SEQ ID NO: 57758 - DNA, 477 bp, Glycine max
  Peptide Sequence Number=SeqID_174536
atgaactcctcccatcctgagggtcttctggatattcttctgggcctaggtggcatgggaacttatctacttggcatgagcccatacattgcttctcaagttgatggggggaacacgccaatcaatacaaagactatctcacttggttggatgtttggttttctctttgttgttagttttgtgggcctcttctctattgtgcctctaagaaaggtgatgattctgaagtacaagctaacatacccgagtggaaccgccacggctctccttgtcaatagcttacacacaccaaaaggagcaaaactagcaaaaaaacagattgctttgctcttcaaaagcttttgtggcagctttgcttttgggtttttccagtggtttttcactgcaggagatgattgtgggttcagcacttttcccacatttggtctccaagcctacagtaaaaggattattgtgaatatgacattaatcacctag

SEQ ID NO: 57759 - DNA, 366 bp, Glycine max
  Peptide Sequence Number=SeqID_174537
atgtatatgacacagatgcaatttgtgaatacgggagcccaaggaaattgtccccttcttagatacaacatttgggcagcatggcgcccgacgtatgtatttaagaaggtgacacagaccctcggtcggtttgacaaagtgaggggatcaagacggaatccgtgcatgatgtatatgcgaaaggcacaacacggggattccccagtggagtcgccaactgtcgcaacctacccttcagcgggagggcaacgcgagggatcatgggtgcatcttccaagaaaggaaaatgcacggagtcaccaccaacgtttattcgaggaaaacgtcgaaaaaaccggaaaggtgtggtctacgaactttaagtaa

SEQ ID NO: 57760 - DNA, 105 bp, Glycine max
  Peptide Sequence Number=SeqID_174538
atgtgggatgctggtggtgatgcatttgattcaatggaggatgttggatttttagagtttgcagaactctcactcgatgagccagaattggagaacgaacattga

SEQ ID NO: 57761 - DNA, 748 bp, Glycine max
  Peptide Sequence Number=SeqID_174539
caaaatcctagtactactactgctaccacctctgatgatcatcatcaccagagaggtggtgtaactgtggcccttcacattggccttcccagtcccaccaccacaacttcttcaacaaacagtgccaccaccccaactactactagcaagttgcctgatcttcatttggcctctgctgcccccaacattcagggccagtattggatcccttctcctgctcaaatcctcattggccccacccagttctcttgcactgtctgcaacaaaatgttcaaccgtttcaacaacatgcagatgcacatgtggggacacggctcgcaatacagaaaaggccccgaatcgcttcggggcgcaaagccagcatcctcgatgctgcggcttccctgctactgctgcgcggagggctgcaagaacaacatcgagcacccaaggtcgaggccgctgaaggacttcaggacgctccagacgcactacaagaggaagcacggtgcgaagccgttcgggtgccggaagtgcgggaagccttttgcagtgagaggtgactggaggacgcacgagaagaactgcgggaggctctggttctgcatctgcgggtctgatttcaagcacaagaggtctctcaaggaccatgttcgcgcctttggggatggacatgctccgcacactgtggagagctgtgatcgggtgggggaggatgaggatgatgaggagttggaagtggaggatgaggaggaggaggattatcata

SEQ ID NO: 57762 - DNA, 795 bp, Glycine max
  Peptide Sequence Number=SeqID_174540
atgacatggcctattcgaatgcaaattgccatagagacaactattgcattggcctatctccatacttctaacatcatccaccgtgatgtcaaaaccaacaacattgtacttgacattaatgtttcggttaaggtagcagattttgggctttcaagattgctccccaatgatgtaagccatgtctccatagctccacaagggtttctggggtatcttgaccctcaatatttccaattctacaggctcacggacaagagtgatgtgtatagctttggggttgtacttattaagctgatatcatccatgccggcagttgatgcagccagggaaagagatgaagttaacttggcaaatctttccatgaaaaagattcaaaaaggaaagcttagtgagcttgtagacccatcctttgggtttgagtcaaaccaattctggaagctctcaataaattatgagtctgagaatctagagaaagaagatgatgatggtgttatctcttccacttcatccagcgaagtacatccaccccaaccagcttcacaggactcgggtcaagaggaaagatgcgcggagtcgccaccaacgtttatttgtggaaaacgtcggaaaaaccaaaggaaaccggtcaaaaagaaaattctaagttcgggagatgtatttacgtttgaggaaggtattagcacctctcacgtcgacaaaagcggggcttttgctcctacgtatcctcctttcgagagggaatcagacctacgtagttctttcttaagcgtgaatcaagcgattctttttacttga

SEQ ID NO: 57763 - DNA, 105 bp, Glycine max
  Peptide Sequence Number=SeqID_174541
atgaagacgcctatgcatccaaccacatatcttggactagacgaggaatctacaaagatatgcaagaagcaaggttcaactgcgttatacactgctgaagcataa

SEQ ID NO: 57764 - DNA, 335 bp, Glycine max
  Peptide Sequence Number=SeqID_174542
atgtcattgcctagcgctgttcatgtgtcctccaccttcgacgctgttcatgtgtcctccattatcaagcgcggagcctctagtgactgggaaatatgttcttctgttgttttccggatcggttccttcgccaaacatgtcaaaaaagaaggagtagagacgagaatcgtcatcacggaaagggcaggatggacgaaatcagtgtcttatctttgctttcctcttatctccgatgagagatatttggcacccttggttgcacaatatgtgaagtcccgagacgtgccgaaaatcaaaaggaagcaggcttacgcgatccgtgaaaattccgtgat

SEQ ID NO: 57765 - DNA, 594 bp, Glycine max
  Peptide Sequence Number=SeqID_174543
atggtctcttcaaccagcaacacgcggccgccgtcgaccaccacagtggcgacggtggcgtgcggtgcccagcgcgggtccggcgtagcgttcaactcagaactcgtccttcttggtcagttccagctccatggcgtcggcggtgcggatggccgcatcgatggcgtcgctgagctggtcggccgtggcatcggcgtcgatcttgaccacgaacatggcggtggtgtcctgcttcacccagccgcccatcttggcgtcctgcgaatcttccagcaggcggttggccacggccaccgggaactgcttggtcttggcgttgtaggccggcgaccagatctcgcggatgttgtgggtgccgaaatcttccaccgacgagcgcacgtagaccatctgggtgcggtcaccttcgacgtcgaacaccatgcggtagtcgccgtcctcgtcgacctcgtaggtgtagcccagcttgtccaggtggcgggccacggccttgtcggcctgggtctcggcggcggcggagccggcggcggccagggcgatcagcagggcggagagaagggtccttttcatgaagatcctgtgaaacagtgttga

SEQ ID NO: 57766 - DNA, 369 bp, Glycine max
  Peptide Sequence Number=SeqID_174544
atgacatctgagtccgcacaggaaattgcagataaaatagactccttagaagagcagtactacggaagggcatcaaggacatgcagcagctcgtccacatccatcagccaacaacaactagatgaaattgttgcaaggcttagggaagacatgactggtcagattagggaagaattgaggactcagctagaagaggaaaataaaaggagcttggaaataatgaccaatgcattgaaagaggctattaaaaaagagttgtcaaataaaggatccccagagtcactccaaattcagccggacatacaacaattaggtgcgcgtgtcagcactaagggaagtaatgttgttatcaatgtccaggcttcatag

SEQ ID NO: 57767 - DNA, 657 bp, Glycine max
  Peptide Sequence Number=SeqID_174545
atgtcaataccacattggcatcacccaacttcaaattttatatcattggtattcggtttaccattggacatcattctcatggatcataaacctttatcgcgtcatcaacacgttcatcgttcacatactatgattaatgacttaatcacttcctattaccatacaatacctgaaccagaactacaaattataccattattatcatgtgccgggttccaacatattgccctaatcaaacaatgtaaaattgatcctgcattgatcactgcattggttgaacgatggaggcttgaaacacatacctttcacctgccatggggaaagtgcaccatcacactcgaagatgttgcacatcatcatgacatgtcatgggcttggtaccgcatgcctttttttgcaccaagagtcccacgacccaaaacaacttttccactagctaaaagatggagtggtggtagattagaatatagggccacaccttatggtgacttggtcggatataggtctcgtatagatcatatggagagccatgagtttggactacaagaagatatccctgttgatcccatgaatcttgatctacttcaccaaattgacatgcgagacaatcattacattgattggatggagtaccatgcggggtggattaatatctga

SEQ ID NO: 57768 - DNA, 648 bp, Glycine max
  Peptide Sequence Number=SeqID_174546
gcttttcgtcttacagaatgcaaaaagtttatacgaatacccactcgggtatttctgcccgtcagcgtgactcaaaagtcagtatgacagatcttgtgagcgcggaagatgacgtaaatctccacgtgtcaacgggcttgtcggccgcgattgacgaaggcttttcgtcttacagaatgcaaaaagtttatacgaataaccactcgggtatttccgcccgtcagcgtgactcaaaagtcagtatgacagatcttgtgagcgcggaagatgacggcacagaagacgacgttagtctctgcgtgctatcaggcttttcgtcttacagacagcaaaaagtttatatggataaccactcgggtatttccggccgtcagcgtgactcaaaagtcagtatgacagatcttgtgagcgcggaagatgacgtcgcagaagacgatgttagtctctgcgtgttatcaggctttttgtcttacagaatgcaaaaagtttatacggataaccactcgggtatttccggccgtcagcgtgactcaaaagtctgtatgacagatcttgtgagcgcggaagataacctaaatctccacgtgtcaacgggcttgtcggccgcgattgacgaagggggatcctctagagtcgccagaagacgac

SEQ ID NO: 57769 - DNA, 197 bp, Glycine max
  Peptide Sequence Number=SeqID_174547
atgaagatgaaagcaaacaaaacaagaaatgaattgaaagtttcggattcgaacacttaccggttgaagaccaaagaacgaatgaagaacggacaaagcacggtaaagaacggcggaaatcttcacggatttgctcacggaaacgtctcggaagcgttacggaagcacctcggcttggattttcttcacggaaacat

SEQ ID NO: 57770 - DNA, 324 bp, Glycine max
  Peptide Sequence Number=SeqID_174548
atggaggccatgaaagagcaaatgaccacaatgatggaagccatgatgagaatgaaaagaatgatgaaggtcaatgcggctacagtcattgctgcaagtatcgccactgaggtggtcctaactcacccatctgacctcaatcaagtaaatcctacagtcgcggatatggtagggcagggaggcgaagtgttaagaagggagacacatgaattaccccgccacactgtagccaacttcgagcctcaccttggatatgccactgaggggcaggcatttggtggcatactgttcgaacccgacaagtgcactagatggcgcaagtag

SEQ ID NO: 57771 - DNA, 177 bp, Glycine max
  Peptide Sequence Number=SeqID_174549
cgcgtgcttttctcgctcagcggatggactgaagtggtgcgcttagcgggatggcccttcgctcagcccaaatgcacatctcatccttcttccatattcttcctcacgctcagtcgaggagtgttgcgctcagcggatggctcgctaagccagaagattggcttagcgagcggatga

SEQ ID NO: 57772 - DNA, 168 bp, Glycine max
  Peptide Sequence Number=SeqID_174550
atggtaaacaatcctagtgaattcaacatacataggaaggttgaaattccgaaattgcaattgaaaattactgtgaaaacaagtgccaaagctagagggaattggaaggagaattggtgccatcccatgaagaaattgagtcaagaagaaaggggccaaccaccttaa

SEQ ID NO: 57773 - DNA, 213 bp, Glycine max
  Peptide Sequence Number=SeqID_174551
atggctactggggaaaatgtttttgagcagcaacgtcatccatatctgcgtaagggtggtcatgctggtgcacatgatccgtacccgtctccccgccatgctccaagcaaagtcctgccctggaacgcacaacaattggctgatggcctcctcgtcaaaccccgaggcctgactcctcctctagctaaactcacaatgctgaccctcctctaa

SEQ ID NO: 57774 - DNA, 636 bp, Glycine max
  Peptide Sequence Number=SeqID_174552
cgcgtgccactttccagcctctcgcttgttgtgcccgagaccgtatttttcgacggaatcgaggacgaagtcgcggccgctttcgagcaggcggtggaccgtcttgtccgcgccggtgcctcggtgcgacgacaggcattcccgattttttcggaactgttcgaccttatcaaggaaaagggtgcgctggtgaccgcggaggcctttgccctgcacaaaacccggctggaaggtgctgatgccgcgcgcatggacccgcgcgttgtcgcacgaacgaagctgggggccaatatttcagtgccggattacatagccatcatcgatgcgcgtgaacgcatgactgcggcgttttcgggaatgatcgggaaaggcgaactgctgatgtcgccgacattgccgcatgttgcggccagggtcgcgccgcttctccaaaatgacgatgcttttttcgccatgaatgcaaaaaccctgcgcaacacgcagatcggcaacttcttcgatctctgcggtgtttcgatcccctgtggaacgggtgacgcaggcatgccggtcggtttgctgctttctggcctagacggtacggatgaccatgtgctgggggcggcgatggcgacggaagaaatcgttcgggcttga

SEQ ID NO: 57775 - DNA, 426 bp, Glycine max
  Peptide Sequence Number=SeqID_174553
atgccaactccaacgccactcccttctttctcatcgtcgcaaaatccacagcgcgccaccttcatcaactccaccatcaccctcccacgcaccttcgggttccacgacattgacctagattgggagttccctcgaaccgcgaacaagatgaaaaacctcggcctgctattcaaagagtggcgcatcgcaatagccgccgaggtcatagccatcggtcgggaaccgcttcttctcaccgtcgcagtgtacttctccgtcgattacttcttatccaaaacctcgtcattgaggtacccgatgggttccattcaccgactattgggtcggctcctggatcggatggtgtcacgatgttatttcaagtgttgcagtttaacagcgaaacaggtgcgaaagttgtgcatgacagtcggtttattcgtatag

SEQ ID NO: 57776 - DNA, 142 bp, Glycine max
  Peptide Sequence Number=SeqID_174554
atggagatgagggtggcgatggtggagccaagggtggtggtgaactttgcgaggtttgtggctgtggagtttgaaacgtgtgcgccgccaatagctgaacaagtgcggcaaaagaagttgcagttgcaggagagagagaatg

SEQ ID NO: 57777 - DNA, 106 bp, Glycine max
  Peptide Sequence Number=SeqID_174555
gtggaagcgcgtggcgttttgcgaaggtgggttgcgtggtgcgaggtatgggagccacgctggcaggaatagtgtggtcgagtgtgagacatggaggaggatgtag

SEQ ID NO: 57778 - DNA, 468 bp, Glycine max
  Peptide Sequence Number=SeqID_174556
atgaagaacgtaaggggtgactcgaataacaacaacccatgccccgaacatggccgctggctcttgtggatagataactggaaagaacttatccaaagaatcaagtcacatggcatgattcctggtgtagcattaaagcctgggacccccgttggagaggtttatcctctggtggaagccgaaaatcctgtggaaatggttcttgtgatgactgtagaacctggattcggaggacaaaaatttatggcagagacgatggataaagtacgtatacttaggaagaagtatccatcacttgacatagaggttgatggtggtttagggccttcaaccatagacgtggccgcatcagcaggggcaaattgcattgttgctggaagttctgtttttggtgcacctgagccagctcaagtaatatccttactgaggagttctgttgagaaagcccagcaaacctcgatacagtaa

SEQ ID NO: 57779 - DNA, 1896 bp, Glycine max
  Peptide Sequence Number=SeqID_174557
atggcgatggagaagggctttgttcgtgtggaaggaggagttattatcacacatggaggtgttgacgtgctaagttatgagacaacttcacctgattcctctggcagtggcagctactaccattgcattgaaaatgtttcacagaaccagtgtgagacatttgcactctttttcgcaaactcttactactctctctccaacctcaccttttatttgggactaaacaagtttgtgattgcacaagcaaatggtttctctgcagacactgagttcttctcccaggaccagcctcttcttatacctattcattgcaaatgcataggtggtggcttctctcaggctgagttaaccaaaaccaccatcaaaggagagagcttctatggcattgctcaatcactagagggtttgccaacttgcaaggctattagggacaacaaccctggtgtgtcaccttggaatcttgatgacaaagtgagattagttgttccattgagatgttcctgtccattttcatctcaagttagaccacaaccaaagcttcttctttcttatcctgtaagtgaaggtcctttggttaagcccaaggaacccaatactggctttcaaacaactagcatcccagtgacaacaagtccacacaagaagtcaccaatgtggaagactgaattgtgcattggtctagctggtgttgcacttggagtctgcattgcttttgctgcattctttttcttcatcagattgaagcacaagaaggaggaagagaattcatgcaaggaaggggacttggagctgcaatatctgaaccaaagtgtgagaaccacctcaactagtgacaagaagatttcatttgaagggtctcaggatgctcttgatgtgaaaattgtggacaccgacgccgccacgccgcggaggaagttgttgctggatacatacaccattgaggatgtgagaaaagcaactgaagatttcagctcaagcaatcacattgaagggtcagtgtatcacggtcgtctgaatggaaagaacatggcaatcaaaaggacaaaggcagaagtagtagtgtcaaagatagatcttggccttttccatgatgcaattcaccaccacccaaacatacttaggcttcttggaactagcatgttagagggggagcagcaagaagagtcatttttggtttttgagtatgccaaaaatggttcattgaaagattggctccatggtggactagccatcaagaaccaattcattgcttcctgctactgtttcctgacttggagccaaaggctcaggatttgccttgatgtggccagtgccttgcagtatatgcaccatgttatgaatccaagttatgtgcatagaaatgtaaagagccggaacatctttttggatgaagaatttggtgccaagataaggaattttggtatggctggttgtgttgagaatgacactgaggaccctcaattctattccactaaccctgcctcttggagtcttggttatttggcacctgaatatgtgcaccaaggtgtaatttccccaagtgttgatatctttgcttatggggtggttttgttggaagttttgtctggtcaaacacctataagcaggcctaatgagaagggagaaggatgcatttggcttacagataaaatcaggtccattttggtgtctgaaaatgtgaatgaactaagggattggatagacaatgcattaggggagaactattcatttgatgcagctgtgacacttgccaacattgcaagagcttgtgtggaggaagactcttctttgagaccaagtgcaagggaaattgttgagaagatatcaagattggtggaggaattaccacaaggggaacatgacgtgttaatgtgtgaaagctctagcaaacctctg

SEQ ID NO: 57780 - DNA, 333 bp, Glycine max
  Peptide Sequence Number=SeqID_174558
atgagtgaatcatccagcaaaccaaagtaccctaaggcgccgcacaaacatattcacaagaagatgaggaaaacactcttcgtcgcaccaacgtcagtgcttgtgtcacgtttaagtgttttccatttgcgtccagccccacccatcttcgaatttaacacgatttttgggtcccgtgtgaagatgaagcgtgaccttaatgctattacccttttcaagcacatgcatgttaaggggattgttggaattgttgaaccaggtcttggtattttcaagatcttggtcagctgttcctgccacctgggtcatatgaaatttgccttttttatgtga

SEQ ID NO: 57781 - DNA, 2511 bp, Glycine max
  Peptide Sequence Number=SeqID_174559
atggacttcgcaaggctcaacactcccaaacctccgcccatcttcacgcgccccctcacctgggtcacctccaccgccctccgcctccaccgccgccaactatctccacctccccgccgccgctacctcccccctctccgccgccacctcctcctcacccctcactctcctctataccttctattctcaccagtaaaactcttgactcttccaaatgtaaatccattctccccccacttaaccccccaccacttcgatcgcttgttcctctctctccaccgcaccgtcaaccccaaaaccacgcacgagttcttccgtttcgccactcgccactgcaacttccgcttcaccgtccgctcctactgcctcctcctccgttccctcctcgccgacagtttcgtgccgcgggccaggttcctcctcgcccgcctaatcgacggccacgttccgacgtggtcgtcgaagacgacgacgtcgttccacgaccgcctccgcgaaatagcctcctcaatgctggagctaaatcagggttccgacgaacaacgactcggcgaattggatttgctgctccacattctctgctctcagttcaagtgcttaggttctcgttgcgcttttgacatcttcgttatgttctccaagagaggtgttttcccgtgtttgaagacctgcaatttgttgttgagttctctggtgaaggccaatgagctccacaagagctacgaggtgtttgatctcgcctgccaaggcgtggcgcccgacgttttcacgttcaccaccgcgattaacgcgttctgcaagggagggagggttggggatgctgtggatttgttctgcaagatggaggggctcggggtttttccgaatgtggtcacttacaacaatgtgattgatggcttgttcaagagtgggaggtttgaggaggcgttgaggtttaaggataggatggttaggagcaaggtgaatccgagtgttgtgacttatggtgtgctgatcagtggtttgatgaagttggagatgtttgaggaggcgaacgaggtgttggtggagatgtatagcatggggtttgctcccaatgaagtagtttttaacgcgctgatcgatggatactgcaggaagggggatatgggtgaggcgttgagggttagggatgagatggcaatgaagggaatgaagcctaattttgttacttttaatactcttttgcagggtttttgcaggagcaatcaaatggagcaggctgagcaggtattggtgtatatattgtcgagtgggttgtctgtgaacatggatgtgtgttcctatgtgattcatcggttaatggagaggtctgggtttgtttcagctttaaaaattgttaccaagttgttgtcggggaacatcagggttagtgatagcttgttaaccccattggttgttggactttgtaaatgtgaaggacattcagaggcaattgagctttggtttaagctggctgcagttaaagggcttgcagccaatacggtgacctcaaatgcacttctccatggactttgtgaacgagggaacatggaggaggttttcgaagtactcaagcaaatgcttgagaaaggtttattgctggataggatctcttacaacacacttatttttggctgttgtaaatggggtaaaattgaggaagctttcaaactcaaggaagagatggttcagcaagaattccaaccagatacgtatacctacaattttctcatgaaaggattggctgatatgggtaaaatagatgatgttcataggcttttgcatgaagccaaagaatatggctttgttccaaatgtctatacatatgcacttttattagaaggatattgtaaggctgatcgcattgaagatgccgtgaaattctttaagaatttagattatgagaaagtagagctaagttctgttgtatataacatacttattgcagcctactgtagaattgggaatgtgacggaagccttcaaactgcgtgatgctatgaaaagtaggggcattctacctacctgtgctacatattcttctctaatacatggaatgtgctgtattggccgtgttgatgaagcaaaggaaatttttgaagaaatgagaaatgaaggcttgcttccaaatgtattttgttatactgctctaattggtggtcactgtaagttaggtcagatggacatagtggggagtatcttactggaaatgtcttcaaacggcatacgacctaataaaattacctacactattatgattgatgggtattgtaaattgggaaatatgaaagaagctagggagcttttaaatgagatgataagaaatggaatagctccagataccgtcacttataatgcattgcaaaaaggatattgcaaggaaagggagctaacagttactttacaaagtgatcataaatctaacataggactacccttagaagaagaaattacttataacacattgattcacaagttgcatccacatacagcaattagcaatagagaatga

SEQ ID NO: 57782 - DNA, 576 bp, Glycine max
  Peptide Sequence Number=SeqID_174560
atggtggcggttgatcttgcaaccacatactcttatgtctcagcttttaaaggttgttacttccctggttcaaaagctctgaatgcgaagaaaaggtatgttccaagctacacctgggctaatatcttttgtgtgaaggagatggcgaacaaaggtagctttgaaatggttagtgatggcttaaaagatgttggtgttggtatgggcatgatccgtagagactcaaatggctacatccttggcttagctatcaacttcctccctcacaagatctcacctaagatggcagaggctctagcctcgaaacggactattcaaactgctagggagaggcgattttctcatttcattttggagacaaactatcttcagctagcacaggcatggaaaagtaaaagagctcttaacccaacctattttgatgatgtcttggaggactgtagatatgttagcagaggtgtagtcaatttcaaaattctttttgtgaaaagactaggcaataaagttgttgaatctcttgcaaagctagctcttgatactagggaaaagtattggttggatgacctactcacttag

SEQ ID NO: 57783 - DNA, 216 bp, Glycine max
  Peptide Sequence Number=SeqID_174561
atggaagatgtagaagagaagatctacaagattgaattacagaacccagctcagaattgtcaatgcaagagttcctgcattttttcatttcttccatgccaaatgctccacatagtcattaagaataagggaagtttggaagagtctatccttctcaataaagacagaataaaagaagagaaagacttggctagctgcagcaaaggatcgatttga

SEQ ID NO: 57784 - DNA, 357 bp, Glycine max
  Peptide Sequence Number=SeqID_174562
atgtcttttgatttgaactgtaagcttaagaaacatgaggtcttgagggaagtacctcctatgtttgtaacactctatgaggagatagaaaccttgggaaataaactaggaaaatttgttgctggtcaggaagccattaacaagattattaaggtgcaaagaaaccttaaggacaaatctggccatggtttcaaaggcaaaaagatttgggtcatgaaattcacaagtgcaaggacctccctgaaaagggcaacccatcatagggatagtccagcacttagcaactcccacatgctaaccagagaaaaggacccaaaaagatttgggtaccttagaggaaaaatagtcatgttgtag

SEQ ID NO: 57785 - DNA, 582 bp, Glycine max
  Peptide Sequence Number=SeqID_174563
atgggacaccttagccattacgcacgaagggtcctctcaagaaaaatgcaacaagttgagccttcttgtcacagctcatcagaatcctcaaagttcacgagcactagctttctcaagatgaaggaacaaagaaaggaaaatcattggcccttacgattcaaaagccaaaacccaactctgtgtccaatgagtcatcttccaaagccttttaatgtaagtgatgctttggaagaagaatttgaggatgatgatgactctgatgaagaagatgatgaactaagtctgatcacaagaaagataaaaaatgtgaagaaacaagaacccctccaggacttagacgattcctcatttaacgaggataatgacgaagaaaccaacctatgtcagattgttgatgcatccaccaataaaggagaaccaacactagatgcgagttcgaaggatgaggactctcaacctgaggaaactgtcaactttgatggtgttaaacatcttgaaagagagcatgaggatttcaagaaagctcatcaagttcacttagttaattttgtcctggaaacttcttcgcctagtagtgaatag

SEQ ID NO: 57786 - DNA, 247 bp, Glycine max
  Peptide Sequence Number=SeqID_174564
atgacggaagggtgtggtgaagaggttgccttgcaaccctccccgccattgcttaagtttttccatgtgcccggtggtcggttttggcccgtggctagggtcggcggtgctgggttatggccccgtgctaagtttcggattgggtttgttggtgatttggaggggagggacgaatcaaagcgacaagggctgaatctcagtggatcgtggcagcaaggccactctgccacttacaataccccgtcgc

SEQ ID NO: 57787 - DNA, 750 bp, Glycine max
  Peptide Sequence Number=SeqID_174565
atgggtttgtgttcttctgtccaccgaaacgagcaaaccaacatgaagcatcatctaacactctcttttgagtccaaaactgaaagccttctgattccttcatcacccttcgaagacaaagagaaacccaaaaacggaaactttgtggttgttgctgatgatgatgcgtttaagcctcagcagtggtcaccctccaggtccaccaccaccttctcagtcaaagactgtggggataacgatggcaaagaggaatcattttttgattcaaaggcctggttagactcagactgtgacgatgatttctatagtgtaaagggtgagtttaccccatctcgtggcagcactccagtgcaccacatttttctcaacaaaaccactccttctgagccttgttctgttccggaaccatctccaacaacacaaaagaaaaagctgttggatctttttcgcgaaagtgtcagagaaaaccaaagtgatgatgctgagaacactttcggcaacgaaaagaaagaagtgaaaccaacaatggtacatgatcttattcctaaatctgcacacagtactccttatgtctcgggaggaaattctgcatgtagcagtgaaagaacaatgaatgatgatcatgcaccgattagagagaaaccagttaaatctgttcagtgctgccttccaagcttggcttcttgtcgtagcttcagcgagaggaagaggaagacaagtcctgcaatagcagctaatggaacagcatga

SEQ ID NO: 57788 - DNA, 375 bp, Glycine max
  Peptide Sequence Number=SeqID_174566
atgtctaaagctcggtcgcgaactggcccatctgaatacccccaatgcagacttccaatcatccttgtatcgccagagcaaccggtgaacaaggtctcgggagaggggtatgaaatcacaagcttgatcattgaaaagggtgtgaagggtttcttcctcactgcttcctttgccaagtttcgcagtgagaatgtccacatacctgaaagggtcgaggaagagatgggtggcgctggttcggcgctcaaggcggaaccagcggcaacgggtggacttggagtggcggcgggagaagatttcatcggaaaggcaggttttgggaaatgcggtgctgtttttagatattggatcggactaatttcaccattaagttga

SEQ ID NO: 57789 - DNA, 686 bp, Glycine max
  Peptide Sequence Number=SeqID_174567
atggggttgaaccaagcacctgcttttatggaaaggttcatcaagtcaaggaaagaacgtgctttacggtgcccttaccgaacgcgtgctagagctagagtaatgagtgaagaagaagacaaggtgcaagagcggataaaggctggcatagaggccctgaaagagcaaatggccacaatgatggaggccatgatgagcatgaagaagataattgctgttgctaaggtggacccgactcccccatctggcctcaaccaaataaatcatcccatctcggatatggtagggcagagaggcaaagaattgggaagtacaagtgaccctcattttgtgcaagttcaaaacaagcatgccttcccgccatatggcttgcctcccaattatacaccacccaatgtggtgcacattcccaatgagaatttcaatgactccactcccatactcattgagagccaacaacctcaatctgatcatgcacctatccctcaacccattggggtgacacatgaaagaccccatcacaatctagccaacttcgagccttgcctcgaatacgccactgaagggcaagcaattggtggtgtacccctgtcaaacactttggagagccctcagtctcgctcacaaccacaacccttgcattttgcggtgggaagaacccctccctctatgggtgaaaagggaaa

SEQ ID NO: 57790 - DNA, 1131 bp, Glycine max
  Peptide Sequence Number=SeqID_174568
atggtagacatattgggtaggatgaaggttatggaaaagttgagggatttgttagaagaaatgcgcgagggtggtcttgtcaatatgaatactgtggcgaaggccatgagacggtttgttggagcagggcagtgggtagatgctgtgaggatatttgatgacttgcaagctcttggattggagaagaacacggaatccatgaacttgttgctcgataccctgtgcaaagagaaattcgtgcagcaagctcgtgaaattttcttggaactgaagcagcacattgctcccaatgctcacacgtttaacatcttcattcatggatggtgcaaaatctgccgtgtggacgaggcacattggacgattcaagagatgaaaggatatggttttcacccctgtgttataagttattccaccctcattcagtgttactgtcaagaagggaatttcagcagggtgtatgagcttcttgatgaaatgcaggctcaagggtgctctgcaaatgtgataacttatacttctatcatgtgtgcactaggaaaggctaaaaagttcgaggaagctttgaaagtacctgagagaatgaggtcttctggatgtaggcctgatactcttttcttcaattcgttgatacatacattggggagagcaggtagattagatgatgctgccgatgtattcaaggtggaaatgcctaaggctggtgtttccccaaatacatccacctataattcaatgatttctatgttttgttatcatgcacaagaaaagagagctttagaaatattgaaggagatggaaaattcaggtggttgtaagcctgatgctcagacttaccacccattgatcaagtcttgctttagaagtggaaaaatagatggtgtgttgagtgagatattaaatgacatgattaataaacagcatctcagtcttgatctttcaacctatacactgctaattcacgggctttgtagagaagatagatgcaattgggcattctctctatttgaggagatgattgatcaagatataatacctagatacagaacttgccgtttgctattggatgaagtcaagcagaaaaatatgtaccaagctgctgagaaaattgaggatcttatgaaaaaattgtaa

SEQ ID NO: 57791 - DNA, 660 bp, Glycine max
  Peptide Sequence Number=SeqID_174569
atggccgggcaatcaaaccatgacctttcattgttttcagctgaggagcttgagttcattgctgaagatgagatcgtggacattgtacccaatctcaaaatgagtgctctcaatttcatttctggagattttggcccatttacgccccagattgttacccaagtaccactgtggttggccactgctctcaagaagagaggcaagtgctccatttgccctccccaatggatgtctgttgagaagttgagtcaagttttggaggcagagcgagactctcaagagatgtcagatcaattgccatttcattatgtggaaatctcaagacttctttttgatcatgcacgtgacaacattcctgatgtatatatggtgaggtctctaattgaggacatcagaaatgttcggtttcataaagttgaaactgatttggaagcatttaatggtcgtacaattgctgttaagattaaaaatttatctgcaatggaagtgaatattgttcgtccatttattggaagagctttacaggcattttataagcatgatagtccagagctgataccagacccagagagagtttctgataggcgcccccaagttatcaacaatgctccaagagtatgtttgatttccatggaaatattttttgcattcactgtataa

SEQ ID NO: 57792 - DNA, 342 bp, Glycine max
  Peptide Sequence Number=SeqID_174570
atgtgcaaaaaggagcacgaatctttcaaaggatacgcccaaaggtggagggatatggtagctcaagtagtgcccccaatgacagagaaagagatgataagaatgatagtagacatcttaccagtgttctactatgaaaagatggtgagttacacaccttcaagctttgcggatttagttttcactagcgaaaggatcaaagtttgtctgaaaagaggaaaatttgattatcttgctttgatgaatgagaaagttggggcaaatgaagagaatgagaaagagggaggaacccatgttgtgactgtcattcctgcatggccaaatctcccaccagctccataa

SEQ ID NO: 57793 - DNA, 621 bp, Glycine max
  Peptide Sequence Number=SeqID_174571
atgaataaaaacaaaagaaaaaagtatgatctcatgctcctcctgcacgaatttctgagtttaagatcatgtcaatctctcacacaagggaaagatgagaatgtggagccactgctagcgtcttcatcttatgaccaggatgattcgtctgaggtggctgtgcttcttaattcgagtgagggagcggtgaatcagaagagaaggcataaatgctgggaaggttttatgttcattgaggctatagtaaaggctgatttctttgttggtgttggcatggggttcctgttctcaataataggtattgcccaagcgccttcgtgtttgtttcaacctttgagcttgacacgaacgagtaaacctcccgttgatcttgatcagatgggccgccgcggcgtcggagtgcgcggcgcagacggcgggcttgggagtatacacctttatgtgcggacagtggatctgcggaaacgcagacttggggctgcaaggttgggtggtggcgcggtggcacggtgtcgctctatcaagaccacacggctgccggcaagtatggaaggaaaactttgtaaccctagaataaaagaacagaagaggaggaaaggaagccacctgttattggcttga

SEQ ID NO: 57794 - DNA, 267 bp, Glycine max
  Peptide Sequence Number=SeqID_174572
atggttgcaaccactcttcaaccacgtataaacctcgagtccttatttgattccaacgacaacaacaacctcgggttcatattcatagttgacggcaacaactacgggcttagattcatcatcgttgagtgttatgtctcaaatggaaaactccgccgtacactgtactgtcaaaaccttcctctccatttctctcctttgcatgtgtcggagaggtcaacggcgatgccgattttgcagtcggcgccaacagtgagggtggggtga

SEQ ID NO: 57795 - DNA, 1338 bp, Glycine max
  Peptide Sequence Number=SeqID_174573
atggcggacgcgactcgttccaaggtgtatgcagatcacctcgaagacgcaatcacgaagcttacagcgtctcagcttgccatgaatacgaaaattgactatcttcttcagcgtatgacgcaactagaagcaaaccagcaacaattgcaattccaccatcttcttcggcgggacagacaccgtcgacgtacaaggttcgacggctccgacccaactggttggaccttcaagatcacgcaattcttcgagtaccactccatgccgaatcaggaacggttgacgatagcatcgttctacatggaagggtcagcccttgcatggttccaatggatgcatcgcaaagtgcagctttcttcgtggtcagcgttcctccatgcgttgcattcccgttttgctttgtcgacatatgaagatcccacaggtctgtcagcaatgtttgttttgagctgctttatctcggggttgagccccgctattcgtcgagaggtgcaagttctgcaacctgtctccttggttcaagtagtggcatatgctcgtttgcaggaggagaaattcctcgatgcgcgccggccgccagcacatcgttctccaacgaccaccgtaacaaccacagtttcacgatctcttacaaccaatgctacctctccattgttacccaacccttcacgaacctcagctccttccattcccttcaaacggctcacatcagaagagctcgtggttcgccgtgagaaggggctgtgcttccactgtgatgagaagtattcacgaggacataaatgctcaccctcattattcctgttagtggtgaaggatgatgagcttgcatcagatgtgacctcgctacggtcgccatcaccaaccgcggacttactccctgaacctcccccggcgcagctcagcttacatgcattatcaggccattcagcgcctgaaaccttacgtctgaagggggccattaatgagcttcacgttaatatccttattgatggaggtagtacgcacaacttcctccaccacagggttgcgacggtgttaggtctttcacccaaagagatagctccacttagagttacggtgggtaacggagacgaaatccgttgtcatcagctttgcatggctgttaaagtacaaatccaaaggtactttttcacggttgactttcacatcttaccattgtgtggcgcgtacgtcgtactaggagtagagtggctcaaaacactggctccaatgctcacagattacacttcattgaccatgaagttcattactaaaggcaagctagttgaattacaccgtgaccgtgagaaggacggggagcctgtctctccttcctag

SEQ ID NO: 57796 - DNA, 2226 bp, Glycine max
  Peptide Sequence Number=SeqID_174574
atggctgatcatcttcttcacctggaaagcgtttttcagatactggtagcaggtcatattgtgacgggtgagggagtaagaccagttccggaaaaggtgcaggctatacagacttggccaactccacgttcaccttgggctttaaggggtttccttggcctcgctaggttctatcgacggttcatcagaggatatgcagctttagcagcacctctcaccaaacttctatgccatggtcagtttcagtggtcatctgaagctaacgtcaccttccaaaagctcaaagacgctattacagtagctcctgctctcacattccctaacttcaaggtcccctttgttgtcgagacagacacgttgggcgtcggcatgggggcagtattatcgcaaggaggtcaccccatcgccttcttcaacaaacaattttgtcccaggatggctaattcttcaacatacgttcgtgagctagcagccattactgtcgccgttaagaagtggcggcagtatttgttagggcatcaattcattattatgactgatcatagaagtttacgggaactcatgaatcaagcagtgcagactccagaacaacactgctacttagctcgtttgctgggtttcaattatacaatccaatatcgctcaggtcaaaccaacatagtggctgatgcattgtcgagagtaatggaagaaccacctgcatctctttacctattgtcaatgcctcggttcgtctttatagaagaccttcataaggaattaacatccttgccagcgttcatggagttgcgcaaacaagttcaggctgatcccacaacttacccagattactcgttgactctagagctcatcttacacaagggacgaatatggcttccctctaatttgtctttcattaagttgttactcgaagaatttcatcaatcacctgcaggcgcccatatgggagtgcaaaagaccttacattgtctacaggaaaacttcacttggagttcaattcgagagtatacacgtgcttttatcgcaagctgcttaacctgtcaatacacaaagtacgataaccggaaaccagggggcttgctctgtcctcttccggtatcggcacaaccctgggaagatttgtcgatggactttatcgtagggttgccaacttatcggggaaatacttgcatctttgtcgtggttgatcacttttctaaggggttgcacttaggcatgctacctactcatcatactgcccacaccgtagctatgttgttcatggagatggtaggacgacttcacgatatgtcgcgaagcattgttttcgatcgcgatccgctttccatcagtaaattttggagagaactcttctccttaagtggtacaaagcttcgcctgagttcagcttatcacccacaatctgatgggcaaactaaagttgctaatcgtatcattgaacaatatttgagggcattttttcaccaaaaaccttctgcatggggtcgctacttgcttttggctgagtggtcttataatacgccgtgtcattctacgactggcatgaccccgtttgaagtcacctttggtcagaaaccacctaactttcctcaatatatctcaggcacttctaaaatagacgcggttaatgatatactcagccaacgagaagcagtgttcgagttgctccgtcgtaagctgagtaaagctcaaattcaaatgaaggcaacagcagataagcagcgtcgcgatcaagagttcgaagtaggggattgggttttagtgaaactcagaccacaccgacagacattagcttctggtttagcctattctaaattggttaaacgatattatgggcccttccaagtcacggcgcgtatgggcaaggtggcatacaagttgcacctacccaaccattcgcgcattcatcccgtttttcactcttctctccttaaaccctatgtggcgtctgcagttccaagggatatcactgacctttcaccaatggctcttgacaatcatcctgtcattactcccctagccatcgtagcatccaaaatgatcccttctaaaacaggcccaaagcatatggtgttggtgcaatggaaaggtctgggcctggaagaaacttcgtgggaggagtggtcagagttcaaagcgctccaccaccttgaggacaaggtgttgtttgatgggcacgggagtgttacgaagaacactaagggtgtgccattagcaaaggagtag

SEQ ID NO: 57797 - DNA, 177 bp, Glycine max
  Peptide Sequence Number=SeqID_174575
atggttgtcgaaaatgaaactgatgaagaaagtttaaagaaacatgcagaattagtcttagcattcctagtttgtggtgaaggttgtgaaagggaacaacaaacaaaagctacaggtgaggttacagcaatttggacaatggaggaaacgagcaagagatgcagaacaccaacatga

SEQ ID NO: 57798 - DNA, 825 bp, Glycine max
  Peptide Sequence Number=SeqID_174576
atgacactccgtctagtgtcagctccgccgtcgttctctctcttctcctgccgcgccaccgcatccaccgccctccctccgccgacaccgacgccgacgccggcgccgacgcttatttcttcaattccacagtccccgccgctaacatgcgcacttcactgtccgcacttccaatcgtgttcggggtgcacgcacgagttcaatctccaccgtccggtgatattggacgacgccaccaatttctttcggaaacacggcgtctccgacttcacatttgacacgtgcaaactgtggggttggaggtgccgtgcgaaattggccgtgcgtggctcttcgacggagcctctcattgggctctatgaggaggctcatcatcctaatattaatgctgctgtggagctgcttagacggggtattattgaaataggtgttgagccatatattgaagatgaaggtactggtgatttgcgatatgtccagatggctgtgacaacatataacacatctcttcctgcggctcaaagatataagaatggaaaggttcaggttacattggtttggaattcaagaaatgaaaactcacccggttcagacaaactgaatgcattagcaaattttctgtggaaaaatggtggtcaaaggagcaggcttcatttaattcactctgtgtgggccaactttcagacttctactaacaataaaattgtatgctgtatgggatacagggaagaacctatcttagatccattggtgggccacctgcatttgccacgctttaggctggaagttctgggtgcgagggcaagtgttgaaaagccaccttaa

SEQ ID NO: 57799 - DNA, 1308 bp, Glycine max
  Peptide Sequence Number=SeqID_174577
atgaggatctatgatgaatttaaagagatagtgaagattcagaagttccgaagattggtgtcgtacagtgggttctactgcttcgctacgctcataagctacttttacgtcaacaacacgactagggctggtttctctagagccgatcaattctacgcctcctaccctgctggtaccgagcttctaaccgacactaccaagttgtacaaagctgctcttggaaactgcttcgaggctgaagagtggggtccgtttgagttctgcgtcatggcgaagcacttcgagcgtcaagggaagtcgccatatgcatatcatgcgaaaatgtttcgcaacaccccaaaggtttgggattgtgaaaaactcatgtttatccctgatcattacatattccccaatgccgaacacgctcactacattgtggatatttcaagaaagttttgtgtggagcaagatatcaagtacttctatgctattcaagattgcagtaacttcagggctaatccagattgtaaaggtgtttgtcatgttgctctagcacaggaggcttttatattagggacaggaaaggtcttactcaaggtgcctccagcattaagatttgtattggaaggtgaaatgccctgttatttgcttgcaaagggtctaattttgcatatcaatggtgaaatatctatgtctggtgcatcatataaagggatgaagttcgtagggacaacaattgaaaatttaagtatggaagaaaggatggcagtgtgcaacatggttgtagaagctgtagggaaaaacagtattgttgtgaccacatacaaataccttggggatatgacacttgcaccatatgaaccagtttttagtgatgaaaatgcaagatttctagtccagtatagatttaatgcatcaaagatggaaccattggtcacaaagccacattcctctgctaatcttgctttggtgtgcgagtgcaataatgtgaaaattgatagagtagacattgcatcattcactgctcgtcgcacaactgtcaaagttcctatgtttctcgttcctgctacacaaaagggtttggatggttattcatctcaaaacacagctcaagggcaacattcagttgaatttgctgttggtgctgacaatccagagagtgcaatttgtgctagcctagccactggtttgttggagacaagaaaatctgatcaaatattagagcagataagtgaaggacaggtttttgcaaatttaaagcaagaattggacactgctgatgttactgacttgtctgcattgtacttaatctacccaagtgactga

SEQ ID NO: 57800 - DNA, 183 bp, Glycine max
  Peptide Sequence Number=SeqID_174578
atgaaatttgtgcaagagaaaggaagaacaaaagtgaaaagaggaaaaagaatgaagaacaatagagagaaaaagagaaacgagtttggtcctaaagtttcaacaacaatttcctctcggccctgcgcaagacaaataggtcaagataaggctgagtgtcatgctctgattggagaggaatga

SEQ ID NO: 57801 - DNA, 696 bp, Glycine max
  Peptide Sequence Number=SeqID_174579
atggaagatattttaaagaggtggactgagcatcttgaaagcacacgattaagggtcagtcacccaccaccgggacacgagttacacccttacaatcaaaatgaagaaaaaacattttctgatatggagaatgtgtttatgcaattcatggaaaaatctcaagctagctttaaagccaatcaaaactcaattcaaaatctagagattcaagttggcaagagttactccatgaaaaattgtcagtgggagcaagagttacaaccttacaatcaatatgaagaagaaagaatttctaatcttggtaatttgttgatgcaactcatggaaacatctgaagctactcaacatgcaattaaaaatctggaaattcaatttggtaagctagcaaaagaagtggctaaattttttgtcacaagggaatacaactttgtagaggttgaagctcatgaggaaagtcttgtagaagagcatgattcaagagaaaaagatggaaaaaaaagtgaggagagaacacaacaacaatgggagaagtgttcacaagtagaaattccaccagaaagtattctccaagtcaatacccctcctcatcaactgattgtcaaggaagaaaggcatgaagaacatgtgaaaatgcaaggaagatgtgttctatgtgaccttcatgccaccttgaaggcattggacctatcaagctaa

SEQ ID NO: 57802 - DNA, 417 bp, Glycine max
  Peptide Sequence Number=SeqID_174580
atgaatattattttccaactatccgatgaattgtattataccagtattattggaggagtggtggtggtaattgggctctatctagtagtgtggggcaaagctaaggaacagaaacatctcatgccaccatcccctgaaaaggttaccctgcaacgccaacaacagctaccagttactgtacccataagtgatgatgccaatgataataataaagctcaattggtcataattggggatagaaaagacgacgtggaagccagaaccaccacgagaaagaataatagtattgaatatgagataaggataaaacttgagagaatgatacagccaggtgctaagtttcttgaacacctactccggatacaactagatcagaatgcatcctccagacgaggagaaaacgtcattcatcactga

SEQ ID NO: 57803 - DNA, 282 bp, Glycine max
  Peptide Sequence Number=SeqID_174581
atggtgctcaacttttccacttttactcaatgtgggacttcacctcaaacttgtactccaacaatctccccctcaagtgtgattttcttctacatggtagtctccccctcaagcggaagtcattattatccacgatacttgtatcgtcgctccactcacgggacacgtcgcctggatccaccgctaggaagactttcgatacaagggattcccaaggctaaggatccatcaccgccatcttacttatctaagccggtcaccaagtcaaactatcggctctga

SEQ ID NO: 57804 - DNA, 279 bp, Glycine max
  Peptide Sequence Number=SeqID_174582
atggagaaggtagcctggccaggagcccaaccttctcttgtgagggaaggtggaggtcccatagctcaggtacctcagcaggtggaggatgcatcctccgaggccatagtccctgagccatttgtttatgaggctaatgaggcaggcgggacacagacgagacagaatactgctactgctaagaggacactgtcataccctaatttcgtccagggacctttgcttgatgacatgcgacctttgtttggtccttgtaaggtgcttggcacccatcattag

SEQ ID NO: 57805 - DNA, 870 bp, Glycine max
  Peptide Sequence Number=SeqID_174583
atggtagaaaagaagaacaagaggataaagagcattcaacatagacccacaacccccaaaacaaagacggagaaggaaccagctaagggaggtctttcagtcagaggaaaatgggttgcacattctccttcatctcctactacaccaaaggcaacttcttggctttctgaagaacattatgaggctctgtacacgtttagttatgcaaagaatgagatgattcaattgaaatatgtcaattttgtgtggctcagaagtgaaggctttgcattttttgagttgattgagaatcacaggttgaagaagccggtggagatgaagggcgcctactacacaaacctagtttggtttgacattgttgggttattgtcagaaggaattatggcaaaccagctgggtctcaaggaagctagatttgctttcaacaaggttgacaagtacaagtctatgatgaagaatccttctacctatgttgttgttgttacaaaaacaaagggaaagaaatgttttggtactggaccgctaatgcttgagcatgggcttttggcctgtgtgctgaagatcaactgggttgatattattgttgatatcatgttgaagatgaaaagggttggccctttcaaatgtccttatgcagttctaatctccaggattcttgactattttggtgttgatacccaagagaaagtctttggttttgttaaggcagaatttgaacctgaagaagttgggattggatggactgagaagagcaaagaagatcaaacagtacaagaagaagccaaagagaagcccatgagcccctttgagcagatgatgctagtaaagatggatgagctcctaaggatacacaaagaagactatacttag

SEQ ID NO: 57806 - DNA, 186 bp, Glycine max
  Peptide Sequence Number=SeqID_174584
atgacattcaggaggattgaagttgttatgattccaaggttagaggaagagggctttctagtcagatggttctttgatggacaccattccttgaaaagtttagctcctagcattatggtccctatgccgtgttctagggaagaacacgtcaggatagagccaacattagaggcaccatcaaagtaa

SEQ ID NO: 57807 - DNA, 255 bp, Glycine max
  Peptide Sequence Number=SeqID_174585
atggcaacagaatggagaaggaagaaaggtgattggagacgtcacttcaaggagaagatgagtcaaggacaaactcaccaccataggaagccatggataagagttggaagtccactaatccaagatcaagtccaagattctccactaagtgtgcttaggtgtcatgaagcatgtgaaaagaggctaagtcatgaagtgccaaaagtgacagttgagcttagctcatcagtgggccaagcgcgcatcccccgctaa

SEQ ID NO: 57808 - DNA, 495 bp, Glycine max
  Peptide Sequence Number=SeqID_174586
atggttgctttcgttaggcagtatcagtacaattctgatatggcttcggatagaatgcagttgcagaacatgtgcaaaagggagcatgaatctttcaaagaatacgcccaaaggtggagggatttggaagctcaagtaacgcccccaatgatggatagggaaatgataacaatgatagtggacacattactagtgttctactatggcaagatggtgggttacatgcctttgagctttgcagatttagtgtttgcgggtgaaaggattgaagcaggcctaaaaaagggcaaatttgattatgctgcttcgacgaattctggtgataagaggcctggggcaaatggaaagaataagaaggagggacgaacccatgctatggctatcgttcttacatggccaaatttcccaccagctcaacaatatcaatactcagccaatatcagcccttctcattacctaccaccctatcagccaagaacacccaatcacccataa

SEQ ID NO: 57809 - DNA, 2047 bp, Glycine max
  Peptide Sequence Number=SeqID_174587
atggggacgcttgcgccggtttcaacctggcctgacgtcccgcagcacccgggcgacgatgcggggcaggcggcgcgcatggcctgctcgacttccgcctgcaggcgggcggccaggatcgcgggcgggggcgtgtcggacggcatggccgtgccggcgccgtcatccggggcgtccgtgagtagcggcacgccgtggtcgtcgacggggtcggtgagcagcgggaaatcgtcgccgccggccggatctgtcagcacggggacatccgcgtcggccacttccgtcagcaggggaaaggcgtcatcggggtacgcatcggtggcgccgcgcgccgcgccgaccggcggcgcggatggcgacagcgtcggttcggcccgctgggtcagggtggggatgccgggatcggaagggtggtggggcatgggggctcccgaggatcgagatggcgccgcccggggcggcgcgaggggcgtcgtggctctgcggcgtatggccggcgccctggtaggcgcgccagcgctggcgcgcggcctgcttgtcgtcgggatcgtcggagacgatttcgagcaggcgctcgaaggcgtcgaagcccggggggcaggcatcgtcgagattgagcagccagggctggggctggccgtccgcgacggctgcctgggccgcctgccagggatctcccgcggtcaggacgacgggcgtttcggccgccagcggatcgttggccaggacgtgcggcacgaacgaggtgtcgtcgaaggcccagagcatgcgatcgaaggccgccaggcgcgagccttccttacagtacaccaccagccgctgacccgccaggcgaaatcgatgcgcgtcatgccggtttccgtgcgtggcggttcaagcctggtccagcaggaactgcatcagcagcggcacgggacggcccgtggcgcccttgtccttgccgctcttccaggcggtgccggcgatgtccaggtgggcccagcggtacgacttggtgaagcgcgacaggaagcaggcggccgtgaccgcgccggccggggggccgccgatgttggccaggtcggcgaagttggacttgagctgatcctggtaggcgtcgtccatcggcatgcgccaggcggtgtcaagggactggcggccggcggcggacagggcctcggccagcgcgtcgtccttggtgaacaggccggtgttgacatgacccagggccacgacgcaggcgccggtcagggtggcgatgtcgatgacggtggacggcttgaagcgctcggcgtaggtcagcgcgtcgcacagcaccaggcggccctcggcgtcggtattgaggatctcgatggtcaggccggccatgctggtgaccacgtcgcctggcttgttggccttgccgctgggcaggttttcgcaggccgggatcaggccgatcacgtccagcggcagttccagttcggccagcgcgcggaacgagccgagcacgctggcggcgccgcacatgtcgtacttcatttcgtccatggtggcggcgggcttgagcgagatgccgccggcgtcgaaggtgatgcccttgccgaccagcacgatggggccgtcggacgccttggcgcccttcttggcgggtttgccggcgtggcgcaggacgatgaagcgcagcgcttcctcggagccgcgcgccaccgacaggaacgagcccatgcccagggcctcgacctgcttgcggtccatgacctcgaccttgagcgacttgaattcgcgcgccaggcgcttggcggtgtcgcccaggtaggtgggggtgcagatattgcccggcaggttgcccagggtgcgggtcagttccatgccgttggcgatggcggcgccttcgcgcaggcccttctgcgcctggctggcgtcggcgcgctcgacgatctgcacgatcttcttgagcttgggacgggcgtcgcggtcgggcttgccgaagctggcgtcgtagtgataggtggcgctgccggcggcgatggccgcgctgcgggcgcgggcgatgagggccacgtcggcgatggggttggcggccagg

SEQ ID NO: 57810 - DNA, 354 bp, Glycine max
  misc_feature (333)..(333): n is a, c, g, or t
  Peptide Sequence Number=SeqID_174588
atggggtcaaaccaagcacatgcttttaagaaaagggtttcatcaagtcaatgtcaagtatggaagaaagaatgtgctttacaatgcccttaccgaacgcatgccaaagctagagtgatgagtgaaatagaggaggtgcaagaccagatgaaggctgacatggaagccatgatgagtatgagaaaaatgatggaggtcaacacggctacagtcgttgccgcaagtactaccactgaggtggacccgactcacccatctggcattaatcaagcaagtcatccagtcccggatatggtaggtcagggaggtggagcattgggaagtacaagcggnccccattttgtgcaggtctaa

SEQ ID NO: 57811 - DNA, 548 bp, Glycine max
  Peptide Sequence Number=SeqID_174589
ggtgcttcgaggaatctgcaaggcatgggatcatcggcggctatcgtaagtggctgagagttcgcacacaaggtttggattggctcccaaagctaagggttgcgagagaggaagaggccgaagctccggaagagagtgaggaggagtatgatgaactaaaagacatcaacatggccaccgccaaagccttggagcgagaaaccaagagggcccggaaggaagaacacgaccgaaacaagtttcaaggagtcgtatggggtaggaacagtgagcttaaactccaaagagacgaaagggatcaatcacgagtcgaatgcatgatcttgaaggatgagttaaaggcttatcttaggtccaagaggagtttgtcccaacagttaagtgagacagaaggaaacatgttggccatcgttgataagtacaaagaagagctaaacctagcggtagctcatgagcataggctagtggatgagtacgccaaggtatctgtggtaaaggaagcaaggggaagggtgaccaattcattgcacggagaggtaatgatgtag

SEQ ID NO: 57812 - DNA, 363 bp, Glycine max
  Peptide Sequence Number=SeqID_174590
atgacaaaacatgtaattgcagctgaaattatctctggtaaaaacattgacctcgccgtttatattccaagaatgtcaatgtcgccttcacaatcaccctggccgtttaaactattgaaaagacaatttccgattatgctatcttatgcaatggcaattaacaagtcacagggactattgctatccatggttggactttatttgccaaaacctgtattcactcatggccaattatatgttgcattgttaagggtcaactcaacaaaaggattaaaaatcctgattcatgatgatgagcagaaaagcatgaattccactaccaatgtagtattcaaagaagtgttcagaaacattaaaagataa

SEQ ID NO: 57813 - DNA, 192 bp, Glycine max
  Peptide Sequence Number=SeqID_174591
atggagttggaatcaccaccatccacagggtgcacccagcatagggtgggtcgcacacgcaatgtggaggtgatgggggtgtgtcatgtacgtagatccgggttagaggaggtggtggcacacaatgatggtttcagaggatgtggtggtggtgcttacatggttgtagaagaaaaaaataaaggaggatag

SEQ ID NO: 57814 - DNA, 381 bp, Glycine max
  Peptide Sequence Number=SeqID_174592
atggtggaaaatggaaattacattccatataacgatcagttaaacaaaattcctaaaagtcaatggacaaaggagcaatcagattttctcaactcgaagactcgaaatgtgatgctatatgctctatcagaagaggagtacaccaaggacgaaggatccaagggagagaagtttttggctcttagcagtcaaaagaacataaagacatcattgtctaaagaacaagtcttgagaagcttgtccaaagctcttaaagttgataactcctctaatgaagaatctgaggaagactttgatgaagataaactcgatttcatctcacgaaagatctacaagatgtggaaaaacaaaggtggctccagatggagttcctcaaaaagg

SEQ ID NO: 57815 - DNA, 795 bp, Glycine max
  Peptide Sequence Number=SeqID_174593
atgagcatgatgggagagctgaaattctttctcagaccacaaataaagcaaacacccaatggtatctacatccaccaaaccaagaatgtgaaagaactattagagaaattaaacatgaacaatgcaaaagaaatgaagacacccatccatcctacaacataccttggactagacaaagaatcaacaaaggtggatgggacccaatacagagcaatgattgagtcactactttatctcacagtgtccaaacctgatatcatgttcaatatatctaattggaaccctaatcttggtctcctattcaaaagaagagaaaatttcagactcctaagtttctgtgatgttgactatgttgatgacaaagttgaaaggaatagcacaagtggaagctatcactttattggtggtaacttcattacatggacatgcaagaagcaagtcttaactacattgtccactgctgaagctgaatatatgtctgcaacaagctcttatgctcaacttctttggataaagaaccagcttgaggactataacatctatgagagtaaaattcccatctactatgataatacagctggtatcagtctttctcaaaatccaacattgtattctaaagctaggcatgtagaaattaagcattatttcattagagatcatgttcggactgggacaatggatttacaatttgtacccactgatgatcagcttgctgacattttcacaacacccttaattgatgagtggttgattttgctaagaaaccaccttggaatggtgtctattaatgaatga

SEQ ID NO: 57816 - DNA, 183 bp, Glycine max
  Peptide Sequence Number=SeqID_174594
atgtggattcacttccctctctattcgaatcatcgacgaacttgttactctcagttcccatccactgttaaagtcaccggatatctcaaatgtcggaaagcatctctctgccctcgacttccattcttccctccacaataccaaacattcggttatgttttggtggttagtattgaaacctga

SEQ ID NO: 57817 - DNA, 369 bp, Glycine max
  Peptide Sequence Number=SeqID_174595
atgtcgaagggagaagcacctttgaatgcgagaagatcagggctttgcgatggatgcaagaagattgaggctaaagcgatggattatctcgcgacggtgggagacagtggcagccattgcgagaggagagggtgggttctttcaccaatcgatgatgaagtcagtgattttgtgtgggttgacaaccatggtgatgatggtgctatcaacagagatggtggtagagatactagtgatggttgtagtgacaatgatagtagaggtaacgacagaagtggtgatggcggtggtaacgatgttgatgatgttggtgacaatggtgatgatggtggtagtggtgctagtgttggcaggcaatggtggttgtga

SEQ ID NO: 57818 - DNA, 177 bp, Glycine max
  Peptide Sequence Number=SeqID_174596
atggtgattttcaaccatagagatgcagcgaaagataaaggagaagaggtgagaggaggtagcttccttgagaaacttcctggagaaacttccttgagaagcaagaacttagctacacacacccctctaataactaagctcacctccttgagaagcttctctgagaagtttccttga

SEQ ID NO: 57819 - DNA, 129 bp, Glycine max
  Peptide Sequence Number=SeqID_174597
atggagattagtgagtttttgagagattgtgagattcctagaggaggaggagacatcccctctcctttggactttagcattgggaaatgcactgtttctttagcacttgatagagcaggcattgaataa

SEQ ID NO: 57820 - DNA, 171 bp, Glycine max
  Peptide Sequence Number=SeqID_174598
atggaatattttggagtccataagaacatggatcaaaaccagcattgtcaaccaactcaacaagcacacgacaagaaccaatatcaatctaatcctatgatggcacctaccaatccttctagtcagactgttggtccttatgtcccgtcatcttaccctggagagaaataa

SEQ ID NO: 57821 - DNA, 3693 bp, Glycine max
  Peptide Sequence Number=SeqID_174599
atgccgaaaggcctgaaaatgaaaaagcttattgaaagacctgatggaacacttgttcatgatacttcttatgttggagaggatgcatgggaggatgatcgagaggctcctgaggagcgtgtaaaacaaattatagaggatgatgaaaggaaaactgcatcatctagcactttgctggcatcaaagctggtatatcaacaccctcagcagggacaacacttgaacagagcaattttgtggaaggttgggcgcggggacaagtttaaattttgggaggataaatggacaggcggagatagccaattagcagagaagtatcgaagattgtacaccatatcggatcagcaacaccaatccatccagcaattaggagctttcaatgaagaaggacgggagtggcatttgcagtggagaagaccgttgtttgacagcgagatagagatggcggtcgcattcctacaagaagttgaagggttcagaatcagcccggattcacaagatcagtgggtgtgggcggctgaaccaaatggaaggtattcggctaggagtgcatatagagtaattagagaagcaatatcaggagagggtcaggggggagggtacaaggaattatggaagctaagggcaccatcgaaagtggctatgtttgcgagagagaaaagagagagacacagtgcaactaggatagaggatacccatcagactcactcaagtattaggaatgatcatagacagagctacaatcgagatagttggaggggccggaatgatattacatcgttctatttcactcggttttcagagaaggctactgagaaggacttatggcaccatttcaagaagttcggtgatgtaagggaggttttcatacctaataacagaaacaagacaggtagaaggtacgggttcgctagatttaaaggcgtggaggatgtgcattatctggaaagaaaactagataatgtcgtctatggcggtctcaggatgtttgtcaacacacccaaatttgggaggaacagaacccagcagccaaaatcagaatcgaaacaatcaatgtatgccgagcacaggggaacggaggcaaggtggccaagacagatgcaaaaaagaatgattcagggatcatacacggaggtagtgtcagggaatcaaagaggaacaaggactaggagagcagtagtcactgaaaactgcagcaacgaaggatcttggtcatcggtgtatctagaagtatcggaaacagggattaattggctcaaggaggcatgggtaggaagattgaaaaatttggctatgtttgataaagcagaggatgatgtgtattgggacgatggcgaagacatagacctgaaatacttaggggatgatatggtcctgattttaggccttactgacgaaagagctaagaagatgatggcagaagaaaatgaaggtggggccactcccttccactcattggaaaaatggagtccgaagttgcgcatgggatatagattgacgtgggatgatgtggctgcagctcggaggatggataaggtgcgggtcttgttgaagacctcacgaaggcctcttttacagcacatggtgaaagtgcacatcaaaggggaagtgtacagggtgtacatagcggaggaaggtggaggagaaaacccagacagaactcaatggaggagctggggagggtatgggtcttcggaggaaatagaatcatttgagagtgacaaggaggatgactgtagttccatgctgaggctcgaacaagaagggggagtcaccgacgttgcgagaagcttggcgggatcggaaatggaagaccagtccatcatcccggtgcggggcgcggtgcaacctgcgatccatcctgagtgcgcggtgttgtctgtcgtggcccctcccgatgcgactgcggacctgcatgaagcgatcgtggctgcggcagaacatggccaggaggacatgcatgaggtcgcgacggcgggcgaacaggaccagccggcaacagggatttctgcgacctccaagggatcacaggtgcaactggttgggcctttacccaacgggtgttccaaacccaacatccagttggacaaacctagtaccctggagacctccatcacaacagctactgtgcactgtgggattagtgacacaactgtgatcgctacagtgaccacatctccaaagaggcagcttgctactcagaaggcaccaacaaagcaggaacaagaagctaaagccatatggcagttagcaaaggaattaggggagttatcaatgaatatcatctcatataatgtcagagggctcgggaggggggtcaaatggccagcaattaaaaaattggtcatcaggcataatatcgacatgatttgtttacaagagacaaaaaaggagaccattgataaatccacttgtcaagctctgtggggggattctgatgtcaactgggaggcacaaccagcaacaaattcagcaggggaaattctttgcatttggagcaataaaaatttcaagctagaaagaaaagttcagggcccgggatttataatgctagaaggaaagtggcaccaagaggctcaaattattcacatcaccaacatttactcaccttgcgatatccagaataagagagttctttgggcgattttaacaatattaggcacccatgtgaaagactcagcgtctatcacacggatgtgggggaaagaaacattaatgagttcaatgaatggatcgaagagctggagattcatggtctcttcagagtggctcgtcaaatggccaggaagcacccaacaggcattggatagaaacttttcagatcattgcccaattttgctatcatccaaaactgtggattggggtcctaaaccattcaagatccttgattgctggctttcggacaactcgcaacattttggtgacactttcaaaaagtacaccaaacttgaagaggagctaaacaagttggagagtgacacaagccacagacacttgacccttgaagaatcattgaccaggaagaagcttcaagaagaattgtggatagcggcccaatctgatgagccgcttttaaggcaaaaggcgagatcaaggtggattagagaaggagattgcaattcaagatattttcatttgttgatgaatgccagacgcagaaatagttgcttgaaaggagtcatgattaatggagcttggattgaagagccaacaagggtcaaagaggtcgtgagatcattctttatagaacgtttccaagaaccggatcctgaaagacctcgattggatggccagaaataccctagattgtacctcatatctagtcagcaaaatcacactattcagcagatgggggtccataatgactcagggtgggagtggcaattcacgtggaggagattgttgtttgataatgagatagacatggctactgaatttctaaaagatatagaaacccagcaaattcagccacagaggtcagatgggtgggcgtggatggcagattccaatggtcaattcttagctaagagcgcttacatcgtcatgagggagtcttcatcagaagcaataaaagatacaactttcgcagatctatggaagatgaaggtgcctgttgtgtggcaacatggaggaggacacagggagctaggagtaaaaggtggagatggtggtggttggctcttacatggttga

SEQ ID NO: 57822 - DNA, 705 bp, Glycine max
  Peptide Sequence Number=SeqID_174600
atggaactcaccatcccacgcaaccccaaccctcttctcgtttcctcacccccaccactctctcgaaaccccaacgtcttcaccttaaccgtgccgcgccgccgcagaaggattcggtttcgggtctcggccgccgcggagcccgatgggccgtcgtggtcgcaatcgctgctgcgcgggtcacggcggttttggggaaagtttggggaaatggtaaagaaggagacgggtctcgacttcgaaaacaggagtgtgaagaaagttggcgagtttgtgaacggagatgaattgcgaaggttggggactgattgggtgtttcggtttgtcgattggaatcgttgggaacggtggaagaatatcaaggattgggaacctaagcgaattggtgcattggttctttacatttttgttgtgacatttgcttgtagaggagtatatgtaacaattcaagcacctttcctaagtcgccagaaaaaagagttgacagaagcttacatggaagcgttaattcctgaaccatcccctaccaacattaaaagaatagaaggaggcttgtgtcttcttcccgcactggttattgatcgtgatagagaagaggagtatgacggtctaagatttccaatggtgtacctccatatagatgatatattcaaaatcaaaatcagaatcaatgggatcagaagtccaaatcaaaatcagatatga

SEQ ID NO: 57823 - DNA, 420 bp, Glycine max
  Peptide Sequence Number=SeqID_174601
atgaccactcttacatggatatggatgacgtcgctatttagcaacattctgcccatcgaccacaatgccaatctccccctgcagatggattgcgcccacaatacacccagtggacccaaagaagtccaacagggccctggggtttctaactctggttacgggcctttgtcagtcctaccgggtggccgttcccccaacaaggaatggcacccacaaagacaccccagtggacccggagaagtccaacagggccctggggtttccagctctggttacgggcctctggattgtgcccgcaagacacccagtggacccgaagaagtccaacaaggtcttggagttgccagctctaattacgggcttctgtcagttctacggggtgcctgtcgcccccagcaagttcatcaggccccctactaa

SEQ ID NO: 57824 - DNA, 333 bp, Glycine max
  Peptide Sequence Number=SeqID_174602
gatggatttagagatgattccctgaggataatgaaagatatagaaaaagagaattctaagtgtcagctcatgcaaaattgtacttaccctaaagatacaatgtacaaccactcactcgtcataattggccatgagcatttgctaatgactacaccaacaaccacaagaccaacaacaccaacaagaacaacaaacaacaagaacaacaacaagaacaacaagaacaagaacaacaacaacaagaacaagaacaacaagaacaagaacaagaacaagaacaaggacaagaacaagaacaacaacaaacaagagagaaaatataaaaacacttag

SEQ ID NO: 57825 - DNA, 210 bp, Glycine max
  Peptide Sequence Number=SeqID_174603
atggacagtatcagcgaagacaacctcatcaaaaccccaaaacccaaatatggttggctaaggcgacgcgcgacggagtcaacacccttactcaccatcaatgccaaagtcgagtacaacaaagacagcgagcacgagagtgacagcgagggagactacaagatcgacggtaagggacaccgtgagaatgaaaatgagagacaacactag

SEQ ID NO: 57826 - DNA, 186 bp, Glycine max
  Peptide Sequence Number=SeqID_174604
atggacaattggaatgaagattttagcgaggatgaaaacgaaaattctactctactttccattttagaagatgaaatatcagatgttgaacatgttggtgcattagttattgctcctagtgaacaacccaagtttattggaagaaaaggatatccaactcaagatctcgtggtaatatgtgattag

SEQ ID NO: 57827 - DNA, 399 bp, Glycine max
  Peptide Sequence Number=SeqID_174605
atgaagaacgcgttcgagaagaaacaagtacgagttcagctagaggaggaacaaggccgaagggatttcgcccggaccgctgcagggaggcgggtgcggatcatgcgcaccagcatgaccactttgacccagacgtggatgacattgcagctcggcaatgtcttgcctagagatcataactccgatctccctctaccgaagtgccagttggtgtatgccatcctgacacggatgagcgcccacgtggcccaggtgattgctaacgccatctatttgtccgcaggtatgccacccaccaggcaccctctagacccgaataagtctaacagggccctgggatttccggcattgatcacgggcctctgccagtcgttcggggttcccgtcacccccactaag

SEQ ID NO: 57828 - DNA, 444 bp, Glycine max
  Peptide Sequence Number=SeqID_174606
atggatcagttgtcggcgatcagcgaggacctggccgagatcgacggacacatcgccgacaatttccgcgccctatcaaatggatttcagaagttggagaaaattaaggattccaatagacagaccaggcagttggaagacctcaccgagaaattgcgagaatgtaaacggcttattaaggagttcgataaagaagtcaaaacattggagaatagctttgatagagaaaccaacaaaatgttgaatgagaaaaagcagtcaatgatcaaagagttgaactcatatgttggtttgaaaaagcagtatgctacaaatattgagaataaacgaattgaactctttgaggggcccaatgaaggttacacagaagaaaatggcttgctagcatcctgtaagcatactgatttcttcataatcggttgtgctggtattcatgtatcttaa

SEQ ID NO: 57829 - DNA, 291 bp, Glycine max
  Peptide Sequence Number=SeqID_174607
atggttttatctcgtaatggtggacgaccttatacagatgagttatttactcaactgaagaagggagcaatggagctgcataaccaacaaagagaggttgattctttaaaaggatattcaaaaggagagatattggagtttaaaaagcaaatgcagcaaacatatgatgaacaattaaaacgaattactgagatgttaaacatggtgatactttcttttatgttatttaattttcaatatcagcttcacatatgtattgctgcgtattgcatgataagcaatttgggttaa

SEQ ID NO: 57830 - DNA, 369 bp, Glycine max
  Peptide Sequence Number=SeqID_174608
atgaagcacggacacgccgccgaagtgccgcgtcccgcgtcggagacacactggacacacaaacgggtgcgactccggtgcgacgcggtgtccgttgccgccgctgtcgccggacacggctggatgcagaaaacgcgtgatcggacgcggcccaaaaagtggacacgcgcgtccaaacgcggcccaaccaaatattttattatttatttaaaaaatacttacctaaaacgaaaatcacgtcttctctttgccgcaagcgaacctccacgtcgccgcctccgtttccccctttgcagcgttatcttaataattcaattcaaaggtagcctcagccctcaagcacgttacagcaatgatcatattttctaa

SEQ ID NO: 57831 - DNA, 1401 bp, Glycine max
  Peptide Sequence Number=SeqID_174609
atgagtgttattggtctgatagctgcagtagcagtagaatttaaggttgtatgtgtgggggttgctgttcactggaagaggcagattgctcagtgtgcaggtggtgtaggggatgatgaagtattagaggggaaaaagagaagggtagggaaagttactttcattaaaagtaacatctttagagatgtacaacctgcacaaccagactacatcattagaagttacttggtgaaagtaactgcagaattttttgggacaattgaaagcataatggccaaattctttgcagcagaaacattgaatagcactcatgtcccatccttttggcttggcttgtattgcatacaccactggaacagatgtggatttgtgttgatccatagtgtcttgagtgagaaggcattgttcctcacggaacaaatcattgagacattcatccaaagaggcccacaaattcatgaaatgagagtaaaaatcagagatagagagactatcctgttgaaagttggcaatttcatgcttaagctggaatcttctagctgtgttattctgattgtagattttcttcagttaagcccacatcttggctgcagtcttgaagggtcaaagattgagaacaatggtgggatcaacagaggcgataatccaggccatgacttgagcatccttaatgacccacttggcattctcttccttgtggatggctttgttaggagcggggttgctgccatcaatatgaccccacagatccttaccggtgatcaacagcaacacaaaatagcttgggtcaaatgggatattgtctgcttgccaaaggaagctgggggggtgttggagtcaaaatatgggggttggaggggtttgagcgaagtaactaggggaaagggtgaattggtatggtggagggatctaaagctcgtgtttaatcatccgcaacatggagagttaatgaacactacaatatcttggagggttgaaagtggggacaagttgggagtgggaccattgttcgataacgaaatagatatggcggtctcattcctatcggatgttgcaagccacccaatacagccacagaaaggtgatcagtgggtatggaaggcaaacccaagtggacaatacacgcccaaatccgcatatgatatggtgtgggggaaaacatatgaacagcaacaggatggagtatttcagcagctgtggaagctcaagctgccgtctaaaattactatgttcgcatggagtggaggagagcacaggtcatctattctttcattgtggcaagataatgccagtatggtgggagtccttgtcttgggtgggtatgttgggtgtcttcccaaatcacccgaggcagcactttctccaacatatacatggagtgacagagggaatgaggtctag

SEQ ID NO: 57832 - DNA, 1068 bp, Glycine max
  Peptide Sequence Number=SeqID_174610
atggtatcagcccatcttagatccattagaagggttacccaccgtgttattcacgcaccaagcccaaaagtgcaggacatgagggggtgtattggggaaaatccaagtccgatatcggctaaagatagtgccaagattgaatattttgcaaaatttatgagtaaaaatgaagttattctgaaagcaaggcagctaatgcagcaaagtttgtctcacggagcatctagtccaaaattgtccaaaatgctagatgtattactggagcatttcaaaactaatgatccgcaaaactccagggtaattatcttctccaattacagagaaagtgtcagggatataatgaatgcacttggagatattggggaattagtcaaagctactgagtttattggtcaaagttcagggaaagcaatgaaaggtcagtcccaaaaagttcaacaggctgtgctgaagaaatttcggtctggcgcctataatgttattgttgctacatcaattggtgaagaaggtcttgatatcatggaagttgatcttgtcatatcttttgatgctaatatttcaccactcagaatgatccagcgaatggggagaacaggaagaaagcatgatggacgagtcgatatccttagaattcctcatgtccttaaaccagaagttaaatgcgttgagctgtccattgagaaatttattcctcgtccaaagaatgtgaaagatgatgagctccacatttctccatcaaaggacaaactaactgttgcggaaattgatttacttgaaacatattttcaccctactgtggaaaacaatagtagaatgtctcttattgcctttccccactttcagacctttccttctagagtgcataaagtgaagcattcctctggaacattgatgcttatagacatgatgcagcgcttgcaaggactagtatcatttccagaagatgacaaaacttcttcacttcaggaagatctgtgtttgggacatggtaagccagtcaccactaccgaacttgatgaagctaaaaagggtaatatcatctgttcaattttctctcctaaattttaa

SEQ ID NO: 57833 - DNA, 237 bp, Glycine max
  Peptide Sequence Number=SeqID_174611
atgtcggaggcggggcggggaaaacccgaccctgttgggggcggggatgagggtaaatctacacccccattgtgtttcgagggtggggacgggagtattttgtgtggtgataacgacaacggtgataatggtaatattaatagcatcagtgacaataaagatattagtgatggtcgcagtgacaatggtgggggtgatgatgaaggtgacattgatggtggtggcaaccaatggtga

SEQ ID NO: 57834 - DNA, 951 bp, Glycine max
  Peptide Sequence Number=SeqID_174612
atggttatgcagacctcgcccattggtgttgacggctacagagataaggtgaatccgaattatcgaatggcatccaataatccttacgagataatggacgatgagggatttgactgggaagcagctgctagagaaatcgacgtggtttgccagacgaccagtgacgtaaagggaaagggaagggtttttgagaagagaaagcagcaatccactctcgataagttcatatctattgccaatgccaatgccgaaaaggaaaccccaccaccgcagttccaagaagatgaccaaagccctgctttcatccaccacattgacaccgaggctgccaaaacttggatatatccagttaatgttcctctccgtgactatcaatttgatattacccagtccgcacttttctcaaacacattggtggccttgccaacgggacttggcaaaaccctcattgccgctgttgttatgtataactacttcagatggtttcctcaagacctttttaactgggaaaaccatctgatgcttcctgtcacaacaggcaaaatagtctttgctgctccttctcggccacttgtcatgcagcagatagaagcatgccacaatattgtgggaatacctcaagaatggacagttgatatgactggtcagctaagtcctcccaaaagagctcaattttggaaaacaaagcgagttttctttgtcactccacaagtgttggaaaaggatattcattctggtacatgtttggtgaagtacttggtatgtttggtgattgatgaagctcacagagcaatgggaaattacgcttattgtgaagctgttcgcgaggtgaccacatctaaggcgactttccaacacactcctcacgctcaggactatgggcttggagcatggcaatacaggtggcctaagtgcctaacaatagatctaggacagactttgatagactga

SEQ ID NO: 57835 - DNA, 4413 bp, Glycine max
  Peptide Sequence Number=SeqID_174613
atggcgtctccgtttcgcaacgacggcgtgtttccttcttctcatgtcaagctctcacatcttatctccgtcaagcttgatggtaaaaatttcaagcagtggaaacaacaaattgacggtgttgttcgtggccacaagcttcaacgcttcgtcacggttccggtgattcctcatcgttccccttctacttccgatcctaatctcagtgaggtgaacgatgcatatctggattgggaacaacaatatgctctcgtctgtaagtggcttctctccacgatctctgattcgctgctcccgaagcttgttgactgcacgcacgcgtggcaggtttggactgaagtgcatcgttacttcgccacgctcctcacgacgaaagcacgtcagcttcgctcagaattgtgtcgtctctccaaaggtactctcacgattgagtcgttcatggagtgtgttcgcgaaatcaatgaatccttgatctcaattggagatcccgttcctcttcgtaacctaattgagatcgtccttgatgcacttcccgaggaatatgatcctatcgttgctgctgtcaatagtaaggaagatcttagctctttggtcgaacttgaatcctgtctccttgcacacgaatcgagattggagaagcatcggaaagcgattctcacagaaccagtgtcagtcaatttaatgcaggctcaaccgtctgattcgtcttctccgatggaaccgtcgtctcctgctacagagtcgtttcccactggcactagtcatgttactgctcatgctgaaaacaataattataattcagaggcgatttgtcacaaaagtggtcatgacacctctatctgttattacaggtattcgcaatccgcttctatgccgttttcacctcaacgtgctcccttcaatccatttctgatgaatgctcgaccggtgtatgcaccttcttttggctatgcttcacctagatcagctgcacccagaccttctccaccacaagcgtttatggccagttctgatccaaccttcagcaaccaatggtggtatccagattcaggtgcgtcgcatcatgttacacctgattcttctaatgtgtctgatgctcactctgtgactggttctgagcaagtgttcatggggaatggccaaggtttgtctatcaactctataggttccatgaattttacttcccctaacttccctcacaaaccactcactctacacagtttactccttgtacctcacatcaccaagaacctcattagtgttagtaaatttgcccaagacaatcaggttttctttgaatttcatccttccttttgtcttgttaaatctcaggattcttctgaggtgcttcttcgtggagttgtaggagctgatggtctttacaagtttcagagtccctcgtctcaagtgtccaagttcaagtctctctctagccttaattctagtgtagccttaggttcaaacaattgtaatcctagtacatcatgtaatactttacttcattctaatgctcaaagtgattgtattactgattgtactccttctgtttcaatgaatacaagcaatgtttcctgtgttaattcacctcttgttcatgctactacatttactaattctcaatctccacaacattctattgttcctaatattatacctaccagcaaatatgctttgtggcttacaaggttaggccatcctcattaccaagctcttgcagaagtgctgaaaacttgcaatattcctataccccccaagtctctagctgaattttgtactgcctgctgtttaggcaaatctcacagactgcctacctctttatccactactgtgtatgctcaaccttttgagttagtagtttgtgacttatggggaccagctcctatccagtctttaggagttgttcaaagcgatggaggaggtgaatttaggtctttccccaagtatctcaataaccttggcattactcataggtttacatgtccccacacccaccaccaaaatggcatagttgaacgaaagcatcgtcatattgttgaaacaggcctagctttattagctcactctaatttacctctcaaaatgtgggatcatgcttttgtcacagctgcttacctaattaataggatgcctagtatgtctcttgccaaccagtccccttatttcaagctacttcacaaattacctgactattctcatcttagagtctttggctgcacttgttttcccttccttcgtccctataatgctcataaattggactatagatcccaagagtgcatattccttggttattctaccattcataagggttataaatgccttgcagctactggccgtatttacatctctagggatgttctttttaatgaaaccagatttccctactccatcttatttccctcttcttcttctgctacatccacatcatctcctcatacttcttctgcctggtctataccagcagttcctgtatctgttattcctcttactcaagtcagttctgttcctgctacacccactacctctgtttctcttagcagccctatgtctgcccctattaacactgccaattctcctattataacaccttccaatgatgcttcccctgcttctgaaaattcttctttacactctcccatcactccctcttctctcacccctatcacatttgatattgcagaggccagcaccatttctccatcctctattccagccaccaattctcctctcagccctgtaccaaccccccaacaaccctctatccatcctcataacactcatcccatgcaaactcgagccaagagtggcattaccaagcctaaaattcatcccactcttttactcaatcatatggaacctacttcagttggtcaggccttgtcttctccccattggtttcaggccatgaaagatgagtatcacgcattgttaaagaatcagacttggaccttggtgtcgccatctgtttctaggaagccaattggctgcaagtgggtttttagggtgaaggagaaccccgatggctccattaacaaatataaggccatgctggtagctaaaggcttccatcagcaagctggcactgattttacagagacatgttctcctgtggtgaagcctgttactgtcagaactgtccttactcttgctgttactcacaagtggcctatacagcagattgatgtgaacaatgccttcttaaatggcacccttgaggaggaagtttttatgctgcagcctcctgggtttgaagctgctgacaagacacttgtatgtaagttgaacaaagcaatttatggactaaagcaggcccctagagcctggtttgataaacttaaaggatcccttctgcatcatggttttcttgcaagcaaatgtgaccctaatctatttctccttcacactgcaagcttaactataatggtgctcatatatgttgatgatatcatcataactggcaattctgcatcctttattactgctttaatcaagaatctgaatactgatttttccctcaaacagttgggtaagttggattattttcttggcatagaggtaacacacttgcctaatggctccctccttctctctcaagccaaatatctgacagatttacttgctaaaattaacatgctcaatgctaatggcatgcctactcctatggtgtccacaagcaaattgtctaaaattggttcgccagctgtttcagatcccactcagttcagatctgttgtgggggctcttcaatatgccactctcaccagacctgaaatctcattttctgtcaataaggtttgccaatttttatctaatcccttggaagagcattggaaggaagttaaaaggatattgaggtaccttagtggcactctgcatcatggcttgctaattcagcctgcctcacctcaccagcctttgtctttgcttgggttctgtgatgctgactgggcatcagaccctgatgacagaaggtccacctcaggagcatgtgtgtttcttggtccaaacttgatatcttggtggtctaagaaacaacggttggttgccaggtcaagtgctgaggctgagtacagaagtatggctcaacttgctgcagaaattctatgggtgcagtctctccttcaagaacttaaatgcagacttctcactcccacaattctggaaaaagtgctctccaagaatctcattgtgaagcatgttccagcccaagatcaatgggcagacttactaactaagcctctctcagcagtgaaatttctccctctgcgtgacaaactgcgtgtgatcaacaaactcagtctgcttgatgcaccctcagctgagcatattgaacttgcacaggagcaatttatgcagcagcaggagaagtatgtgcagaagcaagggcaagataagatggtggtggaagggtag

SEQ ID NO: 57836 - DNA, 492 bp, Glycine max
  misc_feature (56)..(56): n is a, c, g, or t
  Peptide Sequence Number=SeqID_174614
atgtcagctggacttctatttggatctgttgtcggcactatcatagtctctatcancggaacagtggcagccagtgttgcttttctaattgcaagatattttgctcgtgagcgaattgtaaaactagtggaaggaaataagaagtttgttgctattgacaaagcaattggagaaaatgggttcagggttgtgaccctgcttcgtttgagccctctgctgccattttctttggggaattatttatatggattaacatctgttaagtttattccatatgtattgggaagttggttggggatgcttccaggaacatgggcttatgtcagtgctggcattgtttctaatgaaaatattactgcaattttgattgccagtttcatgaaagcttactacaaagccagttttatgaaagcttactacaaagccagttttagatacctatggcagaaacaaaggaaaaccgagaaggttagggcaatgaggagaatgtaa

SEQ ID NO: 57837 - DNA, 459 bp, Glycine max
  Peptide Sequence Number=SeqID_174615
atggggttccaattcgaagtgttgtacaagcctgagctggagaataaggccactgatgctctttcacgacagatgagctcaggggagttgggggccattactatcagcccattatggccaagtcccacatcgactaaagataaagccaagttagagtatataagtgagggacaacccttaccccttgagctagcttttggagttgagttaggaccaaactcacatgctaagacagtggcttgccgtattaatcccaaagtctcacctcgttattttggaccgtttcaaattttatcccgagtcggagaagtggcctacaagcttaaacttccagaatccgcaaaggttcatctggtttttcatgtatcacagctggtggaggaagctacatgggaatcagtatcctctattcgttccagatttccttcatttagccttgaggacaaggccaatgtgtga

SEQ ID NO: 57838 - DNA, 351 bp, Glycine max
  Peptide Sequence Number=SeqID_174616
atgcatatccagcaggaccataacctggttggtggagtggtggtgagacagagacagatacacaaggaaagaaagcaagacataaaagagaccttcaatgaagacggagaggtggttcaagaaggaattgacttggtccttgtagatatagccaacggaggcaaaaccgccaacaacaccgaggagcaagagaccggccaagagggtgcccttcaaggcggttccatcctggaagtcgaggtcagcgtcggcgtcggcgtcggcgtcaccttcgacttcggtcttgttgttattgggactaaacaagcgcttcaagccagactcagacggggcagtgttgatcttgcctag

SEQ ID NO: 57839 - DNA, 732 bp, Glycine max
  Peptide Sequence Number=SeqID_174617
atggctttcgcagcagctcctcttatccaggttgtattatacggaaatcccaagtttttgtttttgaggagtactgctcgttgcacggtccacgcctctcgcagaccaccaccccctgggcctggagttgacaccagaatccattgggaaaacgaagatgaaggttggattggagctaccaataccaaacaccaacagacccacaaacccaataacaacatgttacaggctgatgactttcctgatttcctcaccgcttctttaggttctcattacgaattcttgggtgtatcaccagatgcggatgtagaagaaattaaagttgcttatcggaaattgtcaaaggagtatcatcccgacacaacttccctgcctctcaaaactgcctcagaaaaattcatgaaattaagagaggtttacaacgttcttagcaatgaagagagtcgaaagttttatgattggacccttgctcaagaggctgcaagccgccacgcagagaagatgaaaatgaaattagaagatcctcgccagcaacaactcaagaactgggaacctgttccagacatggttgaccgccttggtggaaggaatatgaagcttagtgatcaggcagtttcggccatcaccattgatctctttatcattgtttttgccctatgttcactctctgaagttggaaagcttctccctgctctccattcagggatcgcctctctaagcagcaagcagtaa

SEQ ID NO: 57840 - DNA, 783 bp, Glycine max
  Peptide Sequence Number=SeqID_174618
atgttttgtttctctctctcaccctctctctctctctctctccctctccctctccctctccctctcatccttttcagaagatcttttcgtggtttaggtaggttgaaattaatctgtttaacctacagaattgtccgctcctacctgctacactatggctatgaagatacattgaattcatttgatgtggctagtaaaagtactgttcctcctatatacatagctcaagaaagtggaattgatgagcaggaaataacatatgccttaaatcacaggaagactttacgacagctaatcaggaatggggacattgatgttgcatttggtaaattgcgtgaatggtatccacagattgttgaggacaatatatcagctacatgctttctgcttcattgtcaaaagtttatcgaattagttcgggttggagcacttgaagaggctgtcaaatatggaagaatagaattgtcaagtttttatgacttgcctgtctttaaggatttagttcaggactgtgttgctttgctggcatatgaacggcctctggaatcctccgtaggttatcttctaaaagactcgcagcgtgaagttgtagctgacacagtaaatgccatgatattgtccgcaaatcctaatatgaaagattcaaaacattgcttgcactcctatcttgagaggttacttagacagcttactgcttgctgcttagagaggcgatccctgaatggagagcagggagaagctttccaacttcagagagtgcttagcagtagtagaagaggctag

SEQ ID NO: 57841 - DNA, 369 bp, Glycine max
  Peptide Sequence Number=SeqID_174619
atggcttgcttttccaccgccctcaccactagccgcaacaggtccaccgcctccaccaccatgaaatctcttccaccacccccaccaccagccgcaacgggtccaccgcctccactaccatccacggaggatcacactcactcatcacagttaccttacattggaagcctagtcacattgcaccaccacctagcactttgtcttccccatctccaaatggatccctggtgtgaggcaaatcatgttagggctgagaagaaagtgcgcccaatagactccacgacatcgccatttcaagtagaccagacaactaggatagcagtgtgcccagcggtagtgtcatttccgacatgtcaaacatcaaggtag

SEQ ID NO: 57842 - DNA, 160 bp, Glycine max
  Peptide Sequence Number=SeqID_174620
atggaaagatttggagtttttgggggccgagcaccgataacctcgaaagacgtttttggagatgtcgaaactggatgggtcctgtcaatgttagaggagcatcagatgttgatccaagataaggcacaattcgtaggacagaacaacaactggagcaacg

SEQ ID NO: 57843 - DNA, 276 bp, Glycine max
  Peptide Sequence Number=SeqID_174621
atgaagctgggcttgacaatgttgaaggcccaggtggaaggattgatgtgtgtgacagaattctgcacctcctattatcgcttgctgcaccccatggtaacaataaatgttcctgcgctcaaatccctagcgactcctcttccttctctccttctgcgtcccccaagcacctcacccattagccatgccgccgcgagcgttgaaggggcagaaatagtgttgttagtgagataccttggtggtattgaaattaaatttgtctatcaaggggaataa

SEQ ID NO: 57844 - DNA, 1536 bp, Glycine max
  Peptide Sequence Number=SeqID_174622
atggcgctcttatacatctctacgccaaatgtaactctctcatttgtgctcgcaccattcccccacctcgacactgtttcttcgaccgctttaatctctggctacgttcaagccggcttgccccatgaggcgctccacgtatttgacaaaatgcacacctctgctgctatttcagaccaacacggttttgaatccagtatatatgttgcaagttctttgatcaacatgtatggtaagtgtcaaatgctggacgatgcacgccaagtatttgatgctatatctcggaaaaatatgattgtctggaatgccatgcttggagtttattcacataatggctttttaagtaatgtcatggagttgttcttggatatgacaacgtgtggcgttcacctagatgaatttgcctacactagcattttgagcacatgtgcatgctttgaatgcctagatattggttaccagttgcattcagctattatgaagaaaagatttacctccaatttatttgccaacaatgcattgatagatatgtatgctaaggctggggctttgaaggaagccagcaaacagtttgagcacacgacataccgagatcatatttcctggaatgccattattgttggatatgtgcaagaagaagcggagactggtgctctcagtttgtttcagagaatgaatttagatggcattgtacctgaggagttgggtcttgaaacaaacctttttgctggaagttctcttattgacatgtattcaaagtgcggggacatcgaagatacacataaaatttattctagcatgccggagcagagtgtggtctctgtgaatgctctgattgcaggatatgctctaaaaaacacaaaagaatctattaatcttctttatgagatgcagatattgggactgaagccatctgagattacatttgcaagcctcatagatgtttgcaagggttctgccaagttttctaaccttaaaagcactgtgatgtggactgctttaatttcagcacatattcaaaatgagtgcagtgatgtggccttaagcttgtatcaagaaatgcatgacaacaatatcttacctgaccaagcaacatttgttactgttcttcgaacttgtgctctcttatcctcattgcatgatgatgagttaaccagcagtgcccttgtagacatgtatgcaaaatgcggggatataaaaagtgctgttcaagtttttgaagaattggctactaaaaaggatgtgatttcttggaattcaatgatagttggatttgccaaaaatggttatgcaaaatgcgccctgaaggtctttgatgaaatgactcaatcatgcattaccccagatgatgtcacacattccttggactgcttaccgcttgtatccatgcaggccccgagtagtcactgtgcccgcatggttgatcttcttggtaggtggggttttctcaaagaagctgaagagttcattgacaaactagaagttgaacccaatttgggccaatttattgggtgcttgcagaatacatggggatga

SEQ ID NO: 57845 - DNA, 234 bp, Glycine max
  Peptide Sequence Number=SeqID_174623
atgaagggggagacagtgaaggaagaagttcatgcaccgattccccagctaggagggtcgtgcatgggcttgacccaacaatcatccaaacactttgcaccggtgccgatcaaacccaaatcaattacgaggatttatagtgatgggcgagggtggtatggtggtcgccatggtaccaactatgggttcacggtggtgcaattatggcttaacggttgtcacaaatgggattga

SEQ ID NO: 57846 - DNA, 1428 bp, Glycine max
  Peptide Sequence Number=SeqID_174624
atggaagaaagtacagcctctttgcttttcttacccttccacacactcaaaaccaaagcccttcctttctccaccctcattgatgtcctctgttcccatctccaccaaagcaatggcagtgttgagcattcattgtctaaggttaagcctaaactcgactctcaatctatcatccaggtcctcaacacctgccgtgaccgtccctatcaacctcaattgggtgtcaggtttttcgtctgggcaggatttcaatctggctacaggcacagttcttacatgtacaccaaagcttcgtacttgcttcggattcatcacaatccccagattattcgtgacgttatcgagtcttatgaggctgaagggtctttagtcactgtcaacatgtttagggaggtgctcaagctctgtaaagaagctcagcttgctgatatggctctgtgggtgttgaggaagatggaggacactttcaacctccacgctgacactgtcatgtataatctggttataaggttgtgttgcaagaagggtgacattgaaacggctctgaagttgaccagtgagatgagttccaatggcctttgtcctgatcttattacgtatatggcaatagttgagggattctctaacgcgggtcgatctgaggaggcctactctgtgcttaaggttatgagactacatggatgttcgcccaatttggtgattttatcggccattttagatggcttttgtaggtctgggtctatggaaagagcattggaattgttggatgaaatggagaaaggtggagtttgtactccaaatgttgtcacttatacatctgtcattcaaagtttctgtaagagaggccagtggaaggaagcattggatattttggataggatgaaagcttttgggtgccacgcaaatcatgttactgtttttactttggttgaaagcctctgtgccgatggtcatgtggaacaaggttatggattatttgataaatttgtggtggaacattgtgtttcctatggtgatttctacagttcacttgtgatttctttgataaggattaaaaagctggaggaagcagagaagctcttcaaggaaatgcttgctggtgatgtaagactggatactttggcatctagcctcttgctaaaggagctttgtatgaaggaccggatattggatggattctacttgcttgaagcaattgagaataagggatgcttgtcttccattgactctgatatttattctattcttttaattgggctttgtcaaagaagccacctcaaggaggccacaaagctggccaagataatgcttaagaaatcagttctgctacaacctccacacaaagatgctgcaattgatatcttaataaagtctggagaaaaagatcttgtgaaccagttgaccggcatacataagaaggggctttga

SEQ ID NO: 57847 - DNA, 2415 bp, Glycine max
  Peptide Sequence Number=SeqID_174625
atggcgaaatcggggaataagaatatgggatcaaccgcaaaagttcacccttccaatgatcccgaactggatcccgattcttacgccctggagaagttcagactctacgaaaccagagcgaggttttacctaatcggaagtgatcggaacaagaggttcttccgggtattgaaaatcgatcgatcagaggcgtgggatctgaatatcagccaagaccccgtgctgtattctccccaggaaatcaagagcttgctccagcggattgctgaaggtaacagggccactggcggcctcacttttgtcgctaaggttttcgggattgctggctgcatcaagtttctcgagtcctactatttgattctcgttactaagcgcagacaaattggttctatttgtggccatgcaatctatagcatcaaggagagccaattgagaaccattccacatgtttcaattcaatctgatttagctcactctaagactgagctcagggaaggattgaaggaggaggagcaacaaaccaggtacttgaaaaggggtgtgaatgatcgggggagggttgctaatgatgttgagacagagcagattgtccttgatgaagaatcaggctcttgcaagggaaagatgagttcagttgtgcaaatgcgtggatcaataccgcttttctggtcacaagaagcatcaagatttagccccaagcctgacataattttgcagaggtatgatccaacataccaagcaacaaaattgcattttgaagacctagctaagagatatggcaatccaattattgttcttaatttgattaagacagttgagaagcggcctcgagaaatgatgctgaggcgtgaatttgcaaatgctgttgggtatctgaaccaaattctaccagtagagaaccatcttagatttattcactgggattttcacaagtttgcaaagagcaagtctgccaatgttttggcagttttaggaggtgtagcaagtgaagcgcttgatttaactgggttttactacagtggtaaaaccagcatcattaagagagccaacaagagcaatagaacaagcacagggagggatacttcagtgagagatctgagagctagttctggggatcttgtgaggattgggaacagtaatgaaatgctaaattctgtggttaatcaagacaaagagactgacatgaaccatcagaataaaaaagataattttggtagtgatgcaccacattttcagagtggagttctccgtaccaactgcattgactgcttggaccgtacaaatgttgcccagtatgcttatggtcttcaagctttaggacgccagctccatgcaatgggtttgactgatgttccaaaagtggatcctgatagtagtattgctgcagctctaatggatatgtatcaaagtatgggagatgctcttgcccagcaatacggtggctctgctgctcacaatactgtgtttccagagaggcagggaaagtggaaagcaacaacacaatcaagagagtttttaaaatccataaaacgatactatagcaatgcttacacagatggttacttccaaccacaggaagggaaacctgctctctgggagctggattcagattattatctccatgtatctgggattggggatgatctaattcctgagaagtgttctgaaccaaatatcagtccttctggaagaggtggaatggtattcatgcctataccagcttgtagagatgacttctctcgcataaagttgacatcatttgacatgttaattgaaaagacttgtagtaaaataaaaaatgtaagactatgctgtgagcctgatcagagaccaggtggggtttctggaaacagtggtgtagcacctgatgcagctgagatacagctcaaaagcccaaattggcttttcggccagagaaagtatgaagagggttcctctgctgcaaaagttgcttctcgtgaatctggcgttgaaggatctcatgctaatggcttttgtgacttgaattggctttcctctggcaatgatatgaatgaagaggatgttttccaaaggtaccttacaatgacctcaacaaatgaggccaacggttggtatggaggtagtctcctcggcgatcaagatgaaagcagtgagatatataaacattatgctgagttatgtcagggacctgccttggaacttttccaaaatgaccctgagaaggagcaacactatgcagatgctttaagcacgagttcatatgaaattgttaatgatgctgtcgttgcagcagaaatggaagcagctctaaaggagtatgaccaagttggtgctgaccttgggattattcccaaatcttgtaaattctatgttgatgatccgagctggctgacgagatggttaactggggacgaaaaagtaccaaggatatga

SEQ ID NO: 57848 - DNA, 214 bp, Glycine max
  Peptide Sequence Number=SeqID_174626
atgaaatccctaacatggacacaagtcaagccacctatcgaatcaagcctacttgatctccctacaacgttgaccaacatgagtcacaaagagaactgtctagtcctatgtcacaaggagaatcctttgcttcatgtttgtcaccttcaaccaacgacttataccatggttctagttgatgatgactctaggtggccaattgcccttaggaaag

SEQ ID NO: 57849 - DNA, 435 bp, Glycine max
  Peptide Sequence Number=SeqID_174627
atgaaatgtccttcttgttctgttgacatttctgattatcttcagaacattcaggttgacatagatttgaaaagtgcaattgagtcattgaaagctaaggttgaagaaattggagaaacaggggagtcaagtgaagatgcagatggattacaagatgatggtgctggcaaggatgaagatactgactcaggaaacaaaaattctatagtggagtcggatagtctacctgaagaatctaatgttggtgaacttaaagataccaccaataaggggccagatccagctgtgaagtacaatggaaagagaaagataggtgattatggaaatcaatcatctgatgataaaatggaaaaaagaggtaaatattacaaaacaactgaggaagcattgcatgaagaagatgattcttcatcaaatcctcttaatcctcaatga

SEQ ID NO: 57850 - DNA, 924 bp, Glycine max
  Peptide Sequence Number=SeqID_174628
atgactatcgcaaacaacattaagacaactatccccaagatcgaaactgttaaagaatttatggggttaatgaaagagcgctcccaaatagctaataagtctcttgttgggacattaatgagtacgttgaccaccacgaagtttgatggctcacgtactatgcacgagcatgtcaatgagataacaaacattacaacaaggcttaagaccttgggaatgacggatttagctaagccgagcctgtcaagagtagcgttagctttccttatggccactgaattcccgtattgtgcaagcttagacagtgtgtcattggttcccaaggaaaactggcacagcaataaacgacctgctgatgagcaagaatactctaatgaggttgaagttcgtgctagtgtggagccctcagaagatgaacttgctgatctgtcaagagcttgtgacaaactctgggatctagatttaaatcttttggtaccttgcaaagactatgaaattgactgtggtgaagggaaaaaggaataccaaaaggaagatatggcacaggggagcttgtttacttgggttagtgatgatgtattcaaaaagcctacatttgctcgttttctttcacttttggataactacaatccacatcaaggatgtaaggaagtagtcacatctgaagagagacaagagcaagcttctttcattgaagaaatcagtagaacagcaccaattaaatatcttcacaagtatcttgcatccaagggaattgtatcagagacttgccaagaattcaaaagaatgattaccagtctgtggtttgacctttatggccgtggtggcacttctggttcctcttctgcttttgaacatgtttttgttggagaaaccaaacaatgtggtgaagtttctggctttcataacatgctgcagctatga

SEQ ID NO: 57851 - DNA, 1644 bp, Glycine max
  Peptide Sequence Number=SeqID_174629
atggctctaacacttcgttcttcaacttcttttattaatcagaaggaaaccaaagtccttaaaacttctgatgatatccctgcgacagttagtttttcaaaattcaagccattggtccgtctccgggcgaaaaattcaatgcaagaagcgcatcacactcgcgagaacagcttcaatgaagcaagtagaagcgagaaatgggagaaggtgcttgctccatcggttgcacataaccacaatgattcgaagagagtacctgtgtatgtgatgctgccactggacacggtaacaatggaaggaagattgaacaagcctagagcaatgaatgcgagtttgatggccctgaagagtgcaggagttgaaggtgtaatggtggatgcttggtggggtttggtggagaaagatgggcctttgaagtacaactgggagccatatgctgagcttgtacagatggtgcaaatgcatggtttgaagcttcaagttgttatgtctttccatcagtgtgggggcaatgttggagacaattgcagcattcctctaccaccatgggtgttggaagaaatcagcaagaaccctgagctggtttacacagacagatcagggaggaggaatcctgagtacatctccttgggctgtgattcagttcctgttctaagaggaaggactcctctccaagtgtactctgactacatgagaagctttcgtgacagattcagagattacttgggcagtgttatcgtggaaatacaagtggggatgggtccttgtggagagctgagatatccttcttatccggaaaccaatggaacttggaggtttcccggaattggagaattccaatgttatgacaagtatatgaaagcatccttggcagcagcagccgaagacattggaaagaaagaatggggaggaggaggaccccatgactcaggccagtacaatcaatttcctgaggatactggatttttcaaaagggaaggaacatggaacactgaatatggacagttctttctggaatggtactctggtaaattgctggaacacggtgagaggatcctcgtatctgctaaaggaatattccaaacaactggggtgaaactatcagggaaagttgctggaatccactggcattacagagcaaggtcacacgcagctgaactaactgctggctactataacacacgacataacgatggatatctgcctatagcaaggatgctggcaaaacatggagttgtcttcaatttcacctgcatggaaatgaaggacagagagcagcctgactttgcatattgctcacctgaagggttagttcaccaggtgaagatggcaacaacaacagctagagcagaacttgctggggaaaatgcattggagagatatgatgcagatgcatatgctcaagttttatcaacaagtaagtcggaatccggcagcggattggctgcattcacatatctaagaatgaacaagaggttgtttgaaggtgataactggcggcacctagtggattttgtaagaaacatgtctgagggtggtcggagagagagacttccagcagctgattcccatgggagtgatctttatgttgggcacatcaaagcaacacgggaaaagcacacacaagaggctgctcttgtgtaa

SEQ ID NO: 57852 - DNA, 306 bp, Glycine max
  Peptide Sequence Number=SeqID_174630
atgtctttcctaaggagatcctcatggactatcaccttcaaaaggcatagaacatcaaagactcaacgtaaggatgcacatgccaaagttgagtatgtgaaaagattgtatgacgaagtgaatgtgcaaattgcaaagaagaatgaaagctataccaagcaagccaacaagaaaaggaaggaagtggtacttgaactcggtgatgatcttggacatttgagggcaaatgttttccaagaaggagggaatgatgagaatcctgaaactggccaaatacaggctaaaggcccaagtggagaaggatga

SEQ ID NO: 57853 - DNA, 3060 bp, Glycine max
  Peptide Sequence Number=SeqID_174631
atgaacaagctggtggtagaagttgtggaggcgagcgacctcatgcccaaagatggggaagggtcagctagcccctttgtagaggtcaagttcgatgagcagcagcacagcactgaaacgaggcacaaagacctgaatccttgttggaatgaaaagcttgtgttcaacatcaataaccccagagatcttgcccacaagacaattgaggtggttgtatacaataacaatcacaatgatcggaaccacaataacttccttggaagggtgagactttcaggctcctcaatccctctatcggagtcccaggccagtgtggaacgctacccacttgagaaacgtggtctcttctcaaatatcaggggagatattgctcttagatgttacacgctgcatgatcatcatcatcatgctcatgctgctgcggaacaccatcaccatcacccccaagtagacactcctcctcctcctgctgctgctgctgctgctgctgaggaggaggaggaggagtatcaggacactccctttcaagaaataaaccccaacatgaacacggtgctagatgaggaaagcgcggttggtggcggggacaagaagaaaaagaagatgcaaaagaaagaaaaggaagtcaggacttttcactctattccagcagcacccgcgatggaaacgacccaaaggagggttgattttgcaaaagctgggccacccaatgtaatgttaatgcagcagatcccaaagcaaaaccctgagtattcattggtggagacaagtccaccactggcggctcgtttgcgctatagaggaggccgggacaagatatccaccacctacgacttagtggaacagatgaattacttgtacgtcaatgttgtcaaggctagggatctccctgttaaggatatcactggtagccttgacccttatgtggaagtcaagcttggtaactacaagggcctcaccaagcacttggacaagaaccagaaccctgtctggaatcaaatcttcgccttctccaaggacaggctgcaatcaaatttgcttgaagtcaccgtcaaggataaggacattgtcaaggatgattttgtggggagagttatgtttgatctcactgaggttcctcttcgggtacccccagacagccccttggctcctcaatggtacatattggaggacaagaagggccaaaaaattcataataatggggaaatcatgcttgcggtttggatgggaacacaagcggatgagtccttccccgaggcctggcactctgatgctcacaacattagtcactccaaccttgcaaacacccgctcaaaggtatatttctcgccaaagctttactatcttagagttcaagtaatcgaggctcaggatcttgttccttccgataaaggaagggccccggacgccattgttagagtacagctggggaatcagatgagattcacaaggccttctcaaattagaggcatcaacccagtttggaatgacgagcttatgtttgtggcagccgaaccatttgaggattttatcattgtgactgttgaggacaaagtaggttctagtgttgaaatcttaggaagggagatcatttcggtgagaagtgttcctccgagacacgagtccagcaagaagctccccgattctcgttggttcaatttgcacaggcctagtgcggttggcgaggaggaaacagagaaaaagaaggacaagttctcaagcaagattcacctccgagtgtgtcttgaggccgggtaccacgtccttgatgagtccacgcatttcagcagtgatcttcagccatcctccaaacatttgaggaagaaaaacattggaattctcgaacttgggatactgagtgcccgcaacttgctgcccatgaaggccagggaagggaggactaccgatgcctactgcgtggccaagtatggcaacaaatgggttcgaaccagaactctgcttgacactctctcccctcgatggaacgagcaatatacctgggaggttcatgatccatgcactgtcatcacggttggggtatttgacaaccaccacatcaatgggagcagtgatgccagagatcagagaattggaaaggtgagaatcaggttgtcaactctggaaactgatagggtgtatactcatttttatcctctgctggttctccaacccaatggcctcaagaagaatggagagcttcacttggcggtgaggttcacctgcactgcatgggttaacatggtagcccagtatggtaggcctttgcttcccaaaatgcattatgtccaacccatacccgtcaggcacatagattggctccgccaccaggccatgcagattgtggccgctcgcctgtctagagcagagccgccccttaggcgcgaagctgttgagtacatgctcgacgtggattaccacatgtggagtctaaggagaagcaaagccaattttcatcgcataatgtcactcctcaaaggagttactgctgtttgcaagtggtttgatgacatctgcacttggagaaatccaatcacaacctgccttgttcacgtcttgttcttgatactggtttgctacccggagttgatactgcccaccatttttctttacttgtttgtaatcgggatttggaattaccgcttcaggccaaggaatccaccccacatggatgctaggctttcacaggcagagactgctcacccagatgaactggacgaggaatttgacacttttccaacaacaaagccttcagatattgtgagaatgaggtatgacagattgcggagtgtggcaggtagagtacaaactgtggttggagatttggctactcaaggagaaagagctcaagccatactaggttggagagactccagggccacatctatcttcatcatcttctcactcatttgggccgttttcatttacattactcccttccaagtggttgcaattctaattggcctctttatgctgcgtcatcctcgctttaggagcaagatgccatcagtaccagttaatttcttcaagagattgccttccaaatcagatatgcttatatga

SEQ ID NO: 57854 - DNA, 744 bp, Glycine max
  Peptide Sequence Number=SeqID_174632
atggataccatcataaccaaaggaaaatcttcgaataaaccactagttgttgctggctgtgtccctcaaggaagtcgagatttgaaagagctccaagggatcagcatagttggagtccagcaaatccatcgtgttgttgaaattgtagaggagactctaaaaggtcatgaagtgcgccttttgacccgtaagaaattgcccacacttgaccttccaaaggtaaggaagaacaagtttgttgagattcttcctattaatgttggttgtttaggtgcttgcacttattgcaagacaaagcatgctcggggtcacctaggaagttacacaattgatagccttgggtttaagagatatggcttagcagtgaggacactggagcatctgattgcagagattttgcggcatccatgtgtttactcttttctgcatgtaccagttcaatctggaagtgatactattttgagtgcaatgaatcgagaatatactgtgagtgagttcaggactgttgtagatactctaactgagcttgtgccagagatgcagattgccactgatataatatgcagatttcctggtgaaactgatgaagattttgtgcaaactgtcaaccttattgaagagtacaagttccctcaagttcacatttcacaattttatcctcgaccagggacacctgctgcaaggatgaaaaaggttccaagtaatgtggttaagagaagaagccgtgaactgacatgtctttga

SEQ ID NO: 57855 - DNA, 489 bp, Glycine max
  Peptide Sequence Number=SeqID_174633
atggaagggtccagattgcagaaacagacaaacctgaaagcaaagcggtttgataaacagaggagaggagaggagaaggcgatgcaacccacatccggcggcggcgggctggcaaggttccgttcagctccggcgagctggttagaatcagttctgttgaaggaagaggaagaagaagaagaccccttaagcttcactcaactgctttccactatcgatgatgctccctctcattctcaacaccaactctatggtgccgctctctcaaacaaggataaaacacctgaaatcttcatgttagaagattccgttccttgcagagtgagggctaagcgtggctgtgctactcatcccaggagtattgctgaaagggttcgcaggactcgtatcagtgaccgcatcagaaagctgcaagaacttgtgccaaacatggataaggtttttcttttcttcctttctttcactttccaattcatttatcaaccataa

SEQ ID NO: 57856 - DNA, 1152 bp, Glycine max
  Peptide Sequence Number=SeqID_174634
atgatgatgaatgttttagggttgagtctggtgttaacttcactggcagcagcaggaatattctctcccaatcccagaacagagaagcatggagccagcaccattgtcaaagaagggcatcgagttgtggtggttgaatacgaccaaggtggccatcagaaaaccaaaatctcaatatccccagagcaacccacgcatcaccatgatcatgatgatgatttgatcaaagaagctgcctcggttctccctaacttatgccaaggcatttcttcatcttcacaatattcacaccaaccgcagaatcacatggatcatgggcctttaaatctgcatgctcctaatcctaaagagctcatttgcgacgcctatggaaaatgcaaacacaaaatctccgacgccatggagaaggctcaagaggccatccataagaagaaggacaagatttgtaaaactaaagagactgtgtatgataaagcccatgacgtccatgaatacgcccaagacactgtagaagcagcaaaggaggatatggccagtaacgtttcaaacgccaaagatgcattgaagcttctaataggaggatctatggagagcctgaattctttgatgggggtggctaatctgctggggtttgccacggcttatgggatatgtgtgtgggttacgttcatctccagctatgtgcagtccaggactatgccaaggcaacaatttgcagtggtgcagagtaaaatataccctgtttatttcagggccatggcttatagcattgcactggctttcttagcccatttcttagcccatagaaacaccaactctgacatgttgcaatcatataatcttctggcctcccttgccacacttttcctcaattatctttacttggagcctcgggccaccaagttgatgttggagaggataaagatagaaaaagaggaaggaagaggcagatcacaagacatgatgagtagtagaacagtagatcctaaagagccagcagatcaggaggatgcactcagatcaaggataatcaagctcaatgacaagctcaagaaattcaattcctattcctcattcctcaatatcctcaatctcatgtctcttacttggcatctcgtttatttggctcaacgacttcaccatatttgctaa

SEQ ID NO: 57857 - DNA, 357 bp, Glycine max
  Peptide Sequence Number=SeqID_174635
atgtacccggttgtgcgctacataaagatcttaaaagggtataccaagaatctacatcgtctggaagcatctattattgaaaggtacatcgcagaagaagccattaaatttttttcagagtacattgaaaaggctaaacatgttgggcttcctgagtctcgtcatgacgacagagtaggcgttttgccatacatacttcagcatgaaggtttagtcaaacaaagtaatccaaaaatgtcaaagaactgggtcttgaaaaagcataacaagactttctctgattggtttaaagatacaatctttgctgatgaaaatgcttctgaaacattaagaaagctagctgatgggcctaaatga

SEQ ID NO: 57858 - DNA, 156 bp, Glycine max
  Peptide Sequence Number=SeqID_174636
atgttttattgtaagggaaaccctggtcttgctgaagtcatggcagcaatttttgctatagagaaagctgtggaaaactcttggagacatctttggctggaaacatgctccttcttcaagcttttaagtccccgaacatggttccctgatccttga

SEQ ID NO: 57859 - DNA, 159 bp, Glycine max
  Peptide Sequence Number=SeqID_174637
atggcgatcatagatgggactgaagagaacaatgcctacagtgacaagcatttgaagagaagcagcgggtatgtcaaagcccagaaatattgttctctccatagtaatcttttgcttgataaagaaggtaggaacttgagcaaacaccacaaagcatag

SEQ ID NO: 57860 - DNA, 135 bp, Glycine max
  Peptide Sequence Number=SeqID_174638
atgagggagtgtaagtgcaccccttcaaatgaacctaggtccgccactgagcatgagtcttgctctctacttgagtatctttggtgttggaagctttacaagagtgtctctaaatgcttgctggactcagtgtaa

SEQ ID NO: 57861 - DNA, 780 bp, Glycine max
  Peptide Sequence Number=SeqID_174639
atgaactttcgtgaagcagcagtcagactggccatttccccttcagtggtgacgcggactattgccgaactggaaaatcagctcggcgagcccctttttaagcggaatacccgatcaattgtgctgaccagctttggtgagcttttcctgccgaaggccatgcggctacttgaagattcagaggctctttttcagacggcccgagatgacaatgacatgaagggcgttgtgaggatcacgttattccggtttcccggccacgagcaggtgttatataagcttcttacctccctcgatccttatcctgagctgtttatagactggcggttagacatgatgaagctggatactgttcagaaccgcattgacatggggatccgtatagagcgggagccaaacccgaattttatcgtcaggcccattacgctggttcatcacgcgctgatgacatcacccgggctcattgagaagctgggcgcgccgaaaaatttcgacgatctgcgccagcgctatcctttcagtggtctgctgaatcctgaaaccggaaaagtattcgaatatatgctcgatggcgttgatacttttgtaccgcgccatctggagttttttaccaccgactcccagtcggagatccaggctgcgttagccggtaaagctgtcattcagtcgagtaatctggcctgcagggaataccttgaagacggcaggctggtcaatgtcctgcccgaactgaaactggaaacctggcagctttatctttacaggccctatcagaccctg

SEQ ID NO: 57862 - DNA, 195 bp, Glycine max
  Peptide Sequence Number=SeqID_174640
atgggacctaacaaactctctacgttcgtacctgcagctaacaagtcagaagtgccccctgagtccgagcttgggtctttcattcgggccctattggggcaccctgtgggccagccaatgcgtataagcttgggctttcttaacgtggctcatttgacgactcagtacatggatgtcacgagtctattggcatag

SEQ ID NO: 57863 - DNA, 550 bp, Glycine max
  Peptide Sequence Number=SeqID_174641
atggagctcttaaaagactatgattgcacgatcgtgtaccatccagtgaaggagttccaagatcttgtagctagtggagtaaggtttgaggtcacaggcgccgaatcacttctagctcatgttcatgttcgttccactttagtgtataccattaaagtcactcaaggtgaagaccctcatttaaggaagattgtggaagagactcaagcaggaaaggtttttgattttgtagtcgattctgaagttggagagccttggttggtaggcccaaatctaattcaagaagttgttgagaagggtaagcttagttccaggtttattagtccttttgagattctagagagggtggggcaaatggcttattgtttatccctcccaccagatctatcaaaacaaccagcaactatagtggacaaacgtgtgaagtgtttacgttataaggatgttgtgttagtgaaagtggcttggagagggccagctggagaagagatgacttgggagccaaaaattgttatgcgtgacaagtaccctaacttgtttgcgactcaag

SEQ ID NO: 57864 - DNA, 813 bp, Glycine max
  Peptide Sequence Number=SeqID_174642
atgaaggaagggaattggctgtggatgatgaactcatactcccaagtagcttcatctacagtccttgtcttccatttgactagtcattgcgtgatggtttcaccatctttgttaacctcccgagcggctaagatatcttcaggctctgccacatcagttactccacttccaagtcctttggcatatggaggtggactggctgagtttgttgtggctagtgagagcttaacagctgccagaccatctgaggtctcagccgctgaagctgcagcattacctatcgccgggctcacagctagtgatgccctcactcaaattgcaggagttaagcttgatgggactggccagctcaagaacattttagtaactgctgcttcaggtggtgtaggtcactacactgttcaactagcaaaactagggaacacccatgttcttgactacaggactccagagggggctgcactcaagagtccatctggtaggaaatatgatgcagtgataaattgtacaactggaatatcttggtcaacttttgatcctaatttgactgaaaaagcggtggtagttgatttaacacctaatgcaagttcattgtggactgctgccgtgaagaaaattactttttccaagaagcagttggtgccattttttgtaaatgtccagcgtgagggcctggaatatctacttcaattaatgaaggatgggaaactcaagtctgttattgactccaagtttcctttgagcaaagctgaagatgcttgggctaagagcattgatggccatgctactggaaaaatcattgtggagccatag

SEQ ID NO: 57865 - DNA, 318 bp, Glycine max
  Peptide Sequence Number=SeqID_174643
atggaaacaatattaagagggagaagcgatgcgagagggagacaagagaacttacttggaagaagatcaacccaacaagaagctgcaacgggagaggaagcagccaccaacatgaagcagaagcagcacgcgagaaaaaatgatgaggtaattgttgttgtgtgtatgcgtgagggagaagacaaaagagaagcgaaagaaggagacgaagaaggagaagaccttgcctacgcagaggagaaaatggaaaaggagaagacgaagcgcggaggagagaacggaaaaggagaagacaaagcaacaacacgggaggagtaa

SEQ ID NO: 57866 - DNA, 834 bp, Glycine max
  Peptide Sequence Number=SeqID_174644
atggctcatttattggcgagcaaccccaatgcttcacagaaacttatatgctcaaacttggagtactatggtgttagaagtagaagaggatccagaaccacgagtgcgtgttatagagtgggaaggaaaagacgatgtggtttggtgttgcaatgcagcagcacaactgatcaggatgtgaggttgcagattgagaatggtagcagcggaaagcttaagcagcagtttgaatatttggtttgtgaatatgggtggaaagtaagaagactatttgaaaacgcagatgagataaagaaggcatctcaagttcaggccgaagctttccatgttcctgtctctcttttcaatgacttgttcttccagttctttcaggcggaagtgctttcagggcttctttacaagcttaaaaactcacctcctaataggtatgcttgtttggtagctgagacagcaatagacgatccagattcggcaaaacaacttgtaggtgtcatagatgtcactgtcttacgagaccaaaacgtgctccaacatcttcctcccgaagctgaagaatacctttacatatcaggaatagccgtctccaaaacattcaggaggcgaaaaatagcgactgccctgttgaaagcctgtgacatgctttccattttgtggggtttcgagtttcttgcccttcgagcttatgaagaagatctaggtgctcgcaaattgtacacaaatgctgggtaccaagttgtgtctcgtgatccaccatggacaagtccagcgttaacaatcatcaccgaggagtttgcttatttcacatggattaccgaaagcacaacaactgagtag

SEQ ID NO: 57867 - DNA, 1242 bp, Glycine max
  Peptide Sequence Number=SeqID_174645
atggagtatgtgaagtctggagagctgttcgattacattgtagagaagggcaggttgcaggaagatgaagctcgtaatttttttcagcagataatctctggtgtggagtactgtcacaggaatatggtggttcatagagatttgaagcctgagaatttacttttggactccaaatgtaatgtcaagattgctgattttggcttgagcaacatcatgcgtgatggccactttcttaaaacaagttgtggaagccctaactatgcagctcctgaggttatctctgggaaactgtatgctggacctgaagtggatgtctggagctgtggtgtaattttatatgcgcttctttgtggcactcttccttttgatgatgaaaacattccaaatctcttcaagaaaataaagggcggtatttacactcttcccagtcatctatctcccaatgctagagatttgataccagggatgcttgtggttgaccctatgaggagaatgaccatacctgagatccgtcaacacccatggttccaagctcgacttccgcgttatttagctgtgccaccaccagatacaatgcaacaggccaaaaagattgacgaggagatccttcaggaagtggtgaaaatgggatttgacaggaatcaattggttgaatctcttgggaacaggatacaaaatgagataaatcccttacttccatccatgtatttcagggtactgtggcatactatttgttattggacaaccgattccgtgtttccagtggctatcttggagctgagtttcaagagaccatgccaggaggatggggagggacagcagaatatttggtacttgggaactccaactgaaggttgcattggaaatgattccggttttaatcaaatgcaaaactcttcagttgttggaaaccgttttccaggctacttggagtatccgggagtaggatcgaggcaacagttccctgttgaaaggaaatgggcccttgggcttcagtctcgagcccatcctcgtgaaataatgactgaggtccttaaagctttgcaagaattaaatgtttgttggaagaagattggtcactacaacatgaagtgtaggtgggttgctggcattcctggtcatcacgaaggaatggttaacaataatgtagataataataatttctttggagatgattccaacatcattgagaatgatgctgtttctacttcaaatgtggtcaaatttgaagtgcagttgtaa

SEQ ID NO: 57868 - DNA, 195 bp, Glycine max
  Peptide Sequence Number=SeqID_174646
atgcaggcatttccagagccagagacggggaggcagcaggtctcgtcaccggagaaaggagagaagaggagaaataagaaagtcaagagacaagatttgggagcggcagaaacaccgctctatcctgccacgttccatgctaaatcttccacaaaagtgaccgcaacatttaagaaggcaatgccagcattgtag

SEQ ID NO: 57869 - DNA, 228 bp, Glycine max
  Peptide Sequence Number=SeqID_174647
atggatggaccggctggtcgaggtggtgctggactggacatgtttctgccaaattataaattgggaaaaacacttgggattggatcttttggcaaggtcaaaattgcagaacatgtattgactggccataaggttgcgatcaagattcttaaccgacgcaagataaagaacatggaaatggaagaaaaagattttccaatatttcctgcagtttgttttgttttgtga

SEQ ID NO: 57870 - DNA, 1824 bp, Glycine max
  Peptide Sequence Number=SeqID_174648
atgcctgaggcaccgagagactacaacctttttgagcaaaacaagaaaactctcgagttcattgaggatgtcactgccaacgcagaccaagttcagaagagggtcctctccgaaatcctctccaacaatgcaaacgttgagtacctcaagagacacgacctccacggccaaaccgaccgcgaaaccttcaagaaactcttgcctgtcataacctacgaggacatccaacccgatatcaaccgcatcgccaatggcgacacttctccaatcctttgctccaaacccatttcagaattcctcactagttctgggacatcaggaggtgagaggaagctgatgccaacaattgaagaagagctagggagaaggagtttgctctacagcctcttgatgccagtgatgtcccagttcgtccccggtttagaaaagggcaaaggaatgtacctaatgttcataaaatccgaggccaaaacgcccggtggaatcgtggcgcgtccagttctcaccagctactacaaaagctcctacttcaaagacagaccttatgatccctacaccaactacaccagcccaaacgagactgtcctctgcccggactcttaccagagcatgtactcccagctcctctgtggcctctgccaacacaaggaggtcctccgcgtcggcgcggtcttcgcctccggcttcatcagggccatccgcttccttgagaagcactggcccctcctttgccacgacattcgaaccggcaccattaacaacacaatcacggacctctcggtccgcgacgctgtgatgaagatcctcaagcccgacccgaggcttggggatctcatccagagcgagtgtggcaagagctcctggcagggcatcatcaccaggctgtggcccaacactaagtatgtggatgtgattgtgactgggacaatgtcacagtacatccccacgttggactactatagcaatgggctaccacttgtgtgcaccatgtatgcgtctagtgagtgctactttggtgtcaaccttaaccctctttgcaagccaagcgaggtctcttacaccctcattcccaccatgtgctactacgagttcttgcctgttaatagaagcaacggggtgtctcatgactctctccacacccccagatccctcaatgagaaggaacagcaggagctggttgagcttgttgatgtcaaacttggccaagaatatgaacttgttgtcacaacttatgctggattgtatcgttacagagttggtgatgtgctgagggtggctggattcaagaacaaggcaccccaattcaactttgtgtgcagaaagaacgtggtgttgagcatagactcggacaagaccgacgaggtggagcttcagaacgcaatgaagaatgctgtgacacacttggtgccctttgacgcatcggtgtctgagtacacaagttatgcagacaccacaacaattcctggccactatgtcttgtactgggagctcagcctcaaaggctcaaccccaattccaccctgtgtgtttgaggattgttgcttagccatagaggaatcactcaacagcgtgtatcgtcaaggccgcgtctccgacaaatcgatcgggccccttgagatcaagattgtggaacaggggacttttgacaagctcatggactatgccataagcctaggggcttcaataaatcagtacaagactccaaggtgtgttaagtttgcacctgtggtggagctcttgaactcaagggtggtggagaagtattttagtcccaaatgtccaaaatgggttccgggccacaagcagtggatcaaccagaactga

SEQ ID NO: 57871 - DNA, 246 bp, Glycine max
  Peptide Sequence Number=SeqID_174649
atgatcttttctttgttatcaatcaacaatagacaaatacaaacagaacataacagccccgcctacataattccacttcttcagccggtgattacccatggagagcaagtatatctccgagtcagaaaaatgctcttaaaaaagatggttgccagtgatgaccttaattcccttgaagaactaattggaaggttaaagaggctgaagaagaatgtggggtttgtagacctcaatgaagccaactga

SEQ ID NO: 57872 - DNA, 702 bp, Glycine max
  Peptide Sequence Number=SeqID_174650
atgaaccctaaagttactaatcgtataatgatgaagcagatatgggttcatgacgatatttgttggaacataactaaaatatttttagattcaacgacttttgtgatttttgatcaggatgctacaatccttttcagcaagtcatgtgctaatatgtttgaaacacaccataagaagggttttgctggaacttttccaagggaaatcactaatttggtggataggtctttcctttttaaagttgatgttaaaagtggatgtagctcacagtttaagaaaacttttagagattttatgcctaatttttgtgatgttgttgaaaatgattcacaatgttgtgaaaaagaagcaattgatttatcaaaggattttgaagagtttacccctaacaaacacaatttctgttgcaaatcagttatgggagaattgactctaaatgaaagtgagtttgcgacccaaactaaggaaaatgatgttttgttctatagttctggagatttgactctgcccaaaaacatggaaggtgaagataagcaactagaaggttggtgttttgttaatgttaaaactaatgaaaattccatactgaaagggaagacaaatggtgttggtatggatgttgaactgatgcagagtcaatctttagaaatacatttgccactaaaatctttgaagaaaaggatcaaggttgagaagatttga

SEQ ID NO: 57873 - DNA, 282 bp, Glycine max
  Peptide Sequence Number=SeqID_174651
atgtactgcgaatctatgaggccaatttgtagaaatggctcaaacggatccgtctcactaatgtgcaagaaaaaaatcccacacttcaaaagtctgaaaatctctcaaaatgcacaacatagtgagaatatgacacgtaggaagaagagcaacaagaacgccatggctaatgctccagggaatgacgactttctaagagacacgatgattggtggattcatgacattcgatttcttccttcatgtatgtgttcttccttataatgtaattcctttcatgtag

SEQ ID NO: 57874 - DNA, 888 bp, Glycine max
  Peptide Sequence Number=SeqID_174652
atggaatttgggagagacattgttttcaagaacatttatggtcaactacaacggcttcatgagactcatacttctttcattctattacaatatccactattgtttccttatattgaagatgcttttcaagaggatattccaataagccaattgacaaataatatggaaaactgtaggagagtgtgtgtaacattgagggagtcgattgcatttagaattcaagatagaagtgtagagttcaataccatattgaatgcacgaagactatttcaacagttctcaattgattgttattctatggttgagtcccaatgtttaacatggataagattcaatcaaaaggcgatcagatttgatgttctaaatggtttgcaagaagtagtctcaagaggagaaaaaaatccttcttctattgggaaacatgttatcttaccatcatcatttactggtggaatgagatacatgtttcaaaattgtcaagatgcaatggccatttgcgagttgcctaatcctgatttatatcccaaattgtccaaagcagttgcaacctacatgctgcatgggccatgtggattagctaacttgaagtctctttgcatgaaagataggaaatgctctaaatactttcctaagaaatttgaaaactccaccacaattgatgatgatggatatccatgctatagacgtcgagacatgggaatgtctattcaaaaaaatggtgtaactttggataataggaatgttgttccttatagtccaatgctacttatgaggtatgaaggtcatatcaatacagagtattacaataaatcaaactcaatagagtacctgttcaaatatgttaccaagggaccagatcgggctacaattgagattagaaattcataa

SEQ ID NO: 57875 - DNA, 351 bp, Glycine max
  Peptide Sequence Number=SeqID_174653
atgtcaagtaggaagaagaaaatgaagaaaaacaagaacgccatcgatgatgctccaaggaatgacgactttctgagagacacgatgattggtgcgttcatgacattcgatttcttctttcagttttggaaaacatttaagaatgaagtgtctacagattgggagttgatcgataagcaggggagggtatcaaaggtcgaactccttgaaaatgacaaagactcaattgccatctacaaaggtgttgctgacattgatgatccaagagtatcagcgtaccaatggagaaggaggaattgtgaagacacgctcaatgcaagcaaggaaatgatgtttattccccctttgtaa

SEQ ID NO: 57876 - DNA, 433 bp, Glycine max
  Peptide Sequence Number=SeqID_174654
gtggtttatacacagtacaattattgcaacaggaaaacacatagaaggtgttgtgttcttgcaacgttctggatccgacattgcccttgtcggacccacgtacacatgtccttccttctcccttggccttgagttcctcattgtttgtccttattgcacggagaggaagaccatacccccacccaacagatctctcatagaacaggtatcaaactatgaatatattcaacatgaacattacgccagttcaactggaattggtttggattgcttaaataagatttcagctagattcctcgacagatatcaattatcgataaagctggtgatattttacacctataacatgcgacaaaagatcaatgtcacacctcaaatcttagggccaatgcttgaggagttacaagctagttggcaccttacattttcataa

SEQ ID NO: 57877 - DNA, 1686 bp, Glycine max
  Peptide Sequence Number=SeqID_174655
atggggggttgcgtgtcagtaccttctaatgcaataaaagcaccaaggaagatccgtagacggataacaaaacctcgtctaaagttctcaaattctcttcctggtgagatcatcaagaagaggaatagcaatgcaggggcacgtgtaacagattattctgtaagtgaggttgttcgtatgaactttgaaaatggtgcaactactacttgcaggcgctcggaagtttctaattcagcattccatcttactcagcttcaatggcaccacagtcaatatgatgctgatgcaaacttagtgagtcaagaagaaacttattttgactcagtcagtattctggaatctgattcagatgacgaattcaatagtgttcatggagatttatatgcagatggttttccaatagtaggcagcacagttggaaacatcccatgtggtcaagtgctccagtatggaagatcgacatgttttacggataacaggtgtcagtatgaagaatatcatgaaagttatgttaaagttgatggaggcaaccaagacagcttaaagggaaaagatgaaagtggttttgcccttattagtacacaaggtgttggaatgtcttgcttaggcaagtctcagggaagcttcaaaggtattaaagaatataaacatggtttggaagagaaaccacaagagaatgcacggaaatcaggccttcttcggttggcaccctccgttagtttcaatgacaaaacaccgaatcggccaagcaaacggctgtcacagattttcaggctttctttcaaacgaagatcttgtgacatagaggatgcaaatgaacttagtcaatcaaaaagatatttgattcgacccagagcagggcatacaattccatgtcagaatggagaaaagccatctcatggatgttggtctgaaattcctccctcaacatttcaactccgtggtgaaaactatttcaaagacaagcacaagtctcctgcaccgaatcatagtccatacattccaattggtgttgatctatttgtctgtcgaagaaagatacatcatattgccagacatcttgagcttccaaatgtgaaagccaatgggaaaattccccaacttcttattgtaaatatccagttgcctacatatccagtagcaatgttccttggtgatagtgatggagaagggatgagtcttgtactgtatttcaaagtttcagagactcttgatgaacacatttcttcccagttccaggaaagcattatgaaattagttgaggacgagactgaaaaggtcaaaggatttgcaaaagaatcaagtgttgcttttagagaaaggctaaagatcatggtaggactcatcaatcctgaggatatgcgcttgagttctgctgaaaagaaactagtaaatgcttataatggaaaacccgtactgtcgcgcccacagcacaacttttacaagggtcctaattactttgagattgatttggacattcatcgatttagctacatatcaagaaaaggacttgatgcatttcgagatcgtttgaaagatggcattcttgatctaggcctaaccattcaggcacagaaacaagaagagcttccggagaaagtattgtgctgccttagattgaacaagattgatcttaatgacaatggtcaaatgcccatgctaatgaccgttgatggtgaatgctaa

SEQ ID NO: 57878 - DNA, 219 bp, Glycine max
  Peptide Sequence Number=SeqID_174656
atggttaatccagtgaaacaacttttttcaaaatgcacagtcattaccattgctcatagaataacttcaatcctggatagtgacatggttttgtttctaaatcaagtgctcattgaggaatatgattcaccaaagaaactgcttaagaacaaatcttcatctcttgctcaactagttgcagaatacgcaaggagatcagactctggttttggaacttaa

SEQ ID NO: 57879 - DNA, 624 bp, Glycine max
  Peptide Sequence Number=SeqID_174657
atgagtgtggtaacagcacaaccacaaacatcaccaaccgctgaggtgaggctaatcagcacagagttacaagtccaagaatgctacaagttgtatgtggagccaacaagagggtgcagaaaactcacaatggaggatgagtatatggtgtcaccaaagttccctttcaacttcaagcttccatttttcctctccatttgcgaggtcacttgtgactcttacattgaggaagagttggagaggttgcccatatcctctggccttgctcggtatctgaaacccttcattcttgagagtgttctatttcactcagttgcggctatccaactagccactggacagcagggtattttcccgagggcgattgttcaccaaacggtcattagaaaaggaaggataactctaccaggaaaatacaatgtcattctcaggtcagacactgatattatggaacttgtaggtgcacatagagaagatttgtcttcagtcatgtcctcaaagagaatgcccacatttaaaacattgagtatcaccacaaaggacacagattcactgagggatttagaacttgagccaaaagtgagaagtaggatgagcatcgtgatatgtcagatcttcagttga

SEQ ID NO: 57880 - DNA, 129 bp, Glycine max
  Peptide Sequence Number=SeqID_174658
atgtgtgagatgtgtactgttgagatgcaatgttactcgataagtggtggaatgatagttgtagcagaggcatgtaagaggattaatgagctgaagtgttgcgctcagcgtgacctcctcgttcaatga

SEQ ID NO: 57881 - DNA, 1797 bp, Glycine max
  Peptide Sequence Number=SeqID_174659
atggttcgaacaggcctcatctatgatcattgttcttcctcggccttaaccaacacttccttcaactcgagtctctttcgttactcgcaaaatgttaccaacatcaccatcttctatggttgtcctagctccgtgtttgcgaataggaattactcttttccatgcaaggaagatcacaatatgagtgctttctatggggaccccgaaactgcaagagttcaagactgtgaaggacctaggattgaagtgcaagtatcaaaggaacctgtgcttggtgaaggaattgaagggctgaacaaagctttgagtgaagggttcagagtgcatcttatttcagaggctcaagttcaacagtgcttagaatgcgttgtaagtaatggaacatgtggggctaatgatgagtctcagtttacatgtttttgccaggatggaactgaaggtttagattgttctgatcatcatagaatctatgattggcggggtgctgaaatcttcaaagtgcttgactttttcaagggtgaccaacaattggttgcttctgagtttgagatttattttcctgattcaggtaataaatggaattgggaaaggaaggttggtataggcgtttctgctgctgtgctcggggcaattgtagtcagcattggcttttatatctgtagtcgtcagaagaagaagaaaaatcttcatgcagtatcatcatctgtacaatctaaagaaacctcttatagttcttctatagaagatactgagaagggatgcacatactttggagtccatttcttcacttatagtgaacttgaagaggccaccaacttctttgatcctgccagagaactaggagatggaggatttggaactgtgtattttggcaaacttcacgatggacgtgtagttgcagtgaagagaatgtacgagaacagttatagaagagtggagcaattcgtgaatgaagtagagatcctaacaggcctacaccaccaaaacctcgtgtcactgtacggatgcacatctcgacacagcagagaacttctgctcgtatacgaatacattccaaatggaaccgttgctgatcacctccacggccaaagagcgaaacctggcacacttgcttggcacacaagaatgaacattgccatagagactgctagtgcactggtgtatctccacgcctctgaaatcatccacagggacgtgaaaacgaataacattctcctcgacaatcacttcagtgtgaaagtagcggattttggcctctcgcgtctcttgccaacgcacgccacacacgtttccaccgcgccacaagggactccaggttatgtggatcctgagtacaatgagtattaccaactcactgataagagtgatgtttatagctttggagttgtgttgattgagctcatatcatcgatgcctgcggttgatatctcgaggcgtaggcatgagataaacctgtccaatatggccattaagaagatacaaagtggggcattgcatgagattgtggacactactcttgggtttgagacggatttcaaggtgaggaaaatgatcagtgctgtggctgagttggcctttcagtgcttgcagagttcaaaagatgtgaggccctctatggcagaagtgttggataggctagaggatattagaagtgatgggagtcataggagcaagcatgaggtgctagatatatcagaagatgatgctgctttgctcaagaatgtgcctcctccaccttcacctgattcacatttggtgaccatttctaattctacaccaccaaatgatagccagtga

SEQ ID NO: 57882 - DNA, 1887 bp, Glycine max
  Peptide Sequence Number=SeqID_174660
atgggttgcgcgagctcgaagaagacggttgccggagccggcggctctaccccggaggggccatgcatggtgcgttcgagttcgcgaagacagggcaataatgggtcggggcggaaccgaaaaggtgtcgcggcggaggcgcgtgagggggaggcgcgtgagtggagcaaggggagcttgagaggggggactgggtcggtgtctttaaggttgtcgtgtaggtttgtggaggctgagcagaatgcggctgggtggccaccttggcttacttctgttgctggggaagccattcaagggtgggtcccactcaaaacagattcttttgagagattggataagattggacaaggtacatatagcagtgtattccaagcacgcgaagttgaaactggaaggatggttgccctgaagaaggtgcgctttgacaaacttcaagctgaaagcattaggttcatggcaagagaaatactaattctccgcacactggaccacccaaacatcatgaaattggaaggtataatcacttcacaactatcaaatagcatataccttgtatttgaatacatggagcatgaccttgctggtctagtagcttctcctgacataaagttcacggactcacagattaagtgttacatgaggcagctattaagtggaattgagcattgtcaccttaaaggtattatgcatcgagacattaaagtatctaatatattagtgaacaatgaaggtgttctcaagatagcagattttggattagccaatacccttagtccaaatagtaagcaacccttaacaagtcgtgtggtgactctatggtatcgtcctcctgagctcttgttgggatcgacgagttatggagtttcagtggatctatggagtgttggctgtgtatttgctgaactttttctagggaagcccatccttaaggggagaactgaggttgaacaattgcacaaaattttcaagctttgtggttctccacctgaggagttctggaaaaagaataagcttcctctggccacaatgtttaagcctaaggctaattacgaaacctctcttcaggagaggtgtagaggctttcctgcaactgctgtaaacctactagagactttactttccattgatccttccaagcgcaggactgcctcctctgctctcatgtccgagtatttcagcaccaagccatatgcttgtaatccgtcacacctgccaaagtatccaccaagcaaagaaatggatgccaaaaatcgggaagaagtgcgcaggaaaaagaatggaggtaaagtgagagaggctgtgacatcaaaaaggcaaagacaagtccacaaagtttcccatgaccatatcaatttcaaccaaccagctttgaaagaggaaatgcagaatgtttctcaaaatcctggtacaaatgatggtagggcatatgttacaaaaggaaaagtagcaggagctatgcataaagagcaaccaaagccttcatatgatgcaaagtcagaggctgcccaagtggtgaatggttgcaatggatacagtgtatactcaggaccggcaccaatctcgggatctagtggctttacatgggctaaaaggagaaaaccaaaagcttcatccatattgtcagatggctcaagaagcaaagtcagtgctctggatccaacctttgcaaaaggtacatatgatttaacagaacatgggatagaagtttcagaaaggaaacatagttataacacaagccatcgggatgagacttccagctatgtatcaaaaaagtaccaggctcctctcgttcaacaaaaatcattcgatgtagctgatacatacaactcaaattattacatggactttgatttcacagataaaatggatgctttgatagacactcag

SEQ ID NO: 57883 - DNA, 165 bp, Glycine max
  Peptide Sequence Number=SeqID_174661
atggaggagcccatagcttttgtgatgaaacatagacggatgcaaaggctcaacctcaattcaagccagggtgggccattatacatgttgttctttgccatccattatatggcatcaatcctgatggagacatggcatgggtgcatttttcttcatcaaaattga

SEQ ID NO: 57884 - DNA, 1788 bp, Glycine max
  Peptide Sequence Number=SeqID_174662
atgtccactcccaacaccgattccggcacggcgccgccaccgcgccccaccatcacgctccctccgcgcccctccgccgaggccttcttctccgccgccgccggcgccagccccggccccatgaccctcgtctccagcttcttcggctccgacgccgccgccgactgccgctccttctctcagctcctcgctggtgccatggcctccccgatggccttctccgccgctgccgcagccgccgacaactccggcaaggacgacgatgggccccacaaggggttcaagcagagcagacccatgaatttggtcattgctcgttcccctgtcttcactgtgccacccgggttgagcccttctgggtttcttaactcccctggcttcttttcccctcagaggggggtgggatcgattgatggggatgtgggattgaagtttggtgattttgggtggactgattcaggagtgtctgaggatttctggggtttgcattatattacatcatttgttggtcgcgctgctgggtctttttctctcgttattattatcaatgtgatctttttgccttggggatggtggatatactcttttgaggttttcactatcgcttcaattcaatgtatacagagcccctttgggatgtcccaccaacaggctttagcgcaggttacagctcaagctgtcctagctcaatcccatatgcacatgcaagctgattatcagatgcctgcggtaacagctccaaccgaaccacctgtacggcagctgtcttttgctctaaatgaagcttcggagcagcaagtggtatcatgtgtatcatctgtatcagaacctagaaatgctcaactcgaagcaccggaactctcacaggctgataagaaatatcaaccatcatcccaggccattgacaaacctgcagatgatggctacaactggcgtaagtatgggcagaagcaggttaagggtagtgagtatccacgaagctattacaagtgcacacatctgaattgtgttgtgaagaaaaaagttgagcgtgcccctgatggtcacataactgaaattatctataaaggccagcataaccatgaaaagcctcaggcaaataggcgtgccaaagataatagtgattcaaatggaaatgtaactgttcagcccaaatctgagtcaaactcacaaggttgggttggacaattaaacaagtttagtgaaaaaattcctgattcttcagttgctaaaagtgaccagacctccaatcaaggggctcctcctaggcaactactacctgggtcaagtgagagtgaggaagtgggtgatgtagataatagggaagaggcagatgatggcgagccaaaccctaagagaaggcaagctaaatttctgcttttcaggaatactgatgttggggtttctgaagtacctctgtctcagaagactgtcacagaacccaaaatcatcgtgcaaacaagaagtgaagttgatcttttggatgatggctacaggtggcgaaaatatggtcagaaagtggtaaagggaaaccctcatccaaggagttattacaaatgcactagtgcaggatgcaacgtgcgcaagcatgttgagagagcttcaatggaccccaaagctgtcataaccacgtatgagggtaaacataatcatgatgtgcctgctgctagaaacagcagccacaacacagctagtagcaattcaatgccattaaaaccacataatgtggtgccggagaaacatcctttgctcaaggatatggattttggaagtactgaccaaagacct

SEQ ID NO: 57885 - DNA, 642 bp, Glycine max
  Peptide Sequence Number=SeqID_174663
atgctgggaactgcactgcaattcagcggcgttcgcggcgaggatcggttttacattccggtgaaggcgaggaagaaccagaatcagcggaaacagagtcacagagccaagaacaacgaacctgaaaacgcggatttagcttcgaagaacaaagtcgatgtctctgaaaatagcaataacaatagcaacatcaaaagcaagagcgatagtaatctcaaccaatctctgaaaccaactctttctccgtccgtagaggctgtcagtaatatcgataggttcttggagtttacaacaccgtcagttcctgctcagtatttctccaagacaacgatgagaggatggaagttttgcgatgtggagtatcagtcttactttacattgagtgatctgtgggagtcttttaaggagtggagtgcgtatggagctggagtgcctttggtgcttgaccaaagtgattctgttgttcagtattatgttccctatttgtcagctattcaactctatgctcactctgctgagaagtcaagtgcaaagccaagccgacaagggaagcttaaaactaccctgttcttccctgtcaataacgctgatctctccccacagttaagcatcttcaacccatccttgccacttagaccatag

SEQ ID NO: 57886 - DNA, 312 bp, Glycine max
  Peptide Sequence Number=SeqID_174664
atgattgtggtgatactggattccaaccaggttttcatcgtcgtgagcctctgcaccagaactaacacttatgtaatctacgtcgatccgaccaccgacacgctccgccacaaggccaagctaggattcaatttgttcaagttacagggcaaggccttggatttcatcaccaagggattgcgctttgcctacaggagcaagatgttcacgagggtcctatataacaggcaagcactaaccatggtgtgtttgagaattgtgaaagcatggtgtcccaatgtgcccatgatgacgggatgtcctgccctctag

SEQ ID NO: 57887 - DNA, 270 bp, Glycine max
  Peptide Sequence Number=SeqID_174665
atggttgaaaaatcgatgtggaaaataaacattttttacaaggacgactacaaagaagttggatgcatggagatgggagagaaggatagagggattgggtcaacaagcgtcaataatacatatagacgtgcttccaacatccaagcaagttgccaattggcactgtccttatccgagactttcagcactcactcagtatccggcgtgagactcaaccctacctcgtcaacacaccaaaattatcggttaaattattcacttgaattttaa

SEQ ID NO: 57888 - DNA, 516 bp, Glycine max
  Peptide Sequence Number=SeqID_174666
atggacaaggacaagtctaatactcacagctttcttcacagtattgttaaacacttcaaattcggttcccctaaagagcgaaacaatgaagctgacatacagcaaatggctgcacaggagcagaagatcttcgcctacgaaaccttggcagctgctactaagaattttagtgctattcataagcttggtgaaggaggctttggacccgtctacaaggggaagctgaatgatgggagagagattgctgtgaagaagttatcacacacttcgaaccaagggaagaaggagttcatgaatgaggcaaagttgttggctcgtgtgcagcatcggaatgtggtgaatttggtgggctattgtgtccatggcaccgagaaactacttgtttatgagtatgttgctcatgaaagcctagacaaacttctattcagtaagttcttctatgccaaccctttattctgtccaacaaaaatcattgatgaaatgaatcctatgtttcaaaaagttgcttccagttag

SEQ ID NO: 57889 - DNA, 945 bp, Glycine max
  Peptide Sequence Number=SeqID_174667
atggaggctgaggttttaagagctaccatgtcaccaccaccttttcctctgtctggttcttcaacaaaaactcacagggcttgctttcccttcaaccccatctcatggaatggcaaaacattgggtctttctcttcaggcatttcccccatcatcctctggacatgtgccatcagagaaaagtgatgatggaagtgaaaacctgacccttgaaagtataagacgtagtttaattcgtcaagaggatagcataatctatagccttttgaagagagcacaacatttatacaatgcaaaaacatacgaccctgaagacttctccatggatggatttcatggctcgttggttgaatacttggtcagggaaagtgagaagcttcatgcaaaggttggcagatacatgtgccctgatgagcatcctttctttcctcatgacctacctgaatcaatgttaccttgtcattacgctcaggtattgcatcataatgcggattcaattaatataaatgatcaagtctggatgatgtattttggagatcttatcccaagattagccaaggaaggagatgatggccattatgaatccacttctatttgtgatataatgtgcttgcaggctctctcaaagaggatccattatggaaaatttgtagctgaggcaaaatttcaagcaaatccggataactataaagatgccattttagcccaggacaaggataggttgatggatatgctaacatatccgaaagttgaagaggaaaacatgataagagtagaggaaaaggccaaaaaatttggcctagtagtggatttaaatgcaaagaagcctcgagctgagccactgtacataataaatccaagtgtggtttctgatctgtatggccattgggtcatgccattgacaaaggaagtgcaagttgcatatttattgaggaggctggactaa

SEQ ID NO: 57890 - DNA, 324 bp, Glycine max
  Peptide Sequence Number=SeqID_174668
atgtttgtgaggggtgtaaggtacaccagtgaagacagtgagggtgattactacagagattcatgtagtgaaggaagtagtgattatgaatatggaaaaaggactgaatttatgacacaaagaagtagtcagcatctaacaggtggtgtctcactgaaaatggacacactatctatgcatgataaatgcagtacagtgcaagaaggattttcaagtgatgatagtgaaactgggaatcctcaagatctactattcgagtattttgaacaagatcctccttatagtcgtgaaccattggctgacaaggaaattactgatccttag

SEQ ID NO: 57891 - DNA, 1968 bp, Glycine max
  Peptide Sequence Number=SeqID_174669
atggatgatgcagaatcacaaaagagagagcagcttgattggaaacgtaggattggaataatcacaggcgtggcaaaggggttgctttatcttcacgaagactcacacaattgcatcatccatcgcgatatcaaggcgagtaacatcttgcttgatgataaatggacgccaaagattgcagattttgggatggctcgtcttttcccggaagatcaaagccaggtccatacacgtgtggctggaaccaatgggtatatggctccggaatacgtgatgcatggaaatctttcggtgaaggcagatgtatttagctatggagttttggtattggagttgatcaccggccaacgaaactcttcttttaatttggacgtggatgcgcaaaatctgcttgattgggcatacaagatgtacaagaaagggaagagcttagaaattgtggattctgcattagcatctacgatagtagccgaagaagtagcaatgtgcgttcagctgggtctgttatgcactcaaggcgatcctcagctacgtcccacgatgaggcgcgtggttgtgatgctgtcgaggaagccagggaacatgcaagaacctacgagaccaggagtaccaggttcaagatacagaagacctcggagacactctgcattgtcttccacagtgggtacctctggtgcctctgattcacacacttctgattctagtaataattataataccacggttactactagtgccacggggactatctcagctactgcagaaacagacccaaaagggaaacgtccaattcgggaggcgatgaggagaactctggtgagaaatggcagtctctacactcgcaaccttcttcatcactccgccctcgcacttgccgcttcatctcgtcctcaattcagactcttttcctccaatgaaaaccccccaccggttccccaaatcgacgacgtgaacaacaaagagctgaaagcgcagatcgagacctacttcaagggcgacgagaaggtgctcccgtcgatcatggaggcgattctgaagcggaagctgtcggggaatcacgaggacaccgacgacgagctcatggaggagctccgcatgcgtcccctcgacgacgtcgacgaccgggactttgagtccgacttcgagtccattcacgacaccgacgaggagatcgacgatttgtacaacgccagggacgtggtgatgaagaggatggtgaaggatgagtacttcaacatggatgataaaaagtgggatgacattgttgaggacgggatcaagcacgggcttcttagggacaccaaggagtgcgaggagattctcgaggatatgctcagctgggacaaactcctccctggtgaacttgaacctgaagaagcttacgaacagtttaagaagtttgaggatgagattgtggcgaaatacttggacaaaatggaaaaagaggaggcctcacagtttgatgatactgttgtgccagataagaaaaaggacttggatgatccaccgggtgaaggtccaattctgcggtggcaaactcgggtagtctttgctcctggtggtgatgcttggcatccaaaaaacaggaaagtgaaactgtcagttaccgtgaaggagctagggctttcaaaataccaatttcgccgtctcagagaattggtaggaaaacgttatcatccagggagagatgagcttacaataactagtgagaggtttgaacatcgagaagaaaacagaaaggactgcttaaggacccttctctctctcattgaggaggcagggaaagctaataaactagtggatgatgctcgatcttcatacgtaaaagagaggcttcataccaatccagctttcatggagaggctgcatgcgaagtcaatgaggttgcgagaatctaatcagtcttatcatgggttccggttgcagaaacaacctccctgcttagagcgtaaggcctcttacatctga

SEQ ID NO: 57892 - DNA, 174 bp, Glycine max
  Peptide Sequence Number=SeqID_174670
atgatgagggtgagttccatgttagaacttcgcttcactaaagtgacctgggagtctcgcatagtgaggtatcttcttaagtaccacccctacggtttaactctgaatgatatgccagagtgtcgagaactacttcccaagaggtttaatgaattttcagtgtatatgagataa

SEQ ID NO: 57893 - DNA, 189 bp, Glycine max
  Peptide Sequence Number=SeqID_174671
atgaacaaaaagttatcatttgccactggtaattcgcgttgctctcgaaggtatttgattaaagcaattccagatataagagaacacaatagatcggtaagaactctaactaaacaagaaagtaatggctgtcgagttagggcaacagacagtggaggtatccactcttgtcacatccgtcgctcatga

SEQ ID NO: 57894 - DNA, 333 bp, Glycine max
  Peptide Sequence Number=SeqID_174672
atggcccaaaacattaggaccattcctcttccaggccgaaatacccatgatcctattttctggaagcatactcaacatagtaattacacaattaaatcagaattgatccctctgtctcaaatttctctgactggattaactcttggattatgtccaaagaagagtagaggcaacaaactacttcttctgtctcatatgggccatttggcaaagaagaacatatgggtttttgagaacaaaaagcaaattttgcggcaaactctggcagtagcagactctatgtattaccaggccaacacaagcactggtcacaatcacactctcaagaggtaa

SEQ ID NO: 57895 - DNA, 282 bp, Glycine max
  Peptide Sequence Number=SeqID_174673
atgacactgtatgcgaaaagtacaacattaacaaggagaagtggacacaattttgtcagagctgtagagacccttcgtgggaggatgtgcgaaagaaggcacaagccatctagaaacaaaacattgcccctcacgtgttgtctcgtgggggattccttggaggagcaggcctcacagggttcctttgttgcccatggacgtcaggatgtactgactactatcattgggcgaccagaacaccctagtcgtgtgcgtgctactggagccagtgtcatgatctaa

SEQ ID NO: 57896 - DNA, 240 bp, Glycine max
  Peptide Sequence Number=SeqID_174674
atggctccgcctctccctaaaggaacatttttcaatgttggtagcgcacgcgggatcaactactttcgccttgaagagttggatatgagatgtgttacggatatcaacccgggcggcacctgctacggtacctatgcatctagtccaattgctagattggatgctgctcgaaaagccctttttgatttgagagtacttttcttgcctttgagttggcttcacccggccgatagaaagtga

SEQ ID NO: 57897 - DNA, 777 bp, Glycine max
  Peptide Sequence Number=SeqID_174675
atgaacgaccctctccatgagtcgatctcttgctttctcataagggtggacccttgggtactagtacctatcaccttcagagggctacacgtcctcgccttcagaggactgcacgtcctcgccttcagaggactgcacgtcctgaccttcagaggactacacgtcctcgccttcagagggtcatttaccctcaccttcagaggactacacgtcctcaccttcagagggctacacgccctcgccatcagaggactgcatgtcctcaccttcgtagggctacacgccctcacctttagaggaccacacatcctcaccttcagagggctacacgcccttgccatcagaggactgcatgtcctcatcttcagaggacaacacgtcctcgccttcaaagggtcatgtcccttcacctttagaggaccacacgtcctcaccttcgtagggctacacgctctcacctttagaggaccacacatcctcaccttcagagggctacacaccctcgccatcaaaggactgcatgtcctcaccttcgtagggctacacgccctcacctttagaggactacacgtcctcgccaacagagggctgcacgccctcacatttagaggactacacatcctcgccaacagagggctgcacaccttcacctccagaggactacacatcctcgccttgagagggctgcacgccctcacctttagagggctacgtgtcctcattttcagtgtgctccacatctgcaccttaagagaatttaaggtcctctgtccttaa

SEQ ID NO: 57898 - DNA, 828 bp, Glycine max
  Peptide Sequence Number=SeqID_174676
atgtcaacccgcgaccacctcaaaacctgggccagacgcatcaagcgcgacggcctgaccctctggttcgccggcaagcacccccgcacgccctggcacgccaaggcgctgggcgtgttcgtggtggcctacgccctcagtcccatcgacctgattcccgacttcatcccggtgctgggctatctggatgatgtgctgttgctgccgggcctgatctggctggccatcaagttgttgccgccagatgtgctgcaggaatgccgcggccaggcggacgcgtggatccaggccaagcgcgaaaagccgcgcagccgggaaccccagcgtgcgcaattccgcgatcgcgcccagttcctcgtcgcgccgtttcttgggcgcgcccagcgatgcggccagcagcatggcaggcttgtcggattcatcgaagccgcgcagcacgctgtcggcaacgggaaaggccttggcgaagctcgcatccagcgcctgttggccacgatagcgcccgcgcttgtccaggatcacctgcgtttgcggatcgcgccggatcaggtgcagcggcacgccttcgcaacgcagccccaacagcttggcttggctgatgtccagcgcccaatcggtctcggcatagaacgcggcgcgggcggtctcgaactgctggagccggtccgcatccgtgctgaacgcttcgggcgtcatgttcaagttgatcttgccgatcttgcccttgagagtgacgcggcgaaagagcgaggcccacaccagcaggatgggattcgtggacaggtcttcgaccaccacgtcctcgaacacgcacggcttgatctctga

SEQ ID NO: 57899 - DNA, 648 bp, Glycine max
  Peptide Sequence Number=SeqID_174677
atgcaggttgtacatcgagaaaaattcttcccactggttgccctaggaagagtttatgagggatccacagcggttcacaacatccctttgttgcatggccaagtgaaggttggtgttgaggaggttaaagatgcagaggctcccgttcttgtacccactaacgaggttcaactagtggggcaggcactgaacaccttccttgcttggctgacacatcttgtgaagcatgtattagaacaagcagttgtgtctccaacaaaacctccagatagaccaaatcatgagcttttcttgaagcctctccaggttatgtgggatgctaccgtgttcggggtgtttaatcaagacttcccattgtacatcaagcacgaagatctctctaaaatttcacacggtggtcaatgtctcagcatatctgttatacagttgtggattctacatctgactaagacaagtatgcgagcggggaattccgatgtgaatggattcctcgagccacaatccattcagagatctgggcaatcacagtttgaatcagaaagttacatcaagagttggatgcagagctcaaaacacgatatctaccttggagcctacctgaatggaccattggaagcagagagattgaaggcgcttcgcatccagtag

SEQ ID NO: 57900 - DNA, 145 bp, Glycine max
  Peptide Sequence Number=SeqID_174678
atgaaaggaggaaaggccaagacaaaattgaagagagcttatcccaaacttgctgtgaacaagaagggagcagccaccaaggataggaaacccgtgggcaaggggaaggcagtgaaagaccctaacatgccaaagaggcctccaa

SEQ ID NO: 57901 - DNA, 162 bp, Glycine max
  Peptide Sequence Number=SeqID_174679
atggttaaagcacgtcaaaaggggggaaaaagagggatgtggttgccgccaagctcgcccaggcgagttgggttgcttccaccagaaggcaccgccttctgctggaaccccctggaaggcccaagtgggcctggttgctatttgcacacccctttttactaa

SEQ ID NO: 57902 - DNA, 805 bp, Glycine max
  Peptide Sequence Number=SeqID_174680
actaagcatttatgagcccgttgaacataataaccctgcactctctcccaacttcgaatttcctgtctacgaggctgaagaggaggaggatgatgagatcccgaaggaacttgctcggttattggaatatgaaaagaaaaccattcggcctcatgaggaggtagtagaggtgattaacttgggaaccgagaaagataagaaggaagtcaagatttgggggcatcgcttgaggcaactgtcagacgaagggatatgcccgggcttggatccccgtattgtggaagcaccgagtgaagtacagaagcagatcgatgcaggttttcttatcacatcagagtatcctcaatggttagccaacatagtgcctgttccaaagagggacggcaaggtcaggatgtgcgttgactaccgagatttgaacaaggctagtccgaaagatgactttcctctacctcacatcgatgtattggttgacagcgctgcaaagtccaaggtcttctccttcatggacggtttctctggggtaatgccctttgggttgataaatgcaggtgccacttaccaaagaggcatgaccactctctttcatgacatgatgcacaaagagatagaagtgtacgtggatgatatgattgtcaagtcaggcactgaagaagaacatgtcgagtacttgctgaagatgtttcaacggctgagaaagtaccaacttcgactgaatcccaacaaatgtacctttggtgttagatctggaaaactcttaggtttcattgtcagtcagaaaggtattgaagtagatcctgacaag

SEQ ID NO: 57903 - DNA, 744 bp, Glycine max
  Peptide Sequence Number=SeqID_174681
atgcgatcagagaagaaccacagaaacatgcgatcagagaagaaaccatggtcgccactcctctgtgacgaactcatcgagaaaatcttgtctcgtcttcccgtgaaacctttgatccaattcaagtgtgtgtgcaaaggatggaactccctgatgtcagatccctatttcatcaaattgcaccttagtaaatctgctgcgaaggacgatttggaacaccttcaactgatgaaaaatgtatgcctcggatccatccctgaaatccacatggaatcgtgtgatgtaagttcgttattccattccctacaaattgaaacgttcttgttcaatttcgcaaacatgccaggctaccatctggtcggttcatgtaatgggttgcactgtggggttagcgaaataccagaaggataccgtgtttgtttctggaacaaggcgacaagggtgatatccagagaatcaccaacgctgtctttttccccgggcattggtcgtagaacaatgtttgtgtttggctatgatccgtcaagtgacaaatacaaggttgtagcaattgcattgactatgctctcacttgacgtatctgaaaagactgagatgaaagttcatggcgcgggtgacagtagttggagaaaccttaaaggttttcctgttcttgggactttacctaaagttggtggagtgtatctgagtggaacccttaattgggttgttattaaaggaaaagaaatcattcattctgaaatc

SEQ ID NO: 57904 - DNA, 339 bp, Glycine max
  Peptide Sequence Number=SeqID_174682
atgttgtctatgaaggctagagagggaacaccaagtttacctataccagagatcttccccttacctatgcctccaaagccaattgtaactccttcatgtggctttagatctaggaacatagacctttccctcgtcatgtgtcaagagcatccattgtccagataccaattgttataccctaatttcgtccggggactatcgtttgttgatcttttgatccttgctagtcgacttacgatgttgaatgccagttacagtgcaaagcaaggaaccattcagtgttccgatcaggaatgcaaaaaataccaaaaaagagggccaaaagggtcttttcattga

SEQ ID NO: 57905 - DNA, 135 bp, Glycine max
  Peptide Sequence Number=SeqID_174683
atggcttccatcattgtgatcatttactctttcatggccttcatgtcagccttcatctgctcttgcacctcctctatttcactcattactctagctctgacacgtgttcgaggaaaatgcaaggattatgcatga

SEQ ID NO: 57906 - DNA, 894 bp, Glycine max
  Peptide Sequence Number=SeqID_174684
atggagctcaacactaaagctagatacactctgacatatgccttatcaaaaaataagtacaacaagatttgtagactgagaactgctaaagagatctgggactcattgagcataaactatgaaagcactgaagatgttggcttgaggaaagtcgtgactctgactagacattataaaagcttcatcatgaaggatggagagtttgtggatgacatgtttggaagacttcaagttcttctaaacaatctagaggctcttggacataggtactccaagactcagataaacttgaaggtgctggacaactttcctaaggtatgggaacccaagaccacaactatccaagaagcaagagatctgaaaaatcttgcatgggatgagttgttaggcatcttgagagtccatgaagtccaccttcaaaatagggagcatatgcaaaaaaagaattttgctactcttaagtctgaagagacaagcttcataatagaagaaaagaagagcttgtctaaagctctgaaagtgcagatacaagaatctgatgaatctgacaactctaatggatccataaatgatgaagtgactctcatgtccaggaagttcaaacagatgatgaagaagaagggaaagtttcaacattcctctagatgtttaaatcttcaactaaagaagaagagatactccaaggacaagaagaagaaaagtttgatggttacctgggatgactcagacagtgagaagagtagcagtttagacaacgaacaagacaacatctgtctcatggtagatatagatgataaggtcaagtgtaaaaagtttaaagaaaaattcaaagcttctgcttctgaaaacactaaattaagtaaatcaaatgaggatctgaaaaagaagatctag

SEQ ID NO: 57907 - DNA, 296 bp, Glycine max
  Peptide Sequence Number=SeqID_174685
atgaatttatatggtacaaccgaagtgaaagttgaggattttagcaatgaacctccacaattaagccagatcaacttggaggaaacttataatgaagatatggtgaaggaagaagagggtattaatgcatttcccagctatgttgctagccaatatttagatgttgtggagaatggtaaaggtaaaaggcccaagtatgaacatgatgatgatccaatcacttgtcttgaaccttcttgggtggaagaaacggttgatgttgtcatttccaaaatgtcgagatgtcctaaaccaag

SEQ ID NO: 57908 - DNA, 513 bp, Glycine max
  Peptide Sequence Number=SeqID_174686
atggtgactgacaatggtagacgacgagaagcaacaaaaacagcggaagaggatcacacttgcccagtagagacagtggctaacagcagagaaggaaaacacaggaccggaagtagccatttctgggatggaactatcaagctgtcaataccgaaaatagggactgaaatgtgcccagaaagagactacaaagctgttaaaactggggctggaccgtacccaggatttcccgacaaagtgactggaggtggttcggcgatgtttcgatggctagaaggcagcgcgtggccttcacgcgccgaaaatgatgcgctgctgtggtggcgtgtggcgacgctgctgctcacgcgacttgcaggggtgggtcgtgctcctcgaggcgcacacaaccctggtttcgtcggaaaatttgacggcggcagacggcggcagcgacagacagtggacagcggacgacggtcggcggccggaataggtcagaatgggatcattcccgctctgataccatgttga

SEQ ID NO: 57909 - DNA, 282 bp, Glycine max
  Peptide Sequence Number=SeqID_174687
atggtggaagctaatcaatcatcttatggaatctatgctgcttttgcaagtgaagccgataataagaaacaagcggctactgcagtcttcaaaattggaaaaataactactaagattgtcaaaatgaagaaaaagatggatattgatgacatcttcgaaataaagaaaaagatggatactaatgtcatcgaagaaaagaaggaaaagatggatattgatgccatcaaagaaaagaagaaaatgttggacgataaagaaaaatcaaaagatgtttttgagtga

SEQ ID NO: 57910 - DNA, 216 bp, Glycine max
  Peptide Sequence Number=SeqID_174688
atggaggccatcaaagcaaagatagagaggctactaaaggccaatttcattcagaatacaagagatttaaatgcaacaacacctaaagatgaatatcctatgccagatgttgatatgctagttgattcagcaacagaaaatgagattttaagtttattagactggaacaccaagaagcctttgatgacatcaagagatatcttgctaatccactag

SEQ ID NO: 57911 - DNA, 402 bp, Glycine max
  Peptide Sequence Number=SeqID_174689
atgaagaaatcttcgccagagaagccgttctgcatgctcggtatgcatgttgtgccttttggagctgtggccggagatagagtctatcttttccattctacgtgccattgtccttcgctgcagctcgtccgtgtcaatgccctcgtcgcccattgccttcaacgacgctgtgaacatgtagtttctatcgatggagacttcactgctgtgatagagccgcaagacaacaaacctgagggcagaaggcaacagcggcaacgaccagtcctcctcctccctcgatggtggcttccagagcactccctttgcgtggagcctctagaggtggcgccactaatgctcctccataccgtcaacatctttcgagccgatgaagagagagagagagagagatggacataa

SEQ ID NO: 57912 - DNA, 492 bp, Glycine max
  Peptide Sequence Number=SeqID_174690
atggggaagtggcaaggaaacgtgtgggagtgtgaattcatatggagaagggagtggtttagttgggaattaccttttgtggaggactttgtcaattttgtgtccaataggaggaggtataggggagaagtaaacaaatggatttggaaggttgagagttctggaagctacacggtcaaatatgcatatttggcatttaggaacacggtatttggctctcatgctacttatggttcgacatacattctatcttctcgaggcttctacaacaatattttcatcaacatgtgctaccatcaagttcggggatatatagggaatagaaggtggaagattctttggtgtgcaaccccatgggttatttcaaattggagaaatgacaatagttttagaggaaatacaggggcatgcatacaatcttatgagaaaaatgctcatgctgattgcagcacagtctgtgctatatttgcacgccatgctattccaacatga

SEQ ID NO: 57913 - DNA, 372 bp, Glycine max
  Peptide Sequence Number=SeqID_174691
atgggcaatatcgtcggcggttcccatcagttcaaagcggtagagatagggaacctgacatttctgcgcaatgatgtcgcccgccaggcagaagcccgcgccaaagttgcgattgcccgcagcaatcacaccgcgaataccgcgccggcgctgcgtggcgtcgagcggaatacgccgcgcaggcaggccgagacgggtgataaaccggtgcgtgttttccgactggctggaaaaatagaccagtggaaacatcgctttatcccccgacggcagcgagctggcgcaggccggcgattttatcgggacggaagccgctccagtggtcgttgtgcgtcatcaccacgggcacctggcgatagccaagcgatttga

SEQ ID NO: 57914 - DNA, 129 bp, Glycine max
  Peptide Sequence Number=SeqID_174692
gctagacaactctcgaaaaccataggaggtggaatgagacagattggcctcctatgtgccgctacatttgttgcatttcaggaaaatgttgggaggctggaaagtgatcacaagaaagctagactttag

SEQ ID NO: 57915 - DNA, 663 bp, Glycine max
  Peptide Sequence Number=SeqID_174693
atgaaggggaggttcatgtttctgtcggtgctcctttgtgccacctttcatgtctccttctccattactgacggttcaaattttgttctcatcattgtatgcttagtagcaaacggcaacttcgagctgggtccgaagccctccgccctgaaaggaactgtggtgattggtggcagccactcgatcccagaatgggagatctctggcttcgtggagtacataaagtccggccagaagcagggcgacatgctgctcgtggtccccgagggggcctacgcggtgcgcctcgggaacgaggcctccatcaagcagaggatcaaggtgatcaagggcatgtactactccatcaccttcatggtggcccgcacctgcgcgcaggaggagaggctcaacatatccgtcactccagactggggcgtcattcctattcagactttgtataccagcagtggttgggacccgattgcattcgggttcaaggcggagaatgagacagtagagatgttgattcataaccctggcaaagaggaggatcccgcgtgtggcccgcttgttgactcggttgctctcaggactctctaccctcctagagctactaaccgagtgaaatcaagcgcatacttgtcttggtactttgagaatagtttaatgttgtataattaa

SEQ ID NO: 57916 - DNA, 642 bp, Glycine max
  Peptide Sequence Number=SeqID_174694
atgatggatgctagaggtggaaaaactgttgtgatgtatacctcattaaaggttttagcttatttcattcatcacaaaaggagaatagttgcaaaaccttcccttgaacactttcttagtctatgtaagtttgcattttcttcaatttcgatcaactctgtaggaagtcctcaagacaatttgtcccaacaaaatagtatcagagctatgacatttgtgaagtttgatgttgagaaaattactggtgatgaagttttggaagaagtctctagagaaaaagctgtcgacatgctttgggaaaagcttgaaagtcagtacatgacaaagtctctccataggcatctttgtctgaagaaacaattatgcaccatgcaaatgcatgaagcatgtaacttccacatgatgcctaacagagattggtttgtcacgttccaagaggttgaaggtggaaaagttctgatggggaatgatggtgcttgtagaataattggtaaaggtataatgcaaattaagatggttgatggtattgtgagaacatcaaccaacatgaggtatgtgcccaaactctgcaagaatttaatttctttgagcactttagactttcttggttgttcataccgagagctgaagatgtattgttaa

SEQ ID NO: 57917 - DNA, 162 bp, Glycine max
  Peptide Sequence Number=SeqID_174695
atcatggttaggaccagaggattaggtcatgccttaggttacgttacgggcagaggtgtgggcagaggagatcgtgatgattacgatgacgctccacagcgtcaacggcctaccacatccgcacggaggcagcgagttcctgtgatctgcggcacacgatga

SEQ ID NO: 57918 - DNA, 438 bp, Glycine max
  Peptide Sequence Number=SeqID_174696
gcctcgcctgattactggtccaggccggctaggaatattaggaaaattgtttgcattaatctcaaaaggcttacccgtaccgatgattggaaatggtaacaatcgctatcaaatggtaagtgttaatgattgcgttgatgctgctatccttgcagttgataaaggttgtcctcatgggccatttaacttagggtctactaacccgcccactacaaaagaattgctgcatggtattattaaacatgcaaattcacgttcaatcgttatccctattccatcagcgatcatcaaaccagcattatcagcacttgataaatgcggtctcactttattgtatccagagcagttcggtattgctgacaaagatgtcctattggataccattgatactaataatactcttgggtggaaaccctctcgtaaagatatagatgctat

SEQ ID NO: 57919 - DNA, 381 bp, Glycine max
  Peptide Sequence Number=SeqID_174697
atggcagaatcttcaaagaaacgaaagggatcctcctccaccaccactactgtaggccaccgtcaccatggaacattcgatgacccaccagcatccattcctccttccttttcatctcccagtcaaggagttccttttgagggcactcttgttgatgactggaaacatgtttattcaagtcatgatgctcgaaaaatggtttgcaatgaccatgctggcatgactagcaaattgcttgttgggtcatttacctttgagtgccgcatcatgcaccatattctttgtcgaattttgcttcctaggtctactaatcttgcccaagcctctgaggaggatttaatcttgttatgggctcttcaagctggtcatcagattgactga

SEQ ID NO: 57920 - DNA, 708 bp, Glycine max
  Peptide Sequence Number=SeqID_174698
atggagtttggccaaatggcatcccaacacttacccttgaatgaggcagatatacaagtatttggtgcacatgatcattctacccacttggtgaccttggcaaaagtatatgagggggcgtcgaccatacaccacgtgccttatgtagatgatgtggtcaagatgagttttggaaaagtttgcgacagtaacactcaagccccttttcccactttaaaggttcagtatgtgagtcaagccctcgacacattcattgtgtggcctaaacatcttgtgaaacctatttcacataaggattcacaaatatgtccaaagaaacaagttgaacctgttcataggtcaaaccccattggtggaattgaacccttaggtgatttgattaagaatttgtatgatccttacgagaagcctcttgagtgttgtgggatggaactaaatttaggattccaaatatttttgaatgagttgactataaggttgggtcatggtttcatgtatggattccttgagtctcaatccatacataatgcaaaggatagacgtgatgaatgtcaacattacattgaaacatggttaaaggaatcacaaagagagctctaccaaggaccttacttgaatcagaacgttgttgagtggttttgttccttgcgtaagaagcttgatattcacatcaaagccgcaattaacaagttaagttttaaattataa

SEQ ID NO: 57921 - DNA, 2886 bp, Glycine max
  Peptide Sequence Number=SeqID_174699
atgatgaggctgaactttctcctttgtttctgtttcttcactctcgtcgtttccgaaaccgacccgaacgacgtgaagattctaaacactttcagaagagggttgaacaactcagagctcttaccatggcccgaagaaggaggagacccgtgcgggagcccaccgtggaaatacatcttctgcaacggcaacagagtcgctcaaattcagaccaagaacctgggtctggtgggcccacttcctcaaaacctcaaccaactcgtcatgctcgagaatctgggcttacagaacaacaacctcaacggtcccttgccttccttcaagggcttaaataaccttaaatacatttttctcggtcgcaacgacttcgattcaatccctttagatttcttcgagggactgaagagtctcgaggtcttggctttggattacaacgagaagcttaatgcaagtagtggcggctggagttttccggcagcgttggcggattcggcgcagctgaggaacttgagttgcatgagctgtaatctggtgggccccattccggggttcctcggggacatggcgtcgctgtcggtgttgctgctgtcgggaaacaacttaaccggcgagattccggcgacgctgaacgccgtgccggcgttgcaggttttgtggctgaacaaccagcgtggtgagggactcactgggaagattgatgtcttggcgagtatgatttcgttgacgagtttgtggcttcacgggaataagtttgaagggagtgtgccagatagtattgcggatttggtttctctaaaggatttggatctcaacgggaatgagtttgttgggttgattccgagtggtttgggtggaatgaagttggatagattggatttgaataacaaccatttcgtgggtccgatcccggatttcgcagcgagtaaagtgagctttgagaacaatgaattttgtgtggccaaacccggggttatgtgtggttttgaggtgatggtgttgttggagtttcttggagggttggggtatcctcggattttggttgatgagtggagtgggaatgacccttgtgatgggccatggttggggataaggtgcaatggggatgggaaggtggacatgattcttttggaaaagtttaatattagtgggactttgagtccttctgttgcaaagttggattctcttgttgagataaggttgggaggtaatgatatcagtggtgggatacctagtaattggactagtttgagatctttgacattgttggatctgagtgggaacaacatttcaggtcccttgccgagttttaggaaagggttgaagcttgtgattgatgagaatcctcatgtaagtgctccagaaggttctcttccttcaccagtgagtagttcgggttccggttcgggttcgtggtctacgaagggtgaatctcctccagctgataagcataatcctaatccatctggagattctagtcctaatccaaagtctagtagttcttttgagtcgaataagtcttccattgggaaaaagttggttccaattgtggctcctatcgcaggtgttgcagctgtggcttttgtgctcattccgctttatgtgtattgtttcaggaagaaaaagggtgtctctgagggtccagggtcattggtgattcaccctagggatgcttctgatctggacaatgtgctgaagattgttgttgctaacaacagcaatgggagcgtttccacagtgactggcagtgggtctgggattacgactggaagtagcgagtctcgtgttattgaagctgggaacctggtgatatcggttcaggttcttcgaaatgtgaccaagaattttgcgcgggagaacgaggttggacgcggtggatttggggttgtttacaagggggaattggaagatgggactaagattgcggtaaaacgaatggaatccggtgtgattacgagcaaggccttggatgaattccagtctgagattgctgttctatctaaagtccggcaccggcatttggtgtctcttttgggttattcagttgaaggtaatgaaaggattctagtttatgagtatatgccacaaggggctcttagtatgcatcttttccattggaagagcttaaaactggagccactgtcttggaagaggaggctcaacattgccttggatgttgctagaggaatggagtatcttcatagtctggctcaccaaatcttcattcacagagatcttaagtcatcaaatattttgcttggggatgattttagagcaaaagtctcagactttgggttggtaaaacttgctcctgatggcaaaaaatctgtagtgaccaggcttgctggtacatttggatacttggcaccggaatatgcagtgacaggaaaagtcactaccaaagcagatgttttcagttttggtgttgtcctaatggagctgctaactggattaatggcacttgacgaggatcgacccgaggaaacccaatacttggcgtcgtggttctggcatataaaatcagacaaggagaaactaatgtctgctattgacccggccctcgacataaaggaagaaatgttcgacgttgtctccatcattgctgagctagctgggcactgctctgccagagaaccaaaccaaaggccagatatgagtcatgctgtgaatgttctttcaccgcttgttcaaaaatggaaaccattagatgatgagactgaggagtattccggcatagattacagtcttcccctaaaccaaatggtgaaggattggcaggagacagaaggaaaggacttaagctatgtggacctacaagacagtaagagtagtatccctgcaaggcctactgggtttgccgagtctttcacttctgtcgatggccggtga

SEQ ID NO: 57922 - DNA, 210 bp, Glycine max
  Peptide Sequence Number=SeqID_174700
atgacacatttcagctttgttccccatggtcatcaggatttactgaatactgcaattgggcgaccggagtacctcggtcattttcgtgttgcgggagttggtgtgacaatcagccaatattttggacatgcatcgcgtggctccaacaattcaactgcatcgatcaacctacaacagttggctgagataataagaaaccttaaagaatag

SEQ ID NO: 57923 - DNA, 678 bp, Glycine max
  Peptide Sequence Number=SeqID_174701
atgccgcaaggggattacatagagcgtcacagaagagactatggctaccgtcttgatcacttcgagcggaagcgcaagaaagaggcgcgtcaagttcacaaacgttcttcaattgcccagaaggctctgggtattaagggcaaaatgattgccaagaaaaattatgctgaaaaggcacagatgaagaagacacttgttcttagcaacacaattaagcaaaagaggaaggagaaggcgggaaaatgggatgttcctctacctaaggtacgtccagtggctgaagatgaaatgttcaaagtggtccgtactggtaaaagaaagaccaagcaatggaagaggatggttacaaaagctacatttgttgggcctggttttaccagaaagcctccaaagtatgagcgattcattcgtcctacaggattgcgattcactaaagctcatgtcactcacccagaacttaaatgcacattcaatctagaattaattggagtgaagaaaaaccccaatggccccatgtacacctctcttggtgtcattaccaggggaactataattgaggtgaatgtcagtgaacttggtcttgtcacacctgctgggaaagttgtgtggggtaaatacgctcaggtcacaaataacccagaaaatgatggttgtataaatgccgttttgcttgtttaa

SEQ ID NO: 57924 - DNA, 321 bp, Glycine max
  Peptide Sequence Number=SeqID_174702
atgatgctaggtctatatatagagattcttaagatgataaaaattacccagcctgacgaaggggtcaccttcctaggtgaaacaaagggggtggtcatgttgaggaaagagagaagagtattgaagaagcttaaggaggttgatggtggatctgtgtggggtccttgtgttgaaagtctacttggtgatgtgatagtcaagtggcatgttccactggaggtagttggcggtacaagtctaaaagtgtcaccattcggtacttgtggagcagatcgagaacataccagattttgtgcaagcaaagtggaagcggaagcgtga

SEQ ID NO: 57925 - DNA, 207 bp, Glycine max
  Peptide Sequence Number=SeqID_174703
atgacacaagagatgcaaaccatgaaggatgacaaattgcagttgcaaatgcagctgagcatagtgtcagaccaagtgcgagagttgaatgcacaacttggagaggggcgttgttcagattcattaccatgcagccatactgccatagcattagatgtaatagtagatgttgtcggggtgtgcatatcgaaagagtttaagaagtaa

SEQ ID NO: 57926 - DNA, 384 bp, Glycine max
  Peptide Sequence Number=SeqID_174704
atggacattgatccatctcgtggtggtgagagtcaacgtcgttgtatttctacgaatatggaagtggacttgcccgaagccagagggctgagagctgctatggacaagctgacatgtaagattcaaagctacatgagatccatagtgccttgctcagtgaacaccaaaagtgttagatccgttagtgtcctaaacaatttagagaccattcaattggatgactttgatgttaatattcctcaaggacagtcacgtgaaggcctcagcgcaccatttactagaagcatggccaaaatgagtgccaaagggaaaaagatggggaaatcagtggtcgacaaaggtcaaggtgatagcaatgcaacctctaaaaatatagtggattga

SEQ ID NO: 57927 - DNA, 444 bp, Glycine max
  Peptide Sequence Number=SeqID_174705
atggacatagctgctattattggcctcaaaccattgggcaaaacctatgctttgggtttaattgaagatcaaattgaaaggaccgaagtagatataggctttactgctaagtcttatggagcttttataaaaaataatgcaaaggatactcaagaggtttctgacgaagaacacataaattttttaatggaagacatttgtcttaacaaatttctattagcttcagtctataaagtaattggcgaggctgtcaaaattatggatactcttggtaagatgaagcacatagcaagaaccttatggattgtgcaactatggctgaatgccattctagccaatcacataactcctgaaaaggatattcttgatgatctcaatttgaaaatcgaaggagcacgattgacattcttgactccgagtaaagagttctgtacatatgaatga

SEQ ID NO: 57928 - DNA, 1260 bp, Glycine max
  Peptide Sequence Number=SeqID_174706
atggcaggagatagaccaccaagagtaattctagagttctactctagctcctcaacaaaacagtatttcactagtattggcaacctcttccatggtctaccaaatgaagatccatacgctcatctggccacttacatagaaatatgtaacacagtgaagatcgcgggggttctggaagatgccatccgccttaatttgttctctttttccttggccggtgaagcaaaaagatggcttcattcgttcaagggaaacaatttgagaacttgggatgaggtagttgagaagttcttgaagaagtattttccggagtctaaaactactgaggggaagcaactccttgatgcttctgctggtggaaaaattaaattgaagacccctaataaagctatagagcttatagagaatatgtcagctagtgatcatgtcgttctccgtgatagagcatacacatctgcagagaaaagtcttcttgagctcacgtcaagatgcattttggctcaaaataagctcttagccaagcaaattgagaccctcattgagtcactgagggatgtaccctgtgtggtggagctaatgagtcaggcatggggcaatttctctcagaaccagggtcaaggttggaggttccatcctgggaacaacttcaacaaggatcaaggaggttcctccaatcaaggccctaattttaatgagagaaccgccatgctggaggaccccttgactcaattcatgcaagtctctatttccaatcataagagcattgggtcagcaattaagaatttggaggtgttggtgggccaaattgctaagcaattggctgagaaacccactgggaactttgtggcaaacatagagaagaacccaaaggaggaatgcaaggtggtccttacaaggtgcaagaggaaagagaaccttgaaaacaaagagagagttgagggagtggtgaaaggtgttaatgatgaggaagtagaggatgagaggaaaaagaaagacgctaacaataaagagaaagaattgagagatgagaaaaatgaagaagaagaaaaatatgcaataattcagggaattttgccacaaaaattcaaggatgctagaagtgtgaccattccatgctctattgggactgtatcagtaggaaaagctctcattgatctgggggcgagcattaatttgatacctctctctatgagccaaagtatttggaatttgaagattgtcccaaccaggataacccttcaactggactgtggatattga

SEQ ID NO: 57929 - DNA, 243 bp, Glycine max
  Peptide Sequence Number=SeqID_174707
atggagaagctcaagatcggtcactgtagctcctccggttcaagctcaatcaaatggtctaaaaccccatacgctttatccattttatgcgccatgattatgacctccattagcaagtggagcacatcagtgtcgcgcgggttggtgttgagacgctcttcgagaagcctctctgcttcctccttggtgaaggtagtgtcggactcggcgtcggggggagtgagcgggggtgttgatgattag

SEQ ID NO: 57930 - DNA, 654 bp, Glycine max
  Peptide Sequence Number=SeqID_174708
atggatttcttttctgataagagtttcgaatgcattcaagcatttcaaaactcaaatctcattccctttatgtctctaaaattgcctgtgtattctgaattggtaaaagctttttattctaatcttgaaattcaagaaagtaccttgatttcagaagtttatgggataaagatggtcattgaccaatccctcttcttctatgatttgacccaattgtctagtgacggtgtaccatttgaaggtgcactagacgatgattggaagtttgatttttctatgcatgatgcccgccggttggtttgcaccaaccaagcggatatgaccagaaggcttcttgccggttcattggctcttgaaagctgcatcctccactatcttattgctcgtattttactcccaatatcttcaaaccttgcacaggtttctgaagaagatcttatagtcatgtgggcctttcatatcgaccgacaaattgattgggcacatttattccggtttgatggactccaaacctatgttggtgagaggtttgatgctttggaacaacaagtgtacatgcaatttgatgcaatggactcaaggatcacaaaggttgaagaagatgtcaccatcattcgcgactgtcttgatttacctccaccaccatcagtttag

SEQ ID NO: 57931 - DNA, 99 bp, Glycine max
  Peptide Sequence Number=SeqID_174709
atggagatgaatggagatgaggtgctccaaatgagtggttccctccacacaatcatgttttacaacattgattatgcactaagcgagatggcacgctga

SEQ ID NO: 57932 - DNA, 375 bp, Glycine max
  Peptide Sequence Number=SeqID_174710
atggtggaagcaaaccaatcatcatatggaatctacactgcatttgcagaagaaagcaaccaagcattggctgctactgctcctttcaacattgatgattcattttatgtaaacaataagccagcgtattcgagctttatggctcgagtttcggcttacatagctaataatatgaatcaagcggctattgtgttcaaggattgtttcgcatgggactatgaagatatgtctatcagtagagaattgatggagcatagattggttatctatgaagggaaaaaactagtgaagcaagcaccatggagatttgctcataatgccatggaggccatcaaagcaaagatagaaaagctattgaatgtcaatttcatttga

SEQ ID NO: 57933 - DNA, 486 bp, Glycine max
  Peptide Sequence Number=SeqID_174711
atggatgtaaggaatgttgcagtggaagatgacttagaggagaaggaagatgctcaaagtcatagcgaaacatctccatcaaaacaactatcacttctagaaccaatggttgaagaatatattgtttgggtggatttaaatcttgacattcctttaaaccatgaaattgctcaacatacttctcctgaagaagaacacccatctgtagacccttctgctatttttattcctattctgactgtcgaaacaaacaagccaattgttgatcaagttacagtcttcgataaagcaagattgaaacaaattaatttaggattgagagggatttcaaaaggccaaaaagcacctcatgatgatccaaggagcaataaaaaaactaacaaatctaaagaagccttggtcaagaaagaagaggatctcttggcgaaactcaagcccattcaagatgaatttcgctctggtcgtctcaagcttttagaactttga

SEQ ID NO: 57934 - DNA, 480 bp, Glycine max
  Peptide Sequence Number=SeqID_174712
atgaatgtaggagctctcatctctggccagatcacatctatggcccagtctaactcctctagacttgggttccctgctcttatcacagctctatttactattagaggggctaggagagcgagggcaaggccagctgaggctccttccacatctgcagctcctcctccagcacgtaccttagcagctccttctacccatcttctgcagactttcaacgtcttgaagccatgtttcaaagcatacatcaggggcagattgttctattacgaagtttacagctggcccgggactcagcccccctttcacagggaggacgaaggtctcaccgctcaggtaccacaacagaggaaggatgagtcatccgagacttccacttcaaagaccctgatcaaaagaaagagggtagttgaaacacaagaagctgcagccacttcggagaaatctcttgaggctacttctgagcctttagaaccagtgtga

SEQ ID NO: 57935 - DNA, 816 bp, Glycine max
  Peptide Sequence Number=SeqID_174713
atgcatgctttgttagggtcattcaagaatggaaactggtctaattttgatgaccttgataggatgttagtcgcatccgctaagcgcaacattcctgggctaagcgcgaggaagaatccagaagaagatgagctgtacaggtttgctaagcgcaccgatcctagaggtgaaggagacatcctcaccacttgtatttttgcaatctttcatcttgttcttctctttgttgttaagaaggcttcctggtatggaaagctaaatcctctgttggatcttccctgtagggctgagttgtcgagctttcacaaggaatcggggtgcgataagttagttgagtatgtgtgtcttaatacagtcctagttgagttaagtcttacaagaggaatctgcggacgatgcttgatcaggattaggctaagctttcatgaggaatcaaggttacaggttgtaccatttgtggtgaggctgatgaaacaggccaatgtactcccactgaagaaaacacccaaggaattcattatatgggaaatcaacagagacgagggtatacttaaggaggattttcaggcttccagcagggtccatataatcaacaaggatagtggagggcacaccctgacaatcagttcaacaaagaccagagtaacaatgtcaaatcataaaagcatcgagtcagcactgaagaaccttgaggtccaagtgggacaactagccaagcagatagctgacaagtttgtggaggttaaggatgaggatagtgttgtgcataagaagaaaactactgacaagaaaagtactgatggaaagaaaaaatga

SEQ ID NO: 57936 - DNA, 366 bp, Glycine max
  Peptide Sequence Number=SeqID_174714
atgcatcagtatgtagaggagcctggttttgggagtggtgcactagagatcacaaacaagttggctagtgaaaacataataggggagaggggatttgggtatgtttacaaggctattatgcctgatggtagagttggagcacttaagttattgaaggctggaagtgggcagggagaaaggaagtttagggcagaggtggacatcatcagccgaatccatcatcaccatttggtgtcattaattggttattgcatatctgaacaacaaagagtgcttatctatgaatccgttcctaatgggaatctcagtcaacacttgcatggtaacgaagtgaatgaccaattttggattggcaaaagaggatga

SEQ ID NO: 57937 - DNA, 462 bp, Glycine max
  Peptide Sequence Number=SeqID_174715
atgggagatttcttgcaaactaattcaaagaagcttttgtatctggggtgcaaaaatttcttgacgatgttgtcagcggtgttaagtctagttaatatgaaggccagatataggtcgagtgacaaaagctttagttcactacttcaagtagtgcacgatttgcttccagaggaaaacacgttgccaaaaagttattatcacaccaagaagatattgtgtccaatgggcccaagacagccaggaaatgacattgatgtttatctttgtcccttgattgaagacttgacaaagttgtgggacaagtacagtgttaagggccatcatgcatgccttatctgtgaagaagacacaagctacatgcaactgagacatggtagaaaaatagtatatactaggcatcgacggtttctgaaacctcatcacccttaccagcgattgaaaaaagcatttaatggaagttaa

SEQ ID NO: 57938 - DNA, 819 bp, Glycine max
  Peptide Sequence Number=SeqID_174716
atggtgagccatgtaattaatgctgatagtgcactggtgtcctgtggtgaatttcaaaatagtaaggagccatgtcaggccactgtatggaaggtttatactaggagaaagaaaataggatcagggggtgggagcatttatgtcggcgatgacaaagtcattcacttcactagacatgggcaagaagtaggaaccggtactgcactagatcttctcctcatcagttcaggaccagccaagcctcgagaaagttgcccaacttgtacagcaccccaagaggaacacggggttatctcctcatgcatgaactgcttcctagctggtggcgttctgtatcggttcgagtatgccgttaccccagcccttttccttgcgaaagcccgcggtggaacgtgtactcttgctgtctctgatgacgatgatattgtcgtccatcgggcaaaatatctgctcgaaaatggctttgggtgctacaatgttttcaagaaaaactgtgaagactttgctatctattgcaaaaccgggctcctagaaattggacaaagtggccaagcagtttccatcatagggggacctcttgctgctgctctatcctcgcccctccgtatggttactactaacgtctacggaatggcagcgacggctgttggagtctactgtgctagtaggtatatggcagacattggaatgaggcctaatgtggtgaaggtaccggttgaagagttaacctcaaggttggccactggcttgctgcaagtggttgaaccccaaattccaaccaatattgctcgtcaatctcctcagcttgttactcaatga

SEQ ID NO: 57939 - DNA, 384 bp, Glycine max
  Peptide Sequence Number=SeqID_174717
atggcagtggaatggagaaggaagagagagaggacacgccacttcaaggagaagatgagtctagaaaaagctcaccaccataggaggccatggataagagcttggaggaagaagaagataaatgatgggagaggaagagaagagcacaaaattttgtgctctaaaagagctctaaaatctgaaataattggacccaaccttggcacatgggctcagaaatctaccatgaggttcatgggaaccctagggccttcttcaacagctctagctcaatcctcttggagcctcttgctcatggctctagtgactggtcccttcctagggaggattgcatcattggatgtcttggaaacactttgttttgaggcaatgcttgatctttag

SEQ ID NO: 57940 - DNA, 345 bp, Glycine max
  Peptide Sequence Number=SeqID_174718
atgaagatcctattgatgagtcatctaggctattccgacaaaggcttctacaatgaaaaatgcaagtgccagggtgcttgccacaagtatgcatggggagtagctgcactgacatacctctacgaccatctctcatatgcgagtaagtataacagcaagtcatgtggaggttatgtgacattactcatgtcttgggtgctggcgcatctgccaatgtttgctacttatagatcaatttcatatagctttagaagctatgtagagcttgttggacatcaaagttgtgccagaggacacgagtcatcatcagctcatacgaaaatgtttgcaattgttggtctctag

SEQ ID NO: 57941 - DNA, 309 bp, Glycine max
  Peptide Sequence Number=SeqID_174719
atgggacgggagatgaagaaaggaaagcatcatcatgaaagaaaaatgagcaacattcgctcgattgacagaaaatccattgttgagaaccgcggagaggccacacgttgcaacaacgccaagctcgaggcagagagtcatcaattaaagaggcactcgagagggagggagaagcaagcaaaaagggttctagcagaaaaggagaagcagatggaggtgaaggtagaggagagtgagcagatctacaaggagaaggatgagctaaagttgggaggatgtgacaactgtccaagattgattcgaacataa

SEQ ID NO: 57942 - DNA, 132 bp, Glycine max
  Peptide Sequence Number=SeqID_174720
atgtcagtgaaaaaccttgtcgggcgcctagtagtacatgacaagacaaatcacacactagtttgggtgtatacgggaaaagagaaagctcagctcgagggacatttcttccaccacaaacattatctttaa

SEQ ID NO: 57943 - DNA, 327 bp, Glycine max
  Peptide Sequence Number=SeqID_174721
atggatgtcttgtgtcttgttgggaacaagtgtgaaaccaaccaaacacagagggcgggtaagcaacagatgatccgtgcgctactcttctcgcaccttcggtcaaatgtgtcaaatagatctgccaagacagctaccaccggactttccttgctatggtggtacttctgtggtaggcccgctatgccgttccggagtctgttttatgcggtccaaaccctcttgcggaatcccttgaccacagttgcaatttctgctcaagggaggggagacatccggaggaaaagatatgggtttttctttccccccgagaggaacattccttag

SEQ ID NO: 57944 - DNA, 465 bp, Glycine max
  Peptide Sequence Number=SeqID_174722
atgcatccggagtttccagaggaagacatcatggccttgttcggggagaaggcggacgatgaggatagggataagtggatagtgtggttcaaagacgcatccaacaccctaggccatggggttggggcggcctacatcaagaaactggccgagttcttcgatgatgtctccttccaccatgttcccagagaggaaaatcagatggctgatgcgcttgccactctagcatccatgtttcaactaacttcacatggagacttgttgtacatcgagttccgatgtcacagaaagcccgcatattgctgcttgatagaagaggagcaagatggtaaacggtggtacttcgacatcaagcgatacgtagagtataaggagtgtccagagggggcttctgacaacgacaagaggatgttgcggaggttggcaattggtttctttctaggcggaggtatcctatacaagtga

SEQ ID NO: 57945 - DNA, 222 bp, Glycine max
  Peptide Sequence Number=SeqID_174723
atggaaagaaaaagcaccaatggaggatgtcactccattagtggatgtttggtttcttggacgagcaagaaacaaggtacaatagctctatcaacagtttggcagagtatatatcagctgcaagttgttgttctcaactcttatggatcaaacaccagcttgaggattacaacttgtttaagagtaaaattcatatcctttgcgataatactgctaccatag

SEQ ID NO: 57946 - DNA, 705 bp, Glycine max
  Peptide Sequence Number=SeqID_174724
atggatgatcgacctgaagaagtcagagaaccaactggacgcttattaaggaaacatcatccagagtctcagatcattagtgatcctaaggacaaactccagacaaggaattctctcaaacacacagtgctacttttcgagatcaagccaaagcaaatagataataccgatgtttggaagctagtggaactcccaaaaggtaaatttggcattggagcaaaatgggtgttcataaataagttggatgaaacaagtaaggtagtgaggaacaaggctaggcttgtggtcaaaggttactcacaacaggaaggtatagattatactaaaactttttttcttgttgctcgtctagaggcaatatgcattttactatcctttgttgcttatcatggcatgatgttatatcaaatggacgtaaaatgcacattcctcaaaggattgattaaggaagaagtctatgtggaacaaccctctagattcgagagttctatctatcctcatcatgcaaagtttgagatgagtgtgataggagaattggagttctttcttggacttcaaatcaagaaaatagatggtggaatatacatacatgaaaccaagtacgtgaaggaacttctgaaaatttttaagatagatgatgcaaagcaaatgaaaacctttatgcatccaaccactgtacttggactggatgaagaatcaaagtag

SEQ ID NO: 57947 - DNA, 314 bp, Glycine max
  Peptide Sequence Number=SeqID_174725
atggggaagacgtttcattacttccggaagaacccttcttccggaaatcttccgaaagaccttcttctggaagttccggaagaaccccaaacgggtcttccggaaggcgccaccgtcaccaagctttcaccattttttccggcgtcttctaccctaagctatcgccgaagggcacaaccgtcattcccactccaaaccgtttcttctatcctccactctccccatcccaataacaaagagaggaatcgaagtctgttccgttctgatcagaaagggaataacggtaacggagatatggggcttctgtctaacag

SEQ ID NO: 57948 - DNA, 639 bp, Glycine max
  Peptide Sequence Number=SeqID_174726
atggtgtacaaggaagacaaagttatagcccttagtgccccaattcaatctgaggatttattaaacacgcatgggattttcgttatggacaagaatgagaacaagacattgcatttgacttttaatactacagggtgggagagggatcaaccaattgtggatgatgatgtgattcaagagattgatgaagagatgaaattgggtgctatgagttttggattgaaggtagaagtggaagcggaaattgaaattaataagatgaatgtgcccgtgaccatgcaaccttattgttcgaatttagaagttgatttatcaccattggaacaagaaaaagaagcaaaggaaaaacccagaatcccttgccctcgaacgcagccgggctccgtcatcagaacatcaccgttgtggtggctgagggtcgtggggatccttacaatgggggaagcaaaggagagccacgacgaagagcacaagcctatcttcgtcattgattccacgctcgcattaatatatagaaaagtcatccattgccgatgcagtggcaccctcgaaccctatgacattgctgatctatgccaccgtgaggcgcgactcttcctatgccattggccggccatctttgttcggaggggaaattag

SEQ ID NO: 57949 - DNA, 327 bp, Glycine max
  Peptide Sequence Number=SeqID_174727
atggcggtttccaaactcagaaatgatgcaaagaaagaaaggagaagaaatggcatttttccaaagctacttgaactacaaggctcaaaacgcataagtgagcaatactctcggaaatggaaacgttgcgcacactccagaaatctcttcaatgatcccaacggtcatatcggggacaagtttcttgtgaagaggaataccaaatttcgagaagatccaacggttaacgaatgctgggcagcgtttttaccgaggcagcttcatgtagcttccttgagaagcttcattaagaggcttcctcaagaagcttcctcgtggcttctttga

SEQ ID NO: 57950 - DNA, 132 bp, Glycine max
  Peptide Sequence Number=SeqID_174728
atgacacccccaaggaagaacgagtccttcgatattcccatcatcaaaaacgttgaagatgcctttcaagctttccctaaagactggaacaacaagacaagatggagtcagcatcaaggggactgttgctga

SEQ ID NO: 57951 - DNA, 138 bp, Glycine max
  Peptide Sequence Number=SeqID_174729
atgacggtttccaaactcagaaatgatgcaaagcgaggcaagttggaagatttcgctttggttgaagggttcctctcggtgtggggttttaacggagaacaacggcgctttgtggtggctaatggtggctgtggatga

SEQ ID NO: 57952 - DNA, 264 bp, Glycine max
  Peptide Sequence Number=SeqID_174730
atgaaacaagaacagataagagaaattgaggttggggaggagaagactcatattttttatcattacgctgcctttgaggatacatatctcacgccagcaatgacacatgtggttggtgacgatttcgaagacgtcacagtggctagcaatttcgaggatgtgggcacggagcgtgttggcgctatcctgcattatgatgagcgacgacttcggcttcttaatggacccctctgtaggttgccgccccaccacatggaggtatag

SEQ ID NO: 57953 - DNA, 1377 bp, Glycine max
  Peptide Sequence Number=SeqID_174731
atgatgcttgatcagatgagcttgcttggtaaaaagatcaatatttctttagcttacgagcttactgggatcgtttccgatgatgagttgcttgatttgctggatctggctttgtcatctgatacatcgaatacagttataagagctcgggagctgatgagatcaaggatagatcctttgcaccttgtatctcagctggcaaatctcattatggacatccttgcagggaaatgtgaaaatggtggttctgacgtcagaagtagattttctcggagacacaactctgaagctgatcttcagaaactaaacaatgcattgaaaatactttctgaaactgagaagcagttaagaaattcgaagaatcaaacaacatggttcattgtagctctcctacagttaagctctgtagattgtcaatctgtggatgcaaatgataccaagttgagtcttagaggtgcatgcaatggagggcaaaggttggaacatgttactacaggcctttgtgataacaagtcatacagattagaaccagaggatcacaaaggaacattggattccatttggtataaagctacagagatgtgtcactctagtcagctcaaaacttttttcaggaacaaggggaagttgtcttcacttcatgttgatggcagtacagcttgtcttgctattgccgagttggagttccaccatcgccaccatgtatccaaggctgagaagtcatggaaagcgattgcaagttccttgcagttcatattgggttgcaacattgagttgaggatcacctatgcaccgtgtgcttctgattccaagtatgccaaacttagatcatctttcagtatcttcggttgctctcacagaattcgtcaacagaagtccttatcatctaatgaacaagtaagtgaatcagattacgctgactacacctcggaaaatcccatgatgaaggatagaatttctacctctgattgtggaatggatgctgtaacggctttgaggagtagcgaagggaatttgctcagctcaggagaaagatttttgaataggtcatttcaagagactaagagaacatcaagtgctgaagtggatttctctaaagaagagggatacaattgtgcacatcttgatccatcaatgcttgattcagataataaccaccaatctaactgttttcctaaaactctttggcttcaaaagaagttccgatcttcacattcatccaagttgacttttcagggtattcaaccacagaaagattttgttatatctgtcccaaaaatgtgtgcatgttctgggacatatacctatgctaacgaacccagcattttttcaagtagttgtaagaactgcaccaaagcctcagaaaaagtaggttga

SEQ ID NO: 57954 - DNA, 1099 bp, Glycine max
  Peptide Sequence Number=SeqID_174732
atggatgggcggcggcattcggtcgatattccaatttccaaaactcttgtggcactgaggagagtcaggtcattgagggatccaaccactaattccatgagcaaactctcttctctggttgacaatgtgcactgggaaaacggttctggcaatgagatttccctgcggttttcggatgctgctgggccatgtgattctgatgataatgctgctttcagatcaaggaatttaggtttcaagggacataggaagccggatgatgctgattttttattgaatcatggcctgttgaactcaaggttgaagcctagtgggatgatgtcttgtaaggatgatcaacaagatgatgaaatggttcactctaagcctaatctgcagtgcatttctggagataaatcacccagtgaaagctgtggtagcaaccttgggggtaaaggattggacttgtcttgtattgtgcttccaagtaataatttcaaggatggggattcatgctatatagaaactgctagatcatctcaattagggagaacagattactccaagtcagccaaaaagtctctacgcaagaatcaagtaaaaccgtcggaggtagcgataagtattgctagcaatgaaggcagtccatgtccttctggttatgatgctttttcgccttatagtgctaaagtaggtataaatcaagatgttgatgttttagataacaatgatgatggatgtggaataagctgctgttggtcgaaatcaccaaggtttagagaatcaaatctatatggtgagatagaagaccgtcccttgatatctcatcgagttgatgagacggatcttgatgcacacaggagcatgagacacaatggtggtgggattagtccaactttggaaactcctagaagtttgtctatgaaattcaggcctaaatcatttagtgatttggtgggacaaaatgtggtagtaaggtctcttttggctgccatctccagaggaaggataacatcattttatctcttctatggtccacgcggcaccggcaagacatccacgtctaggatgtttgccgctgcactgaattgcctgtctgttgtggagaaaaggccatgtg

SEQ ID NO: 57955 - DNA, 204 bp, Glycine max
  Peptide Sequence Number=SeqID_174733
atggcagaatgtggtgtgtgtgacaggttggtgagtgaggagtctcgaccaacgagcgcttttcagaaaccacggtggggctgggataggggcacattattaaagtcaggccaagattcaacggtgaaagcatttaaaaaaaatgttaggattggtaatcttgtggaggagttgtattctcggactgattctcacatcggttga

SEQ ID NO: 57956 - DNA, 572 bp, Glycine max
  Peptide Sequence Number=SeqID_174734
ttgtcctctttccgaatatggaagggttagtggacctagcagtgattgacgctttcctcgcctttcatcatggcaaggaaagcccggtcgacgccattttggccatgtatgacacattcgaccggggaggttcccttgatggaacaaggggttgtattaattataatcccgtcctcgccataagacagcttggctaccttatgagaggggcgccactagaggatgggcttgcgcctaaagacaaagagctcagaggcagtgggcccattggtggctaccgtgagtggttgaaagcccacgtgcaaggtttggattggctcccaagtttgagaaccgctaaaagggaggaagatgaggcactggaggaagacgaagaggtgcaggcccttaggacggaactcaagcaagctcaaacaatcaaagaaaggttccaatcagcagctcttaaaatccgaaaggagaatgccgaactgagagatgtaaatgtagctaccaccaaggcattggaacaaaagaccaagagggctcgtagggacgagcacggccggaacaagttccgaggggctctatag

SEQ ID NO: 57957 - DNA, 267 bp, Glycine max
  Peptide Sequence Number=SeqID_174735
atggtcagtgcattgatggtgcccatgttttatacgttgtgtgatgttgctaaaaggagcagtcgcgctaagcggaccctgtgggctcagtgcacatccaccgctaagcgcaacttcagtgtgcttagcgtgacaagggaatctggaagagcacaaggatcaaggtcgcgcactaagcgtgagatcagcttgccaagcgagatgtttgtctcttgccaggctcagcgcacaactggcgccaagtccaaatccacttactctcgctaa

SEQ ID NO: 57958 - DNA, 264 bp, Glycine max
  Peptide Sequence Number=SeqID_174736
atgggtgcgaataaccactcgggtatttccgcgtatcatgggtgcagaatgaccaaacttggtctatgcttgtcatcgggcacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaagaatgaccaaacttggtctctgcgtgccaacggacacgactgtgtctga

SEQ ID NO: 57959 - DNA, 608 bp, Glycine max
  Peptide Sequence Number=SeqID_174737
gtacacgatgaattcggttataacagtgttgtatttcaatggaagggtctatgaagataatgatgatgtaatatttgaaggtagtaaaaaagcgattcagattaaacatggaattagtttcaatgctttgaagaaaaaaattggagataagaaaaatatattgccttgcaaatttgtgatgacgaagacgttgaaacgatgctggaaagttttaaacaacaagaccaaatgtcagttctggaattgtacatataaaaggatgtggctggtggttcaatgtttcattctgcaaattcgcttacatcatgtggaaattatttatctaatgctgagacaaccaccaacaaatatgagcaatttacatattgacaaagatgatgatgatgatgattatgttgtgtctaactcatacgttgaagagtctttagacgaagatgacagtgttgacggtatatctgatacagacgatgatgtcaccgacatgattcaaccagtaagaattgttcacccagcagaaggtgcacaacgaattgaaaatccattttggaatgatgctttacattataacaatatcaactggagttatcctgatgaggaggacatttgtg

SEQ ID NO: 57960 - DNA, 306 bp, Glycine max
  Peptide Sequence Number=SeqID_174738
atgaaagatgacgcaaggtggaaactactggtgaggaaggtggcatcggccaaagccttgtcttccttagcgctgccaattagaggaagcaggaatatggagtacttgaagtcgttgttgctgagaaggtacttgttgaggactaagaccgcaatgttggaggagtaccaacctgacacgagcccgttcgtgaacccttcacttggagaaggtacttcattggcactacttctttcgtttttcttgtgcttcactgcaaagatgttgccgaagactaaatcaacatatatgggtgacagagcatga

SEQ ID NO: 57961 - DNA, 311 bp, Glycine max
  Peptide Sequence Number=SeqID_174739
atggcttgtgcgttggattggattatcgaccaggcttttgctcaaggagtccaagttgcagtttgcagcacttccaatgagaaggcggtctctgcaatagtatcattcttgctgggacctgagagagcagaaaaaatcaagatatttgccggagacgtggttccccgtaaaaagcctgatccagctatctacctattagcagccagcactctgggtgttgaaccttcaagatgtgttgtggtggaggacagtgccataggcctagcagctgctaaagcagctggaatgacgtgtatagtaacaaagagcgg

SEQ ID NO: 57962 - DNA, 711 bp, Glycine max
  Peptide Sequence Number=SeqID_174740
atggcagctgcaagtagcatcatctccatctcctctgcttcactctttactccaacaacaacccaatgcctcctcaaacacaattacaaggaccatgatcatgttcatgttccatcatcatcatcatcatacttcacaacacacgctgctctcaagatatcaagaccaacaacaacaacgtttggaatcaccacaacaaccaccagggttaataatgttcctcctcgtaggtttagttgttcagcatcgtcatcttcttcctcttccactcttccctcagctcttctatttgactgtgatggagtccttgtggatactgagaaagatggtcaccgcatatctttcaaccaaaccttccaagagagagaactaggcgttacatgggatgtggacttgtacggggaattgctcaaaattggaggcggaaaagaaaggatgacagcgtactttaacaaggtcggttggcctgcgaatgccccaacagatgaacaagaaagaaaagaattcatagcttcactccacaaacaaaagacagaactatttatggcccttattgagaaaaaactgttgcctcttcgtccaggtgttgcaaagttggcgtatgatgatgataagagaaaaaatagttctaggggaagaagattaaccaaagaactaagaggaacaggaaaccttgaaagagaaaaggtttcgagaagttttattgaatag

SEQ ID NO: 57963 - DNA, 1893 bp, Glycine max
  Peptide Sequence Number=SeqID_174741
atggcggagaagtcgggagcagcagaagagagctctaatccgatggcttttcaccatacgacgacgaagcttgtcgttttggcagaccttaacgtcgaagccgaagccgaagccgaagaagacgattcttctctcgtccctcctccactaattaccattttggcaaatgacgaaaacagtcaagataaaagttcgttgtccaaagacactgatagcattgaagctgaaagtaaaaagttgaacaaactgagcaaatcccgctcaagaaagacagattcttctcttgattttgtagctgatgtggatggtgatcaacatgttcaagggcctccttcatctcgggaggaaaaagttagcagtgtgaagactggcttggttcatgttgcaaggaagatgcccaaaaatgctcacgctcattttatactcggcttgatgtaccaaagattaagccaacctcaaaaggctgtgttagcatatgagaaggcagaagagatcttgctgaggcctgaggctgagattgacaggcctgaattgctttctttagttcagattcaccatgcacagtgcctgatactagaaagttcatctgaaaatagttcagataaagaacttgaacctgatgaacttgaagagattctttctaagctgaaagagtcagtgaagtcagatatcagacagacagctgtatggaacacactgggttttatccttcttaaaactggtcgtgtgaagagtgctgtctcagttttgtcatcattgttgtccattgctccagagaactatgattgcctaggaaatcttgggatagcttatcttaaaattgggaatttggaattatctgcaaagtgttttcaagaattgattttaaaagatcaaaaccatcctgcagccttggtcaattatgctgctcttcttttgtgtaaatatgcttcggttgtagcaggtcctggtgcaagtgctgctgaaggtgccatgactgatcagatcatgtctgctaatgttgctaaggaatgtttgctggctgcagttaaagcagatagcaaatcagcccatgtctgggcaaatcttgcctgtgcattttctattagtggtgatcatcgaagttccagcaagtgcttggagaaggcagccaaactggaacccaattgcatgtctactcgatatgctgttgctttccatcgaataaaggaggcagaaagatctcaagatcctagtgaactgctttcgtgtgctggaaatgagatggcttctataataagagacggtgattcatccctggttgagattccaatagcttggtctgggcttgccatggttcataaggctcagcatgagatagcggcagcatatgaaagtgaacagaatgggctaagagaagttgaagagcgtgctgtttgcagtttaaagcaggctatagcagaagatccaaatgatgctgtgcagtggcaccaactcggtattcatagtctctgtgctcggcaattcaaaacatcacaaaagtaccttaaagctgctgttgcctgtgacaaggattgcagctatgcatgggctacccttggtgtctcacttcaactatcagaagaaccatcacaagctgaagaagtatacaagcaagcattgtcgttggcaacaactaaacaagcgcataaacaatatcagcgtgcgaaggctatgtttacaaagtcacttgaactacagcctgggtatgctcttgcattcaacaatctgggtcttgtgtttgttgctgagggtcttttggaagaggccaagtattgttttgacaaagccctccaatcagattcattgttggatgcagctaagtctaatttgattaaggtggttgccatgtcaaagttatgcaaaggcctctcctcatgcggtcttaaagaatga

SEQ ID NO: 57964 - DNA, 1872 bp, Glycine max
  Peptide Sequence Number=SeqID_174742
atggcggatgatagtaaccgcctcgtgaggctgctatgccgcccgaagccactcaacaccaaaggatccgacccgggaatccatttctggcttatcggatccccattcttcccgccactcaccgtcgcctccttcctccgccgcatccacgccctcccctccgctgcttcccccgatttgcccaaggaatcggaggaccttcgcactctcatcccgagaggcttcgaagtcgtcggtgccctagcttccggcgatgacgcccacgctcgcgcggccgttgacgccgcgcgtacgttgaggaaccttctctacggcgagggaacggatcggccggtgatcggagcggtttgcggctttgattccggcgagctgcggttttttgtgtcagagagtgaaaatgcgacgggacttgaatccatttcgtcggtaatagaggaacgggattcgaagaagtttgtgtgggagaatggttgcttgcttcactgtgagcttccaattaagttgccactctattatagtctcaagaatccaactgatgttgagaaatcatatgtacaggctaccgaagccgttattgccaagttaagagaccctcaggctgtgtacttgttagaaacgtcaaacaaagcctctcaggatatatctcctcctgtcataattcgaggtctacaattagactttagcacagacctctccaagatcaaggctttggctgatgatgatgatggctttgatgcaagctcactatcatgttcatactttcccatcagcagtaaagcaggctcaccagttttttctgcagagggtcatcatcagcttctactgtccctgttgcagaatactttccaggaagaaactagactccttattgtggatattaagttagatgtactctgctattcttccaggaagcttccactgaaatatgcaatttcaagtttaatcatacctggcttagttgaccaattaaatgtagtgcagaagttgatgttgcctaaccttttggcacaacatccttggctaaaatcttatcactttagtcctcctgggattctacatccaataactgttttctatgaactgagttttggggagacagaaatgaagcaagttgaagttaggagatccttgcactcaaggttgggattgccgtatgatcgtccccttctaagaatttctaatgccttggatttttcaaaattgaataacaatgatatggtctctctacagaaaggttcaactttgctcagagatgtacacattgggattccaagtagtggggttactgggggaactgtttcccttgttcaagagagcatgtgggtgatcggttctgtgtccacttcgcaagaagagggcatgacatctacgacacagtggacttgtcggagtggcggtggagagacagcacgagaaactcaagagacgcttcagatatctcgtctttctgctttacgcgtttccctgaagacattcgagaaaaagaattgtggtttacttccaagaaatgaggcgatgtcagggagactcaagggtgtatccaatgtcaagcaacttgagggacagttggataatctgatcgtagggggccttaaactacacatgaatctaccaaaacatgaaagggaagacaagacgcatctacaagatagggagattgacagggctacatctggtggacgagacaagggtaaggcagtcatggcgcaaccccactgtcaacctaacaagggacaacaaaagacgtcagagatgggggatggaaagtgtcaagaaaattgcactaatggagtccggaaatggagttcagagtggattatctatgttccactcgttgcagtaacggagtccggaaatgcgcactggctttag

SEQ ID NO: 57965 - DNA, 606 bp, Glycine max
  Peptide Sequence Number=SeqID_174743
atgaagtcaatctcttgctttctcataagggtggacccttgggtactagtacctatcgccttcagagggctacatgacctcgccatcagagggcttcacgtcctcgcctttagagaactacacgtcctcgccttcagagggctacacgtcctcacctttagaggactacacatcctcgccttagaggactacacgtcctcgccttcagagggctacacgccctcgccttcagaggactacacgtcctcaccttcagaggactgcacgtccttgccttcagagggctacataggactatatgtcctccccttcagaggactacgcgtcccagccttcagaggactacacgacctcagagggctatacgccctcgcctttagaggactacacgtcctcacttttagagggttacacgcactcgctttcagagggttgcacgccctcgccttcatagggctacacgccctcacctttagaggactacacgtcctcgccttcagagggctacacgttttcacctttagaggaatacacatcctcgccttcacaccttcagaggactacacgtcctcaccttcagagggctgcacaccctcgccttcgtag

SEQ ID NO: 57966 - DNA, 287 bp, Glycine max
  Peptide Sequence Number=SeqID_174744
tcaaggtgttccttttgaaggcactcttgtggatgactggaaatttgattattcaaggcatgatgctcacagaatggcattacaagccaatgcacctctcccgtatccccaccttgttaatatttttcttcatcatttcaatgttcctttggatgatgaaccagatgtcaaggttaaaaggtctttctccattggtgccggtgttgttacctcctttggttaccgaaagtatgctgatggtcagtgggttcgcaaacaagacttgccactgcctactcctgacgaac

SEQ ID NO: 57967 - DNA, 247 bp, Glycine max
  Peptide Sequence Number=SeqID_174745
ggttcccataaaccctaagagaataaaggtcattcctgagtggctcactccaccaagtataagaaaaatttgggacttccatgacttaacaaacttttacaaaaggtttgtcccatatttttctatacttgtagcaccactcgttgagttggtgaggaaccttgttccttcatgggaagatgcccaggaaatgggttttcaagtgttgaggaaaaaagcccagagtttcaagaaccttgggatttga

SEQ ID NO: 57968 - DNA, 633 bp, Glycine max
  Peptide Sequence Number=SeqID_174746
atggggctgatgcagctattttcctcttctgataaagcgctgtggcgactggcgttgccaatgatcctctccaatatcaccatgccgctgctcggcgtggtcgataccgccgtgattggccatcttgatagcccgatctacctcggtggcgtggccgtaggcaccacggcaaccagcttcatctttatgctgctgctgtttctgcgtatgagcaccaccggtttaaccgcgcaggcattcggggccggcgataaacaggcactggcgcgcgcactgatgcagccgctgctgatcgccctcgccgccgggttgctgctggcgctgctgcgttctcctgccagtagcctggcggcaacgctgatgggcggcagcgcggaagtccagcagcaggcgcagatcttcattgaaatccgctggcttagcgcaccggctaagctggctaacctggtgattctcggctggctgctgggcgtgcagtatgcgcgtgcgccgatggttctgctgattgtcggaaacctggtcaacatcctgctcgatctgctgctggtgctgaaactgcactggggcgttgccggtgccgccgccgccacggcgctggccgaatacgtgacgctggcagtgggattatggatg

SEQ ID NO: 57969 - DNA, 219 bp, Glycine max
  Peptide Sequence Number=SeqID_174747
atgtgcttgttgttttggctcaaaatttgttctataattagtgcctattttagaccaatcttagttctgaaatttcaggtgaaaagtagtgtgaagacaagtgccaaaactagagggaattggaaaggaggattggtgccatcccttgaagaatttgagtcaagaagcaaggggccaaccaccttaagcgctattggactaaaaagcactccaaattga

SEQ ID NO: 57970 - DNA, 261 bp, Glycine max
  Peptide Sequence Number=SeqID_174748
atgccccatgggttgtttccttacaaaggtcacgcgttaatgccattgaggcatttcaccgaacacttggtgggcgcgcgtttaggtatcaatagcaagagaacggggacaatgtggcatagcaccaaaaggagatcaaaatacaccaatgaaaagctagaaagcttagggatggaatacttacttgttggtgatgaacaaaagcgcgaaacggaatcaaaaaatgcgaaaaatggtgaccctagggctgcaaacttgtaa

SEQ ID NO: 57971 - DNA, 204 bp, Glycine max
  Peptide Sequence Number=SeqID_174749
atggagattggtagatcttctagaggtccaccaccgccatctggtttccattgttggccgagaagcttggttggtgtggggaatattggttggtggggtttgggccatgtaggagctgaagttacagcatgggtgtctccttccttcttcttggccctgctcgctccgaatctcctattgcttgtgctggcgggagcggcataa

SEQ ID NO: 57972 - DNA, 305 bp, Glycine max
  Peptide Sequence Number=SeqID_174750
gattcacaagcgattctcctcatgtttcagccagcccgcatcaattaaactttgcaccttacgcttcgaggtcatacagtgctcaatggaatgccccggggcttctccatgacaagcacatgttgcatttgagtcgtattctcggaaaaatggaggttgaggaaccttggttggggctttttcgctgcaaaattccttccttcgttggtgttttggttcgtgctaaaggtggtgttcgtgattggaaggttgctattggcttgagtaatgacattgttgggttggtgggaaacttggatgtatag

SEQ ID NO: 57973 - DNA, 300 bp, Glycine max
  Peptide Sequence Number=SeqID_174751
atgataggagaaaatcactcaaagtgtatcaatctcacacagtgcgtggcgagaaagtcgctagcgcaaggattttgtcggaaatcaaagggagaggaccactttaggtcgtggtttcctttttcttgtttacttgggcaaggattgacattctcaccctgggtcaaagtttatgataagttgggattttggctcaaggcttgtagaacggctggtcatgatatatgtcagggtttggccagcggttcgaggataaaggggatgtcctacattatttccatgatacccatgcaacaatga

SEQ ID NO: 57974 - DNA, 816 bp, Glycine max
  Peptide Sequence Number=SeqID_174752
atgagtggtatccgcctggaagtgcgcgtgcacatcgtcacaggtgcgattgcagcagcacagaacatcgtcaagtgcatcaagcgttgcggtctcgaagtgagtgacctcattttgcaacccttggcttcgagtgagtctgtgctcaccgatgatgaaaaagagctgggtgtctgtctggtagacatcggtggcggtacgactgacctggcggtgttcaagaatggtgccattcgccataccgctgtgatcccgattgcgggtgaccagattactaacgacatcgcggtagccttgcgtacaccaacgcagtcggctgaagaaattaaggttaaacatggttgcgccttacggcaattggccgacccgcgtgaagtggtggaagtgcctgctgtggatggccgcgagccacgtcagttgtcctgccaggccctgactgaggtgattgaagaccgcgtcgaggaaatttacgagtttgtgcagcaagagctgcgccgcagtggcatggagtccatgatcgcctccggcattgtgattaccggcggtgcggcgcagatgcgcggcatggttgagttgggtgaagagattttccacaccccggtccgcctgggtgtgcccaggggtgtggaagggttatccgaagtggtgggtaatccgcgttatgccaccggcataggcttgttgctgatggccaagcagcaggtagaaaaacaaatggtgggtaacttgcaatctgggtcagtaggcaggttgctggaacggatgaaaagctggtttacagggcgagagtgcggggcaaaccaatcactcaaataa

SEQ ID NO: 57975 - DNA, 231 bp, Glycine max
  Peptide Sequence Number=SeqID_174753
atgaatagtgagttgagggtggaggataggcgaatagcgcactccagcctcgatggtggaggacacatgaacagcgctaggcaatcaattcacaggtctccgaataagagtcgagggtggaggataggcgaacatcgctacgcaatcaattcgtggggctccagcctcgatgctgggggagacatgaaccgcgctaggcaatcaattcatgggtctctgaaaaagagttga

SEQ ID NO: 57976 - DNA, 1005 bp, Glycine max
  Peptide Sequence Number=SeqID_174754
atgatgaatacgctcagcacgtcccctgccaatgctgaggcctttatcagcctcgaaaaaattagtaaaaagttccccggcgtattagcactggataatgtcagcctgacgctgaataaaggtgaagtgcattgtctggccgggcagaatggctgcggcaaaagtaccataattaaagtcatttccggggtttatcaaccggaaaaaggcgcggccatcacgctggacggaaaactctttcataccctgacgccgcagctttcttcttattacggcattcaggttatttatcaggatttgtcgttatttcccaatctgtcagtcgccgaaaatatcgttattcaccgctatttaccgggcggtgatttctgggtacatcgcgagtcaatgcgcaaaaaagcgctggcggcgatgcaacgggtcggcgttgctctggatccggatcgtaaagttgaaaagctgtcgatcgctgaccgccagttagtggcaatatgccgtgccatcgctgctgacgccagtctggtgattatggatgaaccgacggcgtcactgacccgcagcgaggtgaatggtttgctgcgggtggtgaatgaactcaaagccgccggtatctgcgtggtgttcgtcagtcaccgtctcgatgaagtgatggaagtggccgatcgtatcagcgtgatgcgcgatggcaaactggtcggcacctatccggccagtgaactcgacagccatgaactggcgttcctgatgaccgggcagcgcttcacttacagccatctgccgcaccgggcgcccgccgatgtgacgccactgctggaaatcagccagctgagccgcaaagggcagtatcacaatatttcgctgtcgctgcgccagggagaaatcacgtcgattatcggcctgctcggttcgggccgtacggaactctgtctgagcctgtttggcatgagccagccggacagcggagagatccgaattaacggccacgtggttgaaattccactctaa

SEQ ID NO: 57977 - DNA, 1011 bp, Glycine max
  Peptide Sequence Number=SeqID_174755
atgaacgggatcagctggttctccttcaccgccgccgacggttacgactatggcctgaccctgccgctgctttgcctgcttggggtgatcatcgttaccggcgtcctgatgaatcgcacccgcgtgggccgccagatttacgccatgggcagcaaccgtgacgccgcatcgcgtcttggtctgaacatcctgcgactgcatttttacgtttacggttttatgggattgctggcgggtattgctgccgtggtacaggcgcaaattacccagtcggtggcacctaattccctgctcggttatgaactgacggtgctggcggcggtggtattaggcggcaccagcatgaccggcgggcgcggctcgctaaccggcaccattctgggcgtgatgctgctggccttcctgcaaaatggcatgaccctgctgagcatttcatcttactggcatcaggtgttcagcggcgcgatcattctgcttttacagcgtcggcaatttccagtcgatctcctcgcagttaccgattctgggcatgctggcgctggggatgggcattaccatgctgaccggcgggatcaacctttcgatcattgccggtgccaacgcgtgttcgctggtgatggcggcgattctggtggcgcatccgaaccagccggaatatgtcgcgctggcgctgcttgcgggtctgggtgtggcgctggtgattggggtgctcaatggcgcgctgattgcctttatcggggtttcaccaattctggcgacgctcggcaccatgacgctgatcgccgggctgaatattctgctgaccaacggcgcggtcatttccggcttcccgccggtaattcagtacctcagcaacggcagcctgctgggtatcccggtcgccctggtgttattcctgctggtggcgctgctgctgtgggtgtttctggaacacactacgctcggccgcagcctgtacctgatgggttccagcgagcaggcgacgcggttcagtggggtcaacacgcataa

SEQ ID NO: 57978 - DNA, 264 bp, Glycine max
  Peptide Sequence Number=SeqID_174756
atgcaatataaccctctgaatgacaacacgcgtagagggtatcttagcttcatgaaacaaatacaatatgatgtggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatgacccaaatggaggaagactaa

SEQ ID NO: 57979 - DNA, 351 bp, Glycine max
  Peptide Sequence Number=SeqID_174757
atggtgcgtctccaatcatctttcttccttctccattctgcttccattcatcttcaagaagtaaaagactccattgatgaagaagatccaaggcctacaagctccataaggagctacgttagggtttctcaccatcttgaaaaagagacaaaaggtttgagagtagaagatgtttgggttcagagagggatgataaggttggcttttaaggagaggctgaggcattttggttggctgaggtgggtggcgggagtaaatgcattaataatggtggttgatgaggtaaagatgaagagatgtaacaaattacaacacacaaaaacacgtaggaaatcgattacaattacataa

SEQ ID NO: 57980 - DNA, 345 bp, Glycine max
  Peptide Sequence Number=SeqID_174758
atggtgattttcacccatgaagttgtagcagaagataaaggagaagaagctcccaacaatggggatttagcctctcattgttatgagaggctttacactttaaggactgatgtggataaaagaataagagggatggataatggaagaagagggggaaatggctatagaatgagggtttcccctattatagatgctcaggcattggatcggggcgataatgcgctgagcgcggtaatgtctgggcttagtgaggtgttcacgcgcttagtgcgggatttcgcgctaagcgtgcctttgagcttcttcgtaggtcttcttcacgctaagcttgagcttgactgctaa

SEQ ID NO: 57981 - DNA, 315 bp, Glycine max
  Peptide Sequence Number=SeqID_174759
atggagatgagcaccatgcaagttgtgctgggaatggttttagtattgttgatgcacgtcttcaatgttttggtgttgaggccaagatcactgagagcaaagcttcacaggcaagggattcatggtccttcacctcacttctactttggcaatattccaaaaatgaagacccttttgcttcaagttcagttagcaccaaccactcaagtcaatgataaagttcaacgtgtttctctttctcacaaatggccttttcctctcttccctcatattcaaaagtggatcaaccaatatgtgggtagaggttgctgctga

SEQ ID NO: 57982 - DNA, 366 bp, Glycine max
  Peptide Sequence Number=SeqID_174760
atgactctcaattcacccaaagaaatttgggattggaagagtatgaaggggatgagcacgttcgtgtcatattcaagaattgctgaaaaaattctggttacagtgcctaagagatatgaagcatcaatatccactttggagactacaaatgagttgtccaagatctcttcaacagaggtgatacatgccttgcatgctcaagatcagagaagattgatgagggaagaatcaaaagttaaaggagttttaccagccaagcaccagaatgcaaacaaatacaagaaaaacaagaacttagatggaatgggagcaagctcagcatcaaccaatgcaaaaggaaattggaagaaatcttatctgccttga

SEQ ID NO: 57983 - DNA, 330 bp, Glycine max
  Peptide Sequence Number=SeqID_174761
atgggacatgaaactgttatttgcaaaaacaggaatcaaccacacagtgaagctacaaaggttgttgatccggaggaggagtacctgtttgctgctacaggtttctctagtattgaatcaagtcaaaattggcttattgatagtggttgtactaaccacatgacaaacaacaaggatttattcaaggaacaaagcattatatgcatattgaaggttcgagttggagatggcaagttcatccgtgtgaatggcaagggaactgtagcaatctcaaccaacaaaggtacaaaactcatttttgatgtgttgtatgttactgaaattgattag

SEQ ID NO: 57984 - DNA, 1811 bp, Glycine max
  Peptide Sequence Number=SeqID_174762
ggttgacatggaaggctgatgtgtgtattggagtgccacgtcacttgccacgtccactttgtagaccctggacagtacataagcccctaagctttgagctagcttgtaggcgaaagacgttgtctaatgtcaagggagattatcaagtgtcgagggtagtggccttgacaagtataagggtcgcaagtttgttgagcccccaagcatggacaactattgtctgggttgttgttattaagttatccagggaggacatgcttttggttttgcaggtgaaatcagacgtgtcaggcgagtgcagtgcatgcacgttactcatgcatatgtgtcacccatggagtggatacgtactggagacgcagtacgtgggtgagtgggactacatcgtggtgcaaacttttggggtacaccttctcttcatcatgtctttcatttctgacttcgtcatgggtatgggtggtaatgactctggggttcgattcagcaacccctcggaggaggaaacttgcgatggagcttctaatagcaagtcatctttttttcaaaggatcgtgggctcctaccatgttggtggggatacttctcgccttcgtatgagggcacaaccttttactaattctctggatagggaactcattccagtcaccacgatcattcccctttctacttttggtggagcaagaagtagtggtcacggggacgttagggcttcccttagtgtgcggcgtagccacagtgttgggtctttatcgtcccctcctgctgttgttggcaatgacgtcgctgctctacaacgtcaattgaggttgacagaccccgaggattcttggaagattgtcatccaagcttacaagagtgatgattttccctttatgagggcgatgttgagttatccacccttcttttttatgtaccattgtctcttcgagggccttcgaagtcctatgccccttcttcaacatcctgcttgtgcttttgtttgttttgtagatatcatgcgagattttgcatggaggactttggtcaagcagggcaaacttgcaggtgggattgtgccaccttctatcgatcctcctgttggagaaggggttgttaaggtctcccccgacgtgtctttctctattttggctaagaggaagcgtgatgatgacgctgggtgtcaagtcgcaaaaagtcaagggcttatttcagcctccaagcaaggaggttttactgtgattactacatcggtcgcttccgctagtcctgtcatggctccgccttccaccatcgttgcacccttgctgagtgctagtgtgacgaccacgagtgctccagagatatcacctccttcatcagctttgccggtttctgcttcaactatgttggcaagcatcgccttcttcctcttctcatccaagtcttcctccaaagaagtctgcgcgattttggaggagaatggactacgacacctggaagctctatgcaaagtggcatccttagaggttgaggtagccaagtggagggtcactactcgtacggtttggagagtggagtgtcctaaggtggccaacaccactatcgcctttgttgagcactgcaagggcttgtcgagggagaagaatgaattggctgacaaggtagagaacattgcagtagaaaaggatgagcttaccaaggtggttgttgatctccatgcccggttgaaggaatcagagtctgagctgagagtgtcaaaggatagggaggccaccaaagagcttaaagaggagttgctggtgtacaagaaggacgtcatagaccaacacaaaaagggcttttatctacaataa

SEQ ID NO: 57985 - DNA, 291 bp, Glycine max
  Peptide Sequence Number=SeqID_174763
atgactatcatcacctccactgccatgaccatcattgtcattgtcgttgccgccaccatcactgtcaacgccaatgatgtgatggcagcgacaccagtcatgatggtagctacagtgatagtcatggtggtggtggcagcaacagcgacaaaggtcatggtggtggaggtggtggcggttgatgacaacaacagtgatgatgacgacgatcatggtggtagttgtaacagtgatcatggtagtgacaatgatagtcatagtgatggtgatatgttaattgagatattttag

SEQ ID NO: 57986 - DNA, 1203 bp, Glycine max
  Peptide Sequence Number=SeqID_174764
atggagatgaacacagtgcaagttgtgttggtagcagttgttgtggtgttgatacatgttttcaatgttttattgttgaggtcaagatcactgagagcaaagcttcataggcaagggattcatggtccttcacctcacttctactttggcaacatcccagaaatgaagacccttttgcttcaagttcagtcagcaccaatcactcaagtcaaagacaaagatgatcatgattctctttctcacaaatggcctttcaccctcttccctcatattcaaaagtggatcagccaatatggtgaagatgtttaccctacttgtagaagaatgggtagaatgtggctaatggtgtcagatatagagatggtgaaggaaatcatcatgtacacctctttgaatctggggaagccttcttatctgtccaaagatatggggccactcttgggccaaggtatattgacatcaagtgggccaatttgggctcatcagaggaagataattgcccctgaactataccttgataaggtgaaggcaatggttaatctgatagtggactcaacaaatgtaacactaaggtcttgggaggctaggcttgaaagtgagggagcagtttcagagattaaaattgacgatgatttgcgaagtttgtcagctgacataattgctagaacttgttttgggagcaattacattgaaggaaaagaaatattctcaaagcttagagatcttcaaaaactcttatccaagattcatgtaggaattccaggctttcgtgatgctactaaagtgaaaaatggtgccataatctgttttagatatttgccaaacaaaagcaacagacagatgtggagattggagaaagagataaactcaaagatatcaaagctcataaaacaacgccaggaggaaactcatgagcaggatctattacaaatgatacttgagggcgcaaagaattgcgagggcagtgatggcctattatcagactccatctcatgtgacgtgttcatgatagataattgcaaaaatatattctttgctggtcatgagactactgcaattacagcctcatggtgcttaatgctgttagctgcacaccaagattggcaagatcgtgctcgtgccgaggtgcttgaagtttgtggaaaaggtgctccagatgcaagtatgcttagaagcctgaaaacgattggacacaatgcatga

SEQ ID NO: 57987 - DNA, 519 bp, Glycine max
  Peptide Sequence Number=SeqID_174765
agggtcgtgcggcagtttggctacacgcagaccattcctgctcctcctgtcgattcatgggtctcgtatgatgatatacacgacaggtggatgcactacgaggatcatatcgttccaacaggtgaggtatgcgttgtgccagaggcgtgttccagtgactacatggactggttcttccgcatctcccatcctttcatgacaccaggccacgcattagatcctctgcctcatggtcacgccccgcagccccgagtcgtccctcagaccccacagacggatatccctcgcgtgctggagctaggagcatcgtcgacatctgcggaggagcccagacatgcagtgaaagtttgtgatgacattgctgagaggttggagcgccatctgagtctaagggttgtcacgcttggctcatcgacacatgaggtgatcgaagaatgcctcaggttggccaggagtgtgacacgggatcatcttgtatatgttaggtctagacgcaagcggcgcacggatcaggcgtag

SEQ ID NO: 57988 - DNA, 852 bp, Glycine max
  Peptide Sequence Number=SeqID_174766
atgtgtaaacgggagagatactttttgccttttttggtggcccttgtcttattttttctgtctttttgtgttaatggtatgcattttgtgctggtccatggaggccttcatggtgcatggtgttggtataaggtggccaataagctgaaatctgaaggtcacaatgtcacaactctagacatggctgcttgtggtgtcaatccaaagcaaaggcaagaggttcattcagtttcagagtacaatgagcctttgatgacattcatggcctctcttcctccagaggaaaaggtgattcttgttggtcacagtcttggtgggctatcagcatctattgccatggaaaattaccctgagaaaatctctgttgcagttttcatcactgccactgttgtctctcaaaatctcacctacccagcttttcttcaagagagaaggagaagattgatttcccttaacttggacgaatttttcatattggatggggttaacaaagctccaattctttcatcgcttggagttgaattattagcatccagattctatcaattgacatcaaatgaggatttgacacttgctttctgtctagtgagacctttacctcccattacaagcgatgttaaattattgatgaaacaaactgcagttacaaagtacaagaatggaagggtatctaaagtcttcatcatcagtgaaaaagataatttgcacacagaggactttcaaaggtgggtaattgaaagcaccggtccatatgctgaggtgaaagtgataaaggattcagatcatatggtcatgttttccaaaccaaaaaagcttagctttgaactattaaagattgcttacaaatattga

SEQ ID NO: 57989 - DNA, 459 bp, Glycine max
  Peptide Sequence Number=SeqID_174767
atggtgaaggaaatcatcatgtatctctttggatttagggaagtctacttatttgttcaaagatccgggtccactcttgggccaaggtacttgccaaacaaaagcaacagacagatgtggagattggagagaaagataaactcaaatatatcaaagctcataaaacaacgccaggaggaaactcatgagcaggatctcttacaaatgatacttgagggtgcaaagtattgcaagggtagtgatggtctcttatcaaattccatctcacatgacaggtttgtgattgataactacaaaattatattctttgccggacatgagattattgccatcacagaatcatggtgcttaatgctgttagctttgcaccaagattggcaagaccgcgctcgtgctgaggtgcttgaagtttgtggaataggtgctctagatgcaatgcaagtatgcttagaagcttaa

SEQ ID NO: 57990 - DNA, 144 bp, Glycine max
  Peptide Sequence Number=SeqID_174768
atggagcaggtagaggaagttagtcgtgatggagatgagcaccatgcaaattgtgttggtagtgttgttgatgccaagattactgagagcaaagcttcagaggcagtgggattcatgagctttcacttcacttctactttgtaa

SEQ ID NO: 57991 - DNA, 4879 bp, Glycine max
  Peptide Sequence Number=SeqID_174769
tttcaacaagaagtctaataatgcacaaggtgggcaatctagggtaaacccccctgggcattcaacagagttcaatagtgcatctactgcccgaaccattaacaatggtacccatgtacagccacaattacatggagcatcagatgggccaggtacaaagtcatctgaatcatcagctgcacatacgagtgctggaattcttccaaaagctccaacttctctacagccccccttgatttctgatccagtccctccctcaagccctgccaagggagatgcgtctaaggcattcccttttcaatttggatccattgctcctggctttgttaatgggatggcaattcctgctcgtacaagttcagcccctcctaatatagatgagcagaagcgtgatcaggctcttcacgactcttacaaatctgtgccttcggtgccaattcctcctgttccaaagcagcaacaaccacctaggaaggatgctggtgtcactgagcaatctaatgctggggacagccgggagactcataatgggggtactaaggcaaaaaaggatcctcaggtatcagctttgacaccggcaagccatatgccaaagccctctgttcctgtaactgggattccaatgccaactccatatcaccagtcacaggctcctttacagtttggcagtgctaatccacagattcaatctcacggtatgtcaacagcatccctccagatgcctataccaatgcctttaccaattggcaatgctacacaggtgcaacgaccagtttttgttccaggtcttcaaccacatccaatgcatcctcggggaatcatgcatcaaggccaaaacatgagttttgctcctcaaatgggtcatcagttgccccatcaattaggcagcatgggcattggcatcggtcctcaatatccccagcagcaaggtggaaaatttgctgctcctcgaaaaactactgtaaagataactcatcctgagacacatgaagagctgaggcttgataaaaggacagatgcatgttcagatggtgggtcatctggtgctaggtcacatcctaacataccttctctatcacctgttaaatcttttccagcttctcatcctgtgaactattattcttccagctcatataataccaattctccctattatccatctagttctattccattaacaagtagcccgatctctcctaattctcagccaccgatatttaattatcctgtgaaccatggtccacaaggtgcaaatttcatgaattcgtcatcacttggttccccacctattagtaaagctagcactccaacaggggttgcatctctggccattaagccaagtggtacgtctgctaatgtggactcatcattgtccaattccagtatttctgatgttcaaaatacagaatcccctagttcaacagcatcttgtgatgctagctcctctgtgctgcaaaaagggtctgaaacttgttcagaaatctccttaccacagtacaagttgtctagtgattctgtcccagttgtggataataatgaaggcgggagggaatctcttagtaggtccaactctttgaaggataagaaaccagggaagaaaggtcaattatcacaccatcaggtttctgtacaatctcccacagcggataatgtgcctttttgtgctgttgaccatggaatatatgataccggagtttccaaacctgtaggaactaaaacaaaccattctgcagaacttaccactgaagatcttccaacatctaatacaatacctagtagcacttctactgctgttgaagtgaaaaccaatgggtctgcagaagttgttgcttgtgtttcagctgaaggatcttgtgcacaaactgttgacagagtgcacaataataatcctgataagatagataaattatttgaaggaaaatttggcatatcagatctgcagtctgctgatcttccagaaacaacatcaaagcatgtcaaggatgggtcagagaatactggcgatgagtcaagtaccaaggatagaccaattatagaaccaaataaagcgaaaactacatctaaagggaagaagaaaagaagagagatacttcagaaagcagatgctgctgggtcaacgtctgatctttataatgcatacaagggacctgaggaaaagaaagaagctgtcttaagttctgagagcacagaaagtgctaccaccaccactttgaagcagttgccaaaagatgctgctcagtcagatgctttagcaagtgaaaaatgtagtcacagtaaagctgaactcgatgactgggaggatgctgctgacatgtctacccccaaactggaggttcatgataaatctcaacaagttggtgatggaagtggaagtacagccaaaaagtattcacgtgatttccttctgaaatttgcagatcagtgcactgatcttcctgaaggttttaaagtcaccgcagacattgaagctttgatgagtggcaatattggtagttctcatgtttttgagcgtgattcacatcctagtcctggaagaattgtagatagacccggtgggatgtctcggatggatcgccgtggggatgtggtaatggaggatgacagatggagtagagtttctggtgcttttcgttctggacgtggtttggatggcattggaggtaatgtgggatttcgatctggccaaggagggaattttggtgtcttaaggaactctcgtgcacagacaccaccacaatatgttggagggatcctttctgggccaatgcaatcggtgggaaatcatggtggaagaaataaccctgatggggagaggtggcagcgttctgctagcttccagcagaggggtttaattccttctcctacccaaactcctttacagatgatgcacaaagctgagaataagtatgaagtgggtaaagcatcagatgtggaagaggtaaagcagaggcagttgaaggctatcttgaacaaactaactccgcagaattttgatagactttttgaacaggtgaaagcagttaatattgacaatgcagtcaccctcactggtgtcatctcacaaatctttgagaaggctctgatggaacctaccttttgtgaaatgtatgccaacttctgtttgcatctggcttctgagttgcctgattttagtgaggacaatgaaaagataacttttaaaaggttattattaaacaagtgccaggaggaatttgagaggggtgaaagagaagaagaagcagcaaataaggctgacgagggtgaggttaagcagtctgctgaggaaagggaagaaagaagagttaaggcaagaagacgcatgttgggaaacatcagattgattggagaactatataagaagaaaatgttgacggagaggataatgcatgagtgtatcaagaagttactgggtcagtatcaggatccatatgaagaagacattgaagctttgtgcaagctaatgagtactattggggagatgattgatcatccaaaagccaaggaacatatggatgcatattttgaaaggatgaaattattatcaaacaacatgaatttatcttctagggtgaggttcatgttgaaagattccattgatttgagaaagaataaatggcaacaaaggaggaaagtagaaggtccaaagaagattgaggaggtacacagggatgccgctcaggagaggcaggcccaagctggtaggtcaggtcgtggtcttggcaacaatcaatcagctagacggaatcccatggattttggtccacgaggatcttctatgctgtcttctcccaattctcaaatgggtggactgcgtggtcttcctactcaagttcgtgggtatggtgcttttcaggatgctcgatttgaggaacgacaatcttatgaggctaggaccttggcagttccattgcctcaaagaccctcaggagatgattctataaacttggggccccaaggtggtcttgctaggggaatgtctacgagaggatcaacagcaatttccaatttaccaatatctgatgtgcttcctgtccatggagactctcatagaatgaatacaggtcttaatggtcacagcaatttatcagagcgcacaccatatagctcaagggaggatcatgtttcaagatatggtactgataggtcttcagggccatctgcttatgatcaatcaagtgctccagagcataatgtaaaccatggcaacagaggcttgaggagtgaagatcggaatcttgaacctcttgctcatttgcaagggtcaatagtctctcagaatgcttcttcagagaagatttggccagaagaacgactgagggacatgtccttgtcagcaataagggaatactacagtgctagagatgagaacgaacttgctttatgtgtcaaagatttgaactctccgagcttccatccttccatggtttctctatgggtcacggattcatttgagagaaaggacgcagaaagagatcttttggccaaactacttgtcaaccttgtgaaatctcagcatggcactttgaatcaagaccagctcatcaaagggtttgaatctgttctcagtacattggaggatgctgttaatgatgcccccagagcagcagagtttcttggccgaatttttgcgatagccataacagagagtgtagttactttgaaggacattgggcagttaatacatgatggtggagaggagccaggtagtctcttagaagttggacttgcagctgatgttctgggaagcacgttggaggtaattcaaagcgagaagggggatgcggttctaaacaagatctgttcaggctctaacttgaggttggaaactttccggccacctaatgctaaaacatcaaggaagttggaaaaatttatttag

SEQ ID NO: 57992 - DNA, 210 bp, Glycine max
  Peptide Sequence Number=SeqID_174770
atgtccttcaatcaatcgaagtcggagaataacgatgcggtttatcgaaaacccgggcgatcctccagcttcaatcagcagaggggctcctacggcaggggtggcgggaccgcgccgacgagcaattcactctcctctagccggagagtagtgttgggattgttttttggaacttggatgcgttttagagtgcgaagtctagtgttatga

SEQ ID NO: 57993 - DNA, 195 bp, Glycine max
  Peptide Sequence Number=SeqID_174771
atgccgtgtgcgaagctcagaacctcgaagctgacatccgctatgtcgttacctgcctcgttggatcgtcgtgccgtagcctgccttgtcgtggttgcctgtgtcgcggttggttgttttgcattgtgccgtgctcgccccgccatgccctgctatccaagtgaacttggttatatgatgaaaacattttgttaa

SEQ ID NO: 57994 - DNA, 231 bp, Glycine max
  Peptide Sequence Number=SeqID_174772
atggcttttggtgtcaatcattcttttctctttggaattttatttgctgctttggttctaacaccaggacaagcgaatgtggatgttgatcctccgggactaatctgcctaagaggatcatgcgtaggtaatacacagtgcgctctactatgtgttggcaatggccatgtcaaagggggctcatgcgtaggattgattcctgggcttatcttgtgctgctgtaacaactga

SEQ ID NO: 57995 - DNA, 258 bp, Glycine max
  Peptide Sequence Number=SeqID_174773
atgcgtgttatactacaccagcctagactaagggaaatgctaggtgcacccaacaacattgctcgagaagaaggttcttccgaaaaaacaaattgttctaccggaagaaggttattccggatgaacaaattgttctaccggaagaatcttcttccggaaagctttctgaaagaaggttcttccgataacacaaattgttcttccgaaagaaggccactagcttcaggaatggtcttcaaaggtgatttcaccgcatga

SEQ ID NO: 57996 - DNA, 312 bp, Glycine max
  Peptide Sequence Number=SeqID_174774
atgaccccaaggaagctcgcctcaaagagatccaggaaagacaaaggatggtcattcctccgggagagacgcgtccagcttagggacgacgagtataccgacttccaggaagagatagttcgccggtggtgggcatcgctggttacccccatggccaagttcgacccagacatagtcctcgagttttatgtcaatgcttggcctacagaggagggtgtgcgtgatatgcgatcttgggtgaggggtcagtggatccctttcaatgcggatgccctcaaccagttcctgggatatccgtgggatccttctaga

SEQ ID NO: 57997 - DNA, 1104 bp, Glycine max
  Peptide Sequence Number=SeqID_174775
atggtttatacttccatcccagcatatattgatccagccaactggcagcaacagcaaccaaatcaccagcagcaaggaaacaacactgctgccagctctcaccttattcttccacaaccaatacaaccaccacagcctccgccatcgcagcctcatggactcggtggtagcactaccgccgggtccatcaggcccggttcgatggcggatagggcaaggatggccaacatacctatgcaggaagctcaacaaaagtgtccaagatgtgaatccaccaacacaaagttttgctacttcaacaactacagcctctctcagccccgccacttctgcaaggcctgcagaaggtactggacacgtggcggggccttgaggaacgtccctgttggcggcggctgccggaggaacaagaggagcagaggaagctccggcaacaacaccaggtctccggcaaactccgatcgccaaaccgcgagtgccggttcggcttccaccaccagtggctcctcctctgctgacttggtggccggcctcggcggtggcaccggagtgccaccgtcgcttagattcatggcttcattgcatcaacttggtgaccaccaccaccaccttggtggtggtggaggagaaatagggttaagctatggcttgaactatggcgcaatttcgggtccaatgggaggaataggagacttgaatttccatataggaggcagtttgagtggtggtggttgttctatgttgtctggtttggaacaatggagggttccacaaactcaccaatttcccttcttgtctggcttggaagctacttcatcacatgggttgtacccttttgagggtgctagtggtagtgatggctacggtagcactcccattaaggtttcaacttctggggttatgtctcagcttgcttctgtgaaaatggaagacaatcatcatcatcatcatcaggaacttggtttgcctagacagttcttgggggtcaataataaccctagcacaaatgagcaatattggagtggtggtggtggtgccacttctgcttggactgatctttctgctttcagctcttcttccactactagtaataacgcactatag

SEQ ID NO: 57998 - DNA, 255 bp, Glycine max
  Peptide Sequence Number=SeqID_174776
atggctagaaggatattgtaccaaatcagtgtttatccagaagcaaaggtgtctgaagaagagtttggtggaattgggaagttggaaggaaagaatagatgggatgccaggctggaagatgaaatgaaaaagattgtgatggttttgagaaagaaggacatggcagactacttgaagttgagtaaagaagtcttaaacttcaacaaggtattggcagtttctatgaatgcatcatggaagaaaccacagagctaa

SEQ ID NO: 57999 - DNA, 822 bp, Glycine max
  Peptide Sequence Number=SeqID_174777
atggaatctggaaacaatattgtgtcaccaactgaggatttctctcgtcatactcatgagccatatgcgaaactatgtccagaatcactgcatataccttatgagtttcgttgtccaatttctctagtgataatgaaagatcctgttatcatttgcacagggcagacatcagatgcctcttctgaattaatagatcctgatatcttagtgagcaaactttcttccaatgatatcgaggaactacaatgtgcagtaggggagctccgacttctcaccaagaaaaatggtcaaaatcgaatgctgattgctgaagcgggtgctatcccctgccttgttgatctcctctatgcacttgacacccaaacaagtgtgagtgtagtgtcaaattcctttaaaattccccaacaccaagagcatgtagctactgtatggaagcttgtgaaaatgcagcagccacctttttcagcctctctggggtggatgggaacagaattgcaattggtggatgcggcaaaagcactattgaatctgtgtttatctcaagggaacaaaggacaggcaattacagccagtattgtgcctaagttgatagaaatgctaacagaacctgatggggatatgagggatgaggcattcgcagtaatggctgtagtagctgctggccattccgatggacaagcaacaattggatctatgaatgttgtatccactttggtggaattagtcagtaatggacctcctaggaacaaagagaatgcaacttcagtgttggaaatggttcagaaagggccaagcgaaaagcttcacagctttttgagttga

SEQ ID NO: 58000 - DNA, 249 bp, Glycine max
  Peptide Sequence Number=SeqID_174778
atggtgattgtcacaacctacccttcggcgggagggcaagtgagactcaaagggtgcgacttccaaagaaggaaaacgtgtgggagtcgccaccaacgtttatttgaggaaaacattagaaaaaccaaaaaaggaaatgaggggtggaggttgtgcagcagctcgcctgggcgagctggttacttcagccttaagccttctagtggcccaggtgaaccaggggatagcctggacgagccaggggcctga

SEQ ID NO: 58001 - DNA, 396 bp, Glycine max
  Peptide Sequence Number=SeqID_174779
atgttctccactgcccttctagcagttttgtacagagcatcattcttggttactgattacaacaaccacaaaagtcttattctattaggtgaggatctttcattatcactagagaaattggacaacgaaactcataaggtatatgcagtgattctggacatagtttcgcatatggctcatgagtatgacgagagaaatcctcagttggtgacacaatattgtttccagattccatcaccaagaaatcttggattgacatatcctatgtttgttgaacaagttatggaactggtcctctcaaaaaaatttatggaattggttgagcttaacccaatcagagattcacttgtgggtattcctggcattattagctcatgcacgaggcccttttactaa

SEQ ID NO: 58002 - DNA, 657 bp, Glycine max
  Peptide Sequence Number=SeqID_174780
cttctcaactctgtaactgataccaaattattctcacttctgcctccgtcacattctatgcagagttgcagaccctccgaacccaagaacctgagagagggtacacaatctggaggtgatggttctttgtctgaagtgacacttgaagaagggtggcctttgggattgagattcttgaactctagaattgggctgatgagaaatggttctgggtcagcctccttcagcactgtgctcactacttctcacaccccttcaactgattcttcctcagatcttgacaccgagtctactggatcactcttccatgacgacagcattacacttggaagcctcattggtatctctagcttctttgaactctcaaggagatcaaccaggggaagaatggtggaaccctccaaggacaacaaaaggattcacaagctgaagccttggttgttttcactttgttcaaggctaagtactgatgcagtgattgggaatgatgctccctctcttggtcactaccttcaagctgagagaagaggtgcaagtacttacagaaggaaccaatttcctaccacttatggacccaatggtttctcccctattcaagactcaacctcactattagtggggagccaaattgatcctaacagagaaatggaagagtga

SEQ ID NO: 58003 - DNA, 732 bp, Glycine max
  Peptide Sequence Number=SeqID_174781
atggaatatgatgtatatgtgaaaaggaaaactaagggaatacttttgatttgcctatatgctgatgatttgcttgtgactggcagcaatagtgaagaaatagagaaattcaaagttgagatgatgactgagtctgagatattgaagttcatgaataattggagcaatgaacttgaagaacacattgggcactccctctggggacccaagtgggccaacatgccaaggaagtacgacaccctactaaacaaaggctcaaaggacttcttgtccaatgcccataagttcatgttgtattacttgatggagggcaccccctttgacttgccccaaattctcttcaattgctttgcaactgaagtgatgaaggacatgatcatcaggaaggacatctaccatagtgtagtcccgatgaaggtccttaaggcccatggagtgacaagaaagttcttgtacgagactcctgaagaagtacaagaccgcatctactttgacgaggtattctttcccgaacaaaaggccttcaaccaagtaaacatctcaaaggtgaggctatttaatgatggatcttttccaaaaactccccaggtggatgattccattctttcggaactttataagaagtatggactcaagaatggaagagatgaccaattggacgtagtgtgggaaaaagctgttgcagaagaaaacaaggaggtatcatcctttcaatctaagaaaagaacgtaa

SEQ ID NO: 58004 - DNA, 585 bp, Glycine max
  Peptide Sequence Number=SeqID_174782
atgtgcaccctcactcagaattttgatcacatagtggtggcgattgaagaatctaaagatgtagagatcataaggattgaggagctacaaggatttttagaagcacaagaattgaagttgattcaaagtggcaaatcaagctttgcaagcacagagtgttggcacaaaaaaggaaaaggaaagggaaaacaaaaagtaaaggaccaaaaaatcaatgatgcacatgaggattttgattcaggcccagttttgcttatggtcacaaccaataaaggtgctttatcttcagaagcttggtatctaaatactggattatctaaccatatgacaaggcataaggagtggctcattgatctagatacaagtagatccagaaaggtcaagctagcaaatagtagaaccttgaatgctgaaggagttggcaatattcttatcagacgaaaggatggtaagacaacattgattgagagtgtgtggtttgtgcatgaaaggcttgccagaacatcctacactccacaacacaatggtctagcagaaagaaggaacagagcagtacttgatatggcaaggagtttacttaagtag

SEQ ID NO: 58005 - DNA, 915 bp, Glycine max
  Peptide Sequence Number=SeqID_174783
atggatgttgaccatcttcttgtgtacaagggattctatgactacgtaaaactgaaaggagttgatgttggtcaacctctggggcttgatgttcttgttgatggaacagttctgacagttgaatccaatatatgcttgctttttataaagggtctggactatcgagctctacagcttgtttgttcttcaacaattgctattatggctgcttttggtgtgaacttcccaaaggcaatctctgtcatggccaaaactgggtgtgcagatcttattgattttaacccaatctgcacacaacttcctgctggtgggacatttgtaatagctcattctttggctgagtctcaaaaggctgtcactgccgctacaaattataataatagggcttttgaatgccatttgccatcaattgttcttggtataaagcttggaatgaaaccaagggaggaaattttaaaccttaaaacactctccgatgttgaaggtttatgcttatcgtttgcaagtgttcataaatcttctgatcctgtccttgctatcaaggaatttttgaaggaagaaccatacacagctgaagaaattgagaaaattattgatgaaaacctcacctcaatttttagcaataatcctatttatttgaatgtcataaaagctgctgagcactacaagttacatcaggaacttgtcaacatttgccgcaaaaatggtgcaattggagctagacttactggagcaggatggggtggctgtgttgttgctttggtgaaagagtgcattgcttctcaatttatccttgatttgaaggaacgtttctaccagtttagggtggacaagggtgatatcagcaagaatgatcttgacctttatgtatttgcttctaagccttccagtggtgcagcaattttcaagctttag

SEQ ID NO: 58006 - DNA, 2727 bp, Glycine max
  Peptide Sequence Number=SeqID_174784
atggccaccatggagcgccggaaaacgatgaccatgaactgggatggcctcggcgacgacgatgacgacgaccacttcttcgagacctacaacctcctctccgccgccgtgccgcaggacctcgccgacgacgataacgatttcgaagacagccgcctctccttcgcctccaccatctcctccaccctctccatcaagccccgaacctcacacttctccgcaaacttcaccggaaaaccaaactacgaaatctggatggccgctccgggatccatctccgaacgcagaagaaggttgctcggcagcatgggcctcgacgagaacaaggagctcctccaagccaccagcgccgccatcgcccgtgccatcacgaaaaaattcgaaaacaacaatggcatcatcaacaacgataacaacaacaacaacaacaacaacaacagcagttacgctatcaattccaccgccgttgatgttgggaaacagaaaccgtcgaactcgccggtatacgtcctcgtccggtcgcggtccgagggcgacatcggctccttctcaatggagaaatcgaggaaggaggagataataggaaaggtatcaaagcagcggttgacgagaaccgctacggaggttgctcagcggcggcacgccggcgctgagaacaaccgaatggtggtgaaagacgtgcctgctgctggggattcacctgtgcatcaggtgaaccgccaggtggtgacggcggccatgggaatgggcgacctgggggcgttttttctaataaagaacctggacacgggaaaagagtttatagtaaacgaatacggagaagacggcacgtggaacaggctgagcgatttgcagactggaaaacagttaacgatggaggagttcgagaaaacggtggggcattccgcggttgtgaaagaggttatgaggcgcgccaacgtgtcgcgccacagcgataagaagctttcttcaaactcctacatttcgaggagtttgagattaagcaagaggcgtggagcttctttgttgaggaacataaagggcgttgcgagtggattcgtcggggagcgtgaggcgtcggtggcggcgcctcaagcggcggtggggaagaacgagtgggtgcgcgtgaggcagagcgggaagtcgcagaaggagctatcggcgctgcacctgtgccaggagttccaggctcacgaagggtgcgtgtggacgataaagttcagtttggatggtaggtatttggcaagtgctggggaggacaaggttatacacgtctgggaggtgcaggagtgtgaggttatgtccttgaaacccgacttgaagaagaaaggtaagaaagggggtgcttctgccattcccgaatatgttcatgttcccgaaactgtttttactctatccgagaagccttattgttctttcactggccatttggatgaggtcttggatttgtcttggtccagatctcagttacttctctcgtcttccatggataaaacagtgaggttgtgggatttggaaaccaagtcatgcttaaaattctttgcacataatgactatgtgacctgcgtgcagttcaaccccatggatgaagactatttccttactggctcccttgatgccaaggtcagaatgtggaacatccctgcacgtctcgttgtggattggattgatatccatgaaatggttactgctgtttcttacacccctgatggccagggtgttctagttggtacacaaaaaggaaattgtcgaacttacagcttagaggattacaagttaactcaatctggcacagttgagcttcgaaacaaaaagaaatctcagctgaaaaaggttaccggtttccagtttgccccaaataatccatcagaagtgcttgttacttcagctgattccaggataagaattgtggatggttcccaagttgttcaaaagtttaaaggttttcgaaatgcaagcagccaaatggcagcttcatttactacaagtggaaggtacatcataagtgcaagtgaagactcacaagtgtatgtttggaagaacgaagaggctcgcactccaagctccggaaaagcaaggagtctgattgttaaccaatctcacgagcacttcccatgtaaagatgtttcagttgcaataccttggccttgtaccataaggggtgatccaccatcagtgccaatgcaaaaccccaaaaagaactcaaaacgttcacaagaggacactccagcgaacagcaagagaatgttgccacctcttccaaagaaaagcaacaaccacgccacagaaagtgcaccaggctccccagaacatgaccctgcagcgatttcgcgcacagaatccggaattggagactcatttgggaacagcaagagaatgttgccaccccttcctaagaaaagtaacaaccatgcaacagaaagtggtgactcccctatagatgaagaacttgaagcaatttctaggacagacacgggattaggtgattcatttgcttcaagctatggtgatccagcttctatatctgcttcaggtactccatcaaatgcatcttggtcttccaattactcatcatatgatggttgcaatggtgcctcatcaatacacccttcagcatggggcttggtgattgtgacagcagggtttggaggtgaaattaggtgttatcagaattttggtctgcctcggaggatgagacaggccaatatctttttgggacctacataa

SEQ ID NO: 58007 - DNA, 360 bp, Glycine max
  Peptide Sequence Number=SeqID_174785
atggaaaataagattttggagaatactgattacactttgatttcggggcatccttacattaagaagtcaggttggagaaagatatcttgttacttcaatatttcttatgaaatcagggacaagaatattgagtttgatgagaatcgtaatgttcagcgtgctgagtttgtgattcgtgcatacatgcaaggtggcaggttctcagacggatggggctcttgtgatcgacgcgagaagagatttcagaaaccaaatcatgatgttcccagcactgcagagactagagcaaaaaataaagcttgtcaagacttgctaggaattggagattaccgacctggtgcaactagtcaatttcgttga

SEQ ID NO: 58008 - DNA, 1674 bp, Glycine max
  Peptide Sequence Number=SeqID_174786
atggctgtttgcattgtttctaatgatggctatgtgatgcagataaaataccaaaatgtatcacgattatgccacacaaagagcgtggtcacagtgaatggtcagtttccagggccacgcattgtagcaagggagggtgacaatcttcttatcaaagtgactaaccatgttcagaacaatatctccatccattggcacggaattcgacagcttcgatcaggttgggctgatggaccagcctatgtgactcaatgccccattcaaacaggccaaagttacgtctacaattacacagttgttggccaaagaggcactctctggtggcatgctcacatttcatggttaagatcaactttatatggtcctctcatcattcttcctcagtatggagttccatatccttttactaagccttacaaggaagttcccatcatctttggagaatggtggaatgcagatcctgaggcagtaataacacaagcattacaaacaggtggaggaccaaatgtgtctgacgcatacactattaatggacttccagggccattgtataactgttctgctaaagatacattcaagctaaaggtcaagccaggcaaaacataccttctccgtttgatcaacgctgcacttaatgacgaactcttcttcagcattgcaaatcacactctcacagtggttgatgtagatgcaatttatgttaagccatttgacactgacactattctcatttcccctggacaaacctccaatgttcttctcaaaaccaaatctcactatcctaatgccacattcttgatgagtgctagaccatatgcgactggccagggcacttttgacaactcaactgtggctgctatccttgaatatgaagtttcaccacacgctcttcactcaacaacttcaatcaagaagctttcactcttcaagcccatcctccctgcccttaatgacacttctttcgcgacaaacttttccaacaagcttcgtagcttagcaagtgctcagtttccagccaatgtaccccagaaaattgataagcactttttcttcacagtaggccttggcacaactccctgctcacaaaaccaaacatgtcaaggacccaccaattcaacaaaatttgcagcatcagtgaataatgtatcttttatacaaccaaccactgcacttcttcaatctcacttctttggacaatccaatggggtttactctccttactttcctattagtccattgattccatttaactataccgggaccccaccaaacaacaccatggtgagcaatggaacaaaggtggtggttcttcccttcaacacaagtgtagagctagtgatgcaagacacaagcattcttggagcagaaagtcaccctctccatttgcatggctttaacttctttgttgttggtcaaggatttggcaactttgatccaaataaggacccagcaaacttcaatcttgttgatcctgttgaaaggaacacagttggtgtcccatctggtggatgggttgctatcagattcctagcagataatccaggggtatggttcatgcattgtcatcttgaagtgcacaccagctggggtctgaaaatggcgtggattgtgttggatggagaacttccaaatcagaagctgcttccaccaccagctgatcttccaaagtgttaa

SEQ ID NO: 58009 - DNA, 1263 bp, Glycine max
  Peptide Sequence Number=SeqID_174787
atgggtgtttctcttgttaaaatcccagtgttccttttgtcattaatcgttttttgcatatttgagcatgctctggcgggtactactagacactaccattttgaaataaggcaccaaaatgtgacacgattgtgccacacaaagagcattgtgacagtgaatggccagtttccaggacctcgcatcgtagccagagagggagaccgtcttctaatcaaagtgactaaccatgttcagaacaacatctccgttcactggcatggaattagacagcttcaatcagggtgggctgatgggccatcatatgtgactcagtgccccattcaaacaaacaggccaaacttttgtctacaattacacaattgttggtcagagaggcactctctggtgtcatgctcacatttcatgctcaatgctcaatatccttttgccaaaccccacaaggaagctcctatcatatttggagagtggtggaatgcagatcctgaggcagtcataacacaagcattgcaaacaggaggaggaccaaatgtgtctgatgcatacactattaatggtcttccagggcccttctataacggctctcacaaagatacattcaagctgaaggtgaagccagggaagccttaccttctacatttgatcaatgcggcactcaacgacgagctattcttcagtattgcaaatcacaccctcacagttgttgaagcagatgcagtttatgtaaaaccttttgcaaccaacaccatccttattgcccctggccaaaccactaatgttcttctcaaaaccatgtcacactacccaaatgccacattcctcatgactgctagaccatatgcaactggccttggcacttttgacaacacaactgtggctgccatattggaatacaaaaccccaccaaatactcatcattcatctgcttccctgaaaactcttccactcctcaaacatattctccccgcactcaatgacacttcttttgccacaaagttcaccaacaaactccgcagcttggcaagctctcagtttcccgcgaatgtaccccagaaagttgataagcactttttcttcacagtaggccttggcacaactccctgcccacaaaaccaaacttgtcaaggacccaccaatgcaacaaaatttgcagcatcaatgaacaatgtctcttttatacaaccaaccactgcacttcttcaatctcacttctttggacaatccaatgggtttacacccctgacttcccaaccaaaccattga

SEQ ID NO: 58010 - DNA, 1591 bp, Glycine max
  Peptide Sequence Number=SeqID_174788
cattgtgacagtgaatggccagtttccaggacctcgcattgtagctagggagggagaccgtcttcttatcaaagtgactaaccatgttcagaacaatatcaccattcactggcatggaattagacagcttcaatcagggtgggctgatgggccatcatatgtgactcagtgccccattcaaacaggccaaacttttgtctacaattacacaattgttggtcagagaggcactctctggtggcatgctcacatttcatggttaagatcaactttgtatggtcctctcatcattcttcccaagctcaatgctcaatatccttttgccaaaccccacaaggaagttcctatcatatttggagagtggtggaatgcagatcctgaggcaatcataacacaagcccttcaaaccggtggaggaccaaatgtatctgatgcctacacaattaatggacttccagggccattgtataactgctctcacaaagatacattcaagttgaaggtgaagccagggaagatttaccttctacgtttgatcaatgcggcactcaacgacgagctatttttcagcattgcaaatcacaccctcacagttgttgaaacagatgcagtttatgtaaaaccttttgcaaccaacaccatccttataaccccaggccaaaccactaatgttattctcaaaaccaattctcactaccccaatgccacattcctcatgactgcgagaccatatgctactggccttggcacttttgacaacacaactgtggctgccatattggaatacaaaaccccatcaaatactcaccattcagctgcttcactgaaaaaccttccactcctcaaacctattctccctgcactcaatgacacttcttttgccacaaaattcaccaacaaactccgcagcttagcaagtgctcagtttccagccaatgtaccacaaaaagttgataaacactttttcttcacagtaggccttggcacaactccctgcccacaaaaccaaacttgtcaaggacccaccaattcaacaaaattttcagcatcagtgaacaatgtctcttttatacaaccaaccactgcacttctccaaacccacttctttgggcaatccaatagggtttacacccctgacttcccaaccaaaccattggttccattcaactatacagggaccccaccaaacaacaccatggtgagcaatggcacaaaggtggtggttcttccattcaacacaagtgtagaacttgtgatgcaggacaccagcattcttggtgctgaaagccaccctctccatttgcatggctttaacttttttgttgttggtcaaggatttggtaactatgatccaaataaggaccctgcaaacttcaatcttgatgacccaattgagaggaacacagttggtgttccatcaggtggatgggttgctatcagattcctagcagataatccaggggtatggttcatgcattgtcacttagaagtgcacacaagctggggtcttaagatggcatgggttgtcttggatggaaaactcccaaatcaaaagttgttcccaccgccagctgatcttcccatgtgttaa

SEQ ID NO: 58011 - DNA, 295 bp, Glycine max
  Peptide Sequence Number=SeqID_174789
aacttttgttggagagaagaatcgcggccccaccaacgcggaaaaggcaattgggtatgagcatggcgttgttgttcccaaagtaccaattctaggttacgttcttggtactgacgacgacggcgtaggtgttggggtgagcctgaaggatgtcttttgcgaggtcaacggtgatgacgcgccggcgcttcagcccatgccgccaaggttgaagcttttggcgttaccgcggagcttgtacttgttgacgatcatggaagagaaggaaggggtggggttgagaggctgtagttga

SEQ ID NO: 58012 - DNA, 582 bp, Glycine max
  Peptide Sequence Number=SeqID_174790
atgagaaagaaacatctgaagatcttatggagactttgtacatttcaacaaccacatgataagtacaaaaaggtatcacgactataccacacaaagagcatggtcacggtgaatggtcagtttacagggccacgcattgtagctagggagggagaccgtcttcttatcaaagtgattaaccatgttcagaacaatatctccatccattggcacggcattcaacagcttcaatcagggtgggctgatggacctgcctatgtgactcagtgccccattcaaataggccaaagttatgtctacaattacaccattggtggccaaagaggcactctcttttggcatgctcacatttcatggttaagatcaactctctgtgatcctatcatcattcttcccaagcatggagttccatatccttttaccaaaccttacaaggaagtttccattatctttggagaatggtggaatgcagatcccgaggcagtcataacacaagcattgcaaataggtggaggaccaaatgtgtctgatgcatacactattaatggtcttcctgggccattgtataactgttctgcttaa

SEQ ID NO: 58013 - DNA, 648 bp, Glycine max
  Peptide Sequence Number=SeqID_174791
atggctgacttgtcaacggcatcgacaacggtctttcaggagtgggcgtacggagcaaagtcggtcggcatcgagcaggacaaactcgccgatatctttaaagacacccaggataaggtgggcgagttcctgcagactggtggcggcccactcaaggacttcttcgacaaggtcgcgcccgcggttgggttgacggcggaagaattccggcaactatctggaccggaggcgctgggcaagtacttcggggcgctggaaaaggccaacctgaaccaggcggaaatgacgttctacctggaggcgctggcatctgacagtagcaagcttgcccccctcttgcgcaacaatgcacaggggctaaatgccatggccgctgaggcacacagtctgggcctggtcttggaagaggacgcggtggccagtgccgccgaattcaacaagacgctggactcgctgggtcaggtggccaagggcgcattcttcgagctttcctctggggctatttcggcgctcaacacgtacaccgaccatgtgaagaaggctaaggcggccaccgacagttggttgagcgccatgaagtccgcagcctattacaaagtctttggcgacaaggacccaacgcgggagcttgctaaggcgatctccatg

SEQ ID NO: 58014 - DNA, 204 bp, Glycine max
  Peptide Sequence Number=SeqID_174792
atggtgagcaatgggacaaaagtggtggttcttcccttcaacacaagtgtagagctagtgatgcaggacaccagcattcttggtgctgaaagatttgggaactttgatccaaataaggaccctacaaacttcaatcttgttaatcctgttgaaaggaacacagttggtgtcccatctggggatgggttgctgtcagattcctag

SEQ ID NO: 58015 - DNA, 144 bp, Glycine max
  Peptide Sequence Number=SeqID_174793
atgtgtaacactttcactataattaaggttacagactacagagacatgtgcaagaagcaccaacctaggataaactttatgggatgtttggaggacccagttggagataaagctgaaagggtagttgggtgggacaaaatttaa

SEQ ID NO: 58016 - DNA, 1392 bp, Glycine max
  Peptide Sequence Number=SeqID_174794
atgcctttttgtgcaatatttagactcagttctttaggggaagacaatttgggtccatggaagaatgaagtcacacaagtagctcaagcagcacgtcctagaactaagggtactcttgtcctagcagcaaacagaaccaatagacctgacattctacagggatttcgacgttaccatggtggttgggacattgcaaatcgacattactgggcctcagttggattcactggtgtggctggtttcacccttgctgtcctgtggtttatctcatttggcttggcacttgtgattcatctatgctgtggatggggaattaacatcaaggataaaggttcaaatcgtttgcaaagaatttggcttgtgttgctgttgttattcacctgtgttgtaacgactggatgcatcgtcctttctttcgggcaggataaattccatggtgaggcagtggataccctccattatgttgtcaatcagtcagactacacagtgcagactctaagaaatgtgacagagtatcttgcgcttaccaaaactatcgtggtggcagagatgtttcttccatctaatatcatggatgatattgacaaattgaatgcagatctagattctgcagcagatacactttccaagcagacaaatgaaaattcatttaaaatacgaaaagtattcaatgctgcgcgtctagctttgattatgatggcagcagtgatgattctactggctgtaatcgggttaatcctgtctatccttggatatcaacacgcaatcctcatatttgttatcactggatggctattggttgcaaccacattcattttttgtggagttttcacaatccttaataatgcaatttgtgacacctgcatggccatgggagaatgggtggagaatccgcatgctgaatctgctcttagccatattcttccatgtgttgatcagagaaccacaaacaagacactttttcagagtaaacaagttgttaccaatattgttagtattgtcaatcggttcatctatgacactgcagatgcaagtccatcacaaggtagtatgaattattacaatcaatctggacctgcaatgccacctttgtgctatccctttgactctcagtttcgagaacaccagtgtacacctcaagaagtgtccttggccaatgcttcactggtttggaagaggtatgaatgcaagacatctgaatatggtgtttgcaccactgttggaagggtgaccccagagatttacttggagttagtacaagtagttaacgaaagttatgcattggaacattatactccacttttacttagccttcagaattgcaattttgtgaggcatgcattcaaagaaattacttcacgttactgtcttccattgaaccattatcttaag

SEQ ID NO: 58017 - DNA, 2454 bp, Glycine max
  Peptide Sequence Number=SeqID_174795
atgggtatatttgaaccttacagagcaattggatgcatcacaagcagcgtccccttctctgttcaaaggctcggcaccgaaactttccttaccgtcagcgttggaaaggcttttcaggtttttaactgtgcaaagctcaatttggttctcgttggtcctcaactgccgaagaagattagtgctcttgcttcctatcgcgaatacacttttgctgcatatggaaacaacattgctgttttcaagcgtgcacaccaggttgcaacttggagcagccataatgctaaggttaagttgcttctgttgtttggagatcatattgtcagtgttgatgctcgcggcaacatgttcttgtggccatttaagggaattgatgagaacctttttccatttgggcacattatgctggatgagaaatttagccccagctgtataatgcatccggatacttacctaaataaggttcttgttgggagtgagcaaggtcctatgcagctttggaacattagcacaaagaaaaagatttttgagttcaagggatggaattcacctatctcctgttgtgtttcatcccctgccttagatgttgttgcaattggctgtacagatggaaggattcatgttcacaacattcgttatgatgaagagttagttacatttacacattccacacgtggttcagtgactgccttatcttttagcactgatggacagcctcttctagcttcgggaggttcatctggtgttataagcatatggaatctggaaaagaaaaggctccaatcagttgtaagagaggctcatgatagtgtgatcacatccctacatttttttgctaatgaaccagtgctaatgagttcatcagcagacaactcgattaaaatgtggatttttgatacaagtgatggtgatcctcgccttttgcgcttccgaagtgggcatagtgctcctcccctttgcataaagttttatgccaatggaagacatattctttctgcaggtcaggatcgtgcctttcgccttttctctgtagttcaggatcaacaaagcagggagctttctcaacggcatgtttctaaacgtgctaagaaattgaaattgaaggaggaagaaataaaattgaagcctgtgattgcatttgattgtgctgaaattagagaacgtgattggtgcaatgtggtcacttgtcatatggatactgcccaggcatatgtttggagacttcaaaattttgttcttggtgagcatatcttgaatccatgccctgaaaatccaacacctgtaaaggcttgtgctatcagtgcctgtggaaattttgtctttctagggacagcaggtggatggattgaaaggtttaatcttcaatctggaattcgcaggggtgcttatattgacatttcagaatcaagaaattgtgctcatgatggtgaagtagttggagttgcttgtgactcaacaaatactctcatgataagtgcaggatacaaaggagatataaaggtttggaatttcaaagaacgtgatcttaaaaccagatgggatgttgattgttctattgttaagattgtttaccatcgttataatggtctcctggctacagtagcagatgatttaacaattcaattatttgatgtcgtggctcttagacttgttcgtaaattcgaaggtcacacagatcgtataacagatttgtgcttcagtgaggatgggaagtggctcctgtcatctagtatggatggaagtcttagaatttgggatgtaatcttagcaagacagatagatgcaatacatgttgatgtacctatcacggcattatccctgtccccaaacatggatatattagcaactgcccatgttgatcaaagtggaatatacctgtgggtaaaccaggcaatgttctctagtacttcaaatgtcgattcatacgcaagtggaaaagaggttgtgagtgtcaaattgccgtctatctcttctgcagaacattctcgagatgagcattatgatgagccaatgaatgcatctcaacctaaagatgctctgtatttctcaactcaagataagcaaatacctgaattagttacactttcattgctgcctaagagccagtggctgaacttaatcaacttggacattataaaggttcgcaataagcctattgagcctccaaaaaaacctgaaaaagctccattcttcttgccttcagttccatccctctctggggaaatattgttcgagtctgatgcagcatttactgattatattaaaggattatctccgtcaactctggatatggagcttcgaatgtttcagatcattgatgatgatgatgatcagcaagaagcagagaagagacctgagttggtatccattgaatggcttctggattattttattcatgagctttcctgcagaaataattttgagtttctacaagctgtcatcaggctatttttgaag

SEQ ID NO: 58018 - DNA, 177 bp, Glycine max
  Peptide Sequence Number=SeqID_174796
atgaatcccaaaatttcggactttggccttgctcccagattatggggagaccaagtagatgctaacactaacaagattgccgggacatatggatacgtgcctcctgattatgctgtacacggacatttctcaatgaaatccgatgtctttagttttggtgtcatggtgttagaaata

SEQ ID NO: 58019 - DNA, 723 bp, Glycine max
  Peptide Sequence Number=SeqID_174797
atgacaggtgttgaaatcgatgaactccctaagcaaattgatgatacacagtacccaaaaacattcttctataaagaagaccttcatccaggcaaaacaatgaaagtacaattcaccaagcgtccctatgcacaaccttatggtgtatatacatggttaacggatattaaagacacctctaaagaaggatatagttttgaagagatatgcatcaagaaagaagcgtttgagggagaagagaagttttgtgcaaaatccttgggaacagtaattggttttgccatttcaaagctgggaaagaacattcaagtactttcaagttcctttgtcaataagcaagagcaatacactgtggaaggagtgcagaatcttggagacaaagcagtgatgtgtcatgggctaaatttcagaactgcagtattttactgccataaagtccgtgaaacaacagctttcatggttccattggtggctggtgatggaaccaaaactcaggcacttgctgtttgccactcagatacttctggaatgaatcatcacatgcttcatgaactcatgggagttgatcctggaactaaccctgtttgccatttccttggaagcaaggccattttatgggtacccaatttatctatggacactgcctatcagactaacacctggaacttcacctttctacgtacgtgtgctgttaggatgcagtgtgctttgatgatgctttga

SEQ ID NO: 58020 - DNA, 363 bp, Glycine max
  Peptide Sequence Number=SeqID_174798
atgcaattttggagggttaaaaatcgaacttcatcgttgaccacaatgcacaaaagcaacactctatctccaacatcaaattatgcttctagacttcaaaatcctcaaaccttgggcttctcattcgagcaagatctaaccgtgaaaatcctagcccctacctccatgaatagatcacctaagaggagccaaatcctgaaacaaaaagagaatcacctaagtttgtttggatctggatggagatggtggcatgtggcagatttggttgttggttgtggtgtcagagttgcggcgtgccttggtactgagctagtgttggaagttgggagggaagtagagaggatgagggaggagatgttataa

SEQ ID NO: 58021 - DNA, 183 bp, Glycine max
  Peptide Sequence Number=SeqID_174799
atggcatcagagtccggtagtttgatggatagtgccgtcagtcctcactttgagggagaggctttagaagctctcgcagtgcagtgggaatgggagtgtttggccaaacagcttcccaataatcttcctcaggtagcgatgcatggacatggctctctcctgcaagagcaagctgccacatag

SEQ ID NO: 58022 - DNA, 246 bp, Glycine max
  Peptide Sequence Number=SeqID_174800
atggctgtgactgatttttacatgggattgaaggtattatgggaggagctggaaaatcttaggccaatgcctcagtgtatttgccctgtaagatgcacttgtgaagcaatgaggaatgttaaaagcttaaacttgacagattcaaagaagtcttcaatgccgataaatgataattacttcaagctcagtgggatgttaatgaactcctatctcttctggccaagtagaaagctaaaccattattaa

SEQ ID NO: 58023 - DNA, 957 bp, Glycine max
  Peptide Sequence Number=SeqID_174801
atgacaaccaagttcttttggatgtggagaatattcattggccaagttaaggcaggagaaatccaccaaatcaaagaacacaagctggaccactttagaatgactagagccttcaataaggtaattactctgtctatcactggggcgttgaatgcagtcttaactgaagaacatagaaaggaaatatgccgttacctctataatcatcaagtacttggagtttatgaatggtccggaaataatcccctgccccctgagatatggctccttccatacatgcttccatttcatccagtttcatatcgtattaaaattagtttaagagtgcttttatatggtgatgacgacaatggtgatgatagcaacggtgacgatagagatattcgtgatgtttgtggtggcgatgacagtggcattggttgtgttgacggtgacgatgtggtggtggtagcggtgttggtggtgacatctaatgattacggtgttgttgttgttagtggtgacagaggtgatgtttgtgatgattgcgacgacgttgatggtgacagtaacaaatgtgtgacaatggtagtaacagtgacggtggtgatggtggtggtggcaaccagttatggtagtgacaataatggtgatggtgttggtggcaacaaagttggtggtggcgatagtgataccagtggttggcaacagagtgtcattatcaaattcagcttgaacattggtaagtctacttatgagactgtaacggttaatagttggttcatgagtggagtcaatagaaacatggtatgttccattcttgacgagacactgcaagcagttggtgctaaagcaatggtggtcggacatactcctcaaactataggtgtaaattgtaaatacaattgtagcatatggctcaaagattgcggaatgtgcagtggagttttgaattcaagaccagaggttcctctataa

SEQ ID NO: 58024 - DNA, 543 bp, Glycine max
  Peptide Sequence Number=SeqID_174802
atgatgctttgtgctatggatggcacaacatggttcatgatccaagagtggatcaaattattacacctttcccagacattgaaattgggatcaaactcgtctagtggtgggtacaaatcgcaatccatcatagaacttgaatttgttcttagagatcaaagccttcttcatcaactttgcccaggcatgttaattattaccattgagcggagggctcaccaatgctacattcagattttctgcaggacaaatataataagggctcgctggattcgggtacttgaagggttagtgaaactcgaattggaacttgaagtacaggtggtgaaggctggaaatcaaagcaaactactgttgcctcttcctctgcagaagaagaataatgtgcctttgccacaggctcttgtgaccttcagtggcttaagtttctacttgatgatcttcatgttcactgcaccaaacaagctgttctctgctgtgacaaaaacagtacacagcacattgcctctattttggtttttcacgagcgaacaaaacatctag

SEQ ID NO: 58025 - DNA, 150 bp, Glycine max
  Peptide Sequence Number=SeqID_174803
atggtagatgtggaagcaaacaacagggctatgttggaacttattgaagcaagacaggaaatcacgagagtcttcaacaagcattgtactatgctcatctaccctgtcgactacaaaactgccagcaaaggaggcaagagaagtgcataa

SEQ ID NO: 58026 - DNA, 171 bp, Glycine max
  Peptide Sequence Number=SeqID_174804
atggctagcaggttggtcgttggtaccaattgtacaaggggttcaccaatgcataagcaggttgccagagataggttgctagtggttggtctaacattggatggtggtttgcttagtgaggtctccaatcataaaagcagtggtgatcttgatatccacaaagagaattga

SEQ ID NO: 58027 - DNA, 426 bp, Glycine max
  Peptide Sequence Number=SeqID_174805
atggtgatagttcggaacaagaaacgtgttggttatacatatgagttgaccttaaaagtcaaaggggaatggatcatacaaggagagaagaagtttattgggggtcatatagatgtcccagagttctcatttggtgaactagatgacttgcagaaaattgagaagggtcatatgctgtttggaatagtgcatgaatatctgctgccacttgtcattgggtttgggggtgttggttccttgatcctgggaatggattctgtcttggttgcattgctcctcactagaaaagtggtggaagtgagactgagtgaagcaagggatatcttgcatcaagacaagacacagatgcgcaacgacttgaagctatttttacagcctgttcgggaaaagttgctgcaattcgaacaggaactcagagatagatag

SEQ ID NO: 58028 - DNA, 201 bp, Glycine max
  Peptide Sequence Number=SeqID_174806
atggagctagcagcacagaatccagaggataggcctggaatgtcttgtgtgctcctaatgccagtgagtgagcttgaattgcctgagccaaaacagccagggttctttggaaaatattcaggtgaagcagactcctccacaggtaagcagcaactaagttcaacagatgaaatagccattaccttattagaagcccgttga

SEQ ID NO: 58029 - DNA, 519 bp, Glycine max
  Peptide Sequence Number=SeqID_174807
atgaagctaacattcttagaaaaaccagagaatgtagcaatagtggaccattacaatgaacaggaggaagatatggagcttccattgtttggcctatcaactatagctagtgcaactgataacttttcaatcagcaacaagcttggaggtggttttggacctggaacattggagaatgggcatgaaattgctgttaagagactttctagtggttctggacaagggctcaaggaatttagaaacgaaattaaattaatagccaaacttcaacactgtaatcttatcaaacacagaacattgttggattggcctaagcgcttcaatataatatgtgggattgcgagggtccttctctatcttcatcaggactccagacttagaatcattcatagagatctgaaaccaagtaacatcttacttgacagtgagatgaatccaaagatctcagactttggcttggttagaattttgtttggagaccagaacgcagcaactacacatagggtggctggaaattag

SEQ ID NO: 58030 - DNA, 306 bp, Glycine max
  Peptide Sequence Number=SeqID_174808
atggataaaatgcgatggcaccagcttcctgttgtcagtcacataaattacaacttttctgttcatgctattgaaatgggagagaaggttacttccataattgagcatgccataaatgtgtttggccgcaaggatgatccagttgggaaccggaacaataacggtggtggttggcaagtagatgtggacatgttagatggtcttttgtctagcctggttgaataccttcaacttgaaaatgcatataatatttttattttaaatcccaagcgtgatgagaggaaacctaaatatgggtatcggtaa

SEQ ID NO: 58031 - DNA, 381 bp, Glycine max
  Peptide Sequence Number=SeqID_174809
atggcatatataacactgaaacttgacactgatgctacaactcagagaccactgaagctgaagacagggccccactcactgcccttggcaaggatcaagaagatcatgaagaattctggggagggtgttaagatgatatcaggtgaggctccaattattttctccaaggcttgtgacctcttcattgaggaacttactagaaggtcctggatcatggccattcaaggcaaaaggaggactttgcacaaagaggatttggcttctgctgttatagccactgatatatttgatttcttgatcactttggtttccaattctgacagccatgcagttggtggtgccacaaatgtcatggaggtggaaactatagattactcttaa

SEQ ID NO: 58032 - DNA, 1122 bp, Glycine max
  Peptide Sequence Number=SeqID_174810
atggacaagttggttcgtgttcagagaagattcttatggggaagagctgtggatcataacaagatagcttgggtcaaatgggacactgtgtgtcttccaaaggaagaaggggggttggggatcaaagatataaacactttcaatctcgcactgcttgcaaaatggaagtggagcttatttcagcagcaaggagatttatgggccagggtattggagtccaaatatggtgggtggaggagtttggacgagggtcttccagcatccggattacggggaggcattatcgaggagcatagtgtggaggacagatcattagcagtaaagtatcctcggttgtacctcatttctagtcagcaaaatcacaccattcagcagatgggggcatgtaaggacacagggtgggaatgggagctcagttggaggagactgttgtttgataatgagatagacatggccgttgcttttttaaacgatgtggagagtaagcaaattcagctacacagaaaagatgagtgggtatggacggcagatccgagtgggcattattcagcaagaagtgcttatatcataatgagggagtctatagcagaaggggcagagttttcagcttttgaagaactatggaagctaaaggttccaaataaagtattagcattcgcctggaggttactcagagatcgtttacctacaagggcaaatctgcatagacgacaagtagaaataaatgataggaaatgcctgttctgtggtaatgtggaggagagtgcaagtcatttgttttttcattgcagcaaaatcagtccgttatggtgggaatccatgtcttgggtgaatagcgtgggtcctctcccgcaaagcccaaaacatcatttcctgcaacacatattcggagtggttgaggctgtcaaggtcaataggtggaagtgttggtggatagctctaacatggtctatatggcagcatcggaataagattcttttttccaacgtcacattaaatgctaacaagatcatggatgatgcagtctttctactttggacttggcttcgtaacttagagaaggactttgggacaggctataaccactggtcgagcaatcttcgattaggtttcatgtgctag

SEQ ID NO: 58033 - DNA, 882 bp, Glycine max
  Peptide Sequence Number=SeqID_174811
atgcagatggaatggtataatatgtggcttgattcactagataattttgggaggttgtatgaagggagagacacagctgagatcattgaggccaaagctttacagttactaaaagggaaggatcaagacctgaagctccatctggaaaaagtattaaaatctggagacttcagtggttttcaagcagaatgtctcacagacacatggataggaaaggacagatgggcatttattgatttgagtgcaggtcccttttcatggggacctgctgttggtggagaaggtgtgcgtacagaagcaagtttaccaagtgtggaaaaaacgattggttctgcttcagaaatttcagaagaagaagctgaagaccgattgcaagatgctattcaggagaaatttgctgtatttggtgataaagaacatcaggccattgatattcttttagctgagattgatatatatgagctttttgcttttaaacattgcaaaggaaggaaagtcaagcttgctctttgtgaagaactcgatgagaggatgcgggatttgagaaacgagctacagtcatttgaaggtgaagagtatgatgaaagtcataagaaaaaagccatagaggctttgaaacggatggagagctggaatctattcagtgacacatatgaggagttccaaaattacacagttgcacgtgattcttttcttgcacatctaggtgcaacactgtggggatcgatgagacatattgtgtcaccttcggttgttgatggtgccttccattattacgagaagatatcctttcagttgtttttcatgacccaggagactaacagaagagagctagagaagcaactagatgctgactcagcactgactagactcaataactaa

SEQ ID NO: 58034 - DNA, 240 bp, Glycine max
  Peptide Sequence Number=SeqID_174812
atggagaaaaaaggtgtgcacatggcttatatccgagttatacaagacatgtatgaaggggacgtacaaaagattatccctaattccatgccttttgcggatgatatagtcttgatagaggaatcaagggaagcagttcacatgaaggttgaattctggaggcagactttgcaaacaaaaagttctcacacaagtaggagaaagacaaagtatatgcattgcaattttagcaggagataa

SEQ ID NO: 58035 - DNA, 1038 bp, Glycine max
  Peptide Sequence Number=SeqID_174813
atgtgtgttggctcggtcaaatatatgattctggtaaacaatggtaaggttggtctcattactccagggaaggggttgcaccaaggggatcccctcttccttgatttattcatattgtgtgtagaaggattttcggctctaattagaaaagctgagagggtggaggatgctcatggagtaaaaatttgcagggagtctccttctattactaatatgttatacacaaatgattgctttttattttttagagcctttacacaagaaggtgaagctattagaaaaattcttggcatttacagaaaaacatcgatacaaaagctcaacgttcagaagtctgaaatcttttttacttgtaatgtaaggcaagcagaaagggatgccatcaaggagggtctgaggactggcaagtatcttgggatcccatccatggtgggtacaagcaggaaggccacatttaaacatatcaaagaccgagtgtggaagagtatctatcttctcccctcttcgttgtgtgatgagttggagaagatgatgaattcattctggtggggagcgcacgggagggaaaatagaggaataaagtggttggcttgggataaactttcggtttcaaatgaaaaaggtggaatgggttttcagagtcttcaagcattcaacttagagatgataacgtatgaagggcaacaaagctatggtatgtcttcaatgaaaaggggttcgaagaactggcagtctgggaagtattctgtagcatcggtctataacttgattatgaataaaattctggatcttagcccgatagcaaaaacaagtattagagtcatgaaccaagaagagtggttgcctcctccacaaggttttttcaaatgcaatgcgaatgcctcgttgaatgatcgtgagccttgtaccagatggggaactgttattcgagacgagaaagaagccttttttattggcaatgttgaatggtctaccagatcatgtagggtgaagtttgctaggagacaaaccaatgtagctgctcacactcttgcgtga

SEQ ID NO: 58036 - DNA, 558 bp, Glycine max
  Peptide Sequence Number=SeqID_174814
atggagaaaaaggaggaaaaggtggtggtgggcgtgccagtgccagtgtattacggtggagaaaatgaataccaaaggggaatcatccctcctaacgccgtgtttggagatccaaagggcatccccatccagcaaaccatttacagggacactcctgctcctttcaactgcccttactgcgctcataccgctctcactaccgttcaattccttcccatgaacaaaaaagttaaatctatcacggattgcattaagatggcttattcgatgcttacggatgaaatacttgtagacgctcgtttaatcaatgtataccagtgtgaatatgaagcgaatcaacaggacagatcaaagcccagtctggcagcatttgttggatgcttgatgccaatgatgcttggagtttgctttctttgcccttcaatggattgcctttggcataaatatcactactgtcctaaatgtcaagaaaaggttgctgattttgagaaatcagatccctgtgttgtgatggatccaccacactggactcaggagagctttgcattgtctggatag

SEQ ID NO: 58037 - DNA, 379 bp, Glycine max
  Peptide Sequence Number=SeqID_174815
gcagcctataaaagctgcagtcgctgctactgctgagcatcttgctggtttgcttccccttcatcttgtctatggacaggcccatgagactgcaattgaggactggttatggtcagtagggtgcaaccctttctccattacatcacaaggatggcacatttcacagttccagtctgattcaattgctcgaagttatgtcatcactacccttgaagaatcaattcaactggagcacgagcttgttaacaagtacaattatgttgttagcctttggaaaagggtatcaactgtcactggagaattgcactatggtgatgcattgaggctactaaacaacttggaggatgcatccaagaggttggccactattctgccataa

SEQ ID NO: 58038 - DNA, 195 bp, Glycine max
  Peptide Sequence Number=SeqID_174816
atgggtgatttcaatgtagtcctcaaggttcatgaaatggaggaaagctctcctacaacttctacatcgaggagtgattatgcttttgaaaaatttgtccaagatttcaatttgatggatgtagggttccaaggctcttatttacttgaaagagaggtagggttaaagaaagacttgagccatttggggtcatag

SEQ ID NO: 58039 - DNA, 255 bp, Glycine max
  Peptide Sequence Number=SeqID_174817
atggcaaagagtcggagaagatcaacgtcgactgttgggagaatattcaaattcgacgtattgttgatgatcttagtccttgtgaagcatgtcttcttagcagcaacaaagggtggcgatgatgttatggagtttatatacggaggaggtgcaataatgatgagttgtgggagaacaaggatttctcaagtgcaagttcagcggatgtcaaatcatgcatatccaagattacactacaatcatattgaacattaa

SEQ ID NO: 58040 - DNA, 819 bp, Glycine max
  Peptide Sequence Number=SeqID_174818
atggttatcactcaccatactttggcatttacatttggcatgctaggtaatgtcatttcgttcttggtattcttggctccagtgccaacattttaccggatatacaagaagaaatcgacggaaagttttcagtcactaccttacttggtggcactattcagttcaatgctttggttgtactatgcgttgctcaaaagagatgctgttcttctcattaccattaactcattcggatgtgttatagagatcatctacatcgtcttgtacatcacctatgcaaccagggatgctaggaacttaactattaagctattttcggcaatgaacatgacctcctttgctgtgatactcttagtgacacactttggtgtgcatggtccccttcgtgtccaagtcctcggatggatttgtgtttctatttcagttagtgtctttgcagcgccactaagcattgtggcacaagttgttcgcacaaaaagtgtcgagtttatgcctttcaatttgtcatttaccctaacattgagtgccataatgtggtttggttatggcctctttctcaaggacatatgcattgctctcccaaacgtgcttggttttgtgctggggttacttcaaatgctgctctacacaatttacagaaaaggaaataagaagacaaatacaaacgaaaagagtctatcagtaaagccactgaaaaacattgctgtagtgaatccgttgggaactggagaagtgtttcctgtggaggaagatgaacaagctgcaaaaaagagccaaggagatggagaggacaaaaaggctgaagactgcctagtctaa

SEQ ID NO: 58041 - DNA, 333 bp, Glycine max
  Peptide Sequence Number=SeqID_174819
atggctttctgctgtgtctcattgcatttcaaaaagtctaatacagaatgcaatttgggttttccgaaaagcaatgaagcgcaacaggaaacaatagttggagtacaggaagttttagcctacttgaagttgtccctgacttcaacattcatcatcctgggatggtgtgccaattatagaagtatctatgggctcaggctggctagatcctcggtgtttgttcctgaagttgtctgttgcactaaactaccattgcaagaaatggctactaggcagattctaaggaaatcagaacctagtaatagtatatggcctaaatggctggctgtttga

SEQ ID NO: 58042 - DNA, 948 bp, Glycine max
  Peptide Sequence Number=SeqID_174820
atgacaaaaacaagaatctcccaagtttatactgtatcatatggtattgaatattgtgggaaaaacggtgatcctaacctcccgtacgtacttttggttgcccaaagtcagaaagaagcaaagaacatggctatcagccacagtactttggcatttgccttcggcatgctaggtaacgtcatttcgttcttggtattcttggctccaataacaacattttaccgaatattcaagaagaaatcgactgagggctttcagtcactgccttacctggtggcattgttcagttccatgctttggttgtactatgctttactcaagaaagacgccatgcttctcttgaccattaactcatttggatgtgtcatagagatcatctacatcatcttgtacatcacctatgcgacaggggatgctaggaacttaactttaaagctattttttgcaatgaatgtgggcgcctttgctctgatcctcttggtcacacattttgctgtgcatggttcccttcgtgtccaagtccttggatggatatgtgtttccctttcgattagcgtctttgcagcaccactaagcattgtggcacaagttgttcggacaaagagtgttgagtttatgcctttcaatttgtcattcaccctcacattgagtgccataatgtggtttggttatggtctctttctcaaggacatatgcattgctcttccaaatgtacttggttttgcactgggattacttcagatgctgctttatgccatttaccggaatggaaataagaaggttgataaaatattggaaaagaaggcaccgctagagccactgaaaagcgttgttatagaaactggtgaggtgtttcttgtggaggaaaagcaacaaggaaagaagagcaaagaaagcagtgaggagaaggagaaaagtgatgaacctaataacgattgcgcagtctag

SEQ ID NO: 58043 - DNA, 117 bp, Glycine max
  Peptide Sequence Number=SeqID_174821
atgaaggagactttggtgttctgcagtggtggtgcatccaaagggaacatgaccattcaggttatgcatgagtatgaccttactttgaaggagcttggtggtaccaatcctgggcag

SEQ ID NO: 58044 - DNA, 384 bp, Glycine max
  Peptide Sequence Number=SeqID_174822
atgaacaagggaagctataagggtggaagtctttttgtttatgcttgtgtaactttaactggtggtgggcctgttttcgagggctattggatagtggaaacaacaccccacacctattgttttcttgccaatttgcacaatcagtctggttatcgtgctactcatggctcggtgtcaatctggtcctgccagaatcagtggagttgcatttctggcagcatagggagaaggaaagggaagtggtattggtggggcatttgggcaaccgtattatggtcgctgtggtgccacaggaatgatgttacttttaatgatcctcaagctagttctgaatatgttggggacatgattctaattagatcatatatgaatgtcgctagctaa

SEQ ID NO: 58045 - DNA, 480 bp, Glycine max
  Peptide Sequence Number=SeqID_174823
atgagaagcaaatcatggccaaggcgtgaccgagaaaacaaaaacaaaaacagtactactattgtggcccccgaaggttgcttctcggtgtatgttggaccccaaatgcaaaggtttgtaatcaaaaccgagtacgcaagccaccccttgttcaagatgttgctcgaagaagctgaatctgagtatggttacaacagccaaggccctttggcccttccctgccacgttgatgtcttctacatggtcttgatggaaatgggttctgatgaaactcaaaccactcctcagggctgtgcctgcgttaagcgatctccctctgcttatcaacctatgaagtaccaacactctccctctgcttatcaacctatgaatgtcgatgtcgtgttggacatggacacaaacacgtgtctgacactcggacacggcaagaggatagggtgttcatgcttcatagttatcaacttcttcctcctcccataa

SEQ ID NO: 58046 - DNA, 975 bp, Glycine max
  Peptide Sequence Number=SeqID_174824
atggctgattcccaggaatttgtcatcatattttgcttggcttttgtttccatggaatcttctaatgcggaaacagcaaaagatgatttggacaaggaaattgttaacattgattcaaagggtgctgtcatatttgtcatagcagcgtctacctttcttgtgctattgttcttctttatgtcatcttggtttgtctgggtgctgattgtacttttctgcattggtggtattgagggtatgcacaattgtattgtaagcctcactttaagaaaatgccaaaattgtggtcagaagacagtgagcttacctctatttggggagatctctattttctcactggcagtattgttattctgtgtggcatttgcaattttctgggctgctactcgacaggaatcatattcatggattggccaagatatccttggcatctgtttgatgataacagtcttgcagttggctcgattacctaatattaaggttgcaactgtactcctttgttgtgcctttgtctatgacattttttgggtattcatatctccagtgattttccacgagagtgttatgattgccgttgctcgaggtgacaaggctggtggagaagcaattcctatgcttttgagatttcctcgtctttttgatccctggggaggttatgacatgattggatttggagatattctgtttcctggtttgcttatttcctttgctcatagatttgacaaagataataggaggggagcatcaaatggatattttctttggttggtagttggctatggcattggcctcgttttgacatatatgggactatatctgatgaatggaaatggacaacctgcacttctctaccttgttccatgcacactaggtgtcacagtcatattgggatgtataagaggtgagttgaagagcctttggaattatggcacagactcatcgttgtccacagagccctctggctctgaagtttaa

SEQ ID NO: 58047 - DNA, 574 bp, Glycine max
  Peptide Sequence Number=SeqID_174825
ggaagggataggaggtagccaagttgatggggttggaggatattgtgggaaagggaaaggcagagatggtattggtggcattgattgcaaaggagggaatggtagtgttcttttgaggtggcttgtaactgaggccactcaaggtgtatacacacagggaacattgcaagtggaagtggagctacttatcaaagttgcttggcagagtgacacaattgttgaaccatccatgcagttaactccatccaccgatggtatgtccaacttgtacactccatattggtctgtggttctgttcactgagaagcttatctgctcgctagtttttggtgaggttgctctaaatctgcacttagctctgtttagagaaagtgctggtggagcaggtatcacaataaacagctcccaccacactgatgtgagagataattggacttggagattgagcaatgagcacaaatgggcaactgaagagagatgtaacaaaaagaagaaggagaataggaaattgatccatgagaatagtgaagaatcatggggtggatttggagagttgatcgactttggtacgtag

SEQ ID NO: 58048 - DNA, 252 bp, Glycine max
  Peptide Sequence Number=SeqID_174826
atggaggatatggtggagctgatcaaagtgaggtcctcgcaatggagcaaggctaagtcgaagggattcatttttcattctatgtctggtctaataacattagatcaatgttacagcagagttagacaatacctgcaacgaaatacatgtcaagattccctttgtgtgcttcctatcggcatgcagttattggcaattgatgaaaggcataatggtattaatatatctagtggggatagtatactgttatga

SEQ ID NO: 58049 - DNA, 465 bp, Glycine max
  Peptide Sequence Number=SeqID_174827
atgacctccatcagtcagaagacagacgagcgcaaacctcgacatctcaagctcgcaacggtgctggcattgggcgcgaccgcagtgctcgccggcaacgctctcctgatcaggaataccgagccggcgcttgccgcctctgaaaacgttgcatcggccagcgccttccgcatcctcacgccgcaggcgatcgacaggctggccggactttcgggtcctgttgctccaggggaggatgcggcaacaggcgtgtcagctccggcaaatgacgaaacgtcctgcatcgccatccgcgccgcccgaaaaacggaccggtacgaggcgctcgagccaaaagccttctgtcaactgcagcaccgtctcttcaatgccgagctgattgatcgcattgccgcgctccagctcgcatcacaacccgacgataccggtacctcgtcgcaattcgccatgaacaaggagttctga

SEQ ID NO: 58050 - DNA, 318 bp, Glycine max
  Peptide Sequence Number=SeqID_174828
atggacgatctcatcatgtccttcggttaccaatgccgcctgtttgcttctgccgaacagtttctggacgcgcagcagcaggcggacatcgactgcatcgttgtggatgtgaagatgcccggcctctccggcatcgaattgcagagtgagttgaaccggcgcggcgagcatgcgccgatgattttcgtgacctcctacgaggatgaccgcacccgcaacgccgccctgagcggcggcgccctcgcctttctgcgcaagccggtcaatatcggcaaactgatgggatgcctggaatcggttctcggaccgcagccctga

SEQ ID NO: 58051 - DNA, 216 bp, Glycine max
  Peptide Sequence Number=SeqID_174829
atgatcgtgtcgtcaggaccgtccgggagggaggcgtttgactgggacaaggctacggcgggtcagcgctgcgggcacctatacagaggtctagttggtatggcggaaggtcgtggcggaatggcaaacgccgggaggaattccgtcaacggcaatgcgtgccctggcggcacagggccggggcataaaaaacagggctcgaaggaagaggcttag

SEQ ID NO: 58052 - DNA, 109 bp, Glycine max
  Peptide Sequence Number=SeqID_174830
atggctgcggctgctatagcgcgcgttattactgaccatcttatcaatcttctcaatcagcagatgcggcatagtgatattgatgcgctcggatttgcccagatagcgg

SEQ ID NO: 58053 - DNA, 645 bp, Glycine max
  Peptide Sequence Number=SeqID_174831
atgaattacttacgcgacatacaaacgtttattgaaggcaatacggtgctctccgccaccttcagcttgctgctgttactggttgccggcatggtcacccatctgatctgcaagttctttgtggtaaaagtggtgcgccgcgtgttctttagcacgcataaaaaccaggtgccgctggataaagacgtccggctctcagaaaagctgtcgaattttattccggtgatcaccgtctattacctgctgcagtttatgccggacctgcccgagcatctgctgatcgcggtgaaaaccatctgcggcattctgttttttgtttatctgtcgctgttctttaacgaagtgctggagatcgttaataactcctattcgcgtaagtcgaagcgcaagaaccactcgataaaaggctatatccagatcggtaagatcctggtgcacatcatttccgccatcatgattctggctatcatgtcgaacaaatcgccggtgattatcatctccagtctgggtgcggtcgcggcggtattgatgctagtgtttcagcacaccctgctgtcgctggtggccaatattcaggtgtcatcgaacgatgtgctgcagcttggcgactggattgaaatgccggataacggcatcagcggtgaa

SEQ ID NO: 58054 - DNA, 141 bp, Glycine max
  Peptide Sequence Number=SeqID_174832
atgaagaaaaatcgagtcgaagtgcttccgagacgttttcgtgagcaaaatctgcctccgttcttcactgttcttcgttcgttcttcgtcgttcttcagtcttcaaccgttttcttttcttccgctttaacgagcttttaa

SEQ ID NO: 58055 - DNA, 333 bp, Glycine max
  Peptide Sequence Number=SeqID_174833
atgggagcgtacatcctttgtggtacaagtagagcgtacatctacttgggttgttatactgagaacaagagagggtacatctcttgtggatcaattcaagtggagcgtacatccacttggttgttcaaagagaacaagggagggtacatcccttgtggatctttgcttgtaaaggattttacgaggttattggaaatctcaagaaccgatggttgcttggggactggatgtaggcacgggttgtcgccgaaccagaatagaatgtggattaatggttatctttgggacattgagcttaaagcaagcttctttgttaaatatgcaagagattga

SEQ ID NO: 58056 - DNA, 659 bp, Glycine max
  Peptide Sequence Number=SeqID_174834
atggagaattgcactaggcaatcacttcgtgtggctcagactcattggtggaggatgcatgaacgacaatcaattcatggggctccgaataaaagtggagaatggagaattgcactaggcaatcacttcgtgtggctccagactcattggtggaggatgcatgaacaacaatcaattcatggggctccgaataaaagtggagaatggagaattgcactaggcaatcacttcgcgtggctccagactcattggtggaagatgcatgaacgacaatcaattcatggggctccgaataaaagtggagaatgcagaattgcactaggcaatcacttcgtgtggctcgagactcattggtggaggatgcatgaacaacaatcaattcatggggctccgaataaaagtggagaatggagaattgcactaggcaatcacttcgcgtggctccagactcattggtggaggatgcatgaacgacaatcaatgcattgggctccgaataaaagtggagaatgcataattgcactaggcaatcacttcgcgtggctccagattcattggtggaaaatgcatgaacgacaatcaattcatggggctccgaataaaagtggagaatggagaattgcactaggcaatcactacgcgtggctccagactcattg

SEQ ID NO: 58057 - DNA, 417 bp, Glycine max
  Peptide Sequence Number=SeqID_174835
gaatcgcaccccacaaagacacccagtggacccagagaagtccaaacagggccctggggtttccagctctggttacgggcctctgtagtcctacagggtgcacgttccccccggcaaggtcatgtcatcataggtaaggatcgcgcctgcaagacacccagtggactcgaagaagttcaacagggtcttggagttgtcaaagctctaattacgggtctctgtcagttctacggagtacctgtcacctccagcaagggcatcaggccccctactaatcgagctttcatcaagaagtactgcgcctccaggcaggcgcagggcgaaacaccacaacatcctggggatggccgacagcgggcaacagacacaccgccatcacctctagagttcacctcagctcatccacaaaaaggttag

SEQ ID NO: 58058 - DNA, 381 bp, Glycine max
  Peptide Sequence Number=SeqID_174836
gtcggccacctcgtcgctgccgtgctcgggcacgcgcaccgacaggtcgccctcgccaaagcgcttgacgccgcgctgcaggttctccagccgcttgagcaggcggcggatgatggggaacacgcccacggccacggccacgcccaccaggcccagcagccaaaggaagccgaagggcgggcgcagccagaaggcggcggcgccgtcgtgcggcgggcggtcaccgcgcggcgggcgcggcgccatgtgcagcatgtaggtctggccgtccgtgccctcgatctcgaagcgcagcccctcctcgggcgagccgggcaggcgccgcgcacggccctgggcgatcacgttgccctggccgtcgcgcatggccacgtcgcgtga

SEQ ID NO: 58059 - DNA, 249 bp, Glycine max
  Peptide Sequence Number=SeqID_174837
atgacggacgaaggttgcaccaacagaggaggccgcgggatggcgggaatgacgcgcgaggaggaggatgaagaggaggcagaggagattgatggcttgtggaagtgttgtgaaacattttcagaggatatcgtagaaatggttgtggaggttgttgctcggagtggcagaggaaggagtggaggcgctgtgtctggagtggcggaaaaagaggtttttttttaccaatatacacgctctctctcctaa

SEQ ID NO: 58060 - DNA, 322 bp, Glycine max
  Peptide Sequence Number=SeqID_174838
atgtgttggtattccttttcaaactgtaatgtaaggatagcgtcgtcgtctagtgaagccgtttgctatgcagtgtgtgtgagtggcgatgcaaatgcaagttccggtgggagggcgagtccccacatggttctctcggcaaagactcctcgaagagaagctgtgcgaccttcacaagtgcagcaatttggactctgtgaaccaaatccacgctcaagtcctcaaagccaatctccaccaagacctcttcgtcgctcccaaactcatcgccgccttctccctctgccgccacctcgcctccgccgtcaacgtcttcaaccac

SEQ ID NO: 58061 - DNA, 1356 bp, Glycine max
  Peptide Sequence Number=SeqID_174839
atggaggaggaacaaaacggcggtcgtttcgacctcataatcctgggcgcctcaggcttcacaggcaaatacgtcctccgcgaagccctcaaattcctcaacaccccatcctcccccctcaaatccatagccatagcgggccgaagcccacaaaaactaacccaggcccttcagtgggcctccaggcccaaccctcccccctccctccccatcctcaccgcggacaccgccgacccctcctccctccgttccctctgcgcccgcacgggcctcctcctcaactgcgtgggccccttccgcctccacggcgagcccgtcgtggccgcctgcgccgcagcgggctgcgactacctcgacatctccggcgagcccgagttcatggagcgcgtggaggccgcgcaccacgagcgggccgtggagacaggagcgcttgtagtatcggcttgtggattcgactccgtgcccgcggagctcggcgtgatgttcaactccaggcagtggatggggcccgccgcgccgaatcgcgtggaggcttacgtggcgcttgagtctgagaagaggattgtggggaactttgctacttacgaatctgcggttctcggtgttgccaatgcgcaccagttgcagcaactcagaaggtcacgcccaagaaaacctaggcctcagattcctggacctcctacttcaaaaggagaaactatagagaacaacaagaaaattggtctttgggcagtgaagttaccttcagcagattcaattgtagttcgacgaacgctagggattctaacagaaaacctccatggtctccctgggctgaacgagagtgctgagacagttgagaaaagggaagccttctggtcatctgtgaagccagctcattttggtgtgaaaataggctcaaaatctttcttgggcattctccgaatcatcatggttggagttttcattggtctttttggaagtattggttttggaaggcagcttcttttgaaatttcctgaaatattcagccttggttggttcaggaagaatggcccctctgaagaggaggtggaaagtgcttccttcaagatgtggtttgttggacatggttatagtgatgggagcattgcttcacagggaaacacaaaacctgacatggagattgtaacaagggttatgggacctgaagttggatatctgaccacaccaataattcttattcagtgtgctcttgttcttctctgccaacgtgacaaccttccaaaaggaggagtttaccctcctgggatcatctttggtccaactgatctccaggaaagacttcaacaaaatggaatatcctttgatgtcatctcaaaaagcaccatttcttga

SEQ ID NO: 58062 - DNA, 906 bp, Glycine max
  Peptide Sequence Number=SeqID_174840
atggaagcatgctttctctcccacaattcctttaccaaaaccaccgatcaactcatccccacaataagaaacgggtctctaccacaccataagcgatcttctcaacatcttcagtgtagaaaagctagaattccacttcccatatcatgctgccacatgtcatcaccatcaccgtttggtgatgatgacaaacctaccctaagtagtgattggcgatctttccgtgcaaaattggtggcaggagaacaattaacaaggcatgttgaggaggtgaatgatctagacactgttgtggatcatcctccactgatcaccattggtgacaaatgggcacacgtaatccacgagcccgaaaatgggtgcttactaattgccaccgaaaagcttgatggggtccatattttcgaacggacggtcatccttctcctatcaactgggcccttaggcccatcagggatcatcttgaatcgtccatcgttgatgtccatcaaggagactagatcaacggctctggatgtggagggcacgttttccaatagtcccttgttctttggggggcccttggaggaagggatttttttgttgagtccaaaagagggtaatggtggtgatggggtggggaagagtggggtgtttgaggaagtgatgaagggtttgtattatggggcaaaggaaagtgttggttgtgctgctgaaatggtgaagaggaatgcgattgggcttggggattttaggttctttgatgggtattgtgggtgggagaaggagcaattgagagatgagataagggctgggtattggactgtggctgcgtgtagcccaagtgtggttgggctggggagtgtgggaagtattgggctttgggatgaggttcttgggcttatgtccagaaggaaggtcatgtga

SEQ ID NO: 58063 - DNA, 318 bp, Glycine max
  Peptide Sequence Number=SeqID_174841
atggtttatagtggaacactaccttcactgatccattcaacacatgtaagtttcttacttcttgttgctttaaggtcatgtttggttactcataaaaaatgttttttttatgacggtgacaacaatgacaacaaaaattgtgatggtgatggtggtagtgccgacatcaataatggtggcaaaaattacactgataatgataatgatgttggtaacaatattgatggtaatgatgatagcaatgcgggagataatagtgatgttgcgacagttgcgatgacaatggtagtccagtggtgttggtggtggcaacggtga

SEQ ID NO: 58064 - DNA, 405 bp, Glycine max
  Peptide Sequence Number=SeqID_174842
atggatctagaaggaaaaagtagagaaatctgttttggcattgtgatcaatttttgcaccagcgtctgttggctttggaagctctctgccactcctcaaggtcttggatggtggcactcacattttgttgaaactgaatgttgttggtggccatttgcttcatcaactcctccaaggaaggtccagaactgctattctgcacaggctatgcagggaagaagaagacaaacacaagaattttatactggttcggcaacaacccgtgcctacatccagtccccaagcgacctgcggtccttgagatttcttttcgaccttgtaaaagcctttacaagcaaagatccacaagggatgtaccctcccttgttctctttgaacaaccaagtggatgtaccctccacttga

SEQ ID NO: 58065 - DNA, 246 bp, Glycine max
  Peptide Sequence Number=SeqID_174843
atggatgaaaccatcattgtcttctcaatcatagacatactttttccttcatggaaagactttaaaagaagtctaaaacatcacaaagatgatatttctcttgaacaatttggcaatcaccttcatttagaagatgagtaccctgaacaagatgatgctaaggaagtttctattcaagcaaaagtgcatgtaatagatgaagggacaacaaatgttgggtcgactccggtgcaacctgccatgtag

SEQ ID NO: 58066 - DNA, 729 bp, Glycine max
  Peptide Sequence Number=SeqID_174844
atgagtgcttgcaaaaccctttcatgtttctccctctcttcttcctcttccttcttcaaacccacccttctccaccctcgccaacgtctaaccctaactcggagatgttccacgtcagccctactcgaagaaccggaaccccaatctccgagcgttcagcacctcctcacgagtcccgacggcgtctccacgctgatgaagatggaccgcaagcctcttctccctcacgagccgcacgttcgctggttcccttacctcgacgcctaccgctgccgaaacggctgcgttttgagcagcgccgaggtcgtccaggccctcgcgccctgcatctccgacgaccggaggcagaggttcgggagcgtggttcggaaccggagctactcggtctgcctcgtcgtggaagggctctgcgacttcggcaacgtctccgccacgttccggtccgcggacgcgcttggcgtccagtccgtccacgtcgtgtcgtgtgacgccaacaaaaggtataaagataatcgccatgtgagcatgggtgcagagaaatggttggacattgaactgtgggactctacaaaggagtgctttaaaatgttgaaatcacgcggttatcgaattgcgacaactcatgtgggaatggatgcgtgctttgttacaaatatgtacataggggaccaatgtctggataaaggtgagggttgtgttaggcagttgacccccaaagcaccaacttga

SEQ ID NO: 58067 - DNA, 1536 bp, Glycine max
  Peptide Sequence Number=SeqID_174845
atggggttgaaatttacaaagcagggaccacctaaaattgaggatccaagtttacataatcaaatgatcaattaccttaccaagaattttattcgcaacttggtatctaagcaacgaagaagaatgcttattgctggttatgatcttgacatgtcatatatcacagaccgagtattagcaatgtcatttccggcacaacgtatgcgagcaatgtatcgaaatcctctatggcaagtcaaatctgtgttggacatgagacattatgaccattataaggtgcaccttcaacctatggccatgtatagtgcatattatcttcttgtcaaccttcaatgtgatattgataatgattatccatacttgtgtagttctgctctaatgtctatgtctattgaacttgttcatggacattttttgatctataatctctgtatagaagaaagttatgatccagataacttctatggacgcgtggaagcatacccctttgatgataaccatgtgccatctcttgaaatgatcaaagctttctgtgaaagtgtggattcatggctgtcaagtgacccaaaaaatattgctgttattcattgcatggcgggaaagggtagaactggattaatggtgagtgcatacctaacttattgcggcatgtcagcagatgaggctcttcaattgtatgcagatagacggacaaccaataatgaaggagtatcaataccaagccagcgtcgatacgtagcatactgggatagtctactttcaaattctgtcccaaggggaactggaaatggaccgacaaaggtgaacttgcctcagccatgtggcagagaattacggcgaatccggctttatgatacaatcaacattgacacaatattctttgttatctcagagctacacgagattcctaatgaggtgtatcgtccaccagtggaagcttatcgtggctgctgtagacagattaagaaagggtatcagagaaataatagtcctcgctattatatctctattcttgaaggtgataaagatggaaatcaatcagaaacagaagaacctcgcattgtagttcaaatggacacagagagtccagcaatataccaaaaatcatgtttggaccattattttgataaacctatacaagtaacaggagatgtacggctcacattctatgagaaaatgataggagggcgcctgttctactgctgttttaatacagcttttattaggaacagcttactacagctcccaatacaagagttggacaaagttgggaagaaaggaacatcaatatgtggccctgacttctgcttagaattattgtttggtcctgctaatgcaggatactcatcgtcaacatattcctgcaaaatgatcccaacaatgagtcccttgtggtgtgatgtagtaagagcattcattcctccaactgctttgccgtctaatttttcattggccaaaggcatggagaaagatgaagttgagagcattataatgcaaaatttcactagttttcttggatttaattttgatgtttaa

SEQ ID NO: 58068 - DNA, 1761 bp, Glycine max
  Peptide Sequence Number=SeqID_174846
atggagatagcagcagcgacacctttcacaacggtgccagtactgacaccgttgttgtggatgacaatccatttagcagcggggtggagtctgcgacagtgcctaccatcagctgcagtgggaggcttctgctggatcgtctctggttccaatccagagccggcccaaaaaggtcctcggcttccggaccgtgtctggtttgacacgggggccgttcgggcgggttctggatccgcggagcaagcgagtgcagaggtggaaccgcgcgctgctgctggcgcgtggggtggcgctggcgatcgacccgctgttcttctattcgctgtcgatagggagggaggggtcgccgtgtttgtacatggacggagggctggcggcgatggtgacggtggcgcggacgtgcgtggacgcggtgcacctcttgcacgtgtggctgcagttcaggctggcgtacgtgtcgcgggagtcgctggtggtggggggttctggttcgacgcattcgtgattctcccagttccccaggttgctggagggtgctggtatgtccttgcaattcaacgtgttgcatcctgcctccggcagcagtgtgagagaactaatggatgcaatctttctgtgtcatgctcagaggagatatgctaccagtctttgttaccagctagcgcgatagcagattcatgtggtggaaactcaacagtggtaagaaagcctttgtgcttagatgttcaaggacctttcaaatatgggatctaccaatgggcacttcctgtcatatccagcaactctttggctgtaaagattctttatcccattttttggggtttgatgaccctcagcactttcggaaatgatcttgaacccacaagcaactggctagaagtgattttcagtatatgcatagtactcagtggactattgcttttcacattattgattggtaacattcaggtattcttacatgcagtcatggcaaagaagagaaagatgcagctgagatgtcgtgacatggaatggtggatgaggaggaggcagttgccatcgcgattaagacaaagagttcgccattttgaacgtcaaagatgggcagcgatgggaggagaagatgagatggaaatgatcaaagacttgccggaggggctgaggagggacatcaagcgccatctttgcctcgacctcattagaaaggttcctctattccacaacatggatgatcttattcttgacaacatctgtgacagggtgaagcccctagtcttctctaaagacgaaaagataatcagagaaggtgatcctgtaccaaggatggtgttcgttgtccgagggcgcataaaacgcaaccaaagccttagcaaaggcatggtagcctcaagcatccttgatcccggagggtttttgggtgacgagctactttcatggtgccttcgtcggccgtttatcgacagacttccggcctcctccgccacatttgtatgtcttgaatcagcagaagcctttggccttgatgccaataacttgaggtacatcactgatcacttccggtacaaatttgcaaatgagaggctgaaaagaacagcaagatattactcatccaattggagaacttgggctgctgtcaacattcaatttgcttggagacgttacaggcagaggactaaaggtcctgtgatccctgtaagggacactaatggaggcactgaacgcaggctcttgcaatatgctgcattgttcatgtcattaaggccacatgaccaccttgaatga

SEQ ID NO: 58069 - DNA, 929 bp, Glycine max
  Peptide Sequence Number=SeqID_174847
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaagtcaaacgggtggcgctgcatttgctggcgtgcgtcctgcaccagcaggcagtgcgtcacctgcaggccgtcgcgctccagcgcataggccacggtgcgggcgatggcggggtcgtcttcgagcagcagcaggcgggtggacatgggcgatcagcgcgcaatgaggaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58070 - DNA, 291 bp, Glycine max
  Peptide Sequence Number=SeqID_174848
atggagcatcgagattactacgcttgtgatacaaaggcaggttcttccatggacgaaactagtgcaaagatagaaattcatggaatcaaagcagacataggagagaaagatgaaattaaacctggaattgatatccagtgcaattacaaagagatgcatgttaacctatcaattgatagtgttgaaaaaatggatgctgctatgttaatcattgaactgctaatcacctctgtaattgatttagttgttgaccctctatatcagtttctagggacaacactaatgttctaa

SEQ ID NO: 58071 - DNA, 480 bp, Glycine max
  Peptide Sequence Number=SeqID_174849
atgcttgcaaataggtctttacctccaaagccgaggggtagcttggagcggggtttggagatgcagaggatttcaaagttggaccagcacttcacagacaagggcttggtcgaggcgttagtcgccattgaggaccccgatgacgatgttgatgtgattctcaaagccgaggaggaggtcaaggttacagaggctaacatcggcgtcaatggcgaccacaaagaagcccaggcgggcaagggagaggccgttgttggtggtcttgcccacgccgcctttatcgaaggtaatgatggtgaccgcgggatgaagtcgaagagctccggcttgtggttccactggaggaggggttttagaggggaggaaagaagaatgggggcaaaggatgaatgtgtagttgggggcagtggtggcgccgaggaaaaggtggagagagggcattgggaagaggagagagggaggaaaataagaagaagatag

SEQ ID NO: 58072 - DNA, 549 bp, Glycine max
  Peptide Sequence Number=SeqID_174850
atgatactggcgaaaagctcctgcgtacaacacgtggcaaaaacgtcactaccactggcgattccaagcaatggatatagccagtctcacaggcgatttgcacagcaggctaggctcactttttatgaaaattgtttacaagggaatgcaaagcaagggcctctgttctgtggcatggaaatttgctctgtggatgatacctcagttgtttgcatacgccataaacttttcaatagtaaagttcctacaggcacagcacagaggaaagtgctgcttggatggggcctaattggagcagcaattactctcaacacatcatggcgggtcattgtgattgcacaattgttgtacattttcatcactaagtcagatggagcttggagtgggtttacatggctagcattttcggacatgtttggttttgtaaagctttctttggcttcagctgttatgttatgcttggagttttggtatttgatgatactggtggtgataacagggcgtttgaaaaatcctctaataccagttgatgccatatctatctggtaa

SEQ ID NO: 58073 - DNA, 396 bp, Glycine max
  Peptide Sequence Number=SeqID_174851
atggcgcaacacagcacaaaagccatattatcgatgtctctagagaagcagttggcaagctatcgccacctctacgatgggctctacaattccatctacggtgtcttcgttggccttcaaattgtcgcaattgttagagttgtgcagaaaaccactgtcagttctcaaatgtactcaacggaggcggagacgaagctggcacaactgcaaagggaacacgcagagcaagtgaaggggtttcggaaagaatacataagagagatggaagtggtgaagattgagaaggagtgcaaagccaagaatcgcagggaagtcctcagagtagccaacgaagagcacaagaagctcgaggctcaagcctcgcagctcagagcgcaggagcacgaccttgaatga

SEQ ID NO: 58074 - DNA, 663 bp, Glycine max
  Peptide Sequence Number=SeqID_174852
atgtggaactttgcatctagtttaattgctggaagtgtgggtctgaaaaatgattctgcaaaaccaactcaccctgcttcagaatgttctgatgatgagacttctatggtaaccagagaggaaaggctggaatgcccaatatgctgggaatcctttaacattgttgaaaatgtgccttatgtcttatggtgtggccacaccctttgtaaaaattgcatccttggattacaatgggctgtggtgaaatttccaacgctgccaattcagcttccgctttttatctcctgcccatggtgcaaccttttgtctctccgtttagtttaccggggaaatctgaaattccctcgcaagaactactttcttctttggatggttgagagcatgaacggtgatagagtgaagtcgcattctactgtttgtggggatcatcaaccagtctggccaataattaaagacagtttaaccaatggaagccaagaaggccatggcatcccttggagagggcaagtttgccatacagagtcttcaagttccaatcaatatcatggcaataccactctggttgagcttggctggttaggaggagggatatcagtttttggcataaactatttggacaaccaaggccgtggagtgaataagagttattttcctggcaattaa

SEQ ID NO: 58075 - DNA, 270 bp, Glycine max
  Peptide Sequence Number=SeqID_174853
atggattctcccttactagaaaacattgacaactctactacttatgttgaggagaagaagacactgaactctgttgttaagaaattcgggtttgagtcgaagaagctatggaaaatagcaggccctgctatcctcacctctatatgtcagtactcacttggtgcactcactcaaacatttgctggcctagttggtgaccttgaacttgcagcagtttctgttgaaaattctgttgttgctggcctcgcctttggagtcatgcaatgctga

SEQ ID NO: 58076 - DNA, 276 bp, Glycine max
  Peptide Sequence Number=SeqID_174854
atgggtttcattcataaccaagcttcaccctctcacatagggataagaactgtgggcgtggaaaaagcttgcagtttctccattgattcagatctttgcatctccatagttacttggaacatgaatggccaggttacgtttgaagattttgctgaaatggttggcagtaaccgcgagttcgatcttctagctgttggcttgcaagaggctcctccatgtccacgaaacaaagtcgcaactctgctttcagcagctcttgatgaaagtcatacgtaa

SEQ ID NO: 58077 - DNA, 666 bp, Glycine max
  Peptide Sequence Number=SeqID_174855
atgttatacctgtttgggctaaaggatgctggatcgttcattaacgaattgaaggtagacaaacaatctgttgggggctgtggaggaataattggaagaaagaaaggggctgtagccatccgtatcaactacaaaggcattcgaatggtgttcatctcgtgccacctctctgctcatgctcgcaacgtggaagaaagaaattcacaatgcaggcatatatcacactccctcttttcaaagttctggaacccatattctagaccatcccatattacaatttggttaggagatctaaactacaggcttcaagggattgatacatatcctgctagaagtttgatagagcaaaaccttcaccggcggttgcatggcaaagatcaactcttacaggaagctggtcgaggacaaattttcaacggtttttgtgagggaacattgaatttcaagccaacttataagtacaataaaggaagtagcaattatgatacaagtcataagatacgagtgcctgcatggacagaccgtatattgttcagaattgaagacgaaaacaaaatggaagcaaccctacattcgtacgagtcgatggatgaaatctacggttctgatcataaaccagttaaggcacacctctgcttaagacttcgtcaaattccaactaattaa

SEQ ID NO: 58078 - DNA, 378 bp, Glycine max
  Peptide Sequence Number=SeqID_174856
atgggttggcttagcagaatttttaaaggctccgatcataataagctttcggaagggcattactataaagaggatgcgggttattacttgccatccacttcgggggatgcttggaaccagagccagaaccagaacgagaatgaagatatcgatcgtgctattgcactgtctctggtggaagagactcagaaagcaaacaacaatgtaaatgactacagatcacaattagaagaagatgaacaacttgccagagctatagaacaaagtctaaatttggagtctcctcccagatatggaaatgaaaatatgtatcaaccaccaattcagtatttccccatggggtccaggtatgagatgttgggggatgacaatgtatga

SEQ ID NO: 58079 - DNA, 294 bp, Glycine max
  Peptide Sequence Number=SeqID_174857
atgaccatccatctgctatatctgccaaatatcgcctacacaccctgcagcaatcacctcactgctcatcaccaccacaaagccgccttcaatctcaattctcaactaaacaacacctctcctttcacaattccaacaaatcctgctggtcttattgaatatagggcacatccattctggatccagaaatattgccctactcacgaacatgatggtactacacgctgttgcagctgcgagcgaatggagggaaaggtggatgaacttgtacagtgcaaagtgaatagaatgtaa

SEQ ID NO: 58080 - DNA, 849 bp, Glycine max
  Peptide Sequence Number=SeqID_174858
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggagggttgtacgctcttatcgctgttggatatacaatggtttacggtatcttgcgattgataaacttcgcgtttggtgatgtcatggttatgggaatttactttgccttttacggtgctactctcatacgttttagctttcctcttgcagttgcattttcacttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 58081 - DNA, 306 bp, Glycine max
  Peptide Sequence Number=SeqID_174859
atggaacaatttctggacaaggtggcctggcttgaagcccagtttcctttaggaagagcccctgaggttgttcctcccagtcctataccaacaaggacagagcctgcactagctgagtcgcaacctccagtagtaaacccacttgcttctccggaggttgagatactatctcctccaccagctccaccggcaccacctttgatactcattcctgatgactcagatgctgaagttgttgctcctcctgactcaccaacccactacctagaggatggttcagacttttctgattggatggactattga

SEQ ID NO: 58082 - DNA, 285 bp, Glycine max
  Peptide Sequence Number=SeqID_174860
atgggctcagaaatctaccctgaggttcatgagaaccctagggccttcttcagcagctctagcccaatcttcttggagcctcttgctcatggttctagtgactggtcccttcctagggaggattgcatcaccttcatacttccttatttctttcaaacatgcccattacttctacgagtgttcactaagattgggagtcaccattccatggaagactttgtcgctagaggcaaaaagcccaaagacaaagtccagatttatacctggaaagatgctactctttaa

SEQ ID NO: 58083 - DNA, 1062 bp, Glycine max
  Peptide Sequence Number=SeqID_174861
atggctaaaccatcatctaatgttacaacaaggaaaaataagacagaccctggttggaagtatggtcatccacttgtggaaggggatacaaacaccattgcttccaaagaacacttggttgggaagtcgggtaacattgcatcttgtaagaaaactccactagatgtagtcgaagagcttaagggatatatggttaacaaaaaaagtgagaccacttacagtagtactggtagtggtaatgtgccaaatataagagattttgaatttggtgaaccagttggatgtgatgaaagtgaagatgagtttgaggactcttgcaatgctactgctttggccacaaagacaaactggtttgtcatcaagctcattaaattgaaaagctttgagaatatggttgcaaccattggtcaatatgggccacattttcccatttcaagctatcatgatatcagagttccactcctgaagaaggaagttgaatacgctgaaaatttgatgaaaggccacagggagcaatgggtcaagtatggttgtactattatgtcctatgcatggattgatcgaaaaaaaaatctcaaggttgaaaagaaatctcaaggatcacagattgcttggggactggatcgagggttttacatggagaacttgttcttgagggagtgttataagacgaaggggcttgggagaatgttgctctctgcggtggcaaagcaagccctaaaaatggggtgcaaaagggtcaagtgggttatgcttgattggaatgttctcaccatcaagttttatgaaaagatgggtgctaacttcattgaggaatatagaagatggggaaaacaaggcagaaaagaattgcctccgccactaagaggccctctccctcctcccctctctggccctcgcctcgaacccattgattgtgaaaagcttgtaggcctaggatcttcttcatcaatggattcctttgcttcttggaagatgaatggcagcggaatgaagaaggaagagagagaggagatgtcacttcaaggagaagatgagtctagaagaagctcaccaccatag

SEQ ID NO: 58084 - DNA, 669 bp, Glycine max
  Peptide Sequence Number=SeqID_174862
atggaggtcaagcttgaaaatttgaccttgtatgtgaacgacaactcccacgcaaagttggtgacattcgattttattggcattgcacactatgacccgaaggtctcgggtgctaggtggcccgaaagggcatggaaactaatttgggcttgcgaagattctagtggttccttaaagtcaaattgtggttccataatgaggtgttcgtcctgttggtcatcctcatcatctgcaatgagaagaaagaatttggaagagcatttgttcccccaactgaacttctcatcgcaattgaaaggaagcccattttctcggtggatcgccatctcctctggggacagacgtttgagtggtaatggtggtggttttgaaggggaagggtcctcatggggttgtcatactatgacaaagcaaagtgggcctctaaggcttgaaagagacctggccatgaagagatctgaccattgctggtcatccattggaaccagtggagtgatattcaaacaactgggtgatcttaaagatgcccaaggggtccgacccatcaaagtggggtacctccagcttcatatgatgagaattggtgggcatgttgttgtgggtggctgcaagggtcaactagttagaggtgagcttggcgattgcatcctctatacattccatatgtga

SEQ ID NO: 58085 - DNA, 261 bp, Glycine max
  Peptide Sequence Number=SeqID_174863
atgaggaacgttcctataggtgttggtcgcaggaagaacaagagctcggcttctcactggtgcaagggagggtcagtgagggtgggggaactcgtggaagagaataaggtagtgttagacttttggcaagcgtaccaattgttgtcgcaggtagcgacagaggaagcagaggatgaggacgatcaggccaaggaagaaggaagaaggaggtggagagaaagagctaggttttttgagggaagagagataacactcaaatga

SEQ ID NO: 58086 - DNA, 1146 bp, Glycine max
  Peptide Sequence Number=SeqID_174864
atggaagagagaactcgtcaccatcgtgtcactgtcgggtcatcgtcgtcgttgttgtccgttgtcgttgctactgcgaatgggagaactcgcaacttcgaggagcgaggaacattgttcaccgcaattcctcaccccaacaaaaggtattgtgttttcatcttcgactttggtcttatcagatttgatgacaataagagtgaaaatgatagtgatgttggttgtgaagatggagccgaggagcaacatggaagtcttcatgaagagaaaaggatatcttatttgacaggcgatgagataaagggtctccattgggaaagtgaagatagtgtttttcaattctatacaagatatgctagatgccatgggaaacacttcatgagggtggatagaaaaagagaccgtagacttatcactcgtactaattgtgaagccaagcttcgtgtttatttagattacaagacatcaagatggaaagtgtattcactccgtgagacccataaccatgaactgaccccacccactgatattcgtcatattcctaagtataatgtgatgactgatttggataaaagccaagtggacgatagtttgcataaatttggtgttagaacttgccacatcatgggatgtttaatggctcaaaaggatagatatgatggacaacgagatatgatcaaagacaaagatgtttgtgttgcattaagttatttggcaagcaagtttgccaatgatcccttgtcatattcaacattcctaactacaattgatgatagattgaagcatttattttggggaaatggaagcagtaaagtggattatgaatgctttagtgatgtacgtgcctttgacaccacttacaagaagactaaatacaataatccacttgtcattttctctggatgcaatcatcattctcagatcactatctttggtgcttctcttttggctaatgagaccactaatatgtataaatgggtattatggacttttttgaaaacaatgaacaagcaacctaaatcaattgtgactgatggtgatggagctatgagggaggccataaaagaagtgtttccaaatgcaatacatcatttgtgtggttggcatttgagtaagaatgtgtttgagaatgtgaagaaaaaatga

SEQ ID NO: 58087 - DNA, 285 bp, Glycine max
  Peptide Sequence Number=SeqID_174865
atgagggacaagccattattggatcgcatggaccttagtcggcaaagcaagtctaactttgagaaccaccacacacctcctaattcgacaagtaattcatctacgataggaatcaggaagcaatccttcaccataattatgtgtcgcaacctacccttcggtgggagggcgacgcgagggcttgcgggtgcgtcttacaagaaaggaaaatgcgcggagtcgccaccaatgtttattcgaggaaaatgtcagaaaaaccggaaaggtgtggtctacgaattttaa

SEQ ID NO: 58088 - DNA, 126 bp, Glycine max
  Peptide Sequence Number=SeqID_174866
atgcacatgaggatcaaaaggtctttaaaggttgtaatggggccaaggacaagtacgaaattgaagattaaagcaagaactaggcaatatacagatacatcaagcatggccaaaataaaacattaa

SEQ ID NO: 58089 - DNA, 201 bp, Glycine max
  Peptide Sequence Number=SeqID_174867
atgggtcatagagtgggggaagaacaactcgatgttggtgatttccttatcaacgttgtcatcaaaggaatcaaaggagatgaatatgataggattgaatcagaggtggcagtgaagaagaaacttaagatgatggttgagtttgcggaggtccttcttacaattgccttgcttcacaactgtgaaggagccaaagattaa

SEQ ID NO: 58090 - DNA, 360 bp, Glycine max
  Peptide Sequence Number=SeqID_174868
atggcgacaatacctactaggtcaccatttcaccattcttaccgatcacctgagcctcaaggaatgaatgattcaagtggtgcagaccccagagcaacaaatgtttacttttcccgtcaccagttccttctcgaccttgggaggatctatccttggacttcattgtgggactaccggggtcatattgttattttagtggctgtggaaaacttttcaaagggctttcatttaggaatgctccaacctcattattttgctcacgcagttgcacttttgttcatggacattgtcaaaaaaatccatgggatgcctcgaagcttggtttcagaccatgatcctttattcatcaatcgtttctag

SEQ ID NO: 58091 - DNA, 180 bp, Glycine max
  Peptide Sequence Number=SeqID_174869
atggtggcaatcagagttatgtttgaaaaactaaaggaagaagttgattctgacttgggtggttttgctggagatttggtgggcattcttgaaaagaatttggtgtctgatcgtgctctgctccagccagaactccctgctccaggttcaaaaattgttagatattggaaattcttttaa

SEQ ID NO: 58092 - DNA, 258 bp, Glycine max
  Peptide Sequence Number=SeqID_174870
atgatgtatattgataggaacaacaatcagaagttacaaatagcaaggcctaagagacaaaacaatacacctgctcacttgaaggactacgtgctgaatggatgcagtggaagacaaagaagaagaggtgagaggaggtgccatccactagggaataagccatggaagaaggagcttcaccaccaagatgagccttggataagaagcttggagaggatgcttcaatggaggaaaagaaagatggagagaaagagatag

SEQ ID NO: 58093 - DNA, 201 bp, Glycine max
  Peptide Sequence Number=SeqID_174871
atgggagctcacaaagccagctgcgccaatgatgaggacggacatgccgccttgacggtggatttgggcagagaggagggagaggttgaagccagggaactcgaaggagaggagtttggtggcgacgacggagcagaagagggaggtgagggtttggaggaagtgagggtgagagtgagagagagtgtttggaggaagtaa

SEQ ID NO: 58094 - DNA, 468 bp, Glycine max
  Peptide Sequence Number=SeqID_174872
atgacgatgatgcgggagttgtcgcggaggtcaatttgcggcgagtggaaggggtcaccgttatcggagagcaaggaggaaggaaaggctttgtataccccaccaaagcagcaacaaggcttcaagctctacgacaggaggaacaacaccctcaagaacagccttatgctcaacaccttgatgcccaattttgctcacaatcacaacaacaacaactctccaagcttctcatcaagtaacattcctgagatcctctccccaggccttcttgacttcccttcccttgctcttagccctgtcacacaatttaatgatgacccatttgacaagtcctctccttcattggggaactcatcagaggaggataaacccatagctgaaagggcttctacttgcatccctctcccatctttaatccaagagactcagaaccatagctcttgcctcttttcccagttactcacctag

SEQ ID NO: 58095 - DNA, 369 bp, Glycine max
  Peptide Sequence Number=SeqID_174873
atgaggtcctttaatggtgattttccaccatggagatgcagcggaagacaaaggagaagaggtgagaggaggcgccatccactagggaataagccatggaagaaggagcttcaccaccaagatgagccttggataagaagcttggagaggatgcttcaatggaggaaaagaaagagggagagaaagagagagggggagcacgaaattgaaagaataaaagaggtagagaagtggaactttgaattgaagaaacctactcaacctattcgtggagtccctactgctatcaattgcatagcaacactacttaaggaacctgtggttaggtcttcctttgtgtcgttcatttcactagcatccactcagtag

SEQ ID NO: 58096 - DNA, 882 bp, Glycine max
  Peptide Sequence Number=SeqID_174874
atggatcgaagttggatgaaatcatcatgcattagtgatgagtatcaaaatgaggttgatgaactcctgcaatttactaaacgtaatacaccatatttgcgtggaaaatttttctgtccatgtgttaactatggaaatgggagacaccaatcaataaatgatattagatcacatcttatatgtgaggggatcattcccacttacacaaaatggatatggtatggcgaattgcctgacatgccacaagtccctcacattaagtcagttgatgaagatgtcggacatcgtatagaagacatgattcgcgaccttggccaagatggttttcaacaggcacatagtgctttgtatgacaaaatagaaaatgattcaaagaagcctttgtattcggggtgcacaactttcacaaggttgtcagcggttttagctttggtcaacttgaaggcacgatttgggtggagtgacaaaagcttcactaaattactagtgttatttaaaaatatgattcatgaagataacacgttgcccaaaaatcactatgaggccaaaaagattttgtgtccagtgggaatggagtaccagaaaatccgtgcatgtcctaatgattgcattttgtacagaaatcagtttgcagaaatgccttattgccccacatgggggaatcacgatacaagtagtggacgccatgctcttggcaaagctttcatgcacgtaatgcacctcgcggcgcaaaccgtgttgatgatgcaaggaggaagaagtttatggttagggatgttttccttccacgaactcgtcattgaaatcaagccaccatcctccacccactacacttgtaaacccaattgttggttctgtaatgcaccacctttcaccgaatga

SEQ ID NO: 58097 - DNA, 429 bp, Glycine max
  Peptide Sequence Number=SeqID_174875
atgtctcttgacactctctttggaaaacttcatgaacatgaaatggaacttatgagactctatcaacatgaagagaatgataaaaagaagaaaggaatagcactcaaagcctcatcatcttctattcaagaagaaagtgacgaagaggacttgaatgaaatagaagaagatgatgatttcaaattttttgtgaagagattcaataaatttatgagaaacaaaagaaatcaaaggaaatcaaacatcaatccaaagaagaaaggagaagattcctccttagccccaaaatgctatgaatgcgatcaacctgggcacttgagattcaattgtcctgtccttaaaagaagaatggaaaaatccaacaagagaaatttaaaaaaagaaagaaagaaaataaagcatacatcacttgggaaaataatgacatag

SEQ ID NO: 58098 - DNA, 174 bp, Glycine max
  Peptide Sequence Number=SeqID_174876
atgtgcgaagcttctggtgactgggaagcacgttattctgttgttttccagattggttctttcgccaaaagaaaaaaagaagaagtagagatgagagtcgtcatcgcaaaaagggcaggacggacgaaatcagtgtcctatctttgctttcctcttatctccgatgagaggtaa

SEQ ID NO: 58099 - DNA, 423 bp, Glycine max
  Peptide Sequence Number=SeqID_174877
atgccctcaccttcagaggactacatgtcctcttcatcagaggactacacgtcctcgcctgtagaggactacatgtcctcgccattagagagctgtacgccctcacttgcagatgactacacgtccccgccatcagagggctgcacgccctcaccttcagaggactacacgttctcgccattagagggctgcacgccctcaccttcaaaggacaacacgttcttgccatcagagggctgcacgccctcaacttcagaggacttcacgtcctcgccatcggagggctgcatgccctcgccttcagagaactacacgtcctcgccatcagagggctgcacgccctcgccttcagaggactacaagtcctcacaatcagagggcagcaagccgtcaccttcagaggactacacgtcctcaccatga

SEQ ID NO: 58100 - DNA, 705 bp, Glycine max
  Peptide Sequence Number=SeqID_174878
atgagggtttttgccagcataggcgaaggcttgcgttttgtgcggcgtacggaggtggtactgggagcgcagctgctggatatgtttgcagtcctgtttggtggtgccgtcgccatgttgcccgcttttgtgcatgatatttaccaaatgggtccggaagggctgggcgtattacgtgccgcaccggctttgggcgcgattgtgacgggtctctggttggcaaaacacccgattcacgagcacagtggacgctggttattgttcgcagtagcgggctttggtgtgtgtatgattgcgtttggtttgtgccgaacctactggttggggattgtgatcctggcggtctccggcatgatggatgccgtgtctgtgatcttacggcaaaccattttgcagttggccacgcctgatggcatgcgagggcgtgtttcagcgattaatggcatttttatcggttcgtcgaatgaattaggagcgtttgagtctggcttaacctcccggctgatggggctggtgccatcggtgattttggcggctcaaaaaggtttgccagtcattctggaccatgccgaacagtttattgccgaacggctggcacccgcagaaattgccaatgacgggcgcgcactgacacttgaagagcaagcgtatatcgttgtggtcatagagcgctggttgcaacgctacttatccgcgccagagtag

SEQ ID NO: 58101 - DNA, 267 bp, Glycine max
  Peptide Sequence Number=SeqID_174879
atgcttgtttttccttccggaatgttgcaaaactttacggattatgcaacagtgcttgtttttcctttagaaatgttgcgaaactttacggattacgcaacgattcttgttttgagggttccgaagggagcaaacaaggttcaaggaccgaccgcaagtgttgaggaaagaaaccctaagtttgaagaacctctggatttgaggttgaatccttttcaagggggagggaatgatgcaatcttacccaccaccaagggcattggatag

SEQ ID NO: 58102 - DNA, 384 bp, Glycine max
  Peptide Sequence Number=SeqID_174880
atgaaggcgataacccttgccgcgctcctgatggcctgccagattgcccccgcgtggagcgaaagcgaattccagatcacctgcccgggccgccccaccatgacggtatcgcgtgccgcctacgggctcagcacgctgatgtggccaacccggcatttccagattgccgccgggcagcagcgcacgcgtctgcaggacggcgataaggtcgccatcacccgtttccgcaatggcgatcagctgatcgtgaataaaaacagcggcgaaacctttttcgtctacgccgacagcgataagctgttgccctgcaaccgcacggaaaaacgcgatgctgatattctgtcgctggagcgctacgacgaccgccagcacccctcttcataa

SEQ ID NO: 58103 - DNA, 408 bp, Glycine max
  Peptide Sequence Number=SeqID_174881
atggttacccgcacctttcgtcaaccaggggcaaacgagctcgttgacgcacagagactaacattgtcatctgcacctttgtcatctagagacggcgagtctgatgacatacggggattaccttatggttacccgcacctttcgtcaaccagggggaaaacgagcccgttgatgcgaagagaccgacatcgtcttctgtaccttttgtcatccaaggacaacgagtcaggtttttactcccgttgtccagaaacattcaagcccagcgacgcgcggggttcttctctgttgggcagagacgatcgggtgcaatggcgaagggaagtgtcgtggttgtccaactttgtcgttttcaaaacaccaaagtttgttgacgcttttgatgccttttcttttctttctgaatga

SEQ ID NO: 58104 - DNA, 204 bp, Glycine max
  Peptide Sequence Number=SeqID_174882
atgcctacgtctctgatacaacacaatatctcttctgctcaaataaaccaggactttattgagctcaagcctaatggaaaactgaaacagagaaaggttgctgggcacacaatattgtcccctagtgagaacttggataccataaaaaatcttcatataccccccactatgcacggaagcagtactttatcaaaacaggtgtaa

SEQ ID NO: 58105 - DNA, 180 bp, Glycine max
  Peptide Sequence Number=SeqID_174883
atgtgtctatcggggaaggagagattgacattctcaccctgggacaaggtttatgataaattgggattttggctcaaggcttgtagaacggctggtcatgatatatgtcagggtttggccagtggttcggggataaaggggatgtcctacattatttccatgatacacatgcaacaatga

SEQ ID NO: 58106 - DNA, 350 bp, Glycine max
  Peptide Sequence Number=SeqID_174884
atggccaccacaccccccgttttgttgaaaaatgggattccggggcttccgggacacccaacattttttgaagctgggttgcttctggcagcttgcctgggcgagctagcgtcgcctgggcgagctgggcggcaacctcctccccctttttcctataaaaaggctgaagggggctgttctaaggatcccttagccccctggctatgtatttcagctgttttgggtgaaaaaaattgtttccgtgaagaaaatccaagccgaggtgcttccgtaacgcttccgagatgtttccgtaagcaaatccgtgaaggttttcgtccgttcttcatccgttcttcgttcttcaacgg

SEQ ID NO: 58107 - DNA, 228 bp, Glycine max
  Peptide Sequence Number=SeqID_174885
atggaacttcctagatcaacagactattggcgtgatcagattgacattagccaagaacgtcacgttcaacattgtaaacgagaagactactacaggcttaatgaaagcgttatctctcaggcgacgctaagtctcctcatgtggcggctcgtggtctacaggtctccttatgtgctggctcgtggtccacaggtgtactcctcagataaaattggatcaaccgattga

SEQ ID NO: 58108 - DNA, 621 bp, Glycine max
  Peptide Sequence Number=SeqID_174886
tgtattgctgatgagattacacagaacctgaaatttgaagagaagaatgggaagtggaaggttctagaacatccctttagagagatccataaaattttcggagaagaagaagcttacattaggcattgcatggaaacaaaggactggagaaacatcagggtgggatcaagaggagatgcaaaggaagagacttatcaactccaacaagtacaggaaggaatatggagacatgaatcttttccattggaaatttgggaagcagtacctcatcactcattatctgccaccgatatgatacggaatttggaaaggtcagaatcactggtagggaggctcttgccaagttcaacattggttggatctaaggactatcaggtgaggagaaaaaaggggaatgcgagtcagtacaaggagattacatggttaggtgaaagctttgtcataagacatttttcttgtgacattgaagctttggaacctgagatcatagaacttttatcgctttcccatcctaatataatggacagcctttttggttttactgatgaggagaagaaggaatgttttttggtaatggaactgaagagcaaaaccctttccatccacattgataactgctaa

SEQ ID NO: 58109 - DNA, 426 bp, Glycine max
  Peptide Sequence Number=SeqID_174887
atggagtatttgcattcaaagaaagtatatcatggagaactgaacccttcaagcattcttgtcaagcctagaggtacatccccagaaggttacttgcacgccaaggtaacagggtttggactaacttctgtcaaggacttgaaccagaaagggaacacaaatcagaatggaactcccccattcatctggtactctccagaagtacttgaagagcaagatcattcagggggtgcagcaaactccaagtttcttgtattgaatcctggttacagcagtcagccagaaccaccagtgcctccggtagtagattactgtcatatagagtcagtgcttccgaggaaatttccttcttgggtgactgaaaatggaaataagcaaacattgattaatgaaaaaagcaaacaactattatgtctcattaactga

SEQ ID NO: 58110 - DNA, 570 bp, Glycine max
  Peptide Sequence Number=SeqID_174888
atgggccttgatatttgcatttgcaagggctctctttctcttttcttcttcttcttctccaagataaacctaaatcctagaagcttgaggtttggtgttggtgatcaacgaagacccttttcctctccctttggtgttgtttggttgagtcatggaagggtgtgtggtggcttagtgatagtgggaaagcattcatcttggacccaaagccctctctattttccctttcttcctctcaaagattgcttcttgatttataaagagcgttgtgtctcgacgtccttcagcataatattccttaaagcagttcacctagtcaatctgctcccccgaacacaaagttcaagatcatcacaggatccaaacacaaacaacaaatcgggaggagaccagtcagggtcacgatgttttgcgagaatgctccaaccatatgggatcaacataggcttaaaggagcactcaaatccggtgacccccaaggcctacactccgaagagtccgtcagggcctctccctcctgattcaggtccaacccctaaaatcattttagcacacagacactgctcgtga

SEQ ID NO: 58111 - DNA, 252 bp, Glycine max
  Peptide Sequence Number=SeqID_174889
atgtcaagacttacacgcgattctcctcaaatttcagccagcccgcatcaattggaccttgcaccttatgcttcagggccccacaatgctcaatggattgccccggggctcctccatgataagcacacgttgctttcgtgtcgtatcctcagagaaatggaggttgaggaaccttggctagggttatggctaccattgaattatcgagtagatatgggagcaagtcaacataggacaccggaattggggtga

SEQ ID NO: 58112 - DNA, 435 bp, Glycine max
  Peptide Sequence Number=SeqID_174890
atgagcatatacgtttttgtctacggcacgctacgcgcgggcgaaatcaacgacctggcgcaagcggccgcgcggcgcgcgctgccgcccgcccgccatctcggcgcggccaccgtgccgggcgcgctggtggacttcggcgactggcccggactggtcccggtgcgggacggccgccgcgtgcgcggcgacatctacgcggtctgcccggccctgctcgccctgatggacgagatcgaggaatacgcgcccggccggcccggctgcttcgtgcgccggcctgtactggcccgcccgctggcgccgcccggcgccgccgcggtggcctgccagtactaccccatcgatccggcctggcgcggggcggcgccggacgtcgccgcggacgactggatcgcctaccgccaggcccgcggacaccccttatcgccgtaa

SEQ ID NO: 58113 - DNA, 264 bp, Glycine max
  Peptide Sequence Number=SeqID_174891
gttgccgaagcgcacgccgtagacgggcgtccagggggtgatccagcgaatacagcgtcttgccttgttcgagggagcacacgctctttcactcagctcgtccagctttttccaattcgggcgagcttccatcccgaccgggacacacacgtggcccaacatccacgcggaacagtgggaggcatcaggggcaacgggaacccgtttttgcatacgatgacctttatagtgcccggacccggcgggtggcctggacgggcttaa

SEQ ID NO: 58114 - DNA, 522 bp, Glycine max
  Peptide Sequence Number=SeqID_174892
atgggagagatagatgcatcagtgggtcctcttatgagctataactggtcaattcccctcgcttgcccgaactctcagaagaatctgcccctgcgattcatgagacgactgagaaacgagaagcgaaagcccagttctattacagaaaagctgcccggggagaaagagccaacagctctctcgtttcaaccaaccgctattgaaaagtcccgagagataggtgggctttctctgttccgtttcccaactgcattacggcaagtcccacccctccttagcaacggggaggcttaccaatcgataaggcttctacaagaacttagtagctttgaatggactgaaacgggagcgagtggtcggcacaacggggcaacctcttcttttcgaggagacaattccaaccaaccccacccggctctggttctctacctgctcatccgtaaccccgagaatatgcccatccgctactgtctcccccgtctatgcgatcgcaactcgaaggtgactcctaagctgcgtaag

SEQ ID NO: 58115 - DNA, 609 bp, Glycine max
  Peptide Sequence Number=SeqID_174893
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaatataccaaaggaagtggagggttttttcaaacaacaagggactgggtcaattattcaatcaaatgatattgagcat

SEQ ID NO: 58116 - DNA, 279 bp, Glycine max
  Peptide Sequence Number=SeqID_174894
atggccggcagcgggcaacagacgcacggccaccaccttcagagcccctcagctcatctacaaaggctagagtgttgcctacgacccgtggccgaccagcaggttcatgatcaacaagtcatcatgcgtccggctcaagacgttaaagaagcgctactaggaggcaacctagaattggctacgaagaagctccctgcgaagcagtccaggaagggcaccatcgaagaggattccaatgtggccccacaagccgacataggctttgacaggggcagctga

SEQ ID NO: 58117 - DNA, 802 bp, Glycine max
  Peptide Sequence Number=SeqID_174895
cagaggactacatgtcctcgccttcagaggacttcacgtcctcaccttcagagggctacacgccttcgccttcgtaggacttcatgtcctaaactttacagggctacatgccctcacctttagaggtctacacgtcctcattttcagaggacttcacgtcctcaccttaagagggctgcacgccctcaccttcagagggctacacgccttcgcattcataggactacatgccctctccttcaaaggacttcacgtccttacttttagtgggctacacgccctcaccttcagaggattgcacatcctcaccttcagaggactacacgtcctcacctttaaaggactgtacgtcctcaccttcagaggattgcacgtcctcacctttagagggctacacacgctcgccttcaaaggactacacgtcctcgccttcagaggactgcacatcctcaccttcagaggactacatggctacacgccctcaccttcagaggattgcacatcctcaccttcagaggactacacgtcctcaccattaaaggactgtacgtcctcaccttcagaggattgcacgtcctcacctttagagggctacacgtcctcaccttcagaggactacacgtcctcaccttcagagagctgcacgttctcaccttcagaggactacgcgccctcacctttagagggttgcacgccctcgccttcaaaaggcgacacgtcctcgacttcagtgggctgcacgccttcgcctatagacggctatgcgtcctcactttcaatgggctccacatctgcactttaa

SEQ ID NO: 58118 - DNA, 333 bp, Glycine max
  Peptide Sequence Number=SeqID_174896
atgggacaccttagtgatcaagggtttctcatggaccttaagagaataaaggtcattcctgagtggtccattccaccaacaccactcattgagttggtgaggaaccatgttaccttttgggaagatgcccaggaaagaggtgttgagggaagaagcctagagtttcaagaacctctggatttgaggtcaaatccttttcaagggggagggaatgatgcaatcctacccccatgggcattggatagaatactccaagaagattgggctagagatgcaggagaaggccctagggttctcatgagccttaaggtagattttgggaccatgggctaa

SEQ ID NO: 58119 - DNA, 533 bp, Glycine max
  Peptide Sequence Number=SeqID_174897
gagatactggcagagcaagaagttgatagagtgcatggattacctgcgcagcctccggtgaagttcaagaatatggtggttatatcactgtcaatgaaactcaaggaagagcactgttctattggtttttcgaggccactcacaaaccagaacaaaaacccgttctcttatggctcaatggagtgtcaaaatcttcttctcgaactcgctgattactctgtctatcaatgtggtggctgtggtgccattcttcgagcgaagcataaaggttatgtgagtggtagcttgtcggatgaggggaaggttggacttggaggagattctgaggatactggtgagaaaggggtaattgacgatgatgttgatgttggcaggaataaagatgaactgggtaaaacaataggaagagaacaggagaaacctcccaagtctcaaattggttgtgagaatgggtccaaattctctaattggccgaatgagagagaagtgagatggaagggttttggagaaagccacgagctgatatggaaaat

SEQ ID NO: 58120 - DNA, 285 bp, Glycine max
  Peptide Sequence Number=SeqID_174898
atgtacattatgtatgcaccacacctacattatagtttgtgtattgttggttcttcagacaatggtgcgcacaagatgctaagcaatcatgttagcttcagtgcggctttcttacgtgcattatctggagggacttcgcctagtaactcgttgcataactcatctcaatgccttcatcgttcaaccaatgcagtgattaatgcaagatcaattatgcactgttcgattagggcaatatgttggtacccggtagatgataataatggtgtaatctgtggtacatga

SEQ ID NO: 58121 - DNA, 300 bp, Glycine max
  Peptide Sequence Number=SeqID_174899
atgtcgatccttgataagcttacaggttatgaatcaaaacctgattttagtgctcatactcatatcattatcattatatgtgtacattatgaaaaaatactgccaacaccttatgttaggtggaatgtcttgaaaattatgaccaggccttacttacttcagggaatagaaaagaagactgcgaagttgagaggaattgagaaggctctagttgcacggcatgaagctggtcatgctgtagtaggtaatgcagtagcaaacattcttgctggacagccacgtgttgagatatgtagatga

SEQ ID NO: 58122 - DNA, 354 bp, Glycine max
  Peptide Sequence Number=SeqID_174900
atgaagttacaagtgacacaagggaaactcgccgctaccgcgcacgaacgcacatcaggtgtagccttgtgcagctccagttcagttccgtctagagtgaataagttgtgggttttttggggattagggttttttgcggttccaccggaggagagggttttttgcagtcccagggagaaggtggagaaagggaaacattcgtctggggtggtgactgagaacgatccgttgttggttcagtttcagaaagttagatcactgcatgaagcatcattgaccatggaaagtcatgtgcttcatgaagcaagtagacttccaatcttgactcttgtgtgtatagagaaaacaaattag

SEQ ID NO: 58123 - DNA, 309 bp, Glycine max
  Peptide Sequence Number=SeqID_174901
atggtccagcaatatagaggctcttgcgtctattgtaagcaggaagtctcttacccaagtgagattcccagtacaatctcaccaactactccattacaacacacttcacccttcctaatggtaacaaggaagacgaacaaaggaaagagcatggttgaggaggattcaagtgttttcgtcaagaatttggatgtttcgaagggtaagactcaaagcgttgaggagaagaacgcgagtatggtggaggcagaaggtgagggcatgggcccttgcagtcacgggagagtgagtgagcatgagaacaactga

SEQ ID NO: 58124 - DNA, 210 bp, Glycine max
  Peptide Sequence Number=SeqID_174902
atggccaaattcaagaaatacatggagatgctacaagggaagaaggaggaaccacctactgaaaaactcacatgggacgtgctacatcaaggatgttttaccatccccatcacattggaaaatctctccattgatgatgcactacttgacttaggcgcgagttgcaagctcatgcctcattctttcttagagaagatttggtcgccttaa

SEQ ID NO: 58125 - DNA, 549 bp, Glycine max
  Peptide Sequence Number=SeqID_174903
atgagagaacctgaggtggtttggagtgggcaatatgtatgggaggaccatcgccctagatccggtgtatggaagggatctagtggtggagaagttatctgcttcagtggatgcgacgatcatcaaacttcagctgatacatctgctctatcaaaaattacatcgactggggcaatgacattttgcttcatccaagccatagagcgtggccatggggctacctatggcagcattcttactgcaatgcgcacttccatcagaaatgttggcggcggcggcggcggtaccgggggtggtgatgtggtaacatcccttctctccatgcttttgactggagggagtctcagcggtgtcggtggactgggacagagaggattcttttttcgtaaatcactgaggatgtgtttggatgaatttatgtctgcccttgagaatgtgacatgctcttgtaataatgactttggttgctgctgcaatccttggatgaaaatgctgattcgactcagatttgaattccacataagaggtgagcatcttaaccctggataa

SEQ ID NO: 58126 - DNA, 729 bp, Glycine max
  Peptide Sequence Number=SeqID_174904
atggagcagaaaaattggaaccttctcgatgaagctttagggcttaacaacaacaatgcgaagccatggcctctgtgtggtcgcttcgtgcttgtggaagattgtgttgacacaagcgccgctttcgttcttcaccaaatcctcaaacgctccttctcttctcacccttcttccgccgtcgtcttcctcgctttctctcaccctttttcccactatgatcgcgtcctcagaaagcttggttgcaacttagctgctcaaagagataatggaagattgtttttccttgacatgcttatgttgcagtgtccagatgaaggaaaagccaatcatgatgggcttgcttctgtatttgagcaaattgaaagagtgatcactgcattacatcaagacaagaaattcatctctatcatgatagatgatatatcctttcttgaagttgctgctaatggctcttccaatgatgttttaaacttggtgcattattgccatacgttaacatctgattcagaatatggttgtgcatttattgcactcgaccataaggacatttatttgaacggagacaggactgctgttatgttagagatggagttccttgctgacattttggtcaaggctgaaccattggccactggtttggcaaaagatgtgcatgggcagaataggaaaaatcttcaaggcaagaggctacttgttacaaagcattctcactgtctaagggacctttaa

SEQ ID NO: 58127 - DNA, 1476 bp, Glycine max
  Peptide Sequence Number=SeqID_174905
atgcatcagaagaaatcagaggttcagatcggaaaagaaagcgtaggcgtctcttccgatttcaatccgcaattccaaaaacacccctaccaccgccaccagcaattctacccccaaatcgaaatcgatatatctccccaatccccaccgcagccaaccacacctcctcctcctcctcctcccccttcactctccaaacagaaacacatcttcaagccccagaacgccgccttcttctccgtatccgtcgccgcgaagagcgccgcgttccgcgcgctgcggcgcgtgaggcgccagcgcgcgttgctcctactcgcggtccccttcctctacctctacttcctcatctcgcgctccttcctcctcgacctcctctccgccatcgccttctccgccgcgctcgtgttttctcttaacctcgctttccctttgcctctccgttcggttcgcctcaaggcggcgaagaattccgcctcccgtcccgcgcccgctcttccggtgttctggacgatcgggtcgaggccgaagacggagaagcgcgccgcggcgtccgggtgctgggtgcaggtgtttggaaacggcgacgtttacgagggggagtttcatcgggggaagtgttcggtgagcggggtgtattactatagcaggagtgggaggtacgagggggattgggtggacgggaagtacgatgggtatggggtggagacgtgggcgcgtgggagccgctaccgtgggtgttactggcaggggctgaggcacgggtttggggtctataggttttacaccggggatgtctatgctggagagtggtctaatgggcagagccatgggtctggggttcacacttgcgaggatgggagtcgctatgttggggagtttaagtggggggtcaagcatggccttggccattaccatttcagccttaaggatgatagcatagataggaatagaatgagtcagttttgctgcaacagtattgacagtcagttagggagtgagaaacagaaattacaggacaagatgcatggttttggcatatatcattttgcgaatggccatcgttatgaaggagcctggcatgaaggcagaaggcaaggacttggaatgtatacatttagaaatggtgaaacccaatctggtcactggcaaaatggagtccttgacattccaagcacacggaacaccacttctccagtttctcctgttggtgtctattattccaaagtactcaatgcagtgcaggaagcaagacgagctgccgagaaagcctatgatatggctaaggtagatgaaggggtgaacagagctgtagcagcttctaatagagcagccaatgcagctagagtagctgctgtaaaagctgtacaaaaacagaattatcataagaaagcagcttcactaggtggctacactagtttaagcagcttcatgccgactgcaacatttgcttttggcattatgctttctttgatttga

SEQ ID NO: 58128 - DNA, 399 bp, Glycine max
  Peptide Sequence Number=SeqID_174906
atgacaggaaattttagttatcacacattggagattgaagaagaagatccccatggccccaaatttccaacgaagcacaacatcaggatggcaatgtattggcttgcacaaggatgtcaacctggagactccctggtttttcattattctggtcatggatcacagcaaaggaactatagtggtgatgaagctgatggatatgatgaaactctatgtccccttgattttgaaacacagggtatgattgtagatgatgagatcaatgccgcacttgttagacctattcctcatggagctaagctacatgcactaattgatgcctgccatagtggcactgttctagatttgccatttctttgcagaatgaacaggttaccttctaaagaaagtctgttatag

SEQ ID NO: 58129 - DNA, 477 bp, Glycine max
  Peptide Sequence Number=SeqID_174907
atgcagaagtcatgcaagattgaacaaaagtacacatcaaaattggagtggatggatactaacacaaaaactaagcgatcgaagcgaaagaaagacgagggggacgtacgtaccggtgagcatgatgatggaagattctggaaagctgaacttgttgatgaggaggtacttcatgcacttggcgtcgttgatgcatcccttgagctcgtgtcgcgagaagcggtaggagatgccgacgatgacggccttcttgcggccgtgggggttgggcgggggcggcgcgtggctgtagggagaggacggaggaggaggcgcgtgggtggaggccggtggctgcgaagggagggcgcgtggatcgccgatgagagtgacagcgcggcagagggcgcagcggatggatcccgcgccaggtggcagctgcagaggggtgcggcagttggagcagttgaccagcatgttgctgtacatcgtaggtaa

SEQ ID NO: 58130 - DNA, 993 bp, Glycine max
  Peptide Sequence Number=SeqID_174908
cggctgctccgactcgatggtcttgcgcgtgaacaccttgcggtagctggcgcggcctgcggtctcggtctggctggccgcgttctggcggaagttctcggcgtagtcgtagtcgttgccatgcacggcccacagctgctcggccagttgcctgagcggctcgggcaggccctcataggcggccacggtattggcccagacggtgtcgccgccatggccgggcagcgtgacggcgcgcagcacgcagaccttgggaaaggccgccttgaaggtgacgtcggtatgccaggaatcggcgcggccgccatgctgggaattgagctccagaaaggccgtgccgtccggggcaggcacggtggggtgcgattcgatctcgccgaacagccgcccgaaggcctggtgcgatgcatccgtcagatggtgctggccccggaagaacagcacgcggtggcgcagcagggccgcatggatctgcgtgaactgttcggccgccagctcgcccgacagcctggcgccgtggaccacggcgcctatgcggccggacaggggctggatctgcagcggctgttgccggtcctgctccaggtcttgggccacggtgctcaggtggctggcttcggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 58131 - DNA, 300 bp, Glycine max
  Peptide Sequence Number=SeqID_174909
atggccaagttcgacccagacatagtcctcgagttttatgccaatgcttggccaacagaggagggtgtgcgagatatgcgatcctgggtgaggggtcagtggatcccatttgatgcggatgccctcagccagttcctgggatatcctttagtgctggaggagggccaggagtgcgagtatggccagaggaggaaccgggccgatgggtttgatgaggaggccatcgcccaattgctgtgtataccgggcaacatccagcccaacgaccataattccgacctccccctgccgaagtgttag

SEQ ID NO: 58132 - DNA, 2541 bp, Glycine max
  Peptide Sequence Number=SeqID_174910
atgcatttcaatcgcctctgcatagttttaccaccaaattctggtgaaatggtagtgccacttgaaaagggtgtcctacaagaagaaccctttcaaacaccaaagaagcaacaagttgaggccaagaagcctcatagggcttgtggtggacaagttcttgatttgcttcgtgattcttttaccaagttatatgattcaaggtggtggagaatttgccaacatggagaacacaaagagaagaacaactctggtgtgttttttcatgacatggatggtgtgcaagtttctgtcaacattggcagggacaaccccagaattttcagctatgctgagttgttcatagggtccaatggtttcagtgaagaccaagttctagggagtggagggtttggaagagtatacaaggctgttttgccaagtgatggaactgaggttgctgtgaagtgctgtttagcagagaaagggaagcagtttgagaagagttttgctgctgagttaacagctgtggcagatcttcgccacaagaatcttgtgaggctgaggggttggtgtgtgaatgaggatcagttgcatcttgtttatgactacatgcctaaccgaagcctcgaccgcgtactatttcgaaggcatgagaattcgaaggctgagcctcttcaatggggacaaagagggaagattttgaaaggtttggcagcagcattgtactatctccatgagcagctagagactcaaatcattcatagggatgttaagaccagcaatgtgatgcttgattcgcattacaatgctcggttgggcgattttggcatggcaaggtggctagaacatgagcttgagtatgagtacaagtataacaataggaaaacaatcgcaaccaaaagtggccacttcaggttgggagaaacatcaagaattggtggcacaattgggtatcttccacctgaaagcttgcagaaaccaagcaatgctacttccaaatctgatgtctttagctttgggattgttgtgctagaggtggtgtctggaaggagagcaattgacctaacacaccctgatgaacaaatcattttgcttgattggattagaaggctttctgatgaagggaagcttctggaagcggctgattctcggttactggatggatcatacaagctttcagagatgcagcatttcattcacataggcctcctatgcacactccatgaccctcaattgaggccaagcatgaaatgggtagtggaagcactttctgacatttctttcaaattaccatcactcccttctttcctctcccaccctttatacatctctctgtcttctccttctaatactaataatagtcctagcagcacaagtgtcactagctcctccaccacagataatgctagcagcataatcaccaaccatacttcatcaaactatgtcacagctgcaggtgaaactgtgtatgtcactgctgagtacaaaaacagtgaaatcatctcttctaagagcatgagccaccaccagcaaccatttcctgtggttgaaactccaagggaaatatcattcaaggagattgtttctgctacagataacttttctgattcgagaagggtggctgagctagactttggaactgcttaccatggcatccttgatgacaagtgccatgttttggtgaaacgccttgggctgaaaacgtgtcctgcattgcgtgatagattctccaacgaacttcggaatcttggaaggcttcgccataggaatttggttcagcttcgaggatggtgcaccgagcaaggagagatgcttgtcttatatgattactcagcaagtagaattctcagccaacggcttcagcatcatagcaatggaagtagaagggggagttctgtcctccaatggcaccacaggtataacatagtgaaagcactggcctctgcagttctctatctacatgaggaatgggatgaacaagtgatccacagaaacattacctcttcagctgtcattcttgaaccagatatgaatccaagactcacctcttttgctctagccgaatttttgtcaaggaatgagaatggtcatcatgtagtcattgatactaaaaagtcggttcgtgggatatttggctacatggcaccggaatatgttgaatcaggtgaagcaaccactgaggctgatgtttatagttttggtgtggtggtgcttgaagttgttagcggacagatggcagtggatttcaggcagccagaggtgcttttggttaagaaggttcatgaatttgagatgagaaaaaggccattgaaggaattagctgatataagactcaatggagagtacaatgaccaagaattgatgagattggtaaggttaggaatagcttgcaccagatgtaacccgcagttaagaccaagcatgagacaaattgtaagcatccttgatggcaatgacaaattacttatccagaataacaaggagagcagagaagaatggagggaaagaaatgattgttctttgtcaatgattaagagaattcaagctctaggaatacagtaa

SEQ ID NO: 58133 - DNA, 5097 bp, Glycine max
  Peptide Sequence Number=SeqID_174911
atgtccttcaatcaatcaaagtccgataagagcgacgctgtgtaccgaaaatccgggcgacccggcagcttcaatcagcagcgcggtccctccggcggtgcgtacggcaagggcggcggtggcggcgccgggccttctccgtcgctctcctctaaccggagttttaacaagaagtctaataataatgcacaaggtgggcaatctagggtaaaccctactccggtgaattcgactgagtctaatagtacttatgcagcccggactgtaccaaacggttcccatgtacagccacatattcatggaggatctgatgcaccgattacaaatgcaactgccaagccatctgaatcgttggctgcacagaggagcaccagaactgttccaaaagctcctacttctcaacctcccgccatgagttcttatccagcagctcctacaaccccagctaaggcagatgcatctaaggcattccctttccaatttggatctattagtcctggctttatgaatgggatggcaattcctgctcgcacaagctcagctcctcctaatatagatgagcagaggcgtgagcaagctcgacatgattcttttagacccgcaccctcaatgccaacacctccagttccaaagcagcaggcagtgaagaaggatacaagtgttgctgaccaatctaacactggggagacttatactgggactagggccaaaaaggatactcaagtgtcaccattacccccagcaagccagatgcagaagccttctgtcatttctttatctggaatgtcaatgccaatgccatatcaccagtcacaggcatctgtacactttggtggtcctaatccacagattcagtctcaaggtatgtcatcggcacctcttcagatgccattaccaatgcctttaccgattggaagtgctgcacaagtgcaacaacaggtttttgttccaggccttcaacctcatcctatccatcctcagggaatcatgcatcagggccaaagcatgggtttcaatcctcaaattggccctcagttgccccatcagttaggcaacatgggtattggaattagcccacaatatccaccacagcaaggaggaaaatttgctgctcctcgtaaaactactcctgtcaagataactcaccctgagacacatgaagagctaagacttgataaaaggacagatgcatattcagatggtgggtcatctggtgcaaggcctcattctggcatgccttctcaatctcagcctgcccagcaattcgcagcttcccatcccattaattattatccatccagttcctacagtaccaatcctctcttttatccaactcccagttctcttccattaacaagtagccagataactcctaactctcagccacccagatttaattatgcagtgaaccatggcccgcaaaatgttagttttgtaaattcatcatctcatagttccctgcctgttaataaagctggcacttctattcctggcaatgctgaaccgcctaatccagaattttcctgggatgtgcataatacattcttgtcagctccttcaggagtaacttctgtgtctattaagccaagtggtggatctggtgttgtggactcatcattttccaattccagtaatcaaaagagtggatctcctagttcttcattgacatctggtgatgctttctcttctgtgccactaaaagggtctgaaacaactgaaatctcttcacaacagtctaaggtgtccagtgattcatcagctttgaactcattgccaaatctgtctgctgcatgtactgtgaagcctacatcagcttccttgttacttcctacatctgctgtgagtgaagagtctgtttcagttctgcctaataatgagggcagaaagaaggaatctcttagtaggtcaaattctttgaaggataaccagaagaaaatacacaagaaaggccaatcacagcatcaggttgctgtgcaatctccttctgtggctaatgtgccttcccaagctgttgatggtgatatccctgttggtgaagtttctgaaactgtaggaactaaaacaaaccattctgcggcagttaccagtgaagatctctccgctgcagcttcagacatgttatcagctaccagtgagagcataacttctgctgttgaaacaaaaactaatgattctacacaagtttctgcatgtgcttcagctgaaggacccgttacacaagtggcggataatttgaacaatcataagaatgctgagatagatgaattgttacaacaggataaaccgttacagccagatattttggaaatggttcgtaaaacagaaaatttgtctcttcaaggaagtaaacaaagtgttagtgatggtggaacagaattaaaacaacccaagcaaggtgctgcaaagttaagcactgaggttgtaaccttgaggaccgtgcagcaagggcaagggcaggacgagtctaccagttgtagtgcagaatgtgacaggacggctgatgataagggcatatctatctctaccactttggattccaaagatgtttgtttgaatagaaatgatagtgtagttagtaatgaagctgtttcttcaaattctggcacatcagatcagcagtctgctgatctcctagaaacaacttcaaaacagtgcaaggatgatagtgcagagaatgctggcagtggttcagtgtctcttccagcatcaggtaccaaggacaaaccaatttcagagtctagtaaggtgaaacctacatcaaaggggaaaaagaaacgaaaagagattcttcagaaggccgatgctgccgggtcaacatctgatctttataatgcatacaagggacctgaagaaaagaaagaaactgttttaagttcagagaaaacagaaagtggttccacttctgaaaatttagagcagttgccaactgatactgctcagccagatgctgtagctgagcaatctaagcagagtaaagctgaacttgatgattgggaggatgctgctgacatgtctacaccaaaactagaagtttctgatgaaaccggacaggttagtgatggaagtgcaattactgccaaaaagtactctcgagatttccttttgaaatttgcagagcagtgcactgatcttcctggagggtttgaaatcacggcagacatagctgaggctttgatgggtgctaatgttagttctcatgttattgaacattcttctactggaagaattattgataggtcaggtgggatgtctcgtcgtgggagtggtgttattgaggaagacaaatggaataaagtttctaatgcatttcattccggtatgcgattggatggtgttggaggtaatgcaggatttcgacctggccaaggaggcaattttggtgttttaaggaatccacgcacacagacacctctgcagtatgctggtgggattctttctggtccaatgcaatccatggtaaatcagggaggaatgcaaagaaatagccctgatggagaaaggtggcagcgcactaatagcttccagcagaggggtttaattccatctccgtctactcctcaaactcctttacagatgatgcacaaagctgaaaagaaatatgaggtgggtaaagtgacagatgaggaacaggcaaagcagaggcaattgaagggtatattaaacaagttaactcctcagaattttgagaagctttttgatcaggttagagcagttaatattgacaatgtggtcactctcaatggtgtcatctcgcaaatctttgagaaggccttgatggaacctaccttctgtgaaatgtatgccaatttctgttttcatctggcagctgtgttacctgatctcagtcaagacaatgaaaagataactttcaagagattattgttaaacaagtgccaggaagaatttgagaggggggaaagagagcaagaagaagctaataaggctgatgagggtgaggtcaagctgtctaatgaggaaagagaagagaaacgaaccaaggcaagaagacgtatgttggggaatatcagattgattggagaactatataagaagaaaatgttgacagaaaggataatgcatgaatgcatcaagaagttattgggtcagtatcaggatccggatgaagaagatattgaagctttgtgcaagctgatgagtactattggggagatgattgaccatcccaaagccaaggaacatatggatgcatattttgaaatgatgagatcattatcaaacaacatgaatttatcttctaggttgaggttcatgttgaaggatgtcattgatttgagaaagaataaatggcaacaaagaagaaaggttgaaggtccgaagaagattgaggaggtgcacagagatgcttctcaagagaggctggcccaagctagtaggctgggtcgtggtccaggcaacaatccacctcgaagaatccctatggattttggtccaagaggatcatcaatgttatctcctaatgctcagatgggtggactgcgtggattgcctactcaagttcgcgggtatggttctcaggatgctcgcatggaagacaggcaaacttatgaggctaggacattgtcagttcccttgcctcaaagacctttgggtgatgaatcaataaccttgggaccaatgggtggccttgccagaggaatgtccattagaggtccacctgcagtttcaagttcaactggtcttaataatggttataataatttgtcagagcgcacttcatacagctctagggaggaccctgcatcaagatatactccagatagatttgctggttcgactgcttacgatcaatctattgttcaagatcgtaatatgaattatggtaacagggacttgagaaatgcaaataggattcttgataaacctgttgtaacttcacctcctgcccgaacacaagggacagcagcctcccagagtatttctccagagcgactgcaggacatgtccatggcagcaatcagagaatactatagtaaacgtattgctttcaaagcatattacaatactgatcctataggggatactgtgggttctggcattagtaaatgtgaaggaaatatgcatatagtacggatgtga

SEQ ID NO: 58134 - DNA, 966 bp, Glycine max
  Peptide Sequence Number=SeqID_174912
atgccatctattgacattattggctctgcactcagaaaggcgaggaaggtttctccaacgaaaggaattgccaacattgcgaaaagggagaaaaataagggtgcaaagcaacttgatgcgttgatgaaagaaattgctgttcccttgaggacgtatgtggagaattttcctaacaaaatgcatcttcatccttatgagagatctcttattgagctgacacttggagatggatactacgaaatgtcttcatcaaagcgagaagcagaggaaaggctgaatgaggggcttaagaaaattgaagagatttttgctcaagaacgaaaagttgttgatgatttgttaggcatagccaagactctcagggcaatgcctgtaattaatttggaaacaccaactctctgccttgttggagctcctaatgtaggcaaatcttctttggtccatgtactctctactggcaagcctgaggacaggaataatttggaaaagttgactctggctgtcctttcgcacctgccgacagcagttttgtatgtccatgacctttctggggagtgtggcacctcaccttctgatcagttttcaatatacaaagaactcagagaaaggttcaatggacatttatggcttgatgtcgtgtcaaaatctgatttgttgaagacgtctcctgtagtctatgcaacagacgagcctcatccctcccaactcgagcttgaaaagtaccggaaatcaggtcccaatggagctattaacgtatctgtcaaaacacaaggagggctacatgagcaacaaccaggagaagtgaaaggtgtcactccactaagggttgatatcaaacttgtgaagaaacttcctgatcaaatagggaagtctgaaaccttcatgagccagaagcttatctttgtaaaatatgttagcagctctgtggccagcctccaagcaggaaaagaagcaaaggcttcttaa

SEQ ID NO: 58135 - DNA, 2622 bp, Glycine max
  Peptide Sequence Number=SeqID_174913
atgggctcaagcctgtgggtccacccagcccaccacgggtttgagcctgcccgagcccaaaaatccacaaaaggtgcaattagaccttctcgttgcttctccgtcacctctgccaccactgcgccgcctcaatttgaggattttgatgtttccaatgtcatttcgcccaacaattgcatttcggaaatcatcatcacgaactttctcagcttcaacaagataacattgttgaaccatattctgaccgtagagcatggaaagaaaattgcagatattgagaacgaggtggcttggtgggccaacccatttaacccacaacccgtgatgcccaggactggaccattatttgctggaaaaagttataaggtttcacgcaagaagaagaagaagaagatgacgacgacgatggagagcttgattgggctggtgaaccgaatccagagggcttgcacggtgctcggtgactatggcggcgctgataacaacaccttctcttctctctgggaagctcttccttctgttgctgttgttggtggccagagttcagggaagtcttcagttttggagagcattgttggtcgtgactttttgccaagaggatcagggattgtgactaggcgtccattggtgttgcagcttcataaactcgaaagtgggtcacaagagtatgccgagtttcttcacctgcccaggagaaagttcactgactttgctttggtccgccaagaaattcaggatgaaactgatagagtaacagggaagacaaaacaaatatctcctattccaattcatcttagcatctattcgccaaacgttgtcaacctaactttgattgatttaccgggtctgactaaagtggctatagagggacaacctgagaatattgttcaggaaattgaaactatggttcgttcttatgttgaaaagcctaattgcatcatactagcaatatctccagccaatcaagacatagcaacttctgatgctattaaacttgccaaggaagttgaccccacaggtgaaaggacatttggggtgttgacaaagctagatttgatggacaaaggaaccaatgctttggattgtgcctgtaaaattatactgctttatcctctttctcgcttttattccctcaaggtccttgaaggaaggtcttatcgcctgcaacatccttgggttggtatagtaaatcgatcccaagcggacatcaatagaaatgttgatatgattgttgctagacgtaaggagcgtgagtattttgcaaccagttctgattatgggcacttggccaataagatgggttcagaataccttgcaaaacttctctcacagcatttggagtcagtaatcagggcaaggatacctagtataacatctttaataaacaaaagtatcgaagaacttgaatcggagatggatcatcttgggagacctattgctcttgatgctggggctcaattatacaccatcctagaactttgccgagcatttgaacggatattcaaggaacatttagatggagggatttacagtagtctctcctctgtcttgcacaagctcattgaacacaggggaagaaggccttttggctgggcagagaaagggtctttacagccaaacggccattctatactaatccctcaaaaacaacttcagattgtgaggggaagaatgcgtccaggaggagataggatatataatgtctttgacaatcagcttcctgctgctttacggaagcttccacttgaccggcatctttctctccagaatgtaagaaaagtggtgtcagaggctgatggttatcagcctcacttgattgccccagagcaaggttacaggcgcttgattgagggagctctcggttactttagaggcccagctgaagcttcagtagatgctgttaactttgttttgaaagaactcgtaaggaaatcaatagctgaaacaaaggaactgaagcgcttcccaacatttcaagccgaactagctgcagcagcaaatgaggctttagaaaggttccgtgaagagagtaagaagacaactgttcggcttgtagacatggaatcttcatatctcactgtggatttcttccggagacttcctcaagaagtggagaaatctggaactcctgctgccacaaatattgaccgatatgcagaggggcatttcaggagaattgcatcaaatgtgtcatcctatatagggttggtggcagacacgcttagaaacacaattccaaaggctgttgtctattgtcaggtcagacaagcaaaacagtcattgctaaaccatttctacacccaaatagggaagaaagagctttaccatggaaagataactcagttgcttccaaagttatatctagggggtaaacagctatcgcaaatgttagatgaagaccctgcattgatggagaggagacaacagtgtgcaaaaaggcttgaactatataaagcagcaagggatgaaattgattctgtttcctgggcaggaagttttacaactgatcttgttcaagtggcaaggttgaaggttatacagaagatcgttgaaaagttccaaggtttgaaggaaattatggaaaagtgccaaagaaaattacatgtcgaagaggacgcctaa

SEQ ID NO: 58136 - DNA, 3507 bp, Glycine max
  Peptide Sequence Number=SeqID_174914
atgaatgagtatactggaccagctcgtaggacgcgaagcaaaggagtcgaggttcggggtggtttgatcaggagtcggaagaggaggagagtggtggattacgatgatgatgaattggttttcgtgaaagaactcaagggtggaggtgaaggtgcgagtgcgaagattgaaaaatctatggaaaggggttttgagtttctgggagagagtgaggatgatggtccttttgaggttgttgaaattgatgaagatgatgatgaagctgaggaagaggtgtatggggaatgtgagcagaagaagaagagggttgaggttaaggtggaagagaaggatgaaggccctgaagtgttgtgttacgtggctgctgagaaagttgcaagctttggtggtggtgacgatgatgagtgcggttctagacccgagaacccggttgttatgctgtgtgtttcagatgatgggggtggtcagagcgaggaggaccacggcagggatcgtagtagcgtgtcttctgatgatggatttggttcgagttcgtcctcttcgagcgaggacgatgattcaagtgatgatgattttaaggttggtgttgaggatgaaagggctgatgatgaggaagactattcaagcattgaggaggagagtgagagtgatgatgattcctcttgtgatgatgagaggggagagttgtacaagaagtttgtgaaggagagggtcagaaatctggtgagtaaatccgggagcagtggagttagtagaagaaaagcaaatcgtgtacttgcaagggatgaaacaaggcaggcagaagtgatagatgatgcagcagagagaggagaaagtgtcaatgctgctgctgatgagctctttgctaatcaggttccgagaccgagtctgccgttagctgctagggagacagtccctttgaatggcaactgccagaagaaaaaacctgtggaagcagaatctgcgaaggagattgatatgctatggaatgaattggatattgctcttcaagaaactgaggcaggagattcaactatgttgaagaagaagcgtttgccatcaggtgtgagaagtgtttctcctttgccaaaaaggcaagagaagatgggagattcagctaaagttgttatgaaggaggatgatggaaatgctgccaaaaatgggctccatgaagtcctaaggatgtcaaatagatcaaagaacataggttttaaattcttcaccgaatgcttttggggaaagcctgattctgacaaagatgatccaatggagttggaagaaaaggatggtgttgttgttcagggtcagactcagccattagcttgtggggtgggaatccctttgacatgggactttctgaagaagaaccctgttgaaaaatcagaggctgagaaagagttagacatgttgtgggctgaaatggagatgttgcttcgagctggagaaattgggatccaggttgatgaagcaagagcaaaggaagaaaatccagccttgcagtgcaagcatgacactatttttaatgaggagattggggtatactgcagattgtgtggttggattgccactgaaatcaaatacatcatgccaccatttgtggattccaaaagatccggtagagaggcatttcctggtgcatggaaaacctcacagtttgatggagctacgtttgatgattgtggtgatgactcaggggcagcttggtctcacaatgaaggaacagtttgggatattatttctgacattaaaaaaggcttgtttcctcatcaacaagaagggtttgagtttatttggacaagtttggcaggaaccaccaaccttgctgagttgaagagggttgacccgggtactgagggtgggtgcattatttcacatgctcctggaacaggaaagacaaagttgaccatggtgtttcttcagacatatttgcaactgtttcccaagtgtctacctgttatcattgctcctgccaacatactgcttacttgggaagatgagttgaggaagtggaacataggaattccattccataacctgaacaatgctgaattgtcaggaaaagaaaatgtaattaatgaatttggttatcaagagctgaataaggatgccataagaatgctgaagctgtgttcatggtacaaagagaagagcattctgttaattagctacaatttatatgagaagctagctgggggaaagtctgaagatgatggggagaaagagaagaaaaacagaaagattcggaaagagaagaaacgtgcaagcattgaaactgcgatgggaaaggttctgcgagactatcctggtttattagttcttgatgaagggcacacaccgaggaatcagcgtagctgtatttggaaggttctttcagaaagtagaagtcagaagcgaatccttctttcagggactcctttccagaacaattttctggaactcttcaatattttttgcttaatgaaaccatccttttctgacaacataccgcaagaactgaagaagttttgccaaagtaaactgatacaggaaaggaaagcttcaaaagatgtgagttgggagtccattaattctggaaatccggctgacgagaaaataaaacagctgaaattgctgatgaatccctttgttcatgttcacaaaggtagcattcttcagaagaaccttcttgggttacaagattgtgtactgattttgaagcccgaaatcttgcagcaaaaaattctggatagcattgaatgttctcaaaatggactcaattttgaacacaaattggccttggtctctgtacacccatcccttttcctcaactgctctctctcaaaaaaggaagaatctgttattgacatggatcagttaaagaagtgtagattggactcttatgaaggggtcaaaacaaaatttttgatggaatttgtgaatttatgtgatgcagttgatgagaaagtccttgttttcagccaatttattgataccttgatcttaattaaggaccaactcgagtcagccttcaattggtctgagggcagagaagtgttgtttatgcatggcagggttgaccaaaagcaaaagcagtccctaattcatagtttcaatgatgccaatagccaagcaaaggtgttgcttgcttctataaaagcatcttctgaaggaattaacttagttggagcttcaagggtcgtgcttcttgatgttgtttggaatccctcggtggaaagacaagctatttgccgagcatatagacttggacaaaagaaggttgtttacacttatcatcttcttgcacaaggcacccctgaatgcaccaaatattgtaaacaagcagaaaagaaccggttatctgaactggttttctcaaatagaaatgctgaaagtgataagctcaagagaagtggagtaattgaggataaagttcttgatgccatggttcagcatgaaaaactcaaggatatatttggtgaatgtctggttcaaccaaaggagggagatcaggagactttgtgcccctga

SEQ ID NO: 58137 - DNA, 1518 bp, Glycine max
  Peptide Sequence Number=SeqID_174915
atgtatgttgctgacaggacgcgtagcaagcggggaggggtggttggaagtggtttaataatgggtgagaagaagaaaagggtgcatgactaccatgaagagattgtcttggaagataatgaagaaggtgcaagtgtgaaagttgaacctgggcctggtgcttcttcatcgtcatcatcatctggtgctcgtgctttgaagcgggaaagggtatctgaacatggttttcagaatttgggagggcgtgcagatgaccctattaaaatcagtgacagtgaagatgatgatggtgaagaggggttgagtgattttgagaagaagaggtttctgggtgaagaggaaaaggaaaggaagagcgaggagggtaaaggttgtggcggtgagaagaagcatgctgtggctgagagtggttcaaatgatgagggatatgattctcttttgtctagtttatcggagagtgagaatgctgtgaccagtgatgaagattttcaggttgatgatgatgggaatgagagtcattactactcgagcagtgattcttcttcatatgatgatggtgagaggggtggatgcagaaagatggtgaaagagagggtgagaaaggtggagagtgaaactgaaagtagtgtagtttacaaaagaaaaggtgaaaggaaagatattgagcttgtagaggaggaagagccacggattggtgctgattgttctagtgcaacctctaataaatctgagatttataaggaggaaccagggcatggagcacagaagcataaagtaaagagggtggagagtgtcaatgccgatgcctttggtgatcactcggagagttcagatcactctatgcagtctgaagctgaagcattggaacatatgaaaaaaagagatagagaccatcaaaatgtgtcattggagaataaggcaggagattcagctgtggtcaagatgagtgagaaaaatgataatgttgatgccggcaaggtaggagaacataaatatgagtttaacagcaataaacgtgagaagccagagaaggtaagggtggtggatgacgaaactgacgacaaacatgagctgtatgaagtcctaaggatgccatctagaacaaaaaaccgatgcctcaagttttttactgaatgcttttggggcgagaatgattctgttaaagatgattcaaatcagttggaagaaaaggatgatgatattgatcagggtcagactcagccactagcttctagggagacagtccttgtgaattggaactttacgaagaaagaactcattgaaaaatcagagtttgagaaggagttagataacttgtggggtgaaatggatatgctccttcgagttgaagaaattgggtctcagattgataaagtaggggaaaatgaagaaaattcagcctcacagtgcaagcacgacactattttcaatgaggagattgggatatactgcagatggtgtggttggattcacactgaaatcaaatatatcacgccaccatttgtaagcacggtctga

SEQ ID NO: 58138 - DNA, 1944 bp, Glycine max
  Peptide Sequence Number=SeqID_174916
gtggataatgaaagatctggtcgagaggcgttatctggtggagggaaaacttcacaatttgatggggttctgtttaatgattctgttgatgactcggaggcagtttggtctcacaatgaaggcacggtttgggatcttattcctgacataaaagaaagcttgtttcctcatcaacaagaagggtttgagtttatttggacaagtttggcaggaaccattgaccttgctgagttgaagagggttgacatgcatactgagggagggtgcattatttcacatgctcctggaacaggaaagacaaagttgaccatggtgtttcttcagacatatttgcaactgtttccaaagtgtctacctattatcattgctcctgccaacatattgcttacttgggaagatgagttaaggaagtggaacctaggaattccctttcataacttgaacaatgctgaattatccggaaacgagcaagacattaatgaagttgacttgtctggcaatcaaaggcagaataaggatgccatccgaatggtgaagttgtgttcgtggtacaaggaaaagagcattctattaatcagctaccatttgtatgagaggctagccagggggttgtgcgaagatgatgggaaaaaagagaagaaaaataaaaagatgaaaaaagggaagaaacgtgcaaggactagggagtacattgaaactgcaatgggaaaggttttgcgtgactatcctggtttgctaattcttgatgaagggcacacaccacggaatcagcgtagctatatttggaaggttctctcagaaagtagatctcaaaagcgagtccttctttcagggactcctttccagaacaattttctggaactctacaatattttgtgcttaatgaagccatcctttcctgacagcataccgcaagaactcaagaagttttgccaaagtagactaaggaaggaaaggaaagcttcaaaatatgcgagttatgaacccatttattctggaaattcagctgatgagaaaataaagcagctgaaatcgctgatgaatccctttgttcatgttcacaaaggtagcattcttcagaagaaccttcccgggttgagagattgtgtgctggttttgaagccagacaggctgcagcaagaaactttggacatcattgattcttctcaaaacatactgaactttgaacataagttggcgttggtatcagtccatccatctctttttctaaactgctctctgtcaaaaaaagaagaatctgttcttgacaaggatcagttggaaaagcttagattgaacccttatgtaggggttaaaaccaattttttgttggagcttgtgagactatgtgatgcagttaacgaaaaagtccttgttttcagccaatttattgataccttatgcttaatcaaggaccaactcgagtcagcctttcattggtctgtggggactgaagtgttgtatatgtatggcaagctagaccaaaagcaaaaacagtccctcattcatagtttcaatgatacaaatagcaaagcaaaggtgttgcttgcatctataaaagcatcttctgaaggaattaacttaattggagcttcaagggtcgtgcttcttgatgttgtttggaatccctcggtggaaagacaagctatttgtcgagcatatagactcggacaaaaaaaagttgtttacacttatcatcttcttgcacaggacacccctgaatgcatcaaattttgtaaacaagcagaaaaggaccggttatctgaactggttttctccaataaaaatgctaaaagtgataagcttaacagttgtggagcagcgcttgaggatgcagttcttgatatcatggttcagcacgaaaaacttaaggatatgtttggtgaacttctggttcaaccaaaggagagagattttggagactttgggcccctgatgctttga

SEQ ID NO: 58139 - DNA, 174 bp, Glycine max
  Peptide Sequence Number=SeqID_174917
atggcaggagggaggtattgtgagaaggaagtgcttccattcaccgcaatggttgctgttgagtgcaccaacgttggtgtcaacgttctattcaaagcagcaactgagaagggtcaagggggcttcctccactcaatctgtctctcatcttcagaattttcctccttggagtaa

SEQ ID NO: 58140 - DNA, 249 bp, Glycine max
  Peptide Sequence Number=SeqID_174918
atggattctacatctcaaacaaactgggttcttggtggatctctacttgccattgagtttcttttggttccaatctgcgttgttggagcagtgatactctcatttgggttttatgctgtcttatgggggaaagcaaaagaagaagaattgactgtagtggactttgatgatatacgtcctccttcaaatactaagagtcctttgttgcagagctacaaagtgaaagatgaagataaccaaaatatttaa

SEQ ID NO: 58141 - DNA, 357 bp, Glycine max
  Peptide Sequence Number=SeqID_174919
atgtgctattatgcagaggcagtgactattccgattgggcccggtaatcctccttttattagatgtgaccctactaataatggctatagaaggtgtggcgggttaaaacagtcaccaccaccatcaaaaccatcattatgttctactgtaggtggatataaaaaatgctccccagcgcagccgccaccaccaccatgtgaaacatataaacttgtaataatcttatcattttgtgagacaaagggcaggccttttggccaatccaataaatcagcagcagcagaaacgtttgagactgcgaatcctttaaatcctgttatgacgagggtgtattgcataaaaattttaaaagattaa

SEQ ID NO: 58142 - DNA, 306 bp, Glycine max
  Peptide Sequence Number=SeqID_174920
gagattcaacaagtttctaaggtacaaaggaaatcaaagaagaaaaatttcaatccaaagaaaaaaggagaagactctccttctgttccaaagtgctatgaatgtaatcaacttggacatttaagacttgattggcctagtttcaacaaaagaatggagaagtctgacaagaaaaatttcaaagacaagaaagcaaagaaagcttacatcacttgggaagataatgatatatattcatcaggagtttcagaaaatgaagtagtgaatctgagtctcatggccaaaaacaatgatagcgaagaagag

SEQ ID NO: 58143 - DNA, 228 bp, Glycine max
  Peptide Sequence Number=SeqID_174921
atgtctgatttagggataaaatatatcgagatgctcgaaattgaacaacggaagccctcgacaaattcaaagcgtcataacttttcactcggatgtccgattcaggcgcataacatatctagacgctcaaaattgaacatcggaagctctcgagaaatacaaatggtcattacttttcactcagatgtccgatttaggcgcatcacatatcgagacgctgaaaattaa

SEQ ID NO: 58144 - DNA, 643 bp, Glycine max
  Peptide Sequence Number=SeqID_174922
atgaactctcttgaagttcttcacctcaccggtaacaaactgcaaggggaaattccatctttctttggtaacatgtgcacattgcaggggttacacctctcaaataacaagttgaacggggaaatttctagcttcttccaaaattcttcatggtgcaacagacacatatttaagaggttgtatttatcttataaccggttgactggaaagttacctaaaagcattggattgctatctgagttggaggttcttaccttggttgggaattctttggagggtgacgtcactgaatcccatctttctaatttttccaaattaaaaaggttgtacctatcagagaactcgttgtctctgaaattggtcccgagttgggttcctccattccaattaaaatacttgagaatcagatcttgcaagttaggccccacctttcctagttggctcaagactcaaagttctttgtacgagcttgatatttctgataacgggattaatgactctgtaccagactggttttggaataacttgcaatatatgacagatttaaatatgtctttcaattacctcattggtgcaattcctgatatatcattgaagcttcctaatagaccgtctataattctgaattcaaatcagtttgagg

SEQ ID NO: 58145 - DNA, 348 bp, Glycine max
  Peptide Sequence Number=SeqID_174923
atgcttcctgaagataacacgttgctaaataatcaccacgaggcaaagaagattttatgtccattgggaatgaaataccaaaaaatccatgcatgccctactgattgcattttgtacaaaaatgagtttgcagaaatgcgtaattgccccacatgtggggtatcaaggtacagagtgaacgatggggaatgcagtgttgatgcaatcgcaaacaacagtcgtccaataaagattatttacaacctccctctttggttgtgcatcaagcgaaagtacataatgctttggatgatgatatcgggcccaaggcaaccagggaatgatattgacgtctatctgactccgtag

SEQ ID NO: 58146 - DNA, 288 bp, Glycine max
  Peptide Sequence Number=SeqID_174924
atgaatagcacacttttgttttcaaggtttggaaaaccagaaaactttagaaagcttttggcaaaggaagaagaagaagaaattcaagaggatgttcaaagagattcaaaggatatccgcaactacgacaacaaatttgtgtcaatccctgtcatgaataagagatcaacaaccacaccattgcctcgaacgagagagatcaacaacctctacatcatcatgaacgagggttgtacaatcctcaactctttcactcagttgtcatcaacacacttcatcgaatcctag

SEQ ID NO: 58147 - DNA, 493 bp, Glycine max
  Peptide Sequence Number=SeqID_174925
atggctgatgccaagtttgcggagctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 58148 - DNA, 626 bp, Glycine max
  Peptide Sequence Number=SeqID_174926
atgacactaatgaaccaaagttcagatcctcgtatctattctgtagcacaaaatagtacacattactcttccggatatagtatagttattgtgctactatggctgaaaggaagagaagatgagtaccgaaacattctgggtttggtaacaagcattgatctgtcaagtaacaaattattaggagaaatacctagagaaatcacaagtctaaatggattgaactttttgaacttatcccacaaccaagtgattggtcatattccacaaggcattggtaatatgggatcattacagtccattgatttttctaggaatcaactttctggtgaaatccctccaaccatttcaaattcgagctttttgagcatgctagacttgtcatataatcatttgaagggaaaaattccaacaagaaaacaattgcaaacctttgatgcctccagctttattggcaacaatctatgtggtccaccactgcccataaactgcagctccaatgggaaaactcatagttatgaaggaagtgatgagcatggagtgaattggttgtttgtcagtgcggcaattggatttattgtgggattctggatagtgattgctcctttgctgatttgtagatcatggcg

SEQ ID NO: 58149 - DNA, 201 bp, Glycine max
  Peptide Sequence Number=SeqID_174927
atgacgtcaggctcgaagcgcagtgagctgggcgcagaacagaatagtggcaaagctgccagccccacggctgtaagcaaggggcagaacgatgcaaaaacaccaggcattgtggttaaactggcctggttggcggtcttgattcccatcagctacggcatctggatgacagtccaaaaagcctggtccttgtttgcataa

SEQ ID NO: 58150 - DNA, 408 bp, Glycine max
  Peptide Sequence Number=SeqID_174928
atgacaaggagtaagaggtttgtggaggcagaggatgaggacagggttatcatgcctaagaagaaagctgctgaaaagaaaggtactgatgataagaaagatgatgtgagaggtgaaagtaatcaggagaaagaaaaacaaataatgaatgaagagagaagtagaagtgaacaagctagagaaaagaagagagaaaaagttgtgaatgaaggggcggaagtaccatatcctatggtaccttctgagaaggagaaggatcgccatttggatatgttgacaaggaaacacaagtatattcaccaggaaaacattgttgtggaaggaaattgtagtgttgtgattcaaaagatccttccacccaagcataaagaccctgggagtgtaaccattccttgttcaattggataa

SEQ ID NO: 58151 - DNA, 621 bp, Glycine max
  Peptide Sequence Number=SeqID_174929
ggcctcatgaattgtgttttcgttcatgtgtcctccaccttcgaacttggagccatgcgtagtgattgcttagtgcaattctccattctcaccttttttcagagccccatgaattgtgttttcgttcttgtgtcatccacctttgagtttggagctatgcttagtgattgcttagtgcaattctctattctcaccctttttcggagacccatgaattgcgttttcgttcatgtgtcctccaccttcgagtttggagccatgcgtagtgattgcttagtgcaattccccattcacaatctttttcggagccccatgaattgcattttcgttcatgtgtcctccaccttcgagtttggagccatgcgtagtgattgcttagtgaaattctccattctcacccttttgcagagccccatgaattgcgttttcgttcatgtgtcctccaccttcgaacttggagccatgcgtagtgattgcttagtgcaattctccattctcaccttttttcggagccccatgaattgtgttttagttcttgtgtcctccacctttgagtttggagctatgcttagtgattgcttagtgcaattctccattctcaaccttttcggagccccatga

SEQ ID NO: 58152 - DNA, 336 bp, Glycine max
  Peptide Sequence Number=SeqID_174930
atgccgatctccccctgcggaagtatcagttggtctgtgtcgtcccgacatagggatcgcgatcacaaggcacccagtggacccggaggagtccgacagggccttggggtttccagctctggttacgggcctctgtcagtcctacaggatgcccgtccccccagcaagggatcgcgcccacaagacatcctgtggactcggagaagtccaacagggccttggggtttccagctctggttacgggcctctgtcagtcctacagggtgcccatttcccccagcaaggtcatgccatcgtgacataggtaagtatgcacttctctcaactgatttttga

SEQ ID NO: 58153 - DNA, 288 bp, Glycine max
  Peptide Sequence Number=SeqID_174931
atggtcaagttggtgcgcatgatccgcactcgtgtctttgcagtggcatgggtgaaatcttgccccggtatgcatagtagatgcgtgatagcctccctctcttgttgtattcacacagttggcgccctccaatatcagggggtggcccaggaactgataaaaggaaactactggcctcttaaccgggagtgcaagtctcagttaagcattttagggcagaggaccttaaattctcttaaggtgcagatgtggagccctctgaaagcgaggacgcttagccttctatag

SEQ ID NO: 58154 - DNA, 540 bp, Glycine max
  Peptide Sequence Number=SeqID_174932
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacgggttggatgtctaattgtccaggcggtaatgatagtatcttgtacctgaaccgatctagtatggatcgtacatggacggtagttggagtcggtggctctcctagggtttccttcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 58155 - DNA, 294 bp, Glycine max
  Peptide Sequence Number=SeqID_174933
gacagagagcttaggggaagcagtaatgggatcatcggtggctatcataagtggctgagagtccggacacaaggattggattggctcccaaatctaaagactgtgagagacaatgaggttaaagcttcggaagaaagtgatgaggtgcaagcgctaaaggcaaagcttgaaagaacctgggtagtcaaagagaagttcaaggcagcaatagtgagctcaaactctgaagaggtgaaaggaatcatcatgggtcaaaggcatgatctggaaggacgagctaaaggcttgccttag

SEQ ID NO: 58156 - DNA, 387 bp, Glycine max
  Peptide Sequence Number=SeqID_174934
atgcctttcattttcgggtacaaggaagattacccttggcataagcatattgctcttctaagacatggtgctctcgcgaatgatttatttttctttgcaaaaggcatgtttgcgtttttaggtggaaaatacccggtggacaattcggtcctgctatccttttttcggagacccatgaattgcgttttggttcatgcattctccacccacgagtttggagccatgcgtagtgattgctttgtgcaattctccgttctctaccccttcttccggagccacatgaattgcgttttcgttcatgcaccctccacccacgagtttgaagccatgcgtagtgattgcttagtgcaattctccattctctatacctttttcagagccccatga

SEQ ID NO: 58157 - DNA, 803 bp, Glycine max
  Peptide Sequence Number=SeqID_174935
aagcacggtttcttccagcgccggctgttccgccagccctatgtgtgcatctttcgcgaggatcatccgctggcgcgcaccggcgtgtcggcgcggcagttccgcgccgccgagcatgtcgccatcgtgtcggagggcaccggccacggggtggtggaccaggtgatcgagcaggccggcatccgccggcgcctgcgcctgacggtgccgcatttcatggcggtggggccggtgctgcaggccaccgacatgatcgcggtggtgccgcggcgcttcgccgattgcgcctgcaagcccttcggcctggccaccgcggcctgtccggtgaagatccccgagtccgtcatcaacgtgttctggcacgcccgcaaccaccgcgagccggccaaccagtggttgcggcaggtggtggtggagcagttcgcggattaggggaccgcgtactcaccgcccggcgcggcgggattcagggcgttggacagccggatctcgtcggccgcgtgcaggtcggccagggtcagcacgcgttcgctgacgttgccggtatcgagcagttcggcgcgctgcacgccgggcaggcagccgctgtcgaccggtggcgtgtaccagtcgccatccaggcgcaggtagacgttgctgcggctgccttcgcacagctcgccgcgttcgttcaggtagaccaggtcgaagatgtgcggatgggccggcagccattcgatggtcttggtgtacccagggccggtaagtggtcttgtagcgcaacagcggctcggacgagcgcagcgcctcgggcgccagcatga

SEQ ID NO: 58158 - DNA, 252 bp, Glycine max
  Peptide Sequence Number=SeqID_174936
atggaaagtgacccgacgtcgcatcacaaacacttggcaatctttaatggggatgatgccaccagggtgtatcaaaatagtgacggggtaaagcccggcgtatgcagcaacggatggggaataaacatttcttgggagaacgtgccaatcccaaaatacatggtagaagagctgggtctccttgacattccattgtgcccccaaatgaacgaagatcatctcgatgcagttactttgtctttcgatccttaa

SEQ ID NO: 58159 - DNA, 522 bp, Glycine max
  Peptide Sequence Number=SeqID_174937
ttaccctcactgttgagaggactacacgtcctcgccttgagaggactacgcgtcctcaccttcagaggactacttactctcaccattgagaggactccacgtcctcaccttgagaggactacacgtcctcatcttgaggtactacacgtcctcgccttgagaggactacatgtcctcaccatcagagggctgcacgccctcacctccagaggactacacgtcctcgccttgagagggctacccgccctcgcattgggactacacgtccttgccttgagaggactacacgtcctcaccatcagagggctgcacgccctcacctccagaggattacatgtcctcgccttgagagggctacacgccctcaccttgggtactagttaccctcaccgtcagaggactacacgtcctcgccttgagaggactacacgtcctcaccaccagagggctgcacgccctcacctccagaggactataagtcctcgccttgagagggctacacgccctcgccttgggtactag

SEQ ID NO: 58160 - DNA, 153 bp, Glycine max
  Peptide Sequence Number=SeqID_174938
atggaggttgaggaaccctggcaggggttatggctaccattgcattatcaagtggtgtttgggcattgggcgtgcggtaagcaggcaggccttgtggctgatttggggatgacttttgtggatgattgggtgagagggactgttattggctga

SEQ ID NO: 58161 - DNA, 462 bp, Glycine max
  Peptide Sequence Number=SeqID_174939
atgttgttgggtttttttatagaagaagggttctggtgcccaaacccttttttgtcttgctcactcatatcgttctcgcattctctcactctccttctcgtggcgctacaactctcgttcttcctctgtgattctcactttcgctctctcactatcactcaactcctcgcggcactgcgtgcccatcgtgccaggaccatgttgctcattgcatcgttgcatgctcgccacattccactctcgcgttgcgcaattgctttcgcgtcccttactccctttctctttctctcattgaaaacatccaaggtgatttcatctacaagtctaaaggctacatataaaagccttaatgtccaaaaaaactcaacttctgttcctttggcagatacacaaaaggataaatcctctatccagcaaccagtgacaattgtagagcttgatcatcaaaagaatcccctttaa

SEQ ID NO: 58162 - DNA, 318 bp, Glycine max
  Peptide Sequence Number=SeqID_174940
atgggatcgcgcccacaagtcgcccagtgggcccgaagaagtccaatagggccctggggtttccagctctgggatcgcgcctacaagacacccagtggacccgaagaagtccaacagggtcttggagttgtcaagctctggttatgggtctctgtcagttttacggagtacctgtcacctctagcaagggcatcaggccccctactaatcgagctttcatcaagaagtactgcatccccaggcaggcgtagggcgaaacaccacagcagcctggggatggccagcagcgggcaacagacgcaccgccatcacctctag

SEQ ID NO: 58163 - DNA, 174 bp, Glycine max
  Peptide Sequence Number=SeqID_174941
gtgaaaaagaggctaagtcaagaagtgctaaaagtgacggttgagcttagctcatcagtggggctaagcatgcatccatcgctaagcgcagcttcagcgtgcttagcacgacagcagaatctggcagagcatcaatatcagggccgcacactaagcgcgagatcagttcgctaa

SEQ ID NO: 58164 - DNA, 219 bp, Glycine max
  Peptide Sequence Number=SeqID_174942
atggctgctaggaaaaggctcacacgcctcctagagaagaggatcaacgttgctttagtacgtgaattctacgcatatgtgtacgatccagaggatggctcgcctatatactacagggtcaggggacaggtcattcaattcgacgttgagacattgaacgactttttagagaccctcattgtcattctggaaggggaggagtaccccacatgctcctag

SEQ ID NO: 58165 - DNA, 399 bp, Glycine max
  Peptide Sequence Number=SeqID_174943
atgaaggatgatgctctcaggcttcaatttttcccttttcttaatgattttgagaatggaaggattcctgattctgttgaattgaggtctttccatgttgagaagttgcaaattgttgacgcgactagttgtaggactaaaattgagggcttgaaggagcagattgttaatcatgaaggtgacattaagcctacaatttatgtgcttaatggattggtggctatgactagatattataggttttttctttttggctttaaggaggatgagcttggttttgagagtggaagtcagaagaagcctaaaacaccgatggggacgaataatgtgagagggggtttgaagctgaacaaggctgtgtggagccaagggatctggagtgtctcgaggaagattaag

SEQ ID NO: 58166 - DNA, 354 bp, Glycine max
  Peptide Sequence Number=SeqID_174944
atggaaaacgacactggtttccctctcatccccaacgtgttctccggcttcaactccctcgtggcctccgcggcatgtggctccctctccgtggcacgtgtcttaacggggcagtttaaccccgctaacggcattggcttggccaacactagcttagtcttcttcgggaatcgtctcttcgcgcttgccgaatctgacctcccttacgccgttaacgtaacccctgacggcgacatcgacaggctcggccgtcacgactttgacgaaaaactcacgttcagcatgacggcgcaccctaagatagacctcgacacagtggagtgcttcgccttctgttacggccccgtgccatga

SEQ ID NO: 58167 - DNA, 225 bp, Glycine max
  Peptide Sequence Number=SeqID_174945
atgagggagagagggttcaggagaagttttgggaccatttttgtgtctgctattccgatgatagtgaccacgcctgagaaatgggatgccattacacgcaagagcagtgacatgtcattgtccatggtggtaaagctcttaattattgatgaagtccatctactcaatgatgataaagctctagttgccaggaccctacggcagacattggcttatgacagctag

SEQ ID NO: 58168 - DNA, 579 bp, Glycine max
  Peptide Sequence Number=SeqID_174946
atgccttgcctttacatcaccaccaaccttaacctagatggagttgacaccaaccccgtcttttctgaagccaccactgctgtctctacaatcattggcaaacctgagaagtttgtaatggtcatattgaagtcatcagtaccaatatcatttgagggtaacaaggaaccagcagcatatgctgagatagtttcaatgggtggcataaatacagaagtgaagaggaagctgattgctaccattggaaccattttgcagtccaacctgtctatcccaagaacacgatttttcctcaaagtctttgatgatttcttgggctgcggcggggataaaggctattgctacattgactcaacccaagccatatttgtgtcattcaaatcctcacccaacaccaccatcaacaataacaaccatttcacatggagaaggtctccaacgttggaatcgtttttagcccctgttgacttaagcgattttgctttggttcataccctcatctccgttgccaacgagattgtgtcgtgttttttgaagtgtgttgatgaattggcaagtgcaccaatgcgtcccaagtag

SEQ ID NO: 58169 - DNA, 228 bp, Glycine max
  Peptide Sequence Number=SeqID_174947
atggaggcgcttgcgggaacaacaaggagaagacacagaacggcagaagaggtattcttttggtggtgggccgcgtccaaccgcgcgcgtcttcctgttcaaccatgtccggtgacggcggaggcgacagacaccgcgtcgcaccggagtcatacgcgcatgcatgttcgatgcgagtctgacatgggacacgccggtgatgagccgcgtccgtgcttcttagattag

SEQ ID NO: 58170 - DNA, 198 bp, Glycine max
  Peptide Sequence Number=SeqID_174948
atggcgaagactgcgagggtgggcttgttcaaacacgaaggtcgttcaaggaaaccaacaaaacttaccaaaacacgagggtggggtgagcgtcacggcgaccacgacggcctgagcgtggctatgcgagactcagcgtcgggggtcagggacaatgccagtgacaacgacggcctgaggatgcctttgagagagtga

SEQ ID NO: 58171 - DNA, 411 bp, Glycine max
  Peptide Sequence Number=SeqID_174949
atggaagtgcttctgaggttcagtgaggatggtgcaagggcttcacaaggttggataacaaggtgcaagggtgaaggagggcttcacaaggcttccggtgagcttttcagggttggggaagggaggtgttctcatcaaaggaagcaacaatcttccataaggttggagagatgtcaaaatgaaccaaagaaaggacccttaattagtgtatacctttatactaccagaaagggtcgtcaatggttctgttgggtggttggggcaatggtgtttggatcaatggtattgcgtggaggcggggctagcttaggagaggggggaatatttgtgtttgttcatgtcttttggggtgcaggaagcaaaaacggatatgaagaagtaaaaagtcccaagtttcacgggttgttctaa

SEQ ID NO: 58172 - DNA, 654 bp, Glycine max
  Peptide Sequence Number=SeqID_174950
atgagacaagggaatgttgaatcagccgcggacgccgggggcgggtggcgcgggcgagggaggaacggcgacagcagcgcggaggatggacaggaacccggcgggctggttcgtgccgccctcgtcgaggaagagatcctcggggaccctgagggcagcgtgggcggcgacgagggcgacggagacgctgaaggcggtgacgaggagggagccgagggaggtgaggaacaaaaggacgaaggtggtggcgaggaggagggagagcgtcgcaaaggcggagaaggggcggccgagaagctggagggggcggtcggcggggcggaggagggagaggaagagccacgaggcgaggaggccgaggaggaggacgagggagaaggggctggtgaggagggacacggcgaggatgagggacacaacgatgtaatagttgatgcgaaagtaggagatgttgtggcggatgcggagggaggaagcggaatgcggattgcggcggttgcggttgcggtggcggttcggtggtttgagggtttgagacggggagaacttgtagttgatgttgttgtggggaaggagagggagagggagaagccatgttgttgggaaataagtgagagaatggagaaagttttgaattttgatatgggtttctga

SEQ ID NO: 58173 - DNA, 280 bp, Glycine max
  Peptide Sequence Number=SeqID_174951
atggagggctcaatgattaatgtaacaagacaggacaatagggcacgtctcctaaattttcattgggtgttgctagccagaaccactgacgagtttggtctccgtgaaggactcgccactgtcaatggcaatatgtccatgcaaggcagaaatcgccattcgaactggcgatatgcacaacgcatagggaaccgtcagtcaaactggcgagttccaatagctgagggtgcaggtctagccctgcttctcgcaggcaatggcagtgcagcagtgcagacgt

SEQ ID NO: 58174 - DNA, 129 bp, Glycine max
  Peptide Sequence Number=SeqID_174952
atgcctttcagtcctggagaccctgtgctactcagtgcatctctcccatcatcagtgcatatctctgttaatagttcactttgcgtacgtatgacagaaaagttgttgataataaccacaacacaatga

SEQ ID NO: 58175 - DNA, 1050 bp, Glycine max
  Peptide Sequence Number=SeqID_174953
atggttcctttggtgggggcgcggaagaaaacacaaacttctcagttcagtgtgactcaaactttctctccaaattcatcatgtggccgaaatttgagaaagaaccaacttggtggcatcatcttcggatgcaagaatgccacaatgaaagaatgtctatctaaacaactgtttggcttaccagctcatcacttctgttatgtgaagaatattgatccagggttgcctctgtttctgttcaattatactgacaggaaacttcatggaatttttgaggcagccagcagtgggagaatgtttatagacccctatggatggactacagatggttcagagagaacacagtatcctgcgcaggtgcaaatttgtgtccgactaaagtgccacccattgcctgaagataaattcaaagaagtaattgcagacaactactacactcataatcgtttctattttgagctagaccatgcacaaacaagcaaacttatttccttactatcagctggagcaattgcctctgataattctgccccacagaatacacagaagtggataactgtatcacgacctcttgcatcaaatgaaactttgagggaaggtgaaacatctaaaatgcttgaattagagacagagcattctactcactcaagtacaagatcatattggattgaaaatgacttttcttttgacggatacatccggccattagatactaatgaagttgagaaggaagtaaacgaggatgagcagaacagcatatttatgaaactgaaggagttaacacttgacagtgaaagtcaagatttatccttggcaaacaatgccaatgatactcctggtatgaataacacagaagagggttatatggaggcgttggatggtttagatgagaaggaacagacttctaatcctccatttgattatcaatataacatagcccagtgtattttagttggtgcaagaggtcaagaattgacaaatttccagaaaatacaaacggagaggaattgctacctggagcagaagctggtacacttttctatgttgtag

SEQ ID NO: 58176 - DNA, 282 bp, Glycine max
  Peptide Sequence Number=SeqID_174954
atgaatctttcattatcacttggcagtcgactccacaggcaatcctgcatggttacactcaaggttatcaatatcgagagtctacgcagactcgtgagagcttctacgagtcaactcgtagagccgactccttttgatctagataatttaatttttgtggaacttaatgatgatgcacaatctgaggaagaccttgatgatgatgatggagatggagatgatgatgaaagtgatgatattcatggagatgatcctattagaggattggacatgcttctttga

SEQ ID NO: 58177 - DNA, 423 bp, Glycine max
  Peptide Sequence Number=SeqID_174955
atggaggaaaaagaggcagagatgaacaggctaaaacataatgccaaaggcacaccctcaccaactttttaccgtggtcaaaaagtagtaaaaagtcattcagaaaagcttcttcagattcttttttttttttgcttggtcagagtatcatctcgggcaactcaaggcaaaaatagcaaaattgaggacacaattattggagccttgaaaagtatgctgctatttatattgtttattattggtttctacttccaggagaccaagtttttgaagtttgtagtatttaagtggaatcatctttcatgggtcatggaagctgcaacaatcatggccattgctttggccaatggaggaaataatgactttcagaataatgactttcatcctctgattcaaatttgtcttcttaatcaagttttgtga

SEQ ID NO: 58178 - DNA, 572 bp, Glycine max
  Peptide Sequence Number=SeqID_174956
atgtgggcttgggaacgatgtccaaccttggctccaaagaggactccttcccaagtagaaaatacatcactggggcacaggtggctgcgacgtggaaaccaacatatcggcaatgatgatgtgagagtttttcgtcgcaagttggatattatgaaacgtcatgagtttgtgtgggagcacccatcaaccgttatatcactgttgcctcccgtttgtttagtcggaagtctcgcgtggcaaaagacaaagatgtttgttgacccacaaaatgcaaagacggctacattggctggagttgcggagacattacaatacatggtgtctcctcaagggaggaatacatggacagttgatgatctcgtgccttatgtggaaaaaattacaattttatccgaagagcaagagagagtcattgagccaatgtcacatggtcctgcatctgagcgtcaatttcccgcacaacagtttcatatacttcagtcaagtgttgaaactcagggcatagacagacaaagggagactgttgaaggggaagaatattcccaaaaaatgtcggagcgtggccatggaat

SEQ ID NO: 58179 - DNA, 168 bp, Glycine max
  Peptide Sequence Number=SeqID_174957
atgaggatatgggctacgtgggagtacgtgagctcagttggaggtgggcaacaggggatgagtggtacctggagatatgtcacgggggtcaggagaccttggggacgtcaggtggggtgctattgcccaaaaccaagcttgaccaatcccgacccaacccgggcatag

SEQ ID NO: 58180 - DNA, 213 bp, Glycine max
  Peptide Sequence Number=SeqID_174958
atggtaaaacatttgcacaagattaaatggcctaactctctaaaaacagtccccagcggagtcgccaactatcgcaacctaccgttcggcgggagggcgacgcatgactcgcgggtgcgtcttccaagaaaggaatacgcgcggagtcgccaccaacgtttatttgaggaaaacgtcggaaaaactggaaaagacgtgatctatgaactttaa

SEQ ID NO: 58181 - DNA, 297 bp, Glycine max
  Peptide Sequence Number=SeqID_174959
atgactgtttccaccacatacaaggacttctaccttgatggcggcactactttatttgccgccgtcgagttttataggaaggatggaggacatgccggaagccgggtagttccgggaaccgccggggaggacggggaaggtgcggacaactttgttggtgttagggttgaggaggagggaacggttgttggcgaagatgaagagaggtggacaaaagggaaaataacagacatgctaattggtctaagaatctttttggatacaagatataagtatttatcagagcttctctattag

SEQ ID NO: 58182 - DNA, 306 bp, Glycine max
  Peptide Sequence Number=SeqID_174960
atgccatgtattcaatggcatgatgataaccttaagctagaccaagaagattgttttgctcattcaatggaatacgatattgagactaatcaagttagaccactcacggtaaagacagatccatggtgctcatgtggaggacttacacctgatggtaccctagttgttgccggtggtttcgcagacggagggaaaacctccagatactatggcggtcaacttgattgccaagactgtgactggagggaataccccgataaattgaaagagcctagatgttttattcccttgtcatcaagatattag

SEQ ID NO: 58183 - DNA, 357 bp, Glycine max
  Peptide Sequence Number=SeqID_174961
atggtgatcacagaccctaaccctcaatcggacagtgaagagatgccttcagggagaaccatgggggattctcttatcctccctacaggacaaatcttgttcataaatggtgcacaaaaggtgttgtatttggctgaaaaacctaagggtaaaaggtttaaggttttgaagccttccaaaatagctagaatgtaccactcaacctcagcagtgcttcctagtggcaaaatttgggttggtggtagcaacacacatgatacttacaaggacaaggataagttcccaactgagactaggattgaggctttctctgctccttacttggacccaaaactagacaaacatcgaccccaaatt

SEQ ID NO: 58184 - DNA, 216 bp, Glycine max
  Peptide Sequence Number=SeqID_174962
atgtcgatgacgacaacaacaatactgatcaatagtggcggtgtgacaacgacgacaacgataaaagtgaaactgatggtaatgatagcgatgaaaatagtagtaataatgttgacaatggtagtgaccacaatagttgtgatgaaggtaatgataatggtgatgaaaatactaggaagagtatttgtcaaatataaaaagtgtgagctttcttaa

SEQ ID NO: 58185 - DNA, 912 bp, Glycine max
  Peptide Sequence Number=SeqID_174963
atgccgacggggttaccgaaggcgaactcctccgtggcgccggacgaccagggatggttgtggacgcagatcaaggcggaggcgcgccgtgacgccgagttggagccggcgctggcgagctacctctactcgacgatcctctcgcactcgtcgctcgtgcgctctctgtcttttcacctcggaaacaagctctgttcctccacgctcctctccactctcctctatgacctgttcctgaacgcgttctccttcgacccctccctctgctccgccgccgtcgccgacctccgcgccgcccgcgaacgcgaccccgcctgcgtttcctactcccactgcctcctcaattacaaaggcttcctcgcttgccaggtccaattccctaaaccccctcttttccagggtttcctacttcttgctagggcgcaccgtgtggcgcatctgttgtggcggcaatcgcggcagccattggctttagcactgcactctcgcatcgctgatgtgttcgcggtggacattcaccctgcggcgaggatcgggaaggggattctgttcgaccatgccaccggggtggtggtgggggagacggcagtgatcgggaacaatgtgtcgatcctgcaccacgttacgctgggtgggactggcaaggttggtggggaccggcatcccaagattggggatggggtgcttattggtgccggtgctaccattctggggaatattaagatcggggaaggtgcaaaggttggtgctggctcggtggttttaatcgatgtgccaccacagacaacagctgttgggaacccagccaggttggttggtgggaaggagaagccctctaagcacgaggatgttcctggggagtccatggaccatacttcctttatctctgagtggtcagattatatcatttga

SEQ ID NO: 58186 - DNA, 1312 bp, Glycine max
  Peptide Sequence Number=SeqID_174964
atgagcactcagtcacaacaacacaacaaaagagaattcaagggagaagaagaggaagaggaagaagaagaaaaccatttgttacattcagaatgcgagacaataccattttcctcacccaacacatcaccctcagagtgggaacatggaaacaaagaagaagaagaagaagaagagaaggacacggtgtatgcagccaaggacaaggtgcagatattcgacctggagtctgccggtggtgtaagggaagggtccacagcggtgccacctttttcgtggaggaagctgtggctgttcaccgggccggggctgttgatgagcgtggcgtttttggacccggggaaccttgaaggggaccttcaggctggagccattgcagggtacacgttgctttggttgttgatgtggtctaccatcatggggctggtgatacagcttctgtcggcaaggcttggggtggcgaccgggcggcacctggcggagctgtgccgggaggagtactccaattgggccaggttggtgctgtggatcttggcggagctggctctcattgctgctgatattcaagaggttattggcagtgctattgctctcaagattcttagccatggacttctccccatttgggctggtgtgattatcacagccatggattgtttcttctttctatttctcgagaactatggagtgaggaagttagaaggtgtattcgcagttttcattggaactatgggcttttcttttgcgtggatgttcttcaatacaaatcccagtgaagaagaactactgatgggccttttgatcccaagagttaattcgaaaacacttcggcaggctgtggaaattgtggggtgtgtgataaccccccacaatgtgttcctccattctgcattagtacaatcaagggacattgatatccgtaacaaaggccaggttcaagaggctataaactactactcaattgagtcctcggttgcacttttagtcacattggtgatcaatctatttgtgataactgttttcgctagggtgttctatggtacagaacaggccaaaggcataggattggtaaatgcagggcagtatcttcaggagaggtatggaggagggttgtttccaattctctatatatggggtattggtttgttagcagctggacaaagtagtaccatcacaggcacatatgcagggcagtttataacagagggttttctcaagctcaatataaagaagtggttgagggcattgattacaagaagttgtgcaattgttccaactatgatttgtgcaattgtttttaatacctcagaag

SEQ ID NO: 58187 - DNA, 665 bp, Glycine max
  Peptide Sequence Number=SeqID_174965
atggaaatgaagaatacaatgaataggaaccctcaaagtgatgcaccaatcataaaacctctagatcctgaagaattcaagaggcaaggctatatgatggttgatttccttgctgattatattaggaatgttagccattatcccgttttaagtaaagtagaacctggttatcttaaacaaagattaccaacttctgctccatgtggtccagaacccattgaatccatacttaaagatgtgcaagatcacatcatccctggcctcacacattggcaaagtcctaatttttatggctacttcccttcaagtggtagcatagcagggtttatgggtgagatgctgagcgctggactcaatgtggttggattcaactgggtgtcatctccatctgccactgagcttgaaagcatagtcatggattggcttggacaagtgctgaacctccccaaaagctttcttttctgtggtgatcatggtggtggtgtggtgttggggactacttgtgaggccattttgtgcactttggtggctgcaagggagaaaaaactttcccaagtcgggaaggagaacataggaaaacttgtggtgtatggctctgatcaaacacacagtgcacttcagaaggcagcacaaattgcaggcatccatccagcgaatttttcggg

SEQ ID NO: 58188 - DNA, 920 bp, Glycine max
  Peptide Sequence Number=SeqID_174966
gcatccatccagcgaatttccgggtcatcaaaacgaagaggtcgaattcgtttgctctgtctcctgattctcttctctccaccattcttttggatgtggagagagggttgattccttgtttcctatgtgccactgttggcactactgcaatagcaaccattgatcctatagggccattgtgtaatgtggccaaggactatggaatttgggtccatgttgatgctgcttatgcaggttcagcttgcatttgccctgagtttagacattgcattgatggggttgaagaggttaactcctttagcctcaatgctcataaatggtttttgaccaatttgacatgttgttgcctttgggtgaaagatcacattgccctcacaaaatccttgacagtaaatcctcaattcttgaggaacaaagcttctgagtcaaagcgagtgattgactacaaggattggcagatacccttgagcaggaaattcaatgccctcaaactatggcttgttcttagaagctatggtgttgagaacattaggaacttcctgagaaatcatgtgcaaatggcgaaaacctttgaagggctagtaaggttggataagaggtttgagattgttgtgccaccaaaattctctttggtttgctttaggatcgccccatcagcaataattgctaatggactttctaaaggtgttgaagcttgctataatgggaaactggtgaatgatgagtatatggtgaatgaagtcaatcgtaaattgcttgattctgttaatagttctggtgatgcattcatgactcatggtgaggtcgaaggagcttttatgattagatgtgctattggtggaaccttaacagaggaacaccatgtgatcatggcatggaagttggtgcaggagcatgccaattctctgttaggactgtga

SEQ ID NO: 58189 - DNA, 171 bp, Glycine max
  Peptide Sequence Number=SeqID_174967
atgaggccgaggcgctaccaaattatgaccgtaatcgacttctacaccgttcttcgtttggtgttcttcattcgtcatctgaactatgtaggtctgagttcctcatcgtacttgaggatacataggagtaagggcaacacccttgtcgaccccaaaaataaagaaacataa

SEQ ID NO: 58190 - DNA, 525 bp, Glycine max
  Peptide Sequence Number=SeqID_174968
atgaagccatctccaagatttctcttcatactcacttttcttggttcgttcttccttgcaagcccagaagcagactcgtgcaccagcaatctaaacctcaatgtttcaatcccttttgatacaacaaaccttcactgcctttctgtatgggatgctcaaagtttcatcctcagatatgctcagacttctgcaaacacttggagcttcattctctcaaccccagacactaattcttacatagctatgggattctcggttggcggcggcatggtgggttcaagtgccatggtggggtgggtggcatcaagaggagccagtggagggataaagcaatattatcttggtggggtcacaccaaatcaggtggttcctgataagggcaacctacagttagaaaccaccgaacctttgtcctcgctgatatttgccactggatccactggtttattccctgcaccgccaagctttgcactaacaatacacctagacaaggtgtccacaagaatagactactcggaaggttag

SEQ ID NO: 58191 - DNA, 132 bp, Glycine max
  Peptide Sequence Number=SeqID_174969
gtgaaaaagaggctaagttttgaagtgcaaaaagtggaaattggggctaagctcagcagttgggctaagcgcacatccacagctaagcacagaaggtgtcttcggccaggcctagcgcaagactggcactaa

SEQ ID NO: 58192 - DNA, 837 bp, Glycine max
  Peptide Sequence Number=SeqID_174970
atgatccttcaaataggctttggtcttggaatcataatcataccaactgttgccactgattctcttatcaatgatgattgggaagcttatcggacatggagctttggtggagagataagtccttgtttggctgatttaaagcatttgaattacttggacttgagcggcaatagatttcttggagaagaatgggtatcaagtatgtggaagcttgaatatcttgatttgagtaatgcaaacctatccaaagcatttcattggctacacactctccaatctcttccttctttgacccacctatatttgtcatactgcacactccctcactataatgaaccatccttgctcaacttctcatctctgcaaactctcgatctttcccgtactcgttattcccctgccatttcttttgtccctaagtggatattcaaattgaagaaacttgtttctcttcaattacagggtaatgaaattcaaggtccgattcctggtggtattcgaaacctctcacttcttcaaaatattgacttgtctttcaactcattttcatcttctatacctaattgcttatacggtcttcatcgtctcaagttcctcaacctagtgcacaacaacttgcatgggactatttctgatgccctgggaaatttgacttctcttgttgaacttgttttgtcatataatcaacttgaaggaacaattccgacttttttgggaaatctccgcaactcaagggagatagatttaacatatctcgatctctctatgaataaattcagtggaaatccatttgaaagtcttggatcactctctaaattgtcatcgctttatatttaa

SEQ ID NO: 58193 - DNA, 639 bp, Glycine max
  Peptide Sequence Number=SeqID_174971
atggcaattttgttaagaggaggagcacttggagattctagctttcgtttgtgttcattaacatcaacttcttctttgcatgtctcccaaaatgttgccatacccacctcatcatcatcatcatcatcactagtactacctttgattgcaagtaaatttaaaacggtcagcagaatcagaatcacctgctctgctgttcaagaatcatctcctagcacagcagctactgctgaaacaaaggaggaggtaaaggaagctccaaaagccgaaccggcaaagaaacctcctgctaaagctccagctaagcctctgcctcagatgatggaggaggatgtgatcccttcactgaaatcaatatttgaagcccaagaagatttctcaaatattgagctggtcttcaaggacaataagttggaaggttcctttttgaagaaaggcaacccctattcattttgggcattttttcccacaggaaaccttattggtccaaaggggttttctctgtcatcgtataactcgggagcaagcaccgttgagccatttctcattgatgaaaagaagattactgcaagacacattatcttttgggttaaaaaacgtttggcagcacaagggatcattcctgtatgggaagattaa

SEQ ID NO: 58194 - DNA, 453 bp, Glycine max
  Peptide Sequence Number=SeqID_174972
atggagtttggatttttgggtttggggataatgggtaaggctatggcaatcaatctgctacgccatggcttcaaggtcactatttggaacagaaccctctccaagtgtgatgaactcgtgcaacatggtgcttcagttggagaaaccccagcaactgtagtcaagaaatgcaagtataccattgcaatgttatctgatccttcggctgctttatcggttgtgtttgataaagatggtgttcttgagcatattaatggaaaatgttatattgacatgtcaacagttgatgctgatacatcttccaaaatatctgagactatcaaagcaaaaggtggttacttccttgaagctcctgtttcgggtagcaagaagccagcagaagatggccaactcataatacttgctgctggagataagtcatctttcttgtatgcttctctattgcgcctttaa

SEQ ID NO: 58195 - DNA, 1167 bp, Glycine max
  Peptide Sequence Number=SeqID_174973
atgtcagagaagaagaagaagaagaatagcacgagaaggagcgttgttgttgttggggagagcaaaaagccacaacctttggtggaagtggaagacatagaggactcactttccttctccaaagacgagactcacaaactgagagtggctcttttggactggtacgacctcaaccgaagggaccttccttggagaaccacattcaaacaagaagatgaagaagtggaaagaagagcttatggggtgtgggtctcggaggttatgctgcagcaaacaagggttcagactgttattgcctattacaaccgttggatgcaaaaatggcccaccattcaccatcttgcgcaagcttctcttgaggaagtaaatgagatgtgggcaggtttgggctactaccgaagagctcgttttcttttagagggggcaaagaaaattgttgccgaaggaggccaaattcctaaagtggcttctatgctacgaaacattcctggaattggagagtacacttctggagccattgcttctattgcattcaaagaggtgggcagtttctgtgttttggttccggaaaaattaaggaaattagcagctcagttggttgatcctgttcgtcctggggacttcaatcaggctctcatggaacttggggcaactgtatgcacccctttgaacccaagctgttcctcatgtccagcatcagaattttgtcacgcgctatcaaatgctaaacatgatagtacagtagcagttacagattatcctgttaagggtgtgaaggttaaacaaagatgtgatttttctgctgtatgtgttgttgagttagttggagctgaaacgttaaataaaaaccagtctagcagcaagtttattcttgtcaaaaggcctgaagaaggattgcttgccggtctctgggagtttccatctgtcttactggatggagaagcagttccattagctagaagagaagcaatggatcgcttcttggaaaaaaatctcaaaattgacatcagaaagacttgcaatatagttttgagggaagatattggggaatttgttcacattttcagtcacatccgcctcaagttgtatgttgaattgctagtgttacaattgaaaggtgcaagcctcactttctatattggcattacaacttgttattatgattaa

SEQ ID NO: 58196 - DNA, 162 bp, Glycine max
  Peptide Sequence Number=SeqID_174974
atgtatgcagtcttaccccctcatgaagatggtcacaaggtagtgccaagtgatctggtggccattggaaacagtcatctaatgggagaatgtatctgtagtattgatacacgttcgatgaaagatgaagtgaaaggactaaggaacaaccgtcatacttaa

SEQ ID NO: 58197 - DNA, 849 bp, Glycine max
  Peptide Sequence Number=SeqID_174975
atggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgttgttcgctttagcaacaaggacattgttgcacaaataatatctgctagcattgctggcgatattgttcttgctgcagcatatgcacatgagctgccacaatatggtcttgaagtagggcttacaaattatgctgcagcttattgcactggtctcctgttggcccgaagagtcctcaatacacttgaaatggatgaggagtatgaaggaaatgttgaggctactggagaggattattccgtggaacctgctgagagcaggaggccattccgtgctctccttgatgttggtcttattaggactacaaccggtaaccgtgtgtttggtgcccttaagggagctctggatggggggttggatattcctcacagtgataagaggtttgctgggtttgataaggaaaagaaggagcttgatgctgagatcttggctgaagatgaaccagagaaataccagtcacacttcagtgaatacatcaagcgtgggatagaagctgatggtattgaggcactgtataagaaggttcatgccgccattcgtgctgatcctactcttaagaaatctgataagcagcccccgaaggagcacaagaggtacaacttgaagaagctgacttatgaggagaggaaggctaagttgattgcacgtgtggcgtctctcaactctgctgctgataacgatgaagatgatgagtga

SEQ ID NO: 58198 - DNA, 1167 bp, Glycine max
  Peptide Sequence Number=SeqID_174976
atgggagatctttctagaaatgattgtacctccatcatgcacctcccagatgattgccttgttattattttccacggtttagatagtcgcattgatcgcgattcatttggcctgacttgccgccgatggctccatgttcaagacttcaaccgtcagtcactgcaatttgagtgttcaagcactgcattacgtcctttatcttcatccaccaagggttttgacattcacacgttccatctccataggttgcttagacgatttcaacatttaaaatctttatcgctatctaattgctcagagctgagtgattcaggattgacccgtttgctaagctatggttcaaatttgcaaaaacttaatctggattgttgtttgaaagtcactgattatgggctatcactggttgcttctggttgtccctcattgatgtcaattagtctataccggtgccccggtattaccgataaagggctagatactttagccagtgcttgcttatctatgaaatatgtaaatctctcctactgctcacaaatatctgacaatgggttaaaagctattacacattggtgtcgccagcttcaggcaattaacatatcacactgtgaaggcttaagtggtgttggctttgaaggatgttcaaaaacactagcttatgtcgaggctgagtcctgtaagcttaagcaagaaggggtcatgggaattgttagcggtggaggaatagagtatctagatgtttcttgtttaagttggtctgttttgggagatcccttgcctggaataggctttgcctcatgcctcaaaatccttaacttccggctgtgtagaactgtttctgatacttctattgtggcaatcgccaagggatgtccactgcttgaagaatggaacttagccttatgtcatgaggtgagggaacctggatggcggacagtggggttatactgccgtaacttgaagagactgcatgttaaccgttgccgcaatctctgtgataatggcttgcaggctttgcgggaagggtgcaaaaatctctccattctgtacttgaatggttgtgttcgcttgacctctgttgcattagagttattcaagtgtcaaagagctaatgtttgcataaaggacatagagataatgtgtataaagccttactgggaattcagatga

SEQ ID NO: 58199 - DNA, 849 bp, Glycine max
  Peptide Sequence Number=SeqID_174977
atggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgttgttcgctttagcaacaaggacattgttgcacaaataatatctgctagcattgctggcgatattgttcttgctgcagcatatgcacatgagctgccacgatatggtcttgaagtagggcttacaaattatgctgcagcttattgcactggtctcctgttggcccgaagagtcctcaaaacacttgaaatggatgaggagtatgaaggaaatgttgaggctactggagaggattattccgtggaacctgctgagagcaggaggccattccgtgctctccttgatgttggtcttattaggactacaaccggtaaccgtgtgtttggtgcccttaagggagctctggatggggggttggatattcctcacagtgacaagaggtttgctgggtttgataaggagaagaaggagcttgatgcagagatcttggcggaagatgaaccagagaaataccagtcacacttcagtgaatacatcaagcgtgggatagaagctgatggtattgaggcactgtataaaaatgttcatgctgccatccgggctgatcctactctcaagaaatctgataagcagaccccgaaggagcacaagaggtacaacttaaagaagctgacatatgaggagaggaaggctaagttgatttcacgtgtggcagctctcaactctgctgctgataatgatgaagatgatgagtga

SEQ ID NO: 58200 - DNA, 303 bp, Glycine max
  Peptide Sequence Number=SeqID_174978
atggatgatgcaaagtatatgaaaacccctatgcatctaaccaatgtacttggattggatgaaaaatcaaagaaggtgggcaaaaagtcaaagaaggtggaagaaaagacatatagagaaatgataagatctattttgtatcttactacgtctagacttgacattatgtttagtgtatgcttttgtgccatattccaaaaagaactagggaagtttatttatcttctgtcaaacacatatttagagatagagtggaacgaaaaagcactagtgcaggatgtcactttattggtggatgtttag

SEQ ID NO: 58201 - DNA, 435 bp, Glycine max
  Peptide Sequence Number=SeqID_174979
atgaaaaaggcatttgtatttcttcaatcagaagtgatcgcgagggagagtttgaaaatgatctctttgaaaatttttgttaagaggatgtgtttcatcttaaacaccaaggataaccttgggaagtttgactccaaatgtgattttggactcttacatggatactttgaatcatccaaggcatataaagtgtacaactccaggatcttgactgtggaaggggccattcatgtaaaattttatgacaataagtctaacactacaatgtcagagttggatgagtcttttgcagagatgaaaatagaaaatatggccaagtcttctattgcatcctgtcaagataagcctgcatccaacacactagtggatgatcatcctgaagaagtcagggaaccaactggatgcttacttaggaaacatcattcagagtcctag

SEQ ID NO: 58202 - DNA, 501 bp, Glycine max
  Peptide Sequence Number=SeqID_174980
atggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgccttttgggggggccgaggccctcctactgctggtcggcaaacggacggcgggcgcacgcgtcgcttctagcccggaattctga

SEQ ID NO: 58203 - DNA, 815 bp, Glycine max
  Peptide Sequence Number=SeqID_174981
atggatgaggatcaagagatggagagatttggaacggagaatgattatgagggtggccaatggattggtggcgagttttactataagaatcgtaaagagaaacgcactcagaccaaggatgatgttctttatggagtttttgcagattctgatgacaatgacgacgatgattatccgagtagaaaacggaggaaagatttttcaaagaagccagacctcaccaagcctgtgaattttgtgtctacaggaacttttatgcctaatcaggaaattgataacaagtccaaagagcaggatgagaaagacggttatgttagtgaggatagaccagggttaggtttaggtttcggtatggggtctggtttaggttttaattctggtaatgctgtgaaaggttcaaatagaaatgatgattctgatgagaatgatgatgatggtttcttgcctaccgcgtttgggaagaagattaaggagggggcaatgagaagggaaaaggaacgggagagggagaggttggagaagaagagggggaagcatcagagtgtaggtcaagatgtgtctggtgatgttggaaaatttgagaagcatacgaaagggatagggttgaagctgttggaaaagatgggttataaaggaggcgggcttgggaagaatgagcaaggtatcgtggctcctattgaggcaaaattgagggccaagaattctggcattgggtttaatgaatctaaggagactatgctgctgcctgttttgcagcaagagaagaagaatgtaccggaaatcacccaacctgtggttggcagaacgaaggagag

SEQ ID NO: 58204 - DNA, 324 bp, Glycine max
  Peptide Sequence Number=SeqID_174982
atggcccttaacattagctcgagattttttacaatagttgcccttgcatttctagtcataatgcaaggaactcttggattcacaggttcaaggaagtgtttacgaaatataaggctaagacaagaaggagggcttcgaaccattgggcgattcgagctggtgtatggtcgagtcgaagtcaaggcagcaagatttctggacttagcacaatttctgacaaaacttcacaaaatcagttcgacttcgagcaatgtggataaccgttctaaggagcagttatgtgcatgtaaggtgtacgtagcaggacacttggcattaggatag

SEQ ID NO: 58205 - DNA, 451 bp, Glycine max
  Peptide Sequence Number=SeqID_174983
ggatcgggttaaattcctgaaccgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgcgaaaccacagccaagggaacgggcttggcggaatcagcggggaaagaagaccctgttgagcttgactctagctccgactttgtgaaatga

SEQ ID NO: 58206 - DNA, 453 bp, Glycine max
  Peptide Sequence Number=SeqID_174984
atggcgaatcatgaggagtgggtcccatttgtggacgtattagcgttgctaatctttggggttgtcctctttccaaacatggacggaggcagaacaagtggggactacccaaagatcccgctgatagggacgaggggttgcattatctacaatcccgcacttgctataagacagttagggtaccccatgaggggagcaccggcggaagagagcctctctcctttccttgtgagagattttggcgcacaaagtttcaaggttatacaaagagtccacatggtgtgggaaagcctgttaaggaaagataaagaacttaggggcatccgtaatggcattatcggtggttatcatgaatggctaaaagttcgtacacgagggttagattggctctccaagttgaaaattatcaacggggagaacttcgaagctccggaagaggatgaagaagtctaa

SEQ ID NO: 58207 - DNA, 703 bp, Glycine max
  Peptide Sequence Number=SeqID_174985
agccatcaagaatcttgattcaatgactcttaaagagctccttggaatccttaaagtctatgagcaagagcttgctcaagatgaaggaacaaagaaagggcagtcgctagcccttacgattcaaagaccaaaacgcaattctgcatccaaaaagttatcgtccaaagccctttctattaatgatgctttagaaaaagaatttgatgatgatgactctgattcagaagatgatgagctaagtttgaccacaagaaagataagaaagatgtggaaaaataagaactcctccaagttcagtggattgtccaaaagatctttccacaagaaagagaaaagtccaatcatctgctataacctcatgagcacttgggaagacctggatgattcatcatctgatgaggatagcgagaaagaaaccaacctatgtctgatggcttatgcatccaccagtaaagtagaactagcactggatgcaagtttagatgatgaggatcctctacctaatgacattgtcaactttgatggtgaagaagatctcaagaaagctcatcaagttcacttagttgattttgtcctggaaaccaaaatgcctggtagtgcacaagatgcctttgtttgtgaggaattcaaggcaccattggatgaaaaggtatccagtggatgcaaaaatcttcttaaggatattcaagacttggaagaaacg

SEQ ID NO: 58208 - DNA, 247 bp, Glycine max
  Peptide Sequence Number=SeqID_174986
ggatcgcgcccgcaggacacctagtggacccgaagaagtccaacagggtcttgaattctacggagtgtctgtcgcccccagcaagatcatcaggccccctactaatcgagctttcatcaagaagtactacgtccccaggcaggcgcagggcaaaacaccacagcagcctggggatggccggcagcggtcaacagaagcaccgcagtcacctctagagttcacttcagctcatcgacaaaaaggttag

SEQ ID NO: 58209 - DNA, 333 bp, Glycine max
  Peptide Sequence Number=SeqID_174987
atggagtggtttttccagatatctcacccattcatgataccgatccaggcaagtgaccagcccagacatgcacctgccccagaccatgaggactacatgcagccggacatcccacaggttccagtggcatttgacccccctcaacatgcagtggatgattacgaaggctatgaggcgatcgcagaaaggttggagcgtgtgctcaaccttaggatggtcactgcagggacaaagttacatgatatcatgcaagattgcctaaggatcgtcagggggggtgctagcacagatggaagtgttagggctcgacaaagacggcacacaaagctttga

SEQ ID NO: 58210 - DNA, 1062 bp, Glycine max
  Peptide Sequence Number=SeqID_174988
atgccggcgctgagtgcgtggttcggggccgattgggcggtagtgatagctttcatcgtgggcgctggcagccagggtattgagtttcagttgcagatggtgcgccgggacggggctgccgtcggccagcaacgcctgcgcgatcctgacgctttccgcgccctgttcggcactggcggtaatggccagtcgcagggtgatcaccgcgtcgccggccagtttgcgcgccagctgggcgtcattgatggtcagcgtatagagcggcgaggccggccagcgttcgttgtccagttggcggaagcccaggcgcagcgggccgcgcagctggaagctgccggcggggtcgagcgcgaagtcggcgcgatccagatcgatgtcgcggtaatagacgttatcgtccgccagcatgttgttgccgtccagcatgcccaggtggcgaatggtggagtaaggctggaaatcgccgacgttgaagtaaaagctctccagccgcaggtcgatcgccagcaggcacaacatggcgcccaccgcggcggtggatttcgggttgtcgatgcggccgcgtttgttgaacgggtaccagctgcgggtgtggtagccctcgagcggcagaatgcggctggcgggcagcggctgcaggtggcgcagcagcgcctgcacgccggggaaacgcgccgggcggccggtcaacagcagcacgtcgcaggtatacagcgccaccacctcggccagcaggcgcaggcagcggccgatgccgatgcgatcggacaagaaggcggcgtgcagatcggccaggcggatcaccagcggggtgtgcagaatctcgaaggcgtcgctgtcggcttcgcgctgcacctcgccgttgataaacgccagcacctgcggcgtcggcggctgcggcagcagatcgcccaggctggcggcgatttccgcccggctgtccagcgggtcgtattcttcataggcgccgagcagcgcgcgcccggcgggcatgaaaatctgcagcgcggcctgctgacgcagggtggaaagcccgtccatacgcccttcgttgccgaatag

SEQ ID NO: 58211 - DNA, 375 bp, Glycine max
  Peptide Sequence Number=SeqID_174989
atgcataaagcattacgggccaatgcacctctcccttaccctcaattggtcactctgtttctccatcattttcaaattccacttgatgatgaaccttttgttcaagtcaagcgttcctttgctattggtgctggggcagtcacttcatttggataccgtaaggatcggaatggtcaatggctgaagaaagatgcacttcctccacaagatgagcgtactccttctcctcctcctcagcgagatgattcagcccttatgactgaagttctttccgagttacggggtcttcgtacttatgttggtgaacgctttgattcttggataatcgctttgccggaatggatatccgtctcacacagcttgaagaagatgtag

SEQ ID NO: 58212 - DNA, 303 bp, Glycine max
  Peptide Sequence Number=SeqID_174990
atgcccgataggaggaaggaagccatacctcttttctgggtactatccttctatggcgagaataacaggagtggtcaagacctaggaacaagaattagatcaagtgaagccaaaaaggaatggagtagcaggaataccaaggaagtgcttggaggagaaggcggaaactgtggcaagccaaggagagtgggcgtcattcatcgacgtattagcatgactagtgtttgggacaatactatttccaaatgtagacgagctggtggatctagtagcgatcgatgcctttcttgcttatcaccatag

SEQ ID NO: 58213 - DNA, 233 bp, Glycine max
  Peptide Sequence Number=SeqID_174991
atggcaagttcccgttttaccgcccgtctgcgccagacactggcactggctgtgctggcaggctgcgcattcggcgctcaggcaaaaatcgatcaggtgcgcttcgccgttgatccaacctatccaccttttgaatccaaaacgccgcagggcaagctggtcgggtttgacatcgacctcggcaatgcgctgtgcgcgcagatgcaggccaaatgcgtgtgggtcgagagcca

SEQ ID NO: 58214 - DNA, 489 bp, Glycine max
  Peptide Sequence Number=SeqID_174992
atggaaacctccatgaccacgcatgaaaaactgctcgccctgctcgatcagcacaacgcccgttaccgactcatggagcatgaagcaaccggtaaatgtgaagccgtggccgcgattcgtggcacggaagtgggacaaggtgccaaagcgctggtgtgtcacgtcaagggcaacggcatcaaacagcatgtgctggcggtgctaccggccgaccagcaggccgacctgagtaaagtggcagccgccgtgggtggccgtcgcgcctcgctggcctcgccggctgaggtggatgcgctgaccggctgcgtatttggcgcgattccgccgtttagctttcatgcggatttacagctggtggtcgacccgctgctgttcgagcgctacgacgaaattgcctttaacgccgggctgctggagaagtcggtggtactgcaggtggaggattaccgcgcactgcataatggtaacgtgatgaaaataatactctaa

SEQ ID NO: 58215 - DNA, 267 bp, Glycine max
  Peptide Sequence Number=SeqID_174993
atgaagtcagctgacaagcgtgagtaccatattgtcatccgaacctttcatcaaccaggggcaaacgagtccgttgacgcgcagagactaatatcgtcttctgcaccttctgtcatcctgacccatgaagtcaggtttactttagtcgtccgaagatattcaagcccaacgacgcacgagattcttctctgctgggcggggacgatcaagttcgatagcgcgtggaaacatcgtggttatcccattttatcgctttcaagacactaa

SEQ ID NO: 58216 - DNA, 327 bp, Glycine max
  Peptide Sequence Number=SeqID_174994
atgaatgaaaaagtgaaggttattctatggatgaatgctctcctgacacctaagctttggaatcctagaaaaaccatgaattgctggcagcctaaccccattacaagtctagaaagtccttcagatgaatatttgagtgttcattggtgtatgataggagatgaaatgcaaagaacatttccattggatttaatgatgaaatctgtgcattttcaagtgaaaaggaggctaagttttgaaatgcaaaaagtagaaattgggctaagctcagcaattaggctaagcgcatatccaccgctaagcgtagcttcaccgcgcttagcgtaa

SEQ ID NO: 58217 - DNA, 159 bp, Glycine max
  Peptide Sequence Number=SeqID_174995
atggaagacgcacccataagccctcgtgtctccctctcgccaaaggttataataatttccaaaaagcaaaatcatcaggaatttaaaattcctgagacagatcctgggtatcctgagtctgagcatcctcctcatctatcaagtgaagtactggagtag

SEQ ID NO: 58218 - DNA, 323 bp, Glycine max
  Peptide Sequence Number=SeqID_174996
gtgctgaccgcatcgggcagcagggtatggctcaggtcgcgtgccgcctgaagcactggctgaaagcgctgcagcagcggctgcagggcgctggcttcctgctgcaggccgagcagaaaacggtcatcaatatgagcggcttcgggaaccaggggagcagcagcggacgtatgcgggcgagtctggctttcataaaaccagtggtcatggccgggagaacggcggtgttccatggtcattcctttcgcaaaaaacggactgagtgcacaacgggcaaatctgaaaagcgcatcgccactcaagggctagcttatcgtcgctga

SEQ ID NO: 58219 - DNA, 213 bp, Glycine max
  Peptide Sequence Number=SeqID_174997
atgactagaaactcaccaaaaaaacacaacgaggagcattggcgatatacctgtgtcgccatcccctatggcgagaagcatactgacctggagggtgccaccattatcaatggcgagaagcatgctgacctggagggtgccgccattgctaatggcgagacagttgacgtggacgctgtctcgctgctaccattgacgagaagcatcacgtga

SEQ ID NO: 58220 - DNA, 1971 bp, Glycine max
  Peptide Sequence Number=SeqID_174998
atgcgctacaacagcgcgaccgatcactatgaaccgattagctgggatgacgcctttgcgctgatcgcgcagcatctgcaggcgatggatcatccggatcagctggagctgtacacctccggtcgcgccagcaatgaagcctcgtggctgtaccagctgtttggtcgcgtgctgggcactaacaatttccctgactgttccaacatgtgccacgaagccagcggcaccggactgaaacgcagcattggcgtcggtaaaggcaccattcgcctggacgatttcgaccacgctgatgcgatttttgtctttggtcagaaccccggcaccaaccatccacgcatgctgcacagcctgcgtcacgccgccgatcacggcgccagaatcgtgaccttcaataccctgcgcgagcgcggcctggaacgttttgccgatccgcagaagccgctggaagtggtgacgtcgatggccggcaacatcagttctgcctattatcagcccaacctcggcggtgatatggcggcggtgcgcggcatggtcaaagcgctgctggaggagcagcgtaaacggctggctgccggtgaaaaaggcattttcgatcaggcctttattgacgccaatactcagggcgttgagcagtatctggccgccgtggacgacacccgctgggagcagattgtgcagcagtcgggcctgagcgaagcgcagattcgcgaagccgccgccatttaccagagcgccgaacgggtgatcattacctgggcgatgggcattactcagcacaaacactcggtcgatacggtacgggaaatcgttaacctgcagctgctgtttggccagctcggcaaacaaggcgcgggcctgtgtccggtgcgcggccacagtaacgtgcagggtaaccgcaccatgggcatcgacgagaaaccgtcgaaagcgttccttgatgcgctgggcgcgcattttgcttttgaaccgccgcgcgagcacggccataacacggttgaagcgcttaacgccatgctgcgtgatgaagtcaaagtgctgattgcgctgggcggtaacctcgccgcagcggcgccggactcaccggttaccgaagaagcgctgcagcactgtggtctgacggtgcacatcagtaccaagctgaaccgcagccatctggtaccgggccacgaaggcctgattctgccgacgctgggccgtaccgagcgcgatcgccaggccagcggtaaccagttcatcaccgtggaagattcgttcagcatggtgcacgcctcagaaggtgtcggcattccgctggcggagacgcagcgttcggaaacagccattgtggccggtatcgcgcatgcaacgctgggcagtgaccacatcgactggctcggcatggccgctgactataacgtcattcgcgatcacattgcggcgaccatccccggcttcgctgattttaaccgtcagtgtgatattcccggcggcttttacctcggtaacgctgccgcggaactgcgtttcaatacgccatcgcgtcaggcagaattcagcgcggcagcactgccgacctcgctgttcccgcagctgggcaatgacgttgaagtgccgttcacgttgcagacgctgcgctcacatgaccagtacaacaccaccatttacggcctggatgaccgctatcgcggcgtatacggtcagcgtgaagtggtgtttatccatccggacgacatggcgtcgctcggtttcagcgaagggcagcttgttgatattgaaaccctgtggaatgacggtctgacgcgtcgcgtcagcggctttaagctggtgccgtataatattccgcgtggtaacctcgccgcctactatccggagaccaatccgctggtaccgctctccagctacggtgacggcagcggcacgcccacctccaaatcggtaccggtgaagctggcgctgaccgccgccgcgcccacccagcgtatcgcctga

SEQ ID NO: 58221 - DNA, 213 bp, Glycine max
  Peptide Sequence Number=SeqID_174999
atggaatgtggatttcatgttggggattctagcagtcatctgagtattggttttttcgaaaatgaaggaggagtggatggccggagaagaaaggttgtttggagaagaagtgtgggactgatgcaatggttggtgaaaacgtgtagctggtggcatatgaatgaatttgggaattgtagagcagtgaatgctagctcagaagattggacatag

SEQ ID NO: 58222 - DNA, 141 bp, Glycine max
  Peptide Sequence Number=SeqID_175000
atgtcacgctctgctccgtcatcatcacggttattcatcctcaacgaggaactggagatgctttttgcgactgtgcccaaattaacaaatgaagagcacgaagaatggtgtgaaatggcgaagatgatactgaaggtcgcg

SEQ ID NO: 58223 - DNA, 135 bp, Glycine max
  Peptide Sequence Number=SeqID_175001
atggtttgttcactttggccaatgtttgttgactatgtcaaggatacatggataatctcacagaaggaaaaatttgttaccgtgtggacgaataaggtgatgcacttagggtcgaatctgctcactgggctttaa

SEQ ID NO: 58224 - DNA, 756 bp, Glycine max
  Peptide Sequence Number=SeqID_175002
atggtggaaagaactagaagaagggatcagagaaaggaaaatactcaaaaggaaactggaaagataagcaaaagaaggaagaaaaaccaaaatcctctaacaagggatcttggaagaattcaaatggtaaagatgggaaaaaatgggtatgacaaaaggaaggtgcaatgtttcaattgtgaaaaatatggtcactatgctgatgagtgttggttcaagaaagggaagtcaagtagaaataacaatgaagaagccaatgtttcccaggagcatgaatctgattttgatccaatttttttgatgatgacaaccagtgaaggtaagtcacatagtgaaaactgggattggttgattgagttcgatccaagcaagaagactcaaatcaaacttgctgatagcaaatcactaatggtagaaggcattggaaaaattgtaattcagagaaaagatggcaaggcttcaatgattgaggaagttttgtttgtaccagatgagtacataagaatgatgtggctctacaagatcaagcacaagagtgatgtgtttgagattcctcagaagttcaaaactatggctgaaagacaaagtgagaagaaattaaagatcctcaggacagatcgtggaggagaatacatatctagaaaagttgaaagcttttgtaagaaaatgagcattcaacatgaagtgactgcaccttatactcttcaacacaatggacttgtagagaggagaaataggagaatcctcaacatgtga

SEQ ID NO: 58225 - DNA, 915 bp, Glycine max
  Peptide Sequence Number=SeqID_175003
atgaagagcgagtttgaaatgtctaaccaggagttgatgaaaagcgagtttgaaatgtatgaccttgggacattgacatatttccttggcttggaatttctgtacactaataagggaattcttatgcatcaaaggaagtataccactaatatgctaaagtggttcaaaataatggactgcaatcacacaatcactccttctaaattatactctaggaatgaagacattgaagatgaagaaagggtggatcctacccattacaagaaactcattggctcactaaggtacctctgcaactcaagacctgaccttagctttacaataggagtagctagcaggcatatgcacgaaagaaggaagtcatacctcatagtagccaagaggatccttagatacctgaaaggtacaaaagacttaggaattcaatttcctaagaacacaaatgagaaaatggatgaattgataggatattgtgactcagactggtgtggtgataaatttgatagaaggagcactactggatatctgtttatgcttgctggagccccaatttcatggtgttccaagaagcaactagtagtggcattgtcaagctgtgaagcaaaatacattgttggaaccaatgcatcatgtcaagcagtttggcttgattctctactaaaggggatcaaagttaaagtgaagagacctctacacctcatgattgacaaccaatctacaatcaatcttgctaaaaatcctattgcatatgggagaagtaaacacacagaaacaaagtttcatttcctaagagagcaagtgaaaaaagggataatcgaagtgacttattgccccactcaagatcaacccgctgatgtgcttaccaaaccagtgaaagtgtattggtttttgaagaagagggatgaactaggagtt

SEQ ID NO: 58226 - DNA, 312 bp, Glycine max
  Peptide Sequence Number=SeqID_175004
atgtgttggtttagaataggtagcaaaatacctttggcaatttacactttgggtatgatagcaaaatacttggatgtattagaaataccaagatgtgcacatgtgcaatttttggcaccccaaaatgctttgagtatgcatgtatgtaaatttagccaaggagatgtgtgtgatgttgtatgccatttttgttttaagagtagtgtcccactggtaaaactaactttccaaatgtttgccttcgcaggaaatggccccaaggaagcttgcctcaaagaggtccaggaaggacaaggcagccgaaggaactag

SEQ ID NO: 58227 - DNA, 522 bp, Glycine max
  Peptide Sequence Number=SeqID_175005
atgtcttacctggggagaagagaagttcttacaggaaaagctaaattcgggatcttcggtgacggtaaagaattaccacagctggcaatggcgaaagttttcagaaatggcgacttccgttcaggatattacagggatcagacctttgctttgtccgtcaatgcgttaacggttgaaagcttttttgcacagctatatgcagataccagcgtagaaagagagccggcatcagcaggaagacagatgaacgggcatttcgcaacgagaagcttacatgaggacgggagctggaaaaatcttatggctcaaaaaaatatttcttctgatatttctcctacagcaggacaaatgcctagattattagggttagctcaggcttctaaaatatataaatcagtacaatttgaaggttctgaaaagttttcaaacaatggaaatgaaatagctttcggaacaattggcgatgcttccacagcagaaggccatttttgggaaactctgaatgcggcttgtgcacttcag

SEQ ID NO: 58228 - DNA, 231 bp, Glycine max
  Peptide Sequence Number=SeqID_175006
atgggtggtgcagtgaccttgttggatatccctggtgggggaaataaagtggttatgtgggatgctaccttgtttggcctgtttaatgaagactttcccttgtacataaagcatgaagatttatctgaaatagcacttggtggtcaatgtcaaagcatctctattacacagttgtggattcgtgcacattggcaaatggtcgtcattttgcctaatggtgggatcctctag

SEQ ID NO: 58229 - DNA, 243 bp, Glycine max
  Peptide Sequence Number=SeqID_175007
atggcaaatgaagaattgaagttgcaggatccacgatgccggatacaatgtcctgacatcctgcccgaaaatactggagttgctgtacaatgcaagataaaaatttttcagaagaagatagatctcctccagcatcaaggagttgcagcccagaatcgtacacggctatataatcatggaggctgcacgagttctgtaccaagtccgggattgaagagttattttgtgagttttgggacttga

SEQ ID NO: 58230 - DNA, 402 bp, Glycine max
  Peptide Sequence Number=SeqID_175008
atgtctgatgagtcttccatggaaagatcagtgtggatggaaatgttgtccatgacaaccactggcctcataaatgtctttgtccttcttctccttttggaaaaattgtaccaatttattgttgtgttcaacccaaaagggctgtattggtactgtatgttaccttgcacatcccaagtctcatattcgtcattgaacagggaaagtccctatgatcttttggttcaagttgtttgttggtccaaggacatttgggctgatggagtctttgagaccttagagggcttcatcttgttgaattcctacataacgagaaagaatatcagcagcaacattcttagctctttttatatgttcaaaatttatctttattccgttatgataaacatattctgggaataa

SEQ ID NO: 58231 - DNA, 2748 bp, Glycine max
  Peptide Sequence Number=SeqID_175009
atgcaattttaccataatggagtcctagtaacactccctggtacaacttccccctctctatccctggccaccttaccccaactaaatcgcatgatccacactgcgtctgttgctacccttcacaccattaccatgctacctgttgactcctctcccccaccctccacaccacaaacacactccttatctagagacgaacaacccacccttgcatcattccaccctgacattacccaagtgctacatcgttactcacccattttttctataccccatggtctacccccaaaccgaccccatgaccaccatatccacctaaagccccactccaaccccatcaacattaaaccataccgttacccccattttcagaaggaatccatgacttccatgatagctgatatgctacaacaggggatcattcgcccaagtaccagcccctattcctcccccgttttgttggttaaaaagaaagatggtcctacttggtctgcccatcaaattcacttacagcaagttttgcggctactacttgataaccatttttatgctaaactttctaagtgtaattttggtgtttgttcagtggattatctaggtcacattatttcagggaatggagtacatgctgaccctacaaaggtgcaggacatcttggcatggccaactccaaagtccctcacggctctccgagccttcctcggtctcactggtttttatcgacgctttgtgcagcattatgcaactattgcaggccccttaacagatttacttaaagctccaacattaatgtggacttctaaagcagaggaagcattcacaaaactcaagcatgctatgactaatctcccagttttggcattacttgattttaatcttccttttgaggtgactacagatgcttctagtgtggcagtaggtgttgtcctctcccaacaaggccacccaattgcctactttagccgtaaaatgtgccctcggctatgttcttcttctgcttatttccgcatttatacggatcacaaaagtctcaagactttattgacacaaactattcaaactccgaagcaacagaaatggttaactaagctcattggttacaattttgagatccattacaaacctggcaaagagaatctcgtcgctgatgcgctgtcccgcgttttggaagcatccactggactttgtgctactcaattctatgcaacacatcctgctggaaaacaattgataacaaaactttgtgaaagctcaaccatgcaacgaaactttagttatagagccggtattctttactttcaagaaagaattttcataccacgcgaagctgccatcattccatccttgctggaggaataccactcatcacctttggggggtcactcaggtattaaggctaccatatctcgcttatcagctgtattttactggcctggcatgtatgcagatgtgaagaacttcatcaatagttgttccatttgtcattacaacaaatatagcacccaacctctttatggcctcttgcaaccacttccagttccacaacaggtttgggaagatatctctatggacttcatcaccaacttacctgcttcgtctaacaagacagtaatttgggtcgtggttgaccgcctaaccaagtatgcacactttatcgccttgcctactcactttacaacatcttatctcgcatctatgttcctttctgaaatccaccgccttcatggtaccctaaagacaattgtaagtgatcgagacagaattttcattagcaaattttggaaggaattattcaaatctttgggtactaccttggcatttagcagttcatatcatcctcaaaccgatggtcagattgaggtcctgaatcgctgccttgaaacatatcttcggtgctttttcagtgaagaacctcaacaatggacccgtttcctttcgcttgcggagttctggtacaacacatctcatcattcagccattggcatgactccatttgaggctctctatggccgtgctccgccgtccctcacatcctatgttgcgggctcctccaaaattgcagccattgatgagaattttgccaagagaagtgacatattgcagctactcaaaaataatctacacagagcacaacatcgcatgattcagcaagtgaattcaaagagaaaagacaaagaatttgcagaaggggattgggtttacctgaagcttcaaccttatcgtcaagtgtcagtgcaccgccgttcttctcaaaagcttgcaaagcggttttacggaccctttcgcatccttcaccgtataggaccagtggcatacgagctggaattaccctctacagtgcgcatccaccctgtatttcatgtttcacttctgaaaccctgcatcaaaacaccagacacgcaaatccttcctcttcctgtgacagtcgtcgtcgcaccttctggaaccaaaccccaagcaattattggtcgccgtacgatacctcaggagcacgattcaagggaagaagtcctggtacactgggagggacaaatgccagctgaagctacttgggaatctagggctgccatcgtgcgttcctttcctgactttgatcttaagggcaagatctattttggagatatgggtaatgatacgaataggccagaaattgagcatgaacctatctccaatagtgggccttccattgctgcaaacaggcccaaacgaattgtgaagcctcctgcacatcacaaatattatgtttag

SEQ ID NO: 58232 - DNA, 390 bp, Glycine max
  Peptide Sequence Number=SeqID_175010
atgtctggaagaggaaagggagggaagggtctaggaaagggaggagcgaaacggcaccgtaaggttctgagggataacattcagggaatcacgaagcccgcgattcggcgtctggcgcgacgtggtggcgtgaagcgtatcagtggtctcatctatgaagaaactcgcggtgttctcaagatcttcctcgagaacgtcattcgcgacgctgtcacctatactgagcacgctcgccgcaagaccgtcactgctatggacgttgtttacgctctcaagaggcagggcaggaccctctatggtttcggtgtatggaataggtggtttgaatgtgctggaacaaagatcgagcctggcaggcactttaacgagagggatgtgataagattttga

SEQ ID NO: 58233 - DNA, 1189 bp, Glycine max
  Peptide Sequence Number=SeqID_175011
atgaatacacgttcccaggatttacagcaactacaggaatccattgcagcccttacaacagcctttcaagaattcaaagtacaccaagaccaaagacatgaatcctaccttagtaactttgaacacttacaaaccaaatctgactcttcttcctcctcatccacccaaccaactgaccaaacaatcaaactaccaaaacttatactacaaccctttgatggctcaaatccaatggaatggctattccaagcagagcaatttttcaatcattattcaatcactcctactcaacgcctctctcgaatttcatgttacatgactggcgacgccctcggttggtatcagtggatgcacaataaccatttgatttcaacatgggaggagtttacccgtgctatggaacttcgtttcggcccctctgcatatgaaaaccatcaacaagcccttttcaaactgcagcaaacagcaaccgttcctgagtaccaacgtgattttgagcgtctttgcaaccgtgtgactagcttgccgcatcactccatcctcgattgtttcatttctggtttacgtcccgaaatccaacatgaacttgccatactacaacctgtcacaatttcacaagcaattggcttggccaaattggttgaatccaaattgttagcatccaaaactagtttcacctacagccctcgccccactcaacctaaatccataccgcctctattgcccaatccaccaccacaacctcgcctaatccaacacccttcacagtctctcctagccttaccagcaccaccctcccccaaacccactaccccacaaattcgtttgttatccaaaactgaaatggatgaccgtcaagccaaaggattatgttttaattgtgatgaacgataccataggggccaccgttgcaaaaacaaagggatgttacaactactttccccagatgaccctcctgatcctcattctgatcccatatcagctgatgtacctcctctaaccaattcagaaacaacccctcccaccccctctgcattccttcttcattctgaaaccccacctacttacaccaaccccgaacaatttcacctgtcactgcaagccgtttctggccagccctcacctagaacactacgcttttatgcgcgtataaatggtcattatgtctcggtcttggtggacatcggaa

SEQ ID NO: 58234 - DNA, 216 bp, Glycine max
  Peptide Sequence Number=SeqID_175012
atggttttgttgcagacactgagaggttctatactcaagtttaagaaatcatactcgctagggctgagcaattcttggtggaaagagaggatatgctgcataacttgtttcctactagtgagcctatgccagcaaaagtcaagagaagaaacattcaagtgctttgaaggaaaattgaggcaaaaagtgaaagaaaaagccttgaagaaaaattga

SEQ ID NO: 58235 - DNA, 150 bp, Glycine max
  Peptide Sequence Number=SeqID_175013
atgcatcatgttgttcttggtgatgacccggaagttaaacaaggcaaaccttctccggatggatttcttgcagcagccaagagatttgaggatggaccggtagatccttttaacattcttgtttttgaaaatgcacatgtcaaaccctaa

SEQ ID NO: 58236 - DNA, 657 bp, Glycine max
  Peptide Sequence Number=SeqID_175014
atgagaggagccacgaaccacgaaccaccgtccaccgtcgagggagcatcgtcagcgtcgactgtcgaggtaagcaccactgtcctttccgccattgatgtcggagtagggaagcttggaggagcttacggatcagacatagaggtatgcctggggagtgcaaccaatgtgcatgttgtctacttggaggcccttcgtgacctcagtataacagagaggtacgcccggggagtggctgctctggttcatatgtacgaccagctgaacgatgcatctatgagccacagtcgacagcttggcggttacatcacactgctgcagtgctggatttatgagcattttccctcggtcgcggagtccaccgctgatcaagactacgacgaggcttccccgcgtgcgtgcaggtggattgcgacgaagaagaccatgaagagcattcgcacgccggcgtacagggagcgcctggaccgactccggattccggatgtctgttggatcccttatggggagcattgggaggtctgggacttccacgttagatcatgctattccggtctcttgcgctgggggcctgttgctgtttattaccgaccggagagggttgtgcggcagtttggctacacgcagactattcctgctcctcctgtcgattcatag

SEQ ID NO: 58237 - DNA, 237 bp, Glycine max
  Peptide Sequence Number=SeqID_175015
atggtaggaaacaatggcattcctgggaatctaccagttcttgaaggaatcaagaattgggataaatggtgttctcaaatgagagttctcttcagctttcaaggtctggttgatgttgttgagaaaggaattagagcactgagtgaaagtgagactaaggcacaaatagcagcttacagggaagaattaaagattgatggaagagcattgtttctgatccaccaatgtatggattga

SEQ ID NO: 58238 - DNA, 242 bp, Glycine max
  Peptide Sequence Number=SeqID_175016
gataaagaacgcgttcaacaagaatgtgcgcccgtgcaagttcaacgagggggaccttgtgctgaaaaagatatcccacgctgctaaagataatcgagggaaggctttctctagaggggctctggtgctcaccaacatggatggcgaggagctaccctcacctgtgaactccgatgttgggcagaatcatcttaggcagtggtcagatgttgggacgaagctaaaggcagagaccaatcaag

SEQ ID NO: 58239 - DNA, 348 bp, Glycine max
  Peptide Sequence Number=SeqID_175017
atggcattgaccatcccacaactgtttttgaagcctctccaggttatgtgggatgctaccatattcggggtgtttaatgaaaactttccgctgtatataaagcacgaagatctctctgaaattacacacggtggtcaatgtctcaacatatctgttatacagttttggattctcggacactggcaaatggtcgtcattttgcctaaggaaaacctagttgtctggttttgttctttacataacaggccagacaactaccttaagggaataattaacagtgctttgaaaggacttgatgatactccacaacctaaatccaaggttgctgctaggtggattgttgttaag

SEQ ID NO: 58240 - DNA, 480 bp, Glycine max
  Peptide Sequence Number=SeqID_175018
atggatattgggattggattagcaaaaagtcaggcaattatatccttagcagggttacaggatgcaccacatcctaaagctttcggaaaatgtgtgttcagagctactaagctttcaagcggtcgtaatataatttacatagacgaaaacttagaggcatcatggccaacagcaaaaggcaatgatagcactctcagctataaattgagagaaaggttcagtacaacctttccaaaattcactgagcaatatgatcccacctcattaataaattattcagatttatgccttattgttgaaagttcaatagcagaagaaaaggttaatgaagaattcgattacttcctcaactatcttagaaataattgggagacaccaataaacctggtgttttcctatctcgaaaaatatatcgatgggggagatcttgttggatacaacgatggaggcattgcaataattacagatttgcatgcgtaa

SEQ ID NO: 58241 - DNA, 306 bp, Glycine max
  Peptide Sequence Number=SeqID_175019
atggatattgagtatcagaagattcatgcttgcccgaatgattgcatattgtacagacatgaatttgaagaattgtccaaatgccctaggtgtggggtaccacgatacaaagtcaaggatgatgaggattgtagtagtgatgaaaacccaaagaagggccccccagtgaaggtgttgtggtatctaccgatcgttccaaggtttaagtgtctttttgctaatggagacgatgctaaagaccttacatggcatgcaaaggggacaaactacgatggaatggtccttcatctggctgattgctcatag

SEQ ID NO: 58242 - DNA, 267 bp, Glycine max
  Peptide Sequence Number=SeqID_175020
atggcgagggtgaggaggatccacttgtcgacgtcattgaacactatggcgatcatggcggtgccatcgatgatgcgcgcgaggacaggaaaggttgtcaaggaaatcacaactcacatgaagatcaggaaccgtgcgaaatcgacttcgttggttccggcgactatcttgcagaggattagggcgaggccgatgccgaagacgaaagggagggacattccgccgacggtgatgttcaaagctcttttctgctctggcgaaacatga

SEQ ID NO: 58243 - DNA, 282 bp, Glycine max
  Peptide Sequence Number=SeqID_175021
atgttctgtttgttccagcatatcacaagatgtttctactctacagcagttggaggattgagatgctatgagaatccaaagaataagattactgcagtacctgccgaggaagagcaaatttggggtgcattcttcaggaacagagaatcagtgatcagtcccaacagtaatataaggttaatgtcagttgagactgcattaggtacaaatggaaaatgtgaggtcagagacaatagaataggagttcataaaaagccaacacatacagctaaatttcactaa

SEQ ID NO: 58244 - DNA, 528 bp, Glycine max
  Peptide Sequence Number=SeqID_175022
atggaagacgaaggtgactggctctactcctccgagtggtggggctccgactccgacgatggtcactctgttctccgatcaacttccggcaagggaaacggcgtcgttgccgtcgttgcatatccctcctccagacccagcaaaatgcattggtcaggaatggaaagatggctgcagcaaaggtgtgaggaggtgcatcctggatacaaggatggagggaagctgaggattcttggataccaatggagggtgcttcgattcaatgaagttactcgccagagcaccgctaaagtaatggctgcttaccgtgaaaacacgcccggtgttgtctatctcatgcagcaaccacattgcttggctgtaccattgattgctattatgcgatgcggtaagattgttaagattaaagctgctgctagcttactaggagtgatacttgggattttctttggaggctcctgtttgccatttgatgatgattacttcgttggctgtctagagcttctgccagactttttgagcccttag

SEQ ID NO: 58245 - DNA, 1093 bp, Glycine max
  Peptide Sequence Number=SeqID_175023
atgctgcatcccctctaccgcctccgcatacgccagccgatgcttggtggacagcttgtggaacaggcgcgtttcgatcgggtaagcgcggcggctgtcctcgcgcaccagctggctgaagtccgccagcgacatcgccagcagcgggctgtaaatgtccagcaggccgctgatcacccggtagccttgcagctcgagctgctcgacctccgggtggttgaacacgtgcttgaacgccacatttttaaatattttcagcagccggtacgccgggctggaatcctccagcagcgcctgattgaaactgccctgatagaccgcgtccagattgtcgataaagcgctgcgccgcatgcggcaccagccgcgccacggtaaacacccgcagatacatgaagaactgatcttccgcgctgcgccgcgcgccgccgcgatcgatcttgcgaaacgcgctggcgacggtcttgtcgaacagatcgcccggcgccacctcgccccactcctgaatcaggtgctgatacagctgctcgacggtgaaaatgctcttctccaccgcgtcttccagatcggccacgcagtacgagatatcgtcggcggcctccatgatataggtcagcgggaaacgatcgaactcgcccatgtgcagctcgcgccgcagccgatcgacgaaggcctcttccgccagatagtagccgggctttttcatcagatagctgtggctggcggggatgtcgctcgcccagtaggccgggcgggtgtatttcaaaatgcagccgacctgcgcgtaggtcaggttgagcttcagcaggctgtacaccatgcggatcgcctgggcgttgccctcgaagtggctgagatcctgacggatccggctgcgcagccggttcaggtcgctctccccttcatgcaggcgcagcgtcgccacctggcagcgatcgtggctgcccggctcgctgccgcagctggcgggatcgagccgttgggcgaaccagtcgttgatcgccgactcgccgaagtgaccgaacggcgggttgccgatgtcgtgcatcagacaggccatttccacgatgctttcaaacggatcgagcagccgg

SEQ ID NO: 58246 - DNA, 592 bp, Glycine max
  Peptide Sequence Number=SeqID_175024
gtgagggcgtgtagccctacgaaggcgaggacatgcagtcctctaatggcgaggacgtgtagtcctctgatggcgatgacgtgtagtcctctgatggcgaggacgtgtagtcctctgaaggtgaggacgtgtagtcctctgaaggtgaggacatgtagtcctctgaaggcaaggacaggtagtcctctgaaggtgagggtacgcgaccctctgatggcaaggacatgtagtcctctgaaggcgagggcgtgtagccctctgaaggcgaggacgtgtagtcctctgaagattgactgtccttttgaaagaggtgataattcatgcaaccttatcctattgtcgcaacatgcccttttgcggacgcgcgaggcgaggctcacgggtgccttttccaaaggaggaaaatgcgcggagtcgccaccaatgtttatttgtggaaaacgtcggaaaaaccgaaggaaaccggtcataaagaatattccaagttcgggagttgtatttacgtttaaggaaggtattagcacctctcacgtcgacaaaagcagggctcttgctcctacgtaccctccatcgaagaggaaatcagacctac

SEQ ID NO: 58247 - DNA, 423 bp, Glycine max
  Peptide Sequence Number=SeqID_175025
atggcctcttcaaatcctttgtttcctgaagcaaattccattcgtagaccacccattttcaatggtgagggttaccattattggaaaacccatatgcagattttcattgaagccatatatttaaacatttgggcagcaatagaaataggaccatacatacccactgtagtagatgtaagcacaagcactgtagaagcaaggcttcatgatgaatgtgatgaacaaaaagctcaaagatcaaagaacaactcaagagaatcaagaacaattcaagagttcaagaatcaagaagaattcaagactcaagaagaaagcctagaatcaagaatcaagattcaaggttcaagctctcaagaatcaagatcaagattcaagactcaagattcaagaatgaagaaaatactcaatcaacataagtattaa

SEQ ID NO: 58248 - DNA, 642 bp, Glycine max
  Peptide Sequence Number=SeqID_175026
atgtacaattatcatgagaaaggaagagctcctaatcttgaaagtgtattggcagacttcatgacatatcaagctagctctaaagtagattcaatgcaacaagcatttaaaagagctgagactcagattggtaagttggtggacgacatgattaaagttgtggtcaggagagaaaaagagtatgtagagattgaaacacatcaagaaagcattcttcaagttaacacaatacatcatcaattgatcaccaaagaagaaaaggatgaagtctccattattctagaatatccctgcatagcaactacaggatatgttgtaggcaaagataaaggtcggttggaactcagtgcagaggatcagaaaatctcctttgacctctttgaagcaatgaagcacccagatatgagtgatgcctgttttgaagaagaagaggtggagcatgagataacattatcagcttcaaccatgcttgatgatccaaaagacaactttgtaggtcatgtggttcttgaagaattagaaaaaattagaccaacagaaaagcctaaagctgaattgaagatccttccagcgcatttaaagtatgtatccttggaggataatgagactaaacccgttaataaattagtagctcctttgtag

SEQ ID NO: 58249 - DNA, 231 bp, Glycine max
  Peptide Sequence Number=SeqID_175027
atgaaaatgcaaatcaaacacatctttagttatcccaaacacatgagaagactcaaatctatcccaaaaatggatgttctagacaagatcttatatacacagggaataataattgaattcaacaaaccaataatggaatatggtaacagtggtaatgaatcgccagaaatgaatgttgaaaggggggaacttcttgctgccattggtttggcaacaggaaaaaggaattga

SEQ ID NO: 58250 - DNA, 414 bp, Glycine max
  Peptide Sequence Number=SeqID_175028
atgggatttaggtcgacgtcgacctgtccgacatttgaacaatggacaagcatgaaaccacttcgtgtgtcaccataccctgagatattgttgcaacttgcaacttccacagtcggagattatccaactttttgtgtggttgaagacaaatgcttttaccagtcatcacttttttctctctttatatgcactacaagagaattgaacacatattcccgatgtcatatacacatagtaccgagtatgaactcaccctcagagaacaaaccttcctcttcttcttcttcttattctccgaatttggtgttgaagctattcggtttccctatgacggctacgagcagtgacgaggatcatggtaagacaatcgagtgtccattttgtgatcgcaaatttcagaatatgcaagcgtag

SEQ ID NO: 58251 - DNA, 114 bp, Glycine max
  Peptide Sequence Number=SeqID_175029
atgtcagaggtcaccgatgccgtcgacgaggaagagattatacagcttgagccatgggttcaggtcatcgcaggtttagactacgttcagggtcgaccgagcatacaaacatga

SEQ ID NO: 58252 - DNA, 1411 bp, Glycine max
  Peptide Sequence Number=SeqID_175030
atgggacttcttcaacgtcccttgtgttgccactcacaacaagaccaacaacaacaaccaccacaatcccatgatcaccttcatttcgaatcatcaacctcatcctccctctcttcacaagcaagcctcccttccattccctccctcaccccacaaaaactgcaccaccccgaagaacaaccgcaaaccacccaccacaaacttgtaactaccgtcaagggccacacctccacgatcttctccctcgccctgcacggcaagtctctctacagcgcctcctcgaacggagaaataagagcatgcagcagagaccctacatcgaccgaattaaaatatataagtggagaacaacctctacctaataccactattgttgtgaacagcaacgcgccaatcaagtccctcatcgtatcacacgacaagctattcacggctcaccaagaccacaaaatccgcgtctggaaaacaaccgaccaacccggtaataataataacaaccccaactactacaaatgcgtcgcctcgcttcccacgctccacgaccggttctccaaactcttctcctccgagaactacgtcgagattcgccgccacaagaagcgcacgtgggtgcatcacgtggacaccgtctccgccctcgcactttcccaagacgggtctcttctctactctgcgtcgtgggacagaacattcaaaatctggcgaacctcggatttcaagtgtctggagtctgttaaaaacgcgcacgaggatgcaattaattccttaattttgtcgaataacggtattgtctatacaggttctgcggatacgaaaataaagatgtggaagaagttagaaggagataaaaagcattctctaataggaacattggagaagcataaatctgctgttaacgctcttgctcttaactctgatgggtcagtgttgtattcaggtgcgtgtgataggtcaattttagtgtgggagggtgatgaagataataacaataacatggtggtggtgggtgctttaagggggcacacgaaagccatactgtgtttggtggtggagtctgacttggtgtgtagcggatctgctgataacagtgttaggatatggaggagaagcgttgagaatgagaagaagagttactattcgtgtttggcggtgctggaaagtcatcgacgacccgtgaagtgtttggctatggctgttgactccaacagtggtggtggtggtggtggtcctcatgaggatgatgatagtaggaggaagaatgatcaagagcgtgagaatgaggggagggggggtgaggaaggaggagctatcgtgagaaggagcgtgtcgtcgagggatgggtgtgtcatcaatgaagggatatcgtcgtgggagggagggggtgttaaggttgagagaagggagaacggag

SEQ ID NO: 58253 - DNA, 234 bp, Glycine max
  Peptide Sequence Number=SeqID_175031
atggatgtttatctcagtcccttgattgaagacctgacaaagttatgggatgagggggttgctgtgtttgatgggtgtcgaaatgagacattcaagttgtgtgcaatgctattttgtaccattaatgactttctagcatacggaaatttgagtggatacaatgtattgtgtgaattagccatgtgtgatttgcttgatgtggatgttgagttatgtggacttttattggcttag

SEQ ID NO: 58254 - DNA, 183 bp, Glycine max
  Peptide Sequence Number=SeqID_175032
atggggattgtcactcgcgataaggtggatgctacatattataattggaaacaagtccctatcgctcaaaaggatttaatcggggaggatattcaggctgaatttgatattcctgaatcatctgatctgaggacaaggaaaaaaaatactttagaccataagagagtggttgaggcagtttaa

SEQ ID NO: 58255 - DNA, 264 bp, Glycine max
  Peptide Sequence Number=SeqID_175033
atgtcagtgaaaaacctcatcagacgcctagaaggagaccagtcagggtcacagtgttttgcaataatgcttcaaccatatgggatcaacataggcgtaaaggagcactcaaaccgtgtgacccccaaggcttacacttcgaagagtccgccagggcctctccctcctgattcaggtccaacccagaaaacatttcagcacacagactctatctatgaactgtataaaacacacgactcctcaattgttctcaaatatttttaa

SEQ ID NO: 58256 - DNA, 180 bp, Glycine max
  Peptide Sequence Number=SeqID_175034
ttgtttgctagccgcgatgaagttttacattgggctcgattggtggcttgtgacattggatttgttgccgtgcttgcaaaaggagtggtgagtataggtgatgtgaacctgagtaggagcggatcgttcgatacaggctacggagatttcgatgacgccacttccagtgaaggaagataa

SEQ ID NO: 58257 - DNA, 207 bp, Glycine max
  Peptide Sequence Number=SeqID_175035
atgtcctctcctctcttcttgccctcatcattagaccctcgctttcatcatcaccaccgcatcttttacctcccaccaaccgcaccaaagccatcatcctcctccgcctctaacatcaccaccacaacaacaagaacaagaagaaagagaagcaaggagagagagaaggtgagagcactgtcactttgtgccttcttttacttgtaa

SEQ ID NO: 58258 - DNA, 930 bp, Glycine max
  Peptide Sequence Number=SeqID_175036
atgtccgatccttcgaggggtcgcgtcaccattactctagggcgtagcggtcatgttgtgaagagggatgtatctgctgcagatgtttcttctttctcttctcttcactcagctggcactaagcgttctgtaagagacagaattggaagtaatgcagataattctgggtggtatggaaatggacatagcggcaataaacgacaccgaggagatgtaagcatgcaaaatggactggatggcaatgaccttcgattgaagctcatgcggaaaagtgcatctaggcagactgacagcaatggcaataagaggcatatggacctccgtgaaaaactttcaaaggcaagtcaccctctgactaacagttataattcaaagcagcatgggccagaatcaagggaaactagtctgttgaggcaaattccctcagctagaagttctgatgatttactgcgtatgaaatccatgagaagctcatactctccttggacattggatcatattaggagaagatcaccagatgggtttccaagtacttccagggggatttccccccaaagggatgtccaagacctacatagaaggcctgtaagcaggacatatgatggtgtcagttcagtttcatatgtaggtagggatgttctagaaacttcgaggcctccagtaagtgcacctcaatctttcatgtcacgctccacaatgtccacattacctccagtaactgccaagcctgtagcatctcatcctggccaacttcctccatcgggcagtgttgctcaaaggtcttcatatgtgagaaacatttcccattaccatctgatggatatccaagttgattctgtggttcccttttggctataccacatgcctgtgggttatgaaaatataacttattcgcatgactgttcctacagccaggaagacaaattataa

SEQ ID NO: 58259 - DNA, 327 bp, Glycine max
  Peptide Sequence Number=SeqID_175037
atggctgatgagcaccagcaaagagttacccttgaggactattcaaacaattcagtgccgcaattctttaccagcattgcacgtcctgaagagaagccaagaggtagctccactcatttaagggttacaggttgtaccatctatggtgaggctcatgaaataggccaatgtattcccattgaagaaaacactcaagaagttaactatatgggaaatcaacagagacaaggatatactcaaggaggattttcaggcttccaacagagtccttataaccaacaaggacagtggagatcgcaccctggcaatcaattcatcaaggactag

SEQ ID NO: 58260 - DNA, 741 bp, Glycine max
  Peptide Sequence Number=SeqID_175038
atggaaaaggatatcattgatctttctccaacatgggattgtgacaatggcaattccactgagaaaaggctcaggctatttggctttgagctaaacccttcatcaaaagagggttgtgccaaagaatctggtgaaggagatgaaagtgtgaactcctctaactcagcttcttctggaggagacaaaactgtgcaagagaaaacatcagccaatgaccctgatgagagaaaatttgagtgccaatattgttacaaggaatttgcaaactcccaagccctaggggggcaccaaaatgctcacaagaaagagagaatgaagaagaagaggttgcagcttcaatccataaaccgttacctacaacaccctttccaaagcaaccatggctttgcttacccttctgatactccttggttctatgacccctctacctataataataactctgagttcaccctttgtgaagaacctcagattagcttcaattcaaatagcgttttggattccaatttttctaatgatcagaaaactagttggtattctcttgcatctcacccttctaatatccaacaagatacttgcatgtttactttctcatccaatgcaagtaataataataatagtcctttcatattcaagccttgccatttccctgcttcaaatcagaaccataataaaaccctagatcttcaactaggtctcaacttggagtcaaatacaagaagttctctaagaaggatgtaa

SEQ ID NO: 58261 - DNA, 969 bp, Glycine max
  misc_feature (114)..(114): n is a, c, g, or t
  Peptide Sequence Number=SeqID_175039
atggtatttgctgaaagtgatcccgtggagaatttggcagaacagagaggattaactatccctagtgggcaacttgttaatgatgaattgaagacccttcaaaccgaaagccgntcccagaaaccaaagcaccctcccccaccgccagactaccgtgtacaactaaagtccgatcccccagcgccaaacgcaccaccgaagcaaatcaatattaagggcctgtccgtcgtcaaagattacttatctgactacggctacattgaatcctctgggccatttaccgattctttcgaccaggaaataatatcagccattaagacctaccagaatttttccaatcttcaagttaccggcggcctgaacaaacagcttattcagcaaatgttgtccatacgatgcggtgtccccgacgttaacttcgactacaacttcaccgacgacaacatttcctatcccaaagccggacaccgctggttcccaaacagaaacctcacatacggttttcttcccgaaaaccaaatcccagacaacatgactaaggtgttcagagattcctttgcgaggtgggcccaagcctcggggactttgagtctcagggagacaacctacgacaacgccgacatccaggtagggttctacaacttcactaactcgaggattgaagtgtatggtggcagcactatatttttgcaaccggattctagtaagaaaggggtggtacttctggacggtaacatgggctggttacttccaagtgaaaacgccacactgtctaaagatgatggagttttggacttggagactgtggcgatgcaccagatagggcatctacttggacttgatcactctcacaaagaggactctgttatgtatccttacatattgtcatcacagtcagagcaacgaaaggtgcagctttccaattctgacaaggccaacattcaccttcagtttgctaagcatgattag

SEQ ID NO: 58262 - DNA, 240 bp, Glycine max
  Peptide Sequence Number=SeqID_175040
atgtcagaattcagcaacttggcccacaaggtggaaaacatagtcaacggaaccatgtttaaggaaggaacatcgatcattgtctctcttacttcagtagataacacaacgggttataaagacaaaggaaataaggaacgcaagttattatttctaaacacgtgggaaaatatggtggaagttatggagattaatagaaccctctacgattctgaagaagtgaaaaaccaaagtccttaa

SEQ ID NO: 58263 - DNA, 381 bp, Glycine max
  Peptide Sequence Number=SeqID_175041
atgaggctactacttcaccttcctttagtgaaagtgaagaagcaaaaaggggaagaatctagggaagaaatctacccccaaaaagaaggacaacctttaatggttaaggaggagtgtaaggaggtaactgtctcctccaagaggttagctaagaaggaaattcattttgaaattaagaaaaatattaaagaaacttcccctcttagacaacctccacatcttttcctttgtaaaaagacacttgttagaactgccacacatcttgggcttgaggttattcctaaagtaaaggagttattggatgagggtttagttcgtaagagcttaaatccttgtgctttgttggtgcgcaaaataggaataatcaacatgaaaatatag

SEQ ID NO: 58264 - DNA, 156 bp, Glycine max
  Peptide Sequence Number=SeqID_175042
atgtatggacacatagtggcaaatttacgaaaggggggtctgtttttatgggtgacgcctggtgccgtcattgaagatgacgagaaagcttggtacgtggagggtgccgctcgtgctactggcgggacacatccacgtcggatgtgccgccagtag

SEQ ID NO: 58265 - DNA, 132 bp, Glycine max
  Peptide Sequence Number=SeqID_175043
atggatagtcaagccatgaaattatataagatcatggacatggacgaagaacagggatcttcagttcttcaacaagaactcaatggccataagcttgcctttgtgcccgctgatattgatttcattatctaa

SEQ ID NO: 58266 - DNA, 439 bp, Glycine max
  Peptide Sequence Number=SeqID_175044
atggcgggtgacggcggtcaggtcgtcgccgaccagcgggaattcaataccgcgcggcgcgtcggcgggcaggttatcgagcagcgccagccagcgagcgtccgcctggtccggtgggacggcgcgatacttctcatgatgaggctccgccgccttcacatgaatatagctgacagcgggggcgagatggcgcgcggcttcttccggcgaatcgccaacccacagccagtttcccatgtcgaaagtcagcgtcaccggcatctgatggacccggcaggcggctttgaagcgctgcattggcgccagttggccgcaatcggtctggtcattttccaccaccagcgccatgccgctggcgctcagaatgtcgcgcagcgtctccagctgttggttatggatgaaatgaccgagggagagcttcagccacagggcgttgagg

SEQ ID NO: 58267 - DNA, 519 bp, Glycine max
  Peptide Sequence Number=SeqID_175045
atggcgatgtttgtcgccaccgaaaccggcgaactggcggaggttgaacgctttatcaaacgcgtcgccggcgctgaactgaacgtggcgaccggcctggcgcgcctggggctgaaggtgggctgggtgagccgcgtcggcaacgatagctttggccgcttcgtgctgaattcgctggccaaagaaggcatcgacgcgcgcggcgtggccgttgacgagcgctacgctaccggcttccagatgaaatctaaagtcgaaaatggaaccgatcccatcgtggaatatttccgtaaaggatcggctgccagccatctgtcgacggaagatttccgcgctgattacttcaccagcgcccgccatttgcacttaagcggcgtcgccgccgcgctgtccgacagctcgtatgcattgctggaacatgcggccagggtgatgaaagccgaagggaaaaccctctcatttgatccaaacctgcgcccggtactgtggaaaagcgaagccgagatggtggagaactga

SEQ ID NO: 58268 - DNA, 171 bp, Glycine max
  Peptide Sequence Number=SeqID_175046
atgaatgatgcgatcaaggaacaagccagaggactaccagcaacaatgccataccaaaagaggaaaactctagatgaggcttcattgttattaagcgagtcgaagactcagtatgaccacaaatcgacctccactccctatggctcacacagacctgggtatagggcctaa

SEQ ID NO: 58269 - DNA, 342 bp, Glycine max
  Peptide Sequence Number=SeqID_175047
atggttcttcgggcgtctcatgtggatctcataattacatttgtcatgcatagcatagtcaaaaggaaagaattcgctttacaatgcccttaccgaacgcgtgccaaagctagagtgatgagtgaaatagaggaggcacaggaacatatgaaggctgacatgtgtggaagcaatgccttccaagattattttgatgatgccaaagaatcaagagtcaaacaagtttcaagaatcaagatcaagattcaagattcaagtaaagaatcaagactcaagattcaagaatcaagagaagactcaatcaagatacgtattaaaagagtttttcaaaacattgcatag

SEQ ID NO: 58270 - DNA, 1263 bp, Glycine max
  Peptide Sequence Number=SeqID_175048
atggtttcgtgggtgagaggcaagtgcgtcggtaacggcgcgtttggggttgtgaacgtggcgatttcgaaaagagataatcgcgttttcgcggtgaagtccgtggattgtggaagggggctttctggtcatcaggtggaggcgttggagaacgagattgggattctgaagcgggtggcttcgccgcacgtggtggcttatctcggagacgatgtcacgtgcgaaggaacggcgtcgttcaggaatcttcatctggagtacatgccaggtggcaccgtcgctgacttggaccgcgctgacgtggacgagcggttagtgaggcgcttcgcgtggtgcctcgtgtccgcgctgcgtgacgttcacgcgcaaggcttcgtccactgcgacgtgaaagggaggaacgtgcttctctccggcgacggcgaaatcgtgaagctcgccgattttggcacggcggtggaaattgaatcctcgccggcggagatgttattgttgtcgcgggggagtccgatgtggatggcgccggaggtggttcgccggcagaggcaggggccggagtccgacgtgtggtcgctcggatgcacggtgatcgagattgtcaccgggaaaccggcgtgggaggatcgcggcgtcgacacgctgactcgaatcggttactcagacgagttgccggaatttccaaagcagttgtcggagctagggaaggattttctcgagaagtgtctcagaagagaacatagtgaacggtggagctgcgatcagctgctgcagcatccatttttgcttccctactacgcggttgctgaatcgtcgcctcgctgcgttctcgactgggttgactcggagctcaactccgagtcagattgtaacgaccgtgatcatcaagaagacgtgtttataaaatttaccaacagcgaagaaaaatcagttattaaaaatagaattagtaaatttgcgacagagtcgagggtaaattgggaaacgcagggttggatagtggtgagggaaattgagtccaacggaaaaccaacgacaacgggaacagaaacagaaatagaggaaggagcatgtacgtgtgagtgtgatggtgttggttcgagcaaagaaggggtaaattgggagtttcacaatgtggcggggactggtatggaatattcggattctgtaggggtaaatcggggaataggaaagttgggtgggagtaacaccgctggagggggtggtggttggagctgtcgttcgacatttgatgccttgctttag

SEQ ID NO: 58271 - DNA, 237 bp, Glycine max
  Peptide Sequence Number=SeqID_175049
atggctaggagggggggacaagcctcgagtggggtgagggggggaccgccctttaacgggctggagggggtagggaagagggaggcgcctggggtcgcgcctgtagcaggggcgccaccaatcgcgctcagtccgagggtgctagcagacgcgcccgcgtcaggggcgctacctgctactccctcgtgcgccgcgcccgtgccacgtgtcatgtgcacagtggaggcgcctgtttga

SEQ ID NO: 58272 - DNA, 294 bp, Glycine max
  Peptide Sequence Number=SeqID_175050
atggtttctagaggtatcatcccgttcgaagaacatactgcagcagtagggactactagcaataataggttttcaaagagaaaaactctagatgagggttcacggaaagccaacaaaggagtaagtcatggtaaaacattgcacaagattaaatggcctaactctctaaaaacaatccccagtggagtcgccaactgtcgcaacctacccttcgatgggagggcgacacgtgactcgcgggatgcgtgttccacgaaaggaatacgcgcggagtcgccaccaacgtttatttga

SEQ ID NO: 58273 - DNA, 3696 bp, Glycine max
  Peptide Sequence Number=SeqID_175051
atgcatataacgcagacagtggataatgacctcgcattgaaaatatttatcaaagccagagccacaccgaaagttgttgcagcatttgctgagaggagggaatttgacaagattctgatatactcaaagcaggttggatacacgcctgattacatgttccttctgcaaacaatattacgggcagatgcccagggtgctgtaaattttgctctgatgatgtctcaaatggaggggggttgccctgttgactacaacacaataactgatctctttcttcagaggaatttaatccgcgaggcaactgcctttttattggatgtgctgaagtcaaacctaccagaacatggatatcttcaaacaaaggtactggaaattaatcttgtgacctttccaaatgttgctgatgctatattggccaatggcatgtttagtcattatgaccgtccacggattgctcagctttgtgaaaaggctggccttttcattcgggctcttcagcattattccgaattgcctgacatcaaacgtgtcattgtgaatacacatgccatcgaaccacaggctctagttgagttctttggaactctttcaaaagaatgggcgctagagtgcatgaaagatcttttactggtcaaccttaggggcaaccttcaaataattgtgcagactgccaaggaatattgtgaacagctcggtgtagatgcatgcattaaactctttgagcaattcaagtcctatgaaggactatactttttcttgggtgcatatttgagctctagcgaggatcctgatattcacttcaagtatatcgaagcagctgctaaaactggacaaattaaggaggtggagcgtgttactcgggaatcaaacttttatgatgctgagaagacgaagaactttctaatggagaccaagcttccagatgcacggccattaataaacgtgtgtgatcgttttggttttgttccagatctcacccattatctctacaccagcaacatgctgcgttatattgagggatatgttcaaaaggtgaatccaggaaatgctcctctagttgtaggacagttgttagatgatgaatgccctgaggatttcattaaaggtcttattctttcagttcgttctcttcttccagttgagcctttagttgaagaatgtgagaagagaaatcgtctccgcttgcttactcagtttttggagcatcttgtaagtgagggaagccaggatgtgcatgtgcataatgctctgggtaaaattatcattgacagtaataacaatcctgagcattttcttacaaccaacccatattatgattctcgtgttgttggtaaatattgtgagaagcgggatcctacacttgctgttgttgcttaccgaagggggcaatgtgatgatgagcttgttaatgtttccaataaaaattccttgttcaaactccaagccagatatgttgtggaacgtatgaatgctgacctctgggagaaagttcttaatcccgagaatgagtttagaagacagttgattgatcaagtggtgtccactgctttgcctgaaagccagagtcctgatcaagtttccgctgcagtgaaagcttttatgactgctgatcttccccatgagttgattgagcttcttgaaaagattgtgctacaaaattctgctttcagcggaaactttaatctacaaaatttgttgatcctcactgcaatcaaggcagatccctcaagagtcatggattacattaataggctggacaactttgatggccctgctgttggggaggtggcagtagaagcaaacctatatgaagaagcttttgccattttcaaaaaatttaatttgaatgttcaagctgttaatgtcctactagataaccttcggaccattgatcgagctgtggagtttgcattccgggttgaagaagatgctgtctggagccaagtggctaaggcacaactaagagaaggcttagtaagtgatgcaattgagtcattcatccgtgcagatgattccactcacttcttagaggttataaaagcttctgaagatgcagaagtataccatgacctagtaaggtaccttcttatggttaggcagaataccaaagagcccaaggtggacagtgagctcatatatgcatatgcaaagattgacaggcttggagaaattgaagagtttatattgatgccaaatgttgctaatttaccaaatgttggagaccgtttgtatgatgaggctctctatgaggctgcaaaaattatatttgcttttatttcaaactgggctaagttagcagtgacattggtgaagcttaaacaattccaaggtgctgttgatgctgctaggaaagcaaacagttcaaaaacatggaaggaagtttgttttgcttgtgttgatgctgaggaattccgattggctcagatttgtggtctcaatgtcatcattcaggtggatgatttggaagaggttagtgagttttaccagaacagaggatgctttaatgaactgatatctctaatggagagtggacttggactggagcgtgcccatatgggtatctttactgagttgggagttctttatgcaagatatcgtcctgagaagttaatggagcacattaagttattctcaactcggcttaacattcccaagcttattcgagcctgtgatgagcagcagcattggatggaacttacatacttatacatccaatatgatgagtttgataatgctgcaaccactgtaatgaatcactctcctgaagcatgggaccacatgcaattcaaagatattatagttaaggttgcaagtgtggagctctactataaggctgttcacttctacttgcaagaacatcctgatattttaaatgatcttcttaatgtacttgccctacgtgtggaccacacccgtgttgtggatataatgcggaaggctggccacattcgattggttaagccgtacttgattgcagttcaaagcaataatgtgtctgctgttaatgaagctttgaatgaaatttatgttgaggaggaggactatgatagacttcatgaatcaatagatctgcatgacaacttcgatcagataggtcttgcacagaagattgagaagcatgagcttcttgagatgaggcgtgtcgctgcttatatttacaagaaagctggaagatggaagcagtccattgctttgtcaaaaaaagacaatctttacaaggactgtatggaaacttgctctcaatctggtgaccgtgaactctcagaggatttgcttgtttactttattgagcaggggaagaaggaatgttttgcatcttgcctcttcgtctgttatgatataatacggccagatgttgctcttgagctagcttggatgaacaatatgattgattttgctttcccatacctcttacagtttattcgagagtatactggtaaagttgatgagcttatcaaggacaaaattgaagcacagaaagaggagaaagctaaagagaaggaagagaaggatgttattgctcagcagaatatgtatgcccagttactaccacttgctttgcctgcaccaccaatgccaggtatgggtggaggaggctatgctccactgacaacaccccctatgggtggtatggggatgcctccgatgccaccttttggaatgcctccaatgggcggcagcagcggctcctactga

SEQ ID NO: 58274 - DNA, 639 bp, Glycine max
  Peptide Sequence Number=SeqID_175052
atggctgcgaacgcccctatcaccatgaaagagaccttaacgctgggaagcgttggaatcaaccagcaattcattacatttactcatgtgacaatggaatcggataagtacatttgtgtcagggaaactggacctcagaacagtgttgtcatcattgacatgagcatgccaatgcagcctttgagacggcccataactgccgattcggctttgatgaaccccaattctagaattcttgctctcaaagcccaagtgccgggaaccactcaggatcatttgcaagtttttaacattgaaacgaaagcaaagatgaaatcgcatcagatgaaagaacaggttgtcttttggaagtggataactccaaatacactgggaattgtcactcagacgtctgtatatcattggtcagttgagggcgatggtgaaccaatgaagatgtttgatcgaacagctaatctggctaataaccaaataattaattatcgttgtgatcctaatgaaaagtggttggttttgattggaattgctcctggttcagcagaggtgttagaaacttttcctatcagcatattaataggctgcaaatttctggcaatcttatggggttcattgtggccattttttgcagttcctatctga

SEQ ID NO: 58275 - DNA, 192 bp, Glycine max
  Peptide Sequence Number=SeqID_175053
atggtggctattcagttgactgttgatttgaagcctgatttgccaagggaagcagagagaattaagaagtgcaaaggtagggtgttttacaagacacctgtcttcaaacgtgaggtattctacatcggtcaaataaccatcgttgtaggacgcgtgactttcaacatcgtctgctacgatgacgcgttataa

SEQ ID NO: 58276 - DNA, 2205 bp, Glycine max
  Peptide Sequence Number=SeqID_175054
atgaatccatctgagcaatttgtggaacatggaatgtctcagcagaatttaaagagaacatcttgtgcaactgtgctcactctagcataccaaagtcttggaatagtttatggtgacctcagcacttctcctctttatgtttacaagaccacgttctcagggaaattgaggctcaaagaagatgaagaggaaatttttggcgtgctttcatttatcttctggacatttaccattattgctctcttcaaatatgttttcattgttatgtctgctgatgacaatggggaaggaggtacctttgcattgtactcacttctctgccggcatgcaagactaagcattttacctaatcagcaagccacagatgagaaattatcggcatataccacacaagattctgctgacacatggctgtctgctaatttgaagttgttctttgaaaagcacccaaggttccagaaaggactgttgatctttgttctgctaggaacctgtatgacaattggtgatggtgtgattactcctgcaatatcagttttttcagcagtttcaggagttcaagttaagatcaaaggactccatgaaaattatgttgtcataatctcatgtgtcattttgttggtccttttctccattcaacatcatgggacacatagagttgccttcatgtttgccccagtagttgcagcatggcttttgtgcatcagtggtattggtgtatacaacatattctactggaaccgacaaatataccgtgcactttctccactctacatgttgaagttcctcagagccactggcattgaaggatggatgtcattaggtggagttgtgctttcaatcacagctagaatagtggaattaattttcctgtggtactttctcaggagtggaggcaatgtatgctgccttgggtcatttttctgcactctcaataaagaaactgtattttggccagttttcatagtggccactcttgctgccattgttggaagtcaagcagtgatttcggctaccttttccattgtaagccagtgttgtgcactaaattgttttcctccggttaagattgttcatacttcaagcagaatatacggacagatttatgtcccagaagtcaattggatattaatgtgcctttgtttagctgtgacaattggcctaagggatattgacatgatgggtcatgcatatgggctggccaccaccactgttatgtttgtgacaacatgcttgatgacactagtaatggtgattgtttggaagcaaggaataataaaagccattatatgtttggtattgtttggatcaattgaactgctttacatctcggcttctatctgcaaagttcctgaaggaggatggatcccccttgtgctatcttttatctttatgagtataatgttcacttggaactatggaacaatgaagaaacatgaatttgatgtggagaacaaggtttcaatgagcaagatactatccttgggaccttgcttaggcatggtccgtgtcccgggaataggggtcattttcagcaatctggcttcaggtgttccagctatttttggccattttgttacaaacttgccagcattccatcaggtgttagtttttgtatgtgtcaaatcagttcaagtcccttgtgtcagtgacaacgaacggttggtcatcagcaggattggcccgaaggagtaccgcatgttttgttgcattgtcaggtacggctacaaggatctgcaacaagagaactacaattttgagaacaaattggtaagtgcaataatacaatttgtagaaatagaagagagtgatccagcaccaacaccagaagaattttctatggatgatggaaacttaaatatggaacaccttggtgtttcaccacacactttgagtagctcatgttacatagagaaaaattttccattttcatgtgttttacgtgtgaagaagaatgacaatgatcatcttcaagagactccctataaagatgagtctatgcagattttaaaagccaaggagtctggtgttacctatatacttggacattcctatgcagaggcaaagaaatcatccaccattctaaagaaatttgccattaatgttgtttatgcttttctaagcaaaaattgcagagaccctgatggtttcttgaacgtagctcatacttctttgctagaagttggtatggtttaccatgtctaa

SEQ ID NO: 58277 - DNA, 717 bp, Glycine max
  Peptide Sequence Number=SeqID_175055
atgccaagtcaatccgagtcaccaagcaactcactgagtcaactctctcggaacatgttctccgacaacaacagcaacatcatgctcgcagccatagtttccttgctcctagtaatcctctttgtcctcctactccatgtgtacgccaaatggttcttattccaggcacaaacacgttcgcagactcgctggcggcgaactccggtgaccgtctccggcgttctggaaccttcccattttcatagtatcaacatagaatcctcacccacgtgcaacaaaggccttgactcggcctcactttcggcaattccaatgtttgtgcaaggaacagagaaaacagaggaatcggaatgtgtcatttgcttgagtgttattgaagagggtgagattggaaggggattgccgaagtgttgccatgcttttcacatggagtgcattgacatgtggttgagttcacattgcaattgtccaatttgtagagctcctattgtggtaagtggagattctcaattgggttctgttgatggtgatagtgatggtgtggttgagattgtggttgttactcccagttatgagaatagtgagaatgagcatggtgaagtgagtgattctgttcccgaaacttcttcatcttcgttgggtttctctctgaagagattgctgagtaaggtttttctgtcacctgatcatgtaactgaattggatgcttcgcagtaa

SEQ ID NO: 58278 - DNA, 390 bp, Glycine max
  Peptide Sequence Number=SeqID_175056
atgacaacagagactccagacgccgaggacctcgtaggggtcccaccggagctgcttctcatcgccgccgccgtcgacgtcgtgcttctccgacttcgagcggtgccccgacatcatgcgccgccctcaaatcaaacgacatcgtatacatgttttatgctttctatccccaaaaccctagaactcggatacagagaaaagagtgtcagggagaatggagatcgaaatggaagggatggggagcaagtgatatcttcccgtgcgtgtgagtcacgaggaaggagaaataatgaagaaggagcattaggaagaagaaggggttgtggcggtgacagtgagatccagaaagtggaccatataaagcacgaaatcggaatcagaattgcatga

SEQ ID NO: 58279 - DNA, 525 bp, Glycine max
  Peptide Sequence Number=SeqID_175057
atgtaccaaatccacgggcaccatgggttgccagagcaagctttccttgggaataaagaggaccaaaaatccataaatagtggcaacagagtttacaaccagaaacactggaagacagtgtattttgcttcaaagggcattgtggagatgctacctctctcatggctagcagccatgataatggctgcacaaaaggtggctgcaaaggccacaaaccttaccacaagatggaggatcctccgagttttggccatgaatttcaaaaagaaaaatggttggtgcacaatgaatcctcaatggaaatatgacaacagcggtgatagcgacaacaacagtcatgacatgacgatggtgacagttgatgatgacaataatcatggtgatggatgcaatggtgatcatgatgatgataacgacaaaggtcattgcgacaaaggtgatgatagtgataacggcgaagtttatgatagtgttgcattgatgttcatgatgaaggtagcaacaatcatgatagtgatgagttaa

SEQ ID NO: 58280 - DNA, 141 bp, Glycine max
  Peptide Sequence Number=SeqID_175058
atggagtcattcgttgttttgcatgcaaatcaatgcagaattgtcggtggcgttcagtgggagatcaaacagttggggatgggtgtctcgagtgatatgagtgggggcccaaatgatgttggtggcgaagaagtgatatga

SEQ ID NO: 58281 - DNA, 752 bp, Glycine max
  Peptide Sequence Number=SeqID_175059
atggccacgattgacatggttgagaggttgagaacagatatgggaggggtggtgttggttgagggagcggaggattcttgggctttgtgcgaaaggattgaggattcaaatattaatgatactttagttgatatgtggaaagtgaaacttcctcctaagggtaagaaccctaaagctggcttcgagggcagcaacctccagcaaaaaaaagaagaagacacagaggctttaccactcttctcttggtcccttctcctctctgcaccattgatgctggtgcttcctgtgtttccggcattctatcatgcttccctatcactccctaccccatcaaaaacaccttgtcctcaagtaagtcaggaggagcttcaggaaatccagcaatatggaagcgcgaaacacccttgttgttccgacagaggtggcggaattggtgttggggaagaagatgcgaagtggtggcgttcgcgccctgcaattccacgcagcgtccgtgatggaggaacatcacacgtaatgggttttgggccgattccgggtgtgggttttgggtcaggtccttcagatacgggtgtggctagcttcgggtcaggttgtgctgtattaagacccaatggcacaacccgtgctcatggcgcgtggctaactcctccgggggaaccaaaggggctgacggtggagctaccagcggtggagttcgcagccgcggtggaggcagacgaaggtccgacagcttctgctcctcgatcttc

SEQ ID NO: 58282 - DNA, 525 bp, Glycine max
  Peptide Sequence Number=SeqID_175060
atggccttcacttccacactctctatctactctcacccgcaggttcgcctcctcaaccagcggctgcaatcgctgcccttcaccgccgccggcgtcgctcaatttgcgccgcttccgcctctcaaccgccggagaacgtgttctccgagaagcttcgtgtttagggtttcttccagcgtggaaggaagtcgcgcacgctccggtggttctcgcagagtctatcgccagtctcaggccagcgcgccgctgtccagtgcgccggtgaaacagattgccaacgttgttgctcccgtcgccgcgttcttcgccctcacttttgagggctgtttgagagaagaggctaccttgttcactcattgcagtttcagactacacaggcagttgcaacctggcacacgagcagcctttgcaggttcatccttagatcgttgtcatcataggttcacctcagcctggaggctcgctgaaagagttgttgtgtttgccagaggtggtgggtcacaagaagcaaatgcaaaagattaa

SEQ ID NO: 58283 - DNA, 123 bp, Glycine max
  Peptide Sequence Number=SeqID_175061
atggctgtgccgccattgaaaatggcgagaaagcttgatacgtggagggtgccgcttgtactactggcgggacacatccacgtcggatgtgccgccaatagctccagcgggatgggtagttaa

SEQ ID NO: 58284 - DNA, 369 bp, Glycine max
  Peptide Sequence Number=SeqID_175062
atgttggtattcaaaggtgttgttctgggaagatggattgttggaggatggggtgttgccgaaggagaagtatcaaagattgtaccagatttctcaacaacaacatcaatatatccagcaaatggggacaacattacatacaggttgggaatggcagttccagtggaggaggttcttcatggagggggtctgacagtacatgagcagcaacaagccatgtggagatgggagggagattcacgtgggaggtatacagtggggagcgcttacgtgttactcaacagtaattcgccaatggagaatcaagacgaagtgtttaaagcactatggaagataaaaatcccaagtaaagcatcatccttcgcctag

SEQ ID NO: 58285 - DNA, 585 bp, Glycine max
  Peptide Sequence Number=SeqID_175063
atgctttcagttcaagggcgcaactttggagatgaaggattattcttccttgctgagagcttggcgttcaaccagactgcagaggaagtgagttttgccgccaatggtataactgcagctggattgagagcttttgatggtgttcttcagtcaaacatcacattgaagactcttgacctttcaggaaaccttgttggagatgaaggtgctaagtgcttatgtgacatattggtgaataactctagcattgagaagctccaactaaacagtgctgacttgggtgatgagggtgcaaaagcaattgctgaaatgttgaagaaaaattcaagtttgcgggttcttgaacttaacaataacatgattgaatattctggattttcaagtctggccggggcacttcttgagaataacagtatacgaaatatacatctcaatggcaattatggtggtgctttgggggctaatgcattggctaaagcacttgagagcaacaagtcattaagggaacttcatttgcatgggaattctattggagatgaaggaatccgttctttgatgactgggttatcttcacataaaggttaa

SEQ ID NO: 58286 - DNA, 581 bp, Glycine max
  Peptide Sequence Number=SeqID_175064
ctaaaggtgcattccatgttgctgagtatattaagaagagcaaaagcctattatggttgaacctttacatgaatgacattggtgatgagggagccgaaaaaattgcagttgctttaaaggaaaatcggtcaatatcaacgctggatctggggggaaataacattcatgttgatggtgttaatgccattgctcaagttttaaaagataacttagttattaccactttagaacttagttataatcccattggaccagacggagccaaggccttggctgaagttctcaagtttcatgggaacataaaaacccttaagcttggttggtgccagggtgctcagagcctggctcgcagcttgaaagtggttaatgaagctttaacctctctagacttaggatttaatgaaataagggatgatggagcttttgctattgctcaagcactcaagtctaatgatgatgtagctgtcacatccctaaacattggcagtaacttcctaacaaaatttgggcagggtgctttggctgatgcaagagaccatgttttggagatgaccgaaaaggaaatcaacatcttcctctag

SEQ ID NO: 58287 - DNA, 1173 bp, Glycine max
  Peptide Sequence Number=SeqID_175065
atgaaaccgtacctacgtgcaatattcctattattccttatccttccttcggcgagatggggcgaggctaaaattgataggaagacgataacaatgttttggggcaaggttaaagatgcgacgataaaaaatttcccgagtcgtgatgagcggaagaaactgagggagtattacgagaaattcagggaattcatggatcgtgtagaacaaaagacgacccctcccccaccgccaatgtaccgtttacaaccaaagtcccctcccccaccgccaaacgcaccaccgaagcaaatcaatattaaaggcctgtccgtcgtcaaagattacttatctgactacggctacattgaatcctctgggccatttaacgattctttcgatcaggaaataatatcagccattaagacctaccagaatttttccaatcttaatgttaccggcgacctgaacaaacagcttattcagcaaatcttgtccatacgatgcggtgtccccgacgttaacttcgactacaacttcaccgacgacaacacttcctatcccaaagccggacaccgctggttcccaaacagaaacctcacatacggttttcttcccgaaaaccaaatcccagacaacatgactaaggtgttcagagattcctttgcgaggtgggcccaagcttcggggactttgagtctcacggagacaacctacgacaacgccgacatccaggtagggttctacaacttcactgccttgagaattgaagtggaggtgtatggtggcagccttatatttttgcaaccggattctagtaagaaaggggtggtacttatggacggtaacatgggctggttacttccaagtgaaaacgccacactgtctaaagatgatggagttttggacttggagactgtggcgatgcaccagatagggcatctacttggacttgatcactctcacaaagaggactctgttatgtatccttacatattgtcctcacagcaacgaaaggtgcagctttccaattctgacaaggccaacattcaccttcagtttgctaagcatgactcggatttgacttctctgccaaactcgcatgactctgcaagccacggtgggcgtttggatgtgcttttagttaccactttctctcttggatttgcttacttactgctccttttgtattag

SEQ ID NO: 58288 - DNA, 546 bp, Glycine max
  Peptide Sequence Number=SeqID_175066
atgggtatacgagcccagttccatccaaggtctgatgataagaaaatatacttgcctccagcttgtcatactttgtctagatgggagaagatgagtttttgtcaatgtctacgccgtgtcaaagtcccacatggatactcttcaaatattaagagccttgtgcagttgaaagatataaagttagtaggcttaaaatctcacaattgccacgtcttgatgcaacaattgttagttgtggccatacgagacatttttcctaacaaagttagacatgccataactcggctatgctttttcttcaatgccatatgtagcaaagtccttgatcctatcaagttagataagctggaaaacgaggctgccattatattatgtcaattggagatggaaatcaaatgttgtggtcctatttatttgcgatggatgtacccggctgagcgatacatgaagatcttaaaagggtatacaaagaatctacaccatcttgaagcatctattgttgaaaggtacattgcagaagaagctattgagttttgttcagagtaa

SEQ ID NO: 58289 - DNA, 1128 bp, Glycine max
  Peptide Sequence Number=SeqID_175067
atgaaaccgtacctacgtccagtattcctattattccttatccttctcgaccaatccatttcggcgagtgctgcattagcaaagataccgagcaagaaagaagatttgaagaaggctgagaaagtgaaggagtgggtcgagaaagtgaaggacggcgtagaacttgcaatagaaaatgcccctccctcaccgccaaacgaagcaccgaagcaaatcaatattaaaggcctgtctgtcgtcaaggattacttatctgagtacggctacattgaatcctctaggccatttaacaattctttcgaccaggaaacaatgtcagccattaagacctaccagaaattttccaatcttccagttaccggcgttccgaacaaacagcttattcagcaaatgttgtccctacgatgcggtgtccccgacgttaactttgactacaacttcaccgacgacaacacttcctatcccaaagccggacaccgctggttcccaaacagaaacctcacatacggttttcttcccgaaaaccaaatcccagacaacatgactaaggtgttcagagattcctttgcgaggtgggcccaagcctcggggactttgagtctcacggagacaacctacgacaacgccgacatccaggtagggttctacaacttcaccgacttgagcattaaaatggaggtgtatggtggcagccttatatttttgcaaccggattctagtaagaaaggggtggtacttctggacggtaacatgggctggttacttccaagtgaaaacgcctcactgtcgaaagatgatggagttttggacttggagactgcagcgatgcaccagatagggcatctacttggacttgatcactctcacaaagaggactctgttatgtatccttacatattgtcatcacagtcacagcaacgaaaggtgcagctttccaattctgacaaggccaacattcaccttcagtttgctaagcatgactcggatctgacttctccaaactcgcatgactcggatctgacttctccaaactcgcatgactctgcaagccacggtgggcgtttggatgtgcttttagttaccactttctctcttggatttgcttacttactgctcctttcgtattag

SEQ ID NO: 58290 - DNA, 498 bp, Glycine max
  Peptide Sequence Number=SeqID_175068
atgaaaaaggttttcagagattccttcaagaggtgggcgcaggccaccacaggggttttgaggctcacggagacaacctacgacaatgccgacatcaaggtggggttcagaatattcaacaatatttgggaccaggtgtttagcctaagctttatcatactgcaaccaggttctaatgtcacgacaggggacatacgcctcaaaggtgccattttatggtcgctgccgagtgaaaaagagagcctgtcgtgggagaacggagttttggacttggagagtgcggcgatgcatcttctagggcttgatcactctaacaaagaggactctgttatgtaccctaacgtattgccatggcagcaacgaaaggtggagctctcggtttctgatatggaaaacattcagcgtcactacactaacggcatctctggccacagtgggcgttggggagtgcttttaatcactatcttgtctcttggatttgcttacgagcttctttaa

SEQ ID NO: 58291 - DNA, 612 bp, Glycine max
  Peptide Sequence Number=SeqID_175069
atgagctcatcctcagagaagaaaccttcttcttcttcttcttcttcttctccttcagtgttgaaggtatttggttcccctttgacggctatgagaagtgacgaggctctcagagatggctgggttaagaaaatcgagtgtcctttctgccatcgcgagtttcagagtttgcaagctctagggggacaccaaaatgcgcataggagagaaagacaaatggctaggtttgcccaatttgaatatatgtgtctgaatcaaagcaaccaaatgttccaatcggttacacctcttgtggttgagcatggagcagcaccaacctctgttttcggtggtgcaactcggttatggacagcacctgagtcatcacagctacctgtggcggagccaccaggtatgcttatccctattgtacaagcaccagtagtaggggatgatgataatatcgacctagaactgagactagtcaatcctaatagggttgagacagatgagagatgtgctcctgagtgtttgagagaacagcaggccattagaactaatcaaattctggttttaaatattaaaatatggcatatattgaatgacgatagacagcatgaggagttctcttga

SEQ ID NO: 58292 - DNA, 884 bp, Glycine max
  Peptide Sequence Number=SeqID_175070
tgctgaccatccttgctcagcctggtggtactgcgccttgcgccgacgcgcggcatcctgattggcggcctgctgtcgtttgccgggctggtgtggctggtgagcgccggcaacccggcacagctgctgagccagcgcctcggcaacggcgagctgatgatgctggcggcctcaacttcctacgcgctgtacggcgtactgacgaagcgctgggcaatcccgctgccaacgtggcaaagcctgtacgtgcaaatcttcttcggcgtgcttttgctgctgcccggcttctggcacgcgccggaggtggcgctgaatgccgacaatattccgctggtgctgttcgccgggctgtttgcctcgattgtggcgccgttcctgtggatccttggcgtgcagcgcctcggcgccagcaccaccagtattttcatgaacgtggtgccggtgtttaccgccctcattgccgtgctgttcctgcacgaacagttgcatgcttatcactggattggcggcggtctgacgctggtcggggccacccagctgcgggctgcggtccagctgcagctgggcgccgtgccaggcgcagatatcctgcaccagcgccagtccaatgcccgccccgggctggctggcgtgatcgagccggccaaacggctgcagcgcctgccgctgctgatccgccgcgatgcccggcccgctgtcttcaatctccagcacctttttgccgcagccgtgcggtgaccgtgccgccgtgtggcgtgtatttgatagcgttgtccagcagattggcgcacagctcggccagcaacagcgcatcgccctgcacctggctcgccgcctgctcttcaaaccccaggtcgatctgtttacgccgcgccgccgcataa

SEQ ID NO: 58293 - DNA, 1152 bp, Glycine max
  Peptide Sequence Number=SeqID_175071
atggtattgaaggagttcaaaatccgaagctatgagtgtcaattcgatagagctcaggtagaagatcttgagagaagatgcaaggtagggccatcagaaagcgtgttagacactatgggtgaccccatgtgtaggattcgaaactgtcccatgtacataatgctggtggcagagatggacaacgaattggttggtgtcattcaaggctcaataaaaacggtcacacttcataatcatcatcctaataaggatatggcaaaggtagggtacgtcttaggcctaagagtttctccacataatagaaaaaaaggcattggctcaagcctagtgcaaaagctagaagaatggttcacttccaatgatgtggactatgcatacatggccacagagaaagaaaaccatgcatcaatcaatctcttcatgaacaagtttggctacatcaagtttaggactccatctatactcataaacccagtgaatcatcacccttttggaatctcatccaacatagagatagccaggatcaaggttgaaaaagctgaatccctctatagagggttcatgggagcatccactgagttcttccctagtgacatagagaatatactaaccaacaacctaagcttgggaacatgggtggcttatttcaaaggggatagtggttttggtaatttagaaggaaaagtccccaatagttgggctatgcttagtgtatggaattgtggggaaatcttcaagctaaggctagggaaaacacctttgtcttgcatgctattcacaaagagtttgagcttgatgaatagaatcttcccttgcttgaaattgcccaccttgcctaatttctttagtccttttggattctacttcatctatggggtgtaccaagaagggcctttctctgggaagctggtgagggccttgtgcaagtttgtgcacaacatggcttctaagactgagcattgcaagatcattgtgacagaagttggagaaacagatcatgagcttattcatcatgttccacattggaaattgttctcatgtccagacttgtggtgtataaaggctttgaagaaaaatggaagaacaaacaggtttcatgaattaaccaacaccccaccaagaggtctctttgtagacccgcgagaagtctaa

SEQ ID NO: 58294 - DNA, 186 bp, Glycine max
  Peptide Sequence Number=SeqID_175072
atggagaagctcaaagccaaagaaaatgttccaaatacatgtggcagattaatccagccaaagggaagtaataatacaagtactataagaggaataatggttgggggaagacttcgtgctggttttggacctttccaattatttcgtattccaaaactctcaattattagtagaaataagaattga

SEQ ID NO: 58295 - DNA, 144 bp, Glycine max
  Peptide Sequence Number=SeqID_175073
atgggaaccataacaattgaaaaatggacaagtacagacaacagacgacatacgagggtgacgatgctgggtgccggtggtaaggatgaggattgtgtaaatcgcaaaagggaaaggagaactgaagaagctgctgaggaatga

SEQ ID NO: 58296 - DNA, 306 bp, Glycine max
  Peptide Sequence Number=SeqID_175074
atggctaggtggatggctatggagaacctcatgctagaggacgcgggaacacaatgctctgaaaggaaagggtgtcacactaaggacaacccttggtccgcccctggtgagtctagcatcgccaaaggctcgtcaaaccaaaggtcaacccttggtgagtctcgcttcgccaaaggctcgtcaagcccaaggtttgcccttggtgagtccttcttctccaaaggctcgtcaaagccaaggtctgcccttggtgagtctctcttctccaatggctctacaaacccaaggtttgcccttggtgagtga

SEQ ID NO: 58297 - DNA, 186 bp, Glycine max
  Peptide Sequence Number=SeqID_175075
atggccggtgtcggtcattatatggccccgactgatatctttcagccgacattgcgcaatttcttttacaaacgctggccgataatgttcttttatttacggacggctaggtttttccgtgcgagctcaaccgagggttcgttccgatcaacactggcatgttgttcttctcatttaggaggataa

SEQ ID NO: 58298 - DNA, 195 bp, Glycine max
  Peptide Sequence Number=SeqID_175076
atgccaaaaggtattcgcgactttggcgacgatgtggaaaagaaaattcgtcagacccaggtgctgctgcgcacgcgtgaaaaactggcggcgctggagcagcgtctggcgaagctggagagtgaaagtccggcggccccggctccggcggtgatcacgccagatccggcaggcaaaatcgatacgcctcagtaa

SEQ ID NO: 58299 - DNA, 291 bp, Glycine max
  Peptide Sequence Number=SeqID_175077
atgggcagaaatgtctccacattgattggtaaatctgttccccgaatccctgaaaaatgtaaagatccagctggagttgctgcacatgatgtccaacgttatgtcaaggaatcagatcgggctgcacaatgcacaaggcaagataaaatgtcaaaagaagaattgaagctgcaggatccacgatgtcggatacaatgtccaggacatcctgcccgaaaatactggacacataaatctgttatatctttaacagattgtgcaggatccacgatgtcggatacgatgtcctga

SEQ ID NO: 58300 - DNA, 663 bp, Glycine max
  Peptide Sequence Number=SeqID_175078
cctccaccatcaccttctcctcctcccccatactattataaatcaccacccccaccttcaccatcccctcctcctccttactattataaatctcccccaccaccttcaccagttcctaaacccccatactattatcactctccacctccaccatcaccttctcctcctcccccatactattataaatcaccacccccaccttcaccatcccctcctcctccttactattataaatctcccccaccaccttcaccatccccaccaccaccttattattatcattccccacctccacctaaagagcatgtacaccctccctactactaccactcaccaccaccaccatccccatctccaccacctccttattattataaatcccctccaccaccatccccttctcctcctcccccctactactatcactctccaccaccaccatctccttctcctcctcctccctactactaccactctccaccaccaccatccccatcaccgccgtctccatattattacaaatcccctccacctccatctccatctccaccacctccttactactatcaaagtcctcctccaccatctcccacttctcatcctccctattactacaaatcccctccaccaccaacgtcatatcctccacctccttaccactac

SEQ ID NO: 58301 - DNA, 318 bp, Glycine max
  Peptide Sequence Number=SeqID_175079
atggtactcagtactttagattttgatgattttgagacttgtgtggtttgcattaaagacaaggatgaaagtagtccgagatactttaacaccttcatagatgattactcacgatatatgcatctttacttactttgttctaaggatgaagctttggatgcctttagattttttaaggttgaagtagagaaacaatgtggaaaacaaattaagattgtgagattagatagaggaggaaagtactatgctagagttctaaccaagactgcctcaaagacaccttttgagttattcaaaggttggaaacctagtttgtga

SEQ ID NO: 58302 - DNA, 273 bp, Glycine max
  Peptide Sequence Number=SeqID_175080
ttttgggaaaatggcagttcagatgtttggggtagtataagtgatcaagggatagtaaatcatatcacaggaggaaattttgcgcagagttccattaccattatgggtggctccgtgatttttatgggcacaggcatcccagttgctcctgctactcagcctagagccttgagcattgtacaaggacgtgctgtaggagtaacacattaccttctaggtggaattgccacaacatgggcattcttcttagcaagaattattgcagtaggataa

SEQ ID NO: 58303 - DNA, 705 bp, Glycine max
  Peptide Sequence Number=SeqID_175081
atgaggattttcctgagctttgacaagtttcttccccaacatgctctattcattagtcgagaagttggcccagcctggttcactgactatttccctactgtcgatccggacaatgaagaagaggtgaacgaaatatggtcattttacttgaatccacagatcctgtcttgtcgtacaggtgttcaatcgaactatttaggcctggttggataccagcctaatttggtttcaagacaatttggcctctcgcaaattcgtcctaaaagcttgttcgaagatcctcaagacgtcataagaggggccaatctttcggaaaagactttcaagaagtttttgaagatttctcttgatgaaaactatgacttgcatccttttgagttcaaccattcccacttctgcaccatggggtttattacctggtgggaaaaatattattcgactcgttcggttggagacactactaccatgatctccaggcttgagagtggctttgcacaaccaacggtcgagaatattcgctcaagccttcaagctcgaggcaaaacacccatgacgaagaggagtgctgaaacgtctcgagctgacgtaagacccaagaaacccactggggtgaaaatccaggaagggaaacaagaagagaaggaagaagaggagagacctcttataagaaaaagaaagttacctacgactcaaccaatctgctga

SEQ ID NO: 58304 - DNA, 373 bp, Glycine max
  Peptide Sequence Number=SeqID_175082
atggatttcgaaatctgccaaattgtgcatcaaaaagctgtcaaatttgtgcagcagaattgttcaacatgtgcagaaaatgcttgtgcattgctggttatgggaaagcttggaagggttgatggggacccgatgctgacaggaatgaggataaaggctacagagttgatttgcgccatcgcccgatcgccacctagtaccacatatgacggagtggtacctggagatatgtcgcgggggtcaggagaccttggggacgtcaggcgagctcctggcagtcaaccaataaaagaacaaaaaccacaaagcaaggagccttgtgtggtggctggccagctatggatcttgagtggtatctggaatttggcctctg

SEQ ID NO: 58305 - DNA, 231 bp, Glycine max
  Peptide Sequence Number=SeqID_175083
atgtacaaccctcctgaaaatccaagccaaggcgcttccgtaacgtttccatgggtgatttcgcgaagattttcagccgttcttcgaagttctttgttcgttcttcgtcgttcttcggtcttcaaccgtgaaactaaggctaaaatcgactcacaaaatcaagctttgtccgcaaaaatcactgaaaaaaacgttttaaggtccaacgcctcagcttttctcaccaagtaa

SEQ ID NO: 58306 - DNA, 390 bp, Glycine max
  Peptide Sequence Number=SeqID_175084
atgaacaagaccttgttggaaagggtcggatgcatgctatccaattcaaggttgaataggagttttcgggctaaggcaatcaacacaacatgttatctcttgaatcgctcagcatccactgcaatagattttaggacagttattaaggtatggtctaacaaacctgctaaatacttaatgttgaaggtgtttggatgtttagcatactatcacgtaaatgaagaatattcaggcaaggctaaggatgtcattaagcaagtggagtttgagagccctacaatcagaaatttttgtgaagaaaagcagtttgaagcaccagatgagactgatcaagatcttcaaatacaacctcaacatcaaaatttagcacaagttgaggagtttgaatga

SEQ ID NO: 58307 - DNA, 366 bp, Glycine max
  Peptide Sequence Number=SeqID_175085
atgtggatcttcaagaagaaatcagggtcgtctagtgataaagtcattaggtacaaagcacgtctggtagcgaaaggttctagtcagaaagaaggaatggactacaacgaggtcttctccccagtagttcgacatacttcaatacgtgttttactggctcttgtagcaactctggacatggagttagagcaactcgatgtccaaacaacctatcttcatggaagattggaggaagacattttgatgcaacaatctaaaggttttgaggtgcaagggaagaaaaattttgtctatatgttgaagaggtctctctataggttgaagcaattgcacatcaatttaacaaaactaactcaaagaatctag

SEQ ID NO: 58308 - DNA, 1071 bp, Glycine max
  Peptide Sequence Number=SeqID_175086
atgatgcttgacactgttcaaaacttttcagatgctacaggagttattaagaggactacaaattttgaagaggggcaatttcctattaggtacctgggggttcccttaacaagtaaaaagctcaccatcacccattatttgcctcttgttgagaagattgtgtgtagaaccaggcattggacagcgagattactcagtcatgcagggagaatacaattagtaaaaagtatttctttctctataacacaatattggatgttgtgttttccaattccaaaattcgtgttgaagaaaattgaagcaatctgcagatcattcatttggactggctgtagtgaggtgaagaagaaaagtccggtggcctgggagactgtgtgcagaccgaaatgtcaaggaggactggatattataaacttgactgtttggaatcaggttgatagccggagtcattggtcttggatgttcaacaatattttggatcaaagagagaaagtcaggctgaaacaggaatggaataatcagatgcagagggataaattctcgatgaaaaccatgtataacctgctaatggataaatctgatcgggtaccgtggagatttttgctgaaccataatattgcaaggccccgagctatagtgaatttatggttgacgtgtcatggtagaatggccacaaaagataggctgaaaagatttggaatgatcaaagaaaatcaatgtagtttatgtaaggagtctgaggaatctattgctcatctatttttttactgcaaaattacaaaatccatatgggatcagattcttaaatggattgaagttactcatgaacctaaaacttgggatgtagaactcaagtgggctattcgagaaactggaaagaaagggtggaaagctaaactcctgaaactagcactcactgaaactctttacgaggtgtggttatatagaaatgatgaagttttcaagaataatgtgaacagaaatatagtggataatatcatagataacatagtatacaggggctggtataacaataagcttagaaagcatatagtaactttgatgctatag

SEQ ID NO: 58309 - DNA, 348 bp, Glycine max
  Peptide Sequence Number=SeqID_175087
atgccttggaacgagaaaccaagaaggcccaaaaggaagaacacgtgccagcaaagttttgaggggctttatagggcagcaatagccatcatcgataagtgcaaagagaagctaaatctagcggcgactcacgagcaaaggctagaggatgagtacgccaagatatcagcagaaaggggaagtaagggaaaggaccgatttgctcttactttgaacaagagtcaagaacttccccgatttctagccaaggccaaagcaatggcggacacctactccgccccccaaggagatccacagacttctcagctattgtcaacatatgatagacttaatggaccatatgattag

SEQ ID NO: 58310 - DNA, 969 bp, Glycine max
  Peptide Sequence Number=SeqID_175088
atgaagtactttgtattgggtgcgctggcatccggtatgctgttatacgggatgagcatgctgtatggcatgactggtagcctggatgtaagcgatattgccaataatattgtgcagcagcctaagagtccggtgttaatcatgggcctggtgtttgtggtggccgggattgcgttcaagttcggtgctgtgccgttccagatgtgggtgccagatgtctatcagggctcgccgacgccgatgactttgctgatcggttcagtgcccaagctggccgcctatgcgatgacagtacgtttgttggtccaaggcctgcacccgttggcattggactggcaggatatgcttgttttaatggctgtgctgtctatcatcattggtaacttcagcgcgattgtacaaactaatctcaagcgcatgctggcgtactcaacgatctcgcatgttggctttatcatgtttggcatgatgagtgcgaatgccaatggctttgcttccagctttttctacattagcgcctatgtgctgatgtcgattgcaggctttggcatcatcctgttactgagtcgccaaggctttgaagctgaagaaatcaatgacctcaaaggcttgaatcagcgtcatccatggtttgctttcctgatgctggtcatcatgttcagtatggcaggcattccgccaaccataggtttttatgccaagtttactgtgctgcaagcggcatggcaggctgggtttacctggcaggttgtgctggcggtactcatggctaccattggtgccttctattacctcaatatcgtacgcaaaatgtattttgatgcgcctgaagatcacacgccgctcactgcacccgttgatatgcgctttattctcagtgtgcatgccctggctttgctgggcttgggcttattccctgaagtactgctcagtgtttgtggtcacagcctgttaatcagtttgcaatag

SEQ ID NO: 58311 - DNA, 641 bp, Glycine max
  Peptide Sequence Number=SeqID_175089
atgaagcagttaacccaggcggaacgcatagcgggcgcactttacggacagatgctgggcgacgcgctcggcatgccttccgagctgtggccgcgcgagcgggttaagcgccacttcggctggatagacggctttctcgacgggccggcggagaacaccgccgcctgttatttcaaggccgggcaatataccgacgataccgcgatggcattggcgttggccgatgcgctggtggaggcgcaaggcgaggtggtgccggagctgatcgcccgcaacgtgatccgctgggtggacggttttgacgctttcaacaagaacattctcggccccagttccaaattggcgctgagcgagcaaaaagcgggcacgccgatcgccgagttggaaaacaacggcatcaccaacggtgcggcgatgcgcatttcgcctttgggctgcgtgctgccttccgcgccgctggaggatttctgccgacaggtgtggctggcctgcagcccgacgcacaaatccgacatcgccgtcgccggtgcggtggcgatcgcctgggccgtggcgcgggcggtggaaggggctgactgggcctccattcgcctggcgttgccgggagtggcggagtatgcccagcgccggcaggagacgac

SEQ ID NO: 58312 - DNA, 177 bp, Glycine max
  Peptide Sequence Number=SeqID_175090
atgtgtctaccggggaaggggaaggaaacactgggttcaacaaaaatagaagaaaatcactcaaagtgtattaatctcacacagggcaaggtttatggtgagttgggacttcggctcaaggcttgtagaacgaatggacatgatatatgtcagggtgttggtctggttcagggataa

SEQ ID NO: 58313 - DNA, 249 bp, Glycine max
  Peptide Sequence Number=SeqID_175091
atgtctcggaacttcacgtattgtgcaacaaagggtgccaagtacctcgaagcggtcaaccaaaggctgcatgccatcaaacaatggtccccggacgaaattagggccatattggtttcgactcctgtgattacagcaccagactggggacaagagtttgaattgatgtgtgatgcaagtgattatgcagtagggtgtagtgtaggggcagcggaaggacaaaatgtttcataccatcaattatgctag

SEQ ID NO: 58314 - DNA, 267 bp, Glycine max
  Peptide Sequence Number=SeqID_175092
atgtcgtacaggatgttacgacatcacgcttcagaacatggatatcgtccaacacttgatgctagggtaccatcaaggtggctcacaaatgactcaagtcccaaaaactcacaaactaactcttcaatcccggacttggtacagaactcgtgcagcctccatgattatatagccgtgtacgattctgggctgcaactccttgatgctggaggagatctatcttcttctgaaaaatctgcagttaaagaactaaaagataacttttga

SEQ ID NO: 58315 - DNA, 213 bp, Glycine max
  Peptide Sequence Number=SeqID_175093
atggactggagcggtgtgcttagcgggattacccttcactcaacgcaaatgcacagctcatctttcttccagattcttcctcgcgctcagtcgaggagtgttgcgctcagcggatggctcgctaagccagaagattggcttaacgagcggatgaaaatcagctcttcacatacttgcctaattaacctaaaattgagaggaaatggttattaa

SEQ ID NO: 58316 - DNA, 447 bp, Glycine max
  Peptide Sequence Number=SeqID_175094
atggaaacaactaaatcaactaaaggagcactccaaattgtagaaatccaggttggtgagctggcagaagcagtgactcaatttatgttcagacgagaaaaatactttgtagaggttgaagctcaagagaaaagccctgtaaaagagcatgagtcaagagaaaaagatgaggaaaaagcacaacaacaatgggagaagtactcaacagtagagaaacaacaagaaaatattctccaaatcaataactttcctcatcaactgattatcaagaaagtaaggcaaggagaacatgaggaaaccttaagtgccattctttctttaatcactaacacctttcttgaaatgatttggaatgtacttccagactatatgaagttcatggaatttctagctaaaaggagaaacttcaaggaagatgtattctatgtgactttcatgccaccttga

SEQ ID NO: 58317 - DNA, 276 bp, Glycine max
  Peptide Sequence Number=SeqID_175095
atgacgaatcagaaagatcagcaattcctccaactggggaagcagggggtcaactccacttcatctgatgatgcgttagagatgacaatcagaggaggagatgggggaactgcttcaagctcaggagaagaaggtgaattcacccctggagattgtgggtcagctggctctggattgcctgcacagatgtgggctcaggcggagcagcctctttgggtctcaccaaaggaagttgatcttcagcccaggctactttctcaagaaaatgctccatag

SEQ ID NO: 58318 - DNA, 321 bp, Glycine max
  Peptide Sequence Number=SeqID_175096
atgatcatattctacaattttgtttttgcaatccatgttcctgatcatgacattagagcaacacatgcatggtatgactattctgggtatggacaatcatcagggaagccaagtgagcataatacatatttggacattgaggctgcaaataagtgtctagaagagatttatggtgccaagaaggaagacataatcctttatggacaatctgttggcagtatcccaactttggatcttgcaactaggttgcctcaattaagagttgttgttctgcacagtcccatactttctggcttaagggtcttgtatccagtaaaatga

SEQ ID NO: 58319 - DNA, 750 bp, Glycine max
  Peptide Sequence Number=SeqID_175097
atggcttcttcttcattaccaattctaagactagaaatcagaaagtctggcatctggatggattggataaggaggcttaaagtagcattaggtgcagccaggggtctggcctatcttcatgaacttgctgatccacctatcatacacagggacataaaatcaagcaatatcctacttgatcatcacctcaatgcaaaagttgcagattttggtctctctaaacttcttgttgatagtgaaaggggccatgtcactactcaagtgaaagggacaatgggttacttggatcctgaatattacatgacccagcagttgactgaaaagagtgatgtatatagctttggagtgctaatgctagaactagcaacagcaagaaggccaatagagcaaggaaagtatattgtaagagaggtaatgagggtaatggacacatcaaaagatttatacaaccttcattccattctagacccaaccataatgaaagcaacaagaccaaaaggtttagaaaagtttgtgatgttggcaatgagatgcgtcaaagaatatgcagcagagaggcctacaatggctgaggttgtaaaagagatcgagagcatgattgagcttgttggattgaaccccaattctgaatcagctacaacatcagaaacttatgtggaagcaggtgtaggaaatgcccaacatccttaccgggaagaagattttagctatagtggaatttttccatccacaagggtagaaccccaatag

SEQ ID NO: 58320 - DNA, 1731 bp, Glycine max
  Peptide Sequence Number=SeqID_175098
atggaccaacaacataaagtgattcctctgctgctgcttcttttccaagttctgcttgtagcatcacagacagatagtcaagattattctggcctaaattctcttacggaatcctggagttacaagccacaaaattgggtgggtccagatccttgtggcagtggatgggatggaattcgttgcagcaattcaagaattacccaattgagactgccaggcttgaatttgggaggccagctgtcttcggcaattcagtctttatctgaactagatactctgaaaatcaaaacggatggagttatgtgtaatttgataaaagttcaggagaataaccacccaaaaggacattttattttgactaggctaattgtggatggcatgcaatactcagttgaagctcacttaataacaagatcattggttggttgtggtttctctggtcgtattccggattcaataggatctttaaagcagctgacatttctagcacttaattctaataatttcagtggaactataccacggtctcttggcaatctatcaaatgttgattggcttgatcttgctgaaaaccagcttgaagggactattcctgtctctgatgaccaaggaagaccaggccttgaccttctccttaaggcacaccactttcatatggggagcaataagctcactggtacaataccagaaaaactttttaactccaatatgattctcgaacacgtgcttttcgaccacaatcaactagagggtggcattcctagatcccttagtactgtgagcacattggaagttgtgcgctttgataagaatggattaactgggggagtgcctgcaaacttaaacaaactcggaaaactaagtgagatggacctgagtgacaatgatttcaatgcttctgatattccctcatgggttacaactctgccaggactaacaacagtaatacttgggcagaaccggctcggtggcgcattaaatctcagtcgctacagcagtagtctgcaactcatgaatttggaagataatgaaataacagaacttgacccagaaaacaactcaccaacttttgagctaagactagctaacaacccactttgtcgtgaaagtggagcttctgaaaggagttactgcaaagttccagtacccaatccctcattttattcaacaccaacaaataattgtttaccttcaccttgcggttctgatcaggtttcgagcccaaattgtaaatgtgcatttccctattctggacttcttatatcaagagctcttagtttctcaaacttcagtaatgcaagttactatagggagcttgagcagtctctgatggatacttttcgaaaccaaagcattccagtggattcagtttctcttagtaaccccttcaggaatactattgataattttgaattgactctggacgtcttcccttcgcaaaccgatcgcttcaacacaactggagttttaactattgcttttctgctaagcaaccaaatttacaaacccccagaattcttctccccttacatcttcaagggtgccaattatgaatactatggaggagaaccaaaaggatcaaagtcatcatcacatgtaggggttatagttggtgctgtagttgctgttgtggtctttgttgttctagcattctttgcagggatgtatgcccttcgccagaaaagaagagcaagaagatctgcagagttgaacccttttggtaagaagtga

SEQ ID NO: 58321 - DNA, 918 bp, Glycine max
  Peptide Sequence Number=SeqID_175099
atggtttttgaaaaccgctttgaaatacttcaaaacaaagacgatgaacctcagaagacttggaaccgcgtgaggtctcccaagaatcgccgcagacacgttagggttcgcaatcagatacgccaacgacctcgcgtactccgcctaggtgtcgccgccgccactgactccagcagccagtccacgacggcgccgccgccttccccgttgatcgtggccctgcgggcggagttcgcggtggcgatgtccgcaagaagcgccgtgacacgaatctcaaagtcggagcggacctcgtggttcaccgaggatagcaccgagcgcaatgactgccagagtaccgcggcggcgacgccggtgtgcttcgcgtggtggaaaatccgatcgaaggagttcgctgccttgcgcacggcgcgctctgcgccctcatgtagaggattcgtgcctctttcgctgcgatataattttctcatgtgccaatacagagacaaagaagctccaaaattaactgaaagtggtttccagtttttgctgatggatacaaatgcacagctttggtacattatcagagaatatatctctaattctgagatagaggtgttgatgcagctgaccttatctcattcatgctggaatcagttttcatggcataggatggcttattcttctcctcctatttccttctttccttctaataaaatttactctttaaaaaaaagggtagagtatcaacttccaaatcttattgttggggctattacgaaagaaagcttgtatagtgcttttgaaaatgtcattgtagcagagcagatagatggtaatgatttatttcttcctatgcttttgctaggaataaggggcctacttgtcaagtttctcctaaagcaagcaagtgttgacaagagagcaagcaagtgttga

SEQ ID NO: 58322 - DNA, 576 bp, Glycine max
  Peptide Sequence Number=SeqID_175100
atggctggagggagcccaaaagcccaccatctccttcaagcaactcaaccaaacccgccattgctgggacgagaagatgaacctcagaagactcggaaccgcgtgaggtctcccaagaacggccgcagacatgttagggttcgcaataagatacgccaacgccctcgcgtactccgcctaggtgtcgccgccgccactgactcgagcagccagtccacgacggcgccgccgccttccccgttgatcgtggccctgcgggcggagttcacggtggcgatgtccgcaagaagcgccgtgacacgaatctcaaagtcggagcggacctcgtggttcaccgaggatagcaccgagcgcaacaactgccagagtaccgtggcagcgacgccggtgtgcttcgcgtggtggaaaatccggtcgaaggagttcgctgccttgcgcacgacgcgccctcatctgatggatacaaatgcacagctttggtacattatcagagaatatatctctaattttgaggatagaggtgttgatgcagctgaccttatctcattcatgctggaatcagttttcatggcatag

SEQ ID NO: 58323 - DNA, 1104 bp, Glycine max
  Peptide Sequence Number=SeqID_175101
atggaggttctgtacacgaagctctatgacaagtacaccagactcaagtctaacaaactctctgatttggatcacctcaacgaagaacaacaactcaaattcagaaacttctcgtccgctgcggaagagttgatagagcacttgatgaccgaaaaggaagagcttcttggacaagtccatcatttgagaaccgaactcgcttcgcttagggctgccaaagacaaccaggttgccgattatcagaggcttttggctgaggaaacccgcaaaaatgaagctcttgccgaagaagttgagaaattgctgaagcttcgccaggaaggagcatgtcatgatttaaattataacagtaagatcatgactgtagatggtcagtttaaggctaactctaacagctcatctataagaatgacaagaaaacgtacaaggcaaaatactttggagaaagaagcaaggtttatatcttttgaaaatgatcaaggtaattctgtggagagagagtcaatggaaaacatttgcaaggacactacttctggtaaggcattgatttacaggaaagtggtcatgatggttgtcggtcaagataggataagcaagataaaagtagaaaaggaaacaaacatgattagctcttatcctatcaagtgtgatacagatagagatcatagatgctcaatgagcctaaaaacacagtgcgaaaagatcgagagaaggggtgttgatgctttgcagtttgcacattatctctacctcaaacagataaatggttactccttcagtatatcgtggattagcaaatcccctgaagaggaagcagaactgctgtaccatgtttcatctctaggtacatttgaaagagtagcaccagaatggatgagggaggacatcatgttcagccctagcatgtaccccatattctttgaaaggccgttaagaatcaaggatgcttcgctttggtcaagaaaattaggcagcttatggctcttggagatcatgttcattgcaatcatattagaagggaagcaaaccaggaaaatgataaaagacaacgatgaaaccaaagtaggcttggccggtaacaagaacgaaggctggcatgtgtaa

SEQ ID NO: 58324 - DNA, 1812 bp, Glycine max
  Peptide Sequence Number=SeqID_175102
atggccgcttcctcactgttttcccctgttctcccctacaccaaattctcctcctcaactctgcgcttcacgaactcaaaaaattccatctttgccctctcgtgttcttctccgaagagcattcctgtgacggagaaggaggtgctccaagccatagctgactccgacggcaagaacctcccatgcgtcagaacctacgacaacgacctgtctcagctcactctcgtcggaaccgtcgatttcaaccaagctttgacggccgccgccgccgacggcggtgaagtcgcctccgatcacatcgacgccggcttggacgccatggtcgtcgaaaccgtgttccctgctccttctagcgaccacgccactgtctccactcgactgttcttacctgctaggaaagttaaagaaaaagccactaagctcaggaagtctttccccaaagatgcattttctggctctgcgtctaagaatgtacttgctatgacctttagacaagtagttttgcaacagatttggagctttgacctaaccgtctttcaaccaggagaggaacggaagatggatgatcttgaaacaccgagagaggttcatgcatcttttgctctcagctcatccgatgaatatcttatctcagtgcttgcagaagccatttgcatatctgcacttcaaagcacccaaatacaatttcttgacaaagcaaaaggtggtaatagaggtggtttctttcgctggtttcagaagcctgaaagtgtacaatcaaaagattctgcaattatcttatccaaattatttgaagatgagatagttgaaaatgctaggagtctattggataactataatttaatgaaggatggcttcaagcctgtgaaaattaagtcagggcatcattggtggaagccatcatgttatgaaaagttggagaaaattggtggttctgatttcagtgcttgggcaagtgagtatgtacctgcatatcggttagagattgacacgaagatagtgggagattccaaaattgaaggttggaagaagtctgcagaaaataggtgggaagttcttttgacccactctcaaatggttcagttggctgaaacactagatatatactatgtggatccttattcgctaccttataaacaattatcctgtggtgtggctgccaagtttgcaaacgtgtacaataaaaaggggaattcttttccaaaattgttgtcattcgcccttgcaagtggtatatttcttgtagcaattagtgctctgggtcaattttgtttgccttggttatgcaaggaaaggaaacactctgtagaacatagatctctaccatcatcggaagtgaatgttgcaatgaatgacttttttgatacaaaaaagttggaagagtgttgtgtgttagctattgctaaggtaaaggacacttttggctggttgggtgaaattaaggtggaggatggtattggtgtctggattggagaattgccagcttacttgagaggtgaaggtgttgatacactttctacttcagagaatatagatgcagatgcaaaagtgcccatacaagacattgctagttaccaggtggttttctctagtgagaggaagatagttggttttcaacctttgagtcgtgttgctgtcaatcattgggctgctaatcctttagcaagggagctatatagagggaaaaaactttctccaagcctcattgaaccaggtctcaaggtgccccttcctgaaaaagttatcgttgtagagttattaatgtcgataaatccagatgcatattttgctctagccaggcgattccggtga

SEQ ID NO: 58325 - DNA, 147 bp, Glycine max
  Peptide Sequence Number=SeqID_175103
atggagaggaagatgactaagttcagcaggcctgctccagagattgaaggccttgtggctgctagtggactaagtcctctgatcgcatgttccctaaatacaggcgatcgagaattttatgtctgcttttgtggaacgctgacataa

SEQ ID NO: 58326 - DNA, 669 bp, Glycine max
  Peptide Sequence Number=SeqID_175104
atgaccccagttctaagacctgggggaattggactcaaggataatttactttttgctgctcttagtgcaaaggcacaaggaaaagttgttggaatcccagaatgtgagggagcagcaaccgcaaaatctccatggaatgcacctgagctctttgatatatgtgttctagagggtgagactattagggagtggctattctttgataagcctagaagggcatttgagagtggaaacagaaagcagaggtcactgccggattatagcgggcgtggatggcacgagtctagaaagcaagtgatgaacgaatttggagggctgaagagatcctattacatggaccctcaacctttgaacctttttgagtggcacctttatgagtatgaaattagcaagtgcgatgtgtgcgccttataccggttggaactaaagctggtcgatgggaagaagagctccaaggcaaagatagtaacaggtgattcagttgctgatcttcagaagcacatgggaagcctctctgccaaaggtagtagaaccaagcttggcataggaggtggtgtttattcagcttctaacagagttgctctactaaatgcaccttatcaatacggcttaacttcaccatatgatgactatgttgttcacaacacattagactattatgtgacatga

SEQ ID NO: 58327 - DNA, 210 bp, Glycine max
  Peptide Sequence Number=SeqID_175105
atggcagcagtgtcgaatgccgcctctcatttttggggttcttttggcagtgacatgaagaacttgataggggaagctatctgtgggatatgccaagagagctttagcactacaatcacagctttatcagagccaatagacatatacagtgagtggattgatgaatgtgaactggtgaaccacccggatgatgatggtgctgagcactga

SEQ ID NO: 58328 - DNA, 481 bp, Glycine max
  Peptide Sequence Number=SeqID_175106
atgaagaaaatttccaagagcagctgcaagttagcatcacacaggctctttaaggacaaggcaaggaaccatgttgatgatctgcaggagagccgtactattgatgctgcacttctggaggagcaagtccatcagatgcttcgtgagtggaaggctgagcttaacgagccatctcctgcttcctctttgcagcaaggtggcagtcttggttcattctctaccgatgtctataggctattgcagctctgtgaggaggaagatgatgccactagtccattagttgcacctaagcctgaacctaatgatcagattatgcaggctggggctaaggtgatagtccaagagggtcaacatcaacaggaattactattacttaaggaatgcaaacccttcactgtaggatttcccaacttggatggaactgctttagagtatcaccaatttgatatcaataaggatatggatgacagcttctatgctg

SEQ ID NO: 58329 - DNA, 216 bp, Glycine max
  Peptide Sequence Number=SeqID_175107
atggctcagtgttataggcaatttgtgaagggaggcctgtcatggtgtcgccatgaggctgtgaagcaaaaaaatgaaaacttggcagaagaagtagaacttcttaagcatataattcaagaactggaacagatggccaggggacgaggattgactggcattctaaacttcagacatggtaacacagaaattggaaaggcagagaaaactgcttga

SEQ ID NO: 58330 - DNA, 304 bp, Glycine max
  Peptide Sequence Number=SeqID_175108
atgaagaaaagaacaaatgcctcacaaaaccaaaaagccaaggttggaaaaaatcatccaaatcaccattggacatgcactaatgaagcagcatggtgcactccatatgcatgttgctgcaacagcgcatcacgtcccgtacctcttgccaccatcgccttttgccatcaaccccctctcatgacctccacaacaactccttactggatgaggattgggattaggattaagtatgcgttggaaatagaggggagggacagttttgggttttgcaatagaagtattagaggaggggaagccaaaa

SEQ ID NO: 58331 - DNA, 1425 bp, Glycine max
  Peptide Sequence Number=SeqID_175109
atggaggttcaaactcacaccttggacattcatcagccccaatttcggagctctgaatacccgaatccgacattcccacactcccttcatgacccgccaatacaaacactcactcacgcgccgggacgcgcgtgcccccagacaaacgccgccctcaaggtgcaaaaggtctaccggagttaccgcacacggcggaggttggctgattccgctgtcgtcgccgaggagctctggtggcaagtgattgatttcgcgaggctaaaccacagcaccatttcgttcttcaatttgccagagagtgctgcgtcacggtggagtagggtcaaactcaacgcttccaaggtgggaaagggtttgtccttggacgccaaagcacaaaaattggcttttcaacattggattgaagctattgatccgcgtcaccgctacgggcacaacttgcattattactatgaagaatggtgcaaaacggattctggccagccattcttttattggttggatttgggaaatggaaaaaatattgatcttgaacaatgccccagatcgaagctccgaaagcaatgcataaagtatctaggacctcaagagagagagcactatgaatacattgtctgtgaggggaatattatccacaagcaatctggagattttcttcacacaagagaagattctaaggatgccaagtggatatttgttatgagcacctctaagaaactttatgctggcaagaaaaagaagggattattccatcattcatcttttttggctggtggagctaccgtggctgctggaaggctggaggctgagcatggcattcttaagtccatctctgcatatagtggacactaccggccaacgaatgacgcgctcaactccttcatatcatatctcaaggaaaatggtgtcgacattgatgaagttgagatacgcaatccaaaagatgataccgatatttacgaggacgggaagcttagtgaaatagccacagcacctgaagattctagcaatggtaatatacctgagcttggagtttctgaggaagctgacaacacgacatcctcaaatacggaagagcctcaacttggatctgttggaagttacaaaaggactctctctggtggtcttcagagtccaagagctgatgtgcccaagaaagcaatattgcaaagaatcaattccaagaaggccacaaaatcctaccaattgggacatcaactttcacatagatggtcaactggggcaggacctagaattgggtgtgttgctgactaccctgtagagcttagactacaggccttggaaatgcttaacctttctccaaaagttcctccttctccttcctcatacaggttagtgggtggtcttgtgccacctacgaccaatggcactagaattgacactgatgagaattctgttcattga

SEQ ID NO: 58332 - DNA, 1227 bp, Glycine max
  Peptide Sequence Number=SeqID_175110
atggcttcttctaatagacactggccaagcatgttcaagtccaagccctgcaaccctcaccaccaatggcagcatgacatcaactcctccctcatctccactagctgccacagaagcccttactcttccggaggaggtggtggttgtgaggagagaagtccagagccaaagccaaggtggaacccaaaacctgagcaaatccgaatactggaggctatattcaactctggaatggtgaatcctccgagggatgagataaggaagataagggcacagttgcaagagtatgggcaagtgggtgatgccaatgtcttctattggttccagaaccgcaagtccaggagcaagcacaagcttcgccatctccaaaactcatcatcaaagaacctgaaccaccatcaccaccttgttgatcaaaatcatcatactcccacttctctccctcaaaccgctactactgcaccctcatcctcatcatcttcatcgtctgagaaatcttccccaaaagagcttataatacctaccaccaaggtgttctccattggattctccgatgtgatgcctaattctcccactgcttctgtgaaccagacctattttcagacccgaattaatgagtccattatgcttccgtcaccaccaccaccagttgaggctttcttcttcccagtgcaacaacaacatcatggagtaacatcatcatcacaagggttttgcttctctgagctgtccaatgttgttcatcaacacaacagcgttggtccttgcactagcctcttgcttagtgagatcgtaggccatggtgttgcttctgcttctgcctcaaagaaagacaagtctcaggtgaaaataatgcaccagccctcactgcttaatttctgtgtcaccactccaacaacaacagctccttctactacaaccactgttgttgtacctcccatcactactacctcctctactactgttccatcccccctcatgcatcaacttcaaggtattggagatccaggtggtgcggcgagatcaatggtgttcattaacgatgtggcattcgaggtggctttggggcccttcaatgtgcgtgaagcctttggagatgatgctgtgctcatccatgccagcactggtcaacctgtgctaacaaaccaatggggtctcactcttcattcactccagcatggcgcttgttattatttggtgcgcaagatagccctatccctcgtttaa

SEQ ID NO: 58333 - DNA, 840 bp, Glycine max
  Peptide Sequence Number=SeqID_175111
ttcgtcgaacagcacgtcggacttcacttcgaattcggcgatgacttcgccgttcttgatggccttgctttcataggggcgcagctcgaccacgtcgcccatttccatcttggaaacgtcgagttcgatcggcagggcgccggcgtcttccatggtgttgtagaagatcggggcgatcttgttgcccaggcacacgccgccgaaacgcttgttcggcacgaaggggatgtcttcgccggtgaaccacagcaccgagttggtggccgacttgcgcgaggagccggtgccgaccacgtcgccgacgtaggcgaccaggtggcccttttccttcagcgattcgatgaacttcacgggaccgcgcttgccgtcttcttccggttggaaggcggcgccgtcgcgcttgttcttgagcatcgccagggcgtgcatcgggatgtcggggcgggtggtggcgtccggggccggcgacaggtcgtcggtgttggtttcgccgggcaccttgaagaccgtgatggtcaggctttcgggcagttcggggcggctggtgaaccactcggcgtcggcccagctctgcatcacggacttggcgttggcgttgcccttgtcggccttttccttgacgtcgtggaaggcgtcgaacatcagcagggtctttttcagggcgtcggcggcgatcgtgccgatttccttgtcgtcgagcagttggaccagcgggccaatgttgtagccgcccagcatggtgccgagcagttcggtcgccttggcgcggctgatcagggcacaagcttcggtgcccagggccacggcggccagatacgaggccttgaccttggcggcatc

SEQ ID NO: 58334 - DNA, 607 bp, Glycine max
  Peptide Sequence Number=SeqID_175112
atggaaatggacttgaaagaaaattgtacttatgtcatgcacaattttaaagtgcttagagacaatggtcagtacagagtgtgtgatcatcaatttaaattggtgtttattggggttactgttgtgagggagtgtgttctaggggacatcccttttagaaaatacaggtttgctggatttgcagatgttgtggatgaccagtttgaacgtggactattggttgatgttattggtgttgtggaggaggttgtctttcggcaagtttcaggaaaaggtagaagggtagtcttcaaattaaaggacttgagtcagcaattgctatcttgcactttgtgggatgattattgcttgcagtttttgaagttcttagatgattatgaaggtgatgacccaattatagttctattaagccattgtaggatcaaggaagcgcagggatcttgtccggcatcgataaacaattctttcaaggcttcaaagttaattattaaccagcccgtgatggagcttcaagaattcaatgaacgctattttttgcttgtagagttgggcattgaggcccggtcaggttttaaatcccatggtgaagggagtacacaactttcag

SEQ ID NO: 58335 - DNA, 912 bp, Glycine max
  Peptide Sequence Number=SeqID_175113
atgccgggctttatgccgccgaaaaaatcggtacgcgatgcgttgattgacctgcaggcccatcagttagggatgatctcggggatccgcgccattattgccgcgatgctgcagtcctttaatcccgagcagctggaagaagaggctaagcgcgatggccatacttcgcgcctggcgcttccggccagccgcaaagcggcgttatgggactattttgtccgtacctacggcgaaaccgccggggaaattgaagacgatttccacaccctgtttggcgaagcgttcctctatgcctatgacatggaaggaacgcgcgccagcaatcaggatcagaccggcgaatgcgtgggtgagcgctccgcctgctttgtggtctgcgacggcattgccgggttgcccggcggcgaggtggcggcggaactggcgcgcaacgcgattctggatcagtttgacggcgataatcatctgaacgcccagaccattcgccagtatgtacagcaggccaacggcgccattctccagcaacagcaggcgacgccggattatcggcgaatgggcactactctggtgagcctgtttatcgatcgcgattataagctggcctattgggcccacgccggtgatagccggttatacctgtttcgccgcggctggctgtaccacgtcaccactgaccacagtctggtccaacagatgaaagatgccggacatcagaccgacgatattaacagcaacctgctgtaccgggcgttaggcatggccagcgacggtgcggaagccagctatagcgatgtggtgccggtcgaagatggcgatgcctttttgctctgtaccgacggtttctggcacggcgtcggcgaagagcagatgaaatcctccctgcagatggtcaacaccccgcagagtggttaa

SEQ ID NO: 58336 - DNA, 720 bp, Glycine max
  Peptide Sequence Number=SeqID_175114
atgtcatgttcatttcttgtgaattatgcgcaaatacatagtttcgtacattgcttgcagatttcagctgctgaatttacttttcctccttggctttcttttagtgccaggaaattgataactaaaatcttggatcccaaccccatgactcgtatcactgtaccagagattttgcgtgatgaatggtttaagaaagactataaacctccagctttcgaggagacaaaggagactaatgttgatgatgtggaagctgtctttaaagattataaatattgcccacatagtagtttcatattaaggatttttcccaaaaatgcagctgcacaatgtaagagagaagagcaaccaacacctatggacgcatttgaattgatatccttgtccaaagggctgaaccttcaaaacttgtttgacatagaccagggatttaaaagggaaataaggttcacatcaaaatgccctgccaatgagataatcaagaagattgaagaagctgcaaaacctcttggttttgatgtgcagaagaaaaatttcaagatgaagcttgaaaatgtgaaagctggaagaaagggaaacctcaatgttgccacagcgatatttcaagggacaccttctcttcacgtggttaaggggcataaggcaaaaggtgatacattagagttccttaaggcatcctttgtaggaaaaaggttgttcaacaaacacattgcggaataa

SEQ ID NO: 58337 - DNA, 401 bp, Glycine max
  Peptide Sequence Number=SeqID_175115
cagagacaaaatttggtcattctgcacccttgtatcatccagaggcggcgggcccgatgatacgcggagataccttacggttatccgcacccttttgtcatccagaggcggcgggcccgatgacaagcagagacaaaatttggtcattctgcacccttgtatcatctagaggcggcgggcccgatgatacgcggagataccttacggttatctgcacccttgtgtcatccagaggcggcgggcccgatgatacgcggaaatacccgagtggttatccgaacgacaagtcatggtcacccgagactctcgtcaaccgagaggagcgaaatgagtgtcgtacactgattttcgtccagggacctttgcttgatgacatgcgaccattctttggtccttgtgag

SEQ ID NO: 58338 - DNA, 315 bp, Glycine max
  Peptide Sequence Number=SeqID_175116
atgggctcagaaatctaccctaaggttcaggagaaccctagggccttcttcagcagctctagcccaatcctcttggagcctcttactcatggctctagtgactggtcccttcctagggaggattgcatcagtctagtcatacatgagggatctgcagacgaaactcagtttaaacgaagcttggatattcagcctgacgagggatcgaggctaagcgcacattgctacgctaagccgaacatcttcactgtaagttgcaccttaagcaatgggcttaacgtggatgatgtgctaagtgccacttcctctttgtga

SEQ ID NO: 58339 - DNA, 585 bp, Glycine max
  Peptide Sequence Number=SeqID_175117
atggcttctaggaaaagaaaggcaccctctacacctacccaagccagaattgacagatcaagattcacattccaggaagcttgggtgagatacacagacattattgtgcctaggaaattgctacttgagagaaatgtggtggtctacaccacaaaatttgatgaattcctagatgagctggatagaagacactggagagaggagttgactgactttctggatagcaatattgatgttgccattgtaaaagaattctatgcaaacctctatgcccccgaggacaaatcacctaagcaggtgagggtgagaggtcatttgattaagtttgatgaggatactcttaacacatttttgaagacccctgttgttatggaagagggggaaacactttgtgcttactctagatttgcactcttgaggcctgatcctcaagagttagctgctaagttctgtatcccagggagattcgagcttaatgctgatgggcagtccttgaagattctgaggaagaacatgaccactcttgctcatacttggagcattctttccatttcaaaccttattcccacttcccacacttctgat

SEQ ID NO: 58340 - DNA, 282 bp, Glycine max
  Peptide Sequence Number=SeqID_175118
atgaattgcagggatggaaaagccgtatgcatcaatacgcagaaaatgcttgtacgggtaatgatccaccaacccgctagttctttttatgaggcactaacgggagaatttatcctggaagcggaagagctactgaatatgcgtgatactatcactagggtttatgtactaagaacgggcatacctttatgggttatatccgaagacatggaaagggatgtttttatgtcagcagcagaagcccaagctcacggaattgtagatcttgtagccgttgaataa

SEQ ID NO: 58341 - DNA, 456 bp, Glycine max
  Peptide Sequence Number=SeqID_175119
atgggattgagtcaggcgccttcgcttaaaaagaggttctatcaagtcaaggtcaagagcctaggagtcgctggtctgaaagagttaggacagttgatgggtcaactccaacaacaagcttttcacaaagcttacggtaagatctgggacctagccatggtagaggtctccacagaggccattgcctccctcgcccaatattatgaccagcctttgaggtgcttcacctttggggacttccagttatcacccacggtggaagagtttgaagaaatcctgggatgccctctgggaggaaggaaaccatacctcttctcgagattctatccttctttagctagaatttctaagatagtccaagtctcgacgcaggaattagatcgcggaaagcaagttgaaatggggtggttggagtaccaaggaaatgttaagaagcaaaagcaagagtcttggcag

SEQ ID NO: 58342 - DNA, 394 bp, Glycine max
  Peptide Sequence Number=SeqID_175120
atggctacaccacccagctcccctcctcctcatcctgagtcagcaaaaccttcgtcgtctacgtcgaagaagacaagaaaagaaacacggcttaaatcattggctactagactagttggggcagagagaccaatggttcatgtggatcctgccattgggaaagttgatgatttgaccttcaaatgggctctggcagacgacaaagaggacgaggacgataaagtatgtgaaaagtatgacataagttatgattatctagaagaaaagttgatggaggacaagaaaaagaaacgactggaggaagcaacccgatctggcagcactcacacaatcgttgatcctccatctctcattagacaacatgtgaagtggatggcccgcacgaaaaaatctg

SEQ ID NO: 58343 - DNA, 351 bp, Glycine max
  Peptide Sequence Number=SeqID_175121
atgtatccttgcatgtcaaattcgtccaggacttcttcttcttctactgtagtagaagttggtgatgagttattggctgtttcaaatgaatttgataagcttctgggtgtaacaagtgttggaacatgctcattatgtgagcataaccaatacaaccaaaaatctggaagtagtctacaaccgatttccttccaccccaagcctcctcgggacagtaaatccagtgtgatgagaatcctgaaattgaccaaatacaggctaaaggcccaagtggagaaggacgaaggcccaagtggagaaggacaaagcccccaagtggagaaggatgaaggcccaagtggagaaagatga

SEQ ID NO: 58344 - DNA, 549 bp, Glycine max
  Peptide Sequence Number=SeqID_175122
atggcagtgatctttgtacaagtgaaagggcaaggaaagagtagcaagcacttgcatgttgaggagaaagaagactttattgccatggatgagaacaagaagtggatgcataaagaaactgaaagacaaagaaggcaagagatgggaaaactctgcgccacccttagatcgcttctgcctttagaatatattaagggaaaacgctcaacctctgattatgtgaatgaggctatgaattatatcaaccacctacaaaataaggtgaagcaattgcaagcaaagagggatgagttagtgaaggtgtctaatttgaagagtaatatttgttctgagaatgaaagctctagcagtagcactactcatcttccacccttggtttctgttcatcctttcccgggaggacttgagattatgtgcggttacagcttcgggaaaagtgtgtttcccatgtcaagagtgttggacattctgcttaaagaagggattaatgtggttagcactacttcaatcagaagagatggaagattcatacacactatacgatcagag

SEQ ID NO: 58345 - DNA, 648 bp, Glycine max
  Peptide Sequence Number=SeqID_175123
atggatgatgaaataaattccattgaaaagaatgacatatgggagatgtgtgatctacttaaaggtcagaataccattggtgtaaaatgggtcttcaagaaaaagctaaacaaggatggtgatgtggacaagtataaagcacgcttggtggcaaaagggtacaagcagcactacatgaatgattatacaaaagtattttctcccgttgcaagacatgactcaattcgattggtggttgcattagcggcacatgcaaaatcttttcccattttccagctagatatcaaatggacattcttgcatggatatttggaggaacatgtatttattgatcaaccccctaactatgttaaggttggatatgaaaataaagtttatagattgaagagagctctttattggttaaagcaagtcccaagggtctggtttcaaatgaagaattgcaatgctgtaagtactatagttgagtgtggcataaaactacataaagatcacgatggaaagaaggttggcaacatactttacaagcaaattgtaggcagcttaatgtatcttactacaactaggctagacataatgtattttgtgtcgttttgtggtcatctaaaaagcaaccaattgtcaccttgccaagccaaatatggttga

SEQ ID NO: 58346 - DNA, 822 bp, Glycine max
  Peptide Sequence Number=SeqID_175124
atgaatctgcttccttcagcccccatatccaaagttgatgatagtttagagcactcattgagttttgagagtaccatgtttcctttacaacgaggcaatgagctggttatccagttttctaatagcccccaccatcacctgcaacacaaaatgtcccaagatctgattctggatgattatgcttctctggatgtcaatgattccaaccaaaaattcagcactagtagcatcagccaaccaacaaagaaacttttctatggggcaaataaaaagaatcatgactactctaacgaacataagaagaagatgattcataaggagattgagaggcaaaggagacaagaaatggctaccttctatgcctctcttagatcccttctccctcttgagttcatcaagggaaagcgttcaatatctgaccacatgaacgaggcagtgaattacataaagcacatgcagaaacatatcaaagagcttggtgccaagagagatgaactgaagaaactctccaatcattccaataatatggaaaataaccatgagggcttgcatacatcttgcaacttcactgtccacgagaaaaatggtattatgggaatagaaatcaccagtgtcttcagagaggaaaagcctaaaatttcaaagttactacagtttttgactgaagaaggacttgaagttgttagtttcttttcaacagaagtcaatggcagattgctccacagtgtgcagtgtgaggtgaaccattccaacagtgtagatccatctgagctgagaaagaaagtttccaaagcattttcaacctttagatgctctgattga

SEQ ID NO: 58347 - DNA, 1197 bp, Glycine max
  Peptide Sequence Number=SeqID_175125
atgacagtgcctttgtgcattttggcgctcaaacgaagtcctgtaggtaagttttctaggctgctattgctatcaatacccaccgctagaaaaccaaccttgtcctcaaggttagacaataaaacaagtagaaacaggggtgagtttaggaaacaaaagggttacctcagcaccagcttgcaatgcctccatgaacgccttggtcccggaacgtgcaatggtaccactgttgttcaccaaatctgctttggtcattccaatgtcgcggtcaataatggaaagagtcttgttggctttgtcgggcacaagacgaatgaagaaatttggttgagcatcgagcttgctcttgtcagaatgatcctccacaatttttactgcaacaacgatataatccccttgaggcggtggcttcggaggtggtggtggatgtggcggtgggcgtcaacgccggtgaggaacaaaacaaagttgagtcatagtagcagagagaacccaaatccaacgcggatgaatctggtgcgcgacgacggtgtccctgagcaggatgatgtcgttgtcatagaggatcttgtggtaatggtggtggtcggtgcagagcggcagaggcagcagttggttgggctggatgtggcagttgatgtcgagacggtggtgctgccacaatctaacggggaagtaggtggtgccagaatcgattccggtagcaggaccatctccttgtccatccatgggaaacgaagtcgggatgggtgtggggttttattgcctgggtgtggggcatggaatcgcaggcggcataggaaggggaggaggaacatgggagtgcggtatcgcaagtggcattgggcagtttgggtttccccattcctaaggataaagctgaggaggaggcacgtgaggttgagacgaaggagagtactggctggggtgttttcggctaaggagatcgagtttgaagagcatggaggcgtggaacacatcaagatgaagttgagatccatggagagtgaaatccatggaagtttgggctgcggcgaggttggccatggcggcctcgaggcggtccaggctggcggcgaaaggatcggcatctgccatggaaaagcgacaaagaaggggcaagtcggactaattgatacgaacaacgctactctaatgctaccgttatactaccaagaaactaagaaggaacactaa

SEQ ID NO: 58348 - DNA, 2075 bp, Glycine max
  Peptide Sequence Number=SeqID_175126
acatacccgacccgtacccgtttccgcagcaaccgccacgtcatcaccaccaccatcactttctcactcctctccttgccgccaccgtctcaacatgctcccttctcctcctcctcatcctcttctgccaccgcaccctcacccgcaaacgcgccaccacccacctcccttctccggccgccacctccccaccgcaccgcctctccttctccgtcctccgccgcgccaccaactccttctccacgcgcctcggccacggcggcttcggccccgtcttcgctggcacccttgccggcgcccccgtcgccgtcaagctcatggactccaacaccaatcaccaacagggcgagcgcgagttccacaacgaactcttcttcgcctcgaagctcctctcccgccacgtcatcaccgccacgcacttctcctccgatcctaaacgacgccatttcctcttggtctacgagctcatgcaaaacggcaacctccaagacgcgcttttgcaccgcaagtgccccgaactcttaaactggaacacgcgcttctcaattatcctcaacgtagggaaaggtattcactttcttcactcctatgacccccctgtaattcatggagacataaaaccgagtaacgttttgcttgatcgcgatttctggccgaggattggggactttgggcttgcgaggttgagctcggatactccgaggtttgaagttgaggttctggaatgtgggagtgttgataatgatgaagagaagatgaagacgaagaagaaggaggaggaggaggaggttgttgttgttgatgattgtggatcggtggagagtgctcatagtgtttttatggaggagggtgacatgggggtggagcaatcgccttcgccggagatggcggcgatgacttcgccagagaccaatttggcagtggcggaggcctcgcccgggtttgagaagggtagtgcgcagagtgagaaggagggtgtgaagaagattaatgagaaagggttgaagagtaattctgtgagggattggtggtggaagcatgaggatgaggttggggttggggagggtaaaaaggttaaggattatgtgatggagtggattggtagggatgtgaataaggaaagggtgaagagtggaattgagttggaaaatgtggagatagggaaggaagagaaaaataagaaggagaagaagagaaggaagaaggaattggaatggtgggaatcaatggaagaggaaaagtttgatggtgttgtgaaggggaagagaaggacggtgagggaatggtggaaggaggagtgttttgaggagaatgtgaatgcgaagacgacaaagaagaagaagaaggagaagaaaaagaggaagggtgggagtgtgaagagtgatgatgatgagaattgtggtgatgattggtggatgagtgatgatgcaatggataagaggaagggcaagagtaggagtaggaacaaccgtgggaacatggattgctggatggatgggttgagtggtgagttatggagagggaggaggaataatagctttgattctgctagtggggagattccaaagagtggtggtgtgagtagtactcctagtattaggggaactgtgtgttatgttgctcctgagtgtggctatggtggggaagtgtctgagaagtgtgatgtgtatagctttggggtgttgttgcttgtgatcatttctgggcggcgcccacttcaggtcagcggttcacccttgtccgagtttcaaagggcaaatctcctgtcatgggcgcgccattgtgcgcgaaatgggaagcttgttgagcttgttgatgagtctattgaattgttggataaggagcaggctcttctctgcatcagggtggctttgctttgcttgctgaagtcacctgctcgtcgtccttcaatgaaggaggttgtaggaatgctcagtggagaattggagcctccccaattgcctgttgaatactctccttcaaccccttctaggttccctttcaagtctagtagaaaaggcagaaaaaaatgtatagggattttaggaggggaaagctatgctctcaccatttga

SEQ ID NO: 58349 - DNA, 409 bp, Glycine max
  Peptide Sequence Number=SeqID_175127
gctaacttacaatagcaagccccaagagactcaacataaggatgcacaagccaaagttgagtatgtgaaaagattgtatgaccaagtgaaggtgcaaattgcaaagaagaatgaaagctatgccaagcaagccaacaagaaaaggaaggaagtggtacttgaacccggtgatgatcctggacatttgagggcaaatattttccaagaaggagggaatgatgagaatcctgaaactggccaaatacagacttatcaaggtaatccttgtggcgtctaccctgacttatcttccttcactggaagtggcatcatccaattctccgtagcatgtatcaagcgatccgctcctagtcaggatcacatcacaatgggtattattttcaaacaaatgccattggcatttaattga

SEQ ID NO: 58350 - DNA, 2283 bp, Glycine max
  Peptide Sequence Number=SeqID_175128
atgttgttcccggcaaatgctcaatttgctaagaagacttatctcattcaaatggataagtcagcaatgccaaaagccttccccaaccaccttgaatggtattcatcaaaggtgaaatcagcactgtccacatctccagaagctgatatggacaatgaggagagaataatctacacttaccagaatgcttttcatggagttgcagccaagttgactgaagaagaagctgagaagctagaggctgaagaaggtgttgtgaccatattccctgaaaaaaagtatgagctacacaccacaagaagtccaacattccttggtcttgaaccagaaaaaagcactaatatgtggtcagaaaagctagctggccatgatgtaatagtgggagtgttagacactgggatttggccagagagtgaaagcttcaaagatgtaggcttgagaccggtaccttctcattggaaaggtacatgtgagattggaacaggcttcacaaatagtcactgcaataaaaaggttgtgggggcaagagtgttctaccatggatatgaagcagcaattggtagaattaatgagcaaaaagagtataagtcaccaagagatcaagatggtcatggcactcacacagcagctacagttggtggctctcctgtgcatggagctaaccttcttggttatgctaatggcacagccagaggaatggcaccaggtacaaggattgcagcttacaaagtgtgttggattggtggctgcttcagctcagacattgtatcagctattgataaagctgtggctgatggtgtgaatgttctttccatctctttaggtggtggagtctcctcttactacagggatagtttatctgtggctgcatttggagcaatggagaggggtgtttttgtttcatgttctgctggaaattcaggacctgaccctgctagcctcacaaatgtgtcaccttggatcaccacagttggagccagcacaatggatagggattttccttcagatgttaagcttgggaatggcaaaaaaattattggagtttcactctataaagggaaaaatgtgctatcaattaagaaacaataccctttggtgtacttggggagcaactctagtagggttgatccaagatctatgtgcttggaagggactttggatcctaaagtggtgtcaggaaagatagtaatttgtgatagaggccttagtcctagagtgctgaagggtcatgtggtgagaagtgcaggaggggtgggaatgattctcactaacactgaagccaatggggaagaactggttgcagattctcacctccttccagcagtagcgataggagagaaagaaggaaaagaactcaaaagttatgtcctatcaagtaaaactgctactgcagctctagcttttaaaggtacaatattaggaataaaaccatctcctgtagtggcagcattttcatcaagagggcctaattttctcagccttgaaattctgaagcctgacttagtggctcctggggtgaacattcttgctgcatggagtgaggccattggtccatcaggtttgaaaatagacaacagaagagtgaagttcaatatagtctctggcacctcaatgtcatgccctcatgtgagtggcgtagcagctttggtcaagtctaggcaccctgagtggagtcctgcagctataaaatctgctttgatgacaacatcttatgttcttgacaacaccaagaaaacactcagagattcctcaactgccaaaccatcaagtccttatgatcatggtgctggacacattgaccctattagagctcttgaccctggtttggtctatgacatggtgccacaggactactttgaatttctgtgcacacagaatctgactccaacacagctaaaagtttttgccaaatattcaaacagatcttgtagacactctcttgcaagttcaggggacttgaactacccagccatatcatcggtgtttactcagaaaacaaccacttcattccctagtccagtgattcttcacagaattgtcaccaatgttggccctcctgattccaaataccatgttgtggtgtcaccattcaaaggtgcttctatcaaagttgagccagaaaccttgaattttaccagaaaacaccagaagttgtcttacaagattaccttcaagccaaaggttcggcaaacctcgcccgaattcggaactctagtatggaaggatggtttccacactgtgagaagccccattgtgataacatggctgccaccaccaatgtga

SEQ ID NO: 58351 - DNA, 390 bp, Glycine max
  Peptide Sequence Number=SeqID_175129
atggatctggccaaatcaatcaggcaggaattgatcattaattataataaactcatcaacgcgttactagccaaaggaattgaatcatatgtgactctatcactgggacctacctcaaaccttggaaaacaaaaatttggggatagggtgaagcattggatcacattcaatgagccacatacattttccacccaaggatatgatgttggtctacaagcgcctggtcgatctccattctccttcacttgttctgcttctaaaccttacattgttgctcacaatgtcctactctctcatgcaacagtagcatatatatttataggaaaaatatacaagtacagatgttctccaagtgaaattatagggaggatcactaggggtagcttttga

SEQ ID NO: 58352 - DNA, 240 bp, Glycine max
  Peptide Sequence Number=SeqID_175130
atgaccattctaaatcagaaccgcaccaatcaccacaaaagaggcatcagtctccaagacaagaatagggaagcgatctttaacagtaacaacattgagagagcggtgaatatccatgtggggatagaaaccttggcattggatatgatttccattgcctaccatcatagaaaatggagagataggggtggtgggaagtttgagatgacgagctatttgaggttgaatgatgttgtgtga

SEQ ID NO: 58353 - DNA, 189 bp, Glycine max
  Peptide Sequence Number=SeqID_175131
atggaagtgtctcacgatgctcaagaattcatagtgaccccaatgaggtttgatgcgagagtttttgtagcaaaattttggaaaaagaatttaaggtgttacaaaggagggagacatgaaaaacgttatggatccgtgactccagaggaaggcgaagctcataggcgactttgccaatacgctgcatga

SEQ ID NO: 58354 - DNA, 213 bp, Glycine max
  Peptide Sequence Number=SeqID_175132
atggatgatggattgggtggagatgaggattggatgggttatgttttctcttgtcttttcatgagggaggcattgggagtaggtgagggtgtagggaagcatgcagatggagagatgggtgagtgtgtgctagttggattgcacttcggggaattaagtgaggagagatggtgggcatgtagggaaggatttgaggtggtgcaatttgagtag

SEQ ID NO: 58355 - DNA, 498 bp, Glycine max
  Peptide Sequence Number=SeqID_175133
atggcgaagcagcaaacacacgaaatcaatgcaagcactaacaataacattaacacaactaaaactgtcaccaccaaggtgaaacgaacaaggagaagtgtccccagaaattccccacctcaacgcagctcaatatacagaggagtcactagacaccgatggacaggtcgatacgaagctcatttgtgggacaagaattgctggaatgagtcacagaacaagaaaggacggcaaggtgcttatgacgatgaagaggccgcagcacatgcttatgatctagcagcattgaaatactggggtcaagataccattcttaattttccgttatcgacctaccagaatgaactgaaggaaatggagggtcaatctagggaagagtatattggatcactaaggaggaaagcagcggtttttctcgtggagtttctaaatacagaggtgttgcaaggtacaattattattcatttattctacaatctgaaaatcagaccaaaataa

SEQ ID NO: 58356 - DNA, 969 bp, Glycine max
  Peptide Sequence Number=SeqID_175134
atggtcttctccgttggctactatttactaaggagacaagcaagaaagagttttaggaccattctcaaagaaaattttggtcatgaaagcgccattttagagccattgcaatttgatttggctgtaattgaagcggcgactaacaacttctccaatgagaactgtattggcaaaggtggatttggagaagtttacaaggggatattacctgatgggcaacaaatagcagtaaagagactttcaagaagttctaagcaagattctaaacggcaaaaattgttaagttggtgtgaacgctacaacatcataggaggaattgctcaaggaatcttatatttacatgaacattctcgactcaaagttatacatcgtgatctcaaacctagtaatattttattggatgaaaatatgattccaaaaatctcagattttggtctagctagaattgttgaaataaatcaagacaaaggaaatacaaataaaattgttggaacattaggttatatgtctccggaatatgcaatgcttggacaattttcggagaaatctgatgttttcagttttggagtcatgattttagaaattattactggaaaaaagaatgtaaattcatatgaatcacaacggattggtcatagcctcctaagttatgtttggaagcaatggagggatcatgcaccgttaagcatattggacccaaatatgaaaggaagttttcctgaaattgaagtaattaggtgcgttcacattggcttattatgtgttcaacaatatcctgatgctagaccaacaatggcaacaattgtttcatatatgagcaatcatttgattaatttaccaactccacaagagcatgcatttttgttgcaaatggatccaaaagcaattgtacaagaatcaagttccagccaatcttccacactattgtccaacaacgaaatatctataaccgaatttcttcctcgatag

SEQ ID NO: 58357 - DNA, 715 bp, Glycine max
  Peptide Sequence Number=SeqID_175135
atggtggtaaaaccattcaacggggatagtccgaagataaaattgagggataagtcttcccaaattgatgatggtgttggtaaagatgaggcaccaagaaacatattagcggacgtcggagcgcatataagaccagaagaaattgtcctgaagatgatgaaaaggcttattggacgtcctggtggcagacaaattggtctttcggcaatagagtcattagaggtagcaatatggcttcacattgatggggttggaattgggaagaagatggatgtggtgagtaatggaacgatgactgctaaaacaaggccgaaacacgctgggcttggaagtagtgttttaagttattgggttgaagcagagtctaggcgaatcagtagttacaaggctcaagtttttgagccattggacctcgagaactttgtttgcgccatagaggggaaggtggaagaggttgtcattgcccaccataacctacattgccggtgtgggagaagtaggcaaattgaggaactttgcaatgcatacctgaatgaaattgtgagtgttatccccattgacaaggataatgacgcggtggtgagagatatggttgtagatgcggaaggtttctgccataggcatcccgaacattgtgttggggcttttaggggtgatcgtcagaaatttgttcgagaaaaaggacaatggtgggtgggtcatatccaaaggaaag

SEQ ID NO: 58358 - DNA, 607 bp, Glycine max
  Peptide Sequence Number=SeqID_175136
atggatggactgatagaggttctcaattgcatccttgaacaataccttcgagcttttgttcacgacaaatcggtaacgtatgggaaaagtccatcgtcaattcccagctatctacttgggtcctcaccagtcgaggccatcgactccttactagccacacaggccaccattcatgaaacattacagtgtcacctctcaaaggcccaagccactatgaagcgacacaaggtcacccatcgctgcgatgttcagctttcggtcaatgattggccttaccaaggtccctctcctcccagtccagaccccctacctcctatggccactgacaaccacccgataatagaacacatgtcgattcttgattggaaatgggacacaacgacaaatcccctgaccaagctaccgctggtgcactggtttgggttgccttcggaagacacaacatcagaacattgggaggatttatgggcttctcacaaccttctggacaaggttaattttccagagaaaggctcggaagattgcttatcctccaattctgttatcattttgttattttctgctttattacgaattcttctggacaaggttaattttccagagaaag

SEQ ID NO: 58359 - DNA, 1528 bp, Glycine max
  Peptide Sequence Number=SeqID_175137
atggcttacttcaagcttcccttcctcattatcatccttgttaccttgctcaatttttcaacaagtcacgcacaagacgaccctttttacctttaccaatattgctcaagcaacagaaccactgccaacacctccttccaaataaacctcagaaccctcctctcttccctttcatctcacgccaccggcgacacccaattctacaacacaacattcaccggaaccaacccctccgacacaatctacgccatgttcatgtgtaggggcgacgtcccttctcagctttgtcaagcatgcgtcataaacgccactcaaagactctcctcagaatgctccttgtccaaagaatcggtgttttggtacgacgagtgcatggtttggtattccaccaacccgatcttcaccaccgtggccacaactccgagttttcacttgttgaacacgggcaacgtctcgaaccctcaaaccttcatgcgtttgttgtttcagaccatgaaccaaaccggagaagaagcagcaggtaaccctaaaaagttcgccacaagggaagtattagtttctgaacttcaatccctttattgtctcgtacagtgcacacccaacctttcaccccatgattgcaaaacgtgtctcgatgaaatcataggagaacttccatcatgttgtcagggaaaaataggagggagagttctaaatccaagttgtaacattaggtatgaaatgtaccctttctttctctccactcttaatacacaaacaccaaagctagttcctgagacaaaattttccgaggaagacacaaagttttcagaagacccagtttatctctctcacaattgcttaagtagcaaaaccttcactgtcagtagcactttccagaaaagcctcaacaccctcttctcttacttgtcttccaacgccacaaacggcaagtcgtttcatgatgcaaatataaacaaccaagtgtatggtctcttcatgtgccgaggtgatgttccttctcctaactgtgaacagtgcgttttaaacgcaactcatcgaatgttatcagagtgtggttcatttcaagaggctataatttggtacagtcactgcttgcttcgctattcacatcggaatttcttcaacatggtagaaaaaagtcccgtgttctcgaggctgaatatcacgcgtttctcaagccccgatcagggacaaaaattcttcattttcgtgttgtcgaatgcgttgtcgaaagttgctattgaagcaggggacagtgatgagagattcggaaccaaatcgttgaaactgaatgatttgcaaacgctttatactcttggtcagtgtacacgggatttgaccagtgatgattgtaaggggtgtttgggggatgttattggacccggaattccatggtctcgtttggggagtgtagggggaagagttatgtaccctagctgcaatctgcgatttgaattggtccaattttacaaggatggtgaccaagctgctacgccttcttcatcaggtgaagttcttcctcaag

SEQ ID NO: 58360 - DNA, 207 bp, Glycine max
  Peptide Sequence Number=SeqID_175138
atgcctctagtgtcatcactggttgttgaagagagagctggtgaaggctctacatcaaaagctggacaagggatcaccgaaggtggagttggtggagcatttggagtggctcgtgccctgacccgccttggccccgggaagacactagaaggaactgttggattcacaactggtttgactcatcttcttctagaaacacatatttaa

SEQ ID NO: 58361 - DNA, 264 bp, Glycine max
  Peptide Sequence Number=SeqID_175139
atggaggtgaaattaggggatgtaagggtagggacaaacatggggcaaggattggagttggaattggaagaagagggttggggggaattgaacgatagtgaaggtaatgggaaaaatccaaaagggaatgaaagggtaggtctagtggtggggatgagaaagttcatagagaacccaaaggaagtcgatggggtagtagcaggaataacaggttgggtagtgggtagtgttttgggaggctgtgggcacaacagaaataggtaa

SEQ ID NO: 58362 - DNA, 249 bp, Glycine max
  Peptide Sequence Number=SeqID_175140
atgacaggagtaggactggtccagtcttctgaggtattcgtacttattaactgtcttgttcttggtcttgacttgacggctgacagtggtaaacctggggattctgattcttctgttttgaggtctagcgaagaggaaatggatgatgaaggcttcttggggcgtgttccagattcatcctggatagttcctcacatcccttcccctcctactagtattataaagaaaattcttccacttggttggtga

SEQ ID NO: 58363 - DNA, 300 bp, Glycine max
  Peptide Sequence Number=SeqID_175141
atggagttgatcgcttcaaacaagagatcttgttctcttgttagagtattgatttggctttcttcgtcttcctccgaagtttctatgagcaaattattaatcttctcttcaatggccgattctagtgtagaagcaaagcttcatggtgaatcaaagaacaattcaagagttcaagataagaatcaagaagaattcaagactcaagaagaaagtttagagtcaagaatcaagattcaaggttcaagatctcaagaatcaagatcaagattcaagactcaagagaaggctcaatcaagataa

SEQ ID NO: 58364 - DNA, 579 bp, Glycine max
  Peptide Sequence Number=SeqID_175142
atgcctcctaaggcgactgggtcctccgatagaggaggaaagagtttcggcaatggatcattgttgactctaccagagccaaccgtaaaaaagagttcctcaatatcctctgggtcacctacccaggctgggtcattaacccagaaaaccaagtttgaaggatcatcgacccaaatagccactatcaaacctaagtcatcaactcaagactccccgaagccagcagcaccagaccaggtcaagaactggttccaagcacaccctgaattcttaaaacctgctgatctagaaacttcattgtttctaaatcagaagtcacaattagcagctttcctagccaactcaaaatctaaagaaagcctggctaagaatttaaaggaagttctccaactacttcaacaagaggaagaagaaggttcttcatccaaaaaggaagaaaataagtcttcaaaagagaacgatgatccattctaccaaaacgaagatgattgttttggcatatctttagaagatgctctgacaccagagatcagcggaggatcaaacggacaaataggaagtaagaatgatgcagtttga

SEQ ID NO: 58365 - DNA, 402 bp, Glycine max
  Peptide Sequence Number=SeqID_175143
atggatgactggaacattccaaaaatccctcaggatacactatacgttcctgagacaattaaagacaaacataattttgattacataatcataattgtagaaaataatattcctctaggacaagatataggggaagaatttcatttactttcaaaaaactcaattgtgaacatagtccccttaattgatatgggcatagatgcagcagttttaatgtgccttagggacattaggcataacaaatttgaagattccttcataggtacagtagaaacaagcctaggacaaggtctgatatacttcaattgttatccaaacaaaatagtgagtctgatggacaaaaacattcttgactctctgttcctaaacatccactttcatggccttgacatgaaagaatga

SEQ ID NO: 58366 - DNA, 312 bp, Glycine max
  Peptide Sequence Number=SeqID_175144
atgacttacatgtacgacgacctaagacgcgctttccacgggcaaacggcgcgaggaagaaataaggcacatgagcacaagcctcaagtttttctattagataaaaagagtaaaatcactagcaacacgaagaaagggttcagggatcaggataaactcacctttcaaattttgaagccgcaagcaagttgcccttcgtccggcttagtgatgatgggtcacaaatttctctttcaacacttggtgaagacaggggatgctggtgaagacgaaaggggatgctgggtgaagagtggaaagggatggctgtaa

SEQ ID NO: 58367 - DNA, 627 bp, Glycine max
  Peptide Sequence Number=SeqID_175145
atggtgaggtgcaacactggcgaacaggggtggttcgacggcacagtagagggtggtgacgacacagtcttgtgtgctagggttaaaaaggtttttgttgttgataaggatgcgccaactcagcaaaatcagttaacaaaagcaggagtggtgatcctccttcggggccttactgcaggtggtggtggtgcctatgtgttactgctatcattccctgacccatcaaaaacaccttgtcctcaagtgcgggaactggaggtggagtcggcatgggcggcagaggtggcatgggtggctgagtcagcatgggtgatggagtctgcatgggcagcggagttgtggcaaggtgcgggaagtagaggtggagtcgacatgggcggcggaggtggcggtggtgacgacacggaggaagaaggtttggccaaggcggccttgaggcgttcctcgcgagcggcagaaagttcgacgtttgccattcgagtcgaagctggtatgccagccatggaagacagccataagagctttgtttggcgggtggtgtggattgcggtagttgaagctggtatggcagccatagaaggtagccatgggcaggtggtggtggtgcctatgtgttactgctactag

SEQ ID NO: 58368 - DNA, 201 bp, Glycine max
  Peptide Sequence Number=SeqID_175146
atggctagaggtgttgacgccaacaaagcgaaggtgaggccagacgaaggtgttgtgagacgctaccacaacaacgggaaggaagaagatagaaaggtgttgcgggacaaagatgttgcagtggtggtcggaggtgttgacgatagcgaaggtggcggagatgctatcacgactacgggaaggaagaagatagaaaggtga

SEQ ID NO: 58369 - DNA, 279 bp, Glycine max
  Peptide Sequence Number=SeqID_175147
ctgacaactacaacatctcattcactttcactttcactccttagcctggttgtaggagtcagggtttatcgagggtttggtttcgttccttcctctctgctacaacaatggcgaaacctgggtgaggtcgtcgctctccctccggttctgtttctgactcctcctctcgctcctcttccccctcttcctcctcttcctcccgaagctctcgcagtcgcaaccctcccccgcagaggcgtcgaaagtaccgctaatttcctcgatcggagtgcaatttga

SEQ ID NO: 58370 - DNA, 210 bp, Glycine max
  Peptide Sequence Number=SeqID_175148
atgatcagcgaggtagattctgatgatggtggtcacatcaacctcacagagtttactgagttgaacaccaagaaacttgaagattcattctcaattttcgacagtagcagtaacagtactatttctgcaaaggagttgtgcatggtggcggccagcctaatcagtgaatgctctgtcgaggagtgcctgaaaaataattggcaacattga

SEQ ID NO: 58371 - DNA, 2424 bp, Glycine max
  Peptide Sequence Number=SeqID_175149
atgtcagtcccgggagaagtaaatgggacggcattagacaggcaacctacatcggagatggagacatggacatcccataaggcagggatcattgacttcatgcatgaccaaggcacacaatacgattgtggagtgggtaacatacagctggcaccatctaatgatacatgtgttctgcaagcagatgttagtggacacataattaaaaataaagaaacaatacacacaccagttaccaacaatcacaaggaagcatgtgaccttagtgctgacgttactgggcctctgatagtgggccttattagccctacccctgttgaattagttactcaacaaaatctaaacccaactgttaatactgaaacaccaggaatgttgaagatgtacatgagaagtaaggggtgtagaaagcaaaaggcccacaccagtgcaaatgtgtgtcaaatggatgaaagtacaaagataaacactctgaagcagatcaaagtggatatcacaaaaaataattggagtagcaaggaagctgagttacctccaaatgaggctctgatgtctagtgcatgccaagttcaaatagtagaagaaccaccaagtactagtgccaatagctcacagtacctacaggaggcagaacatcaatggatgatggcaggacaaatgggggtgttgtgggatacagatcataaaagtatcattgataagatatgggctatggagaacaaagataggaaagaggcagagaagctgggcaataagagttgtgggggactattgtgtatatggagtgagaaaagtttcaaagtggaacgtaaagttagtggtagagggtttattctgctggaagaagtatggattggagaggatcataagctgattatagctaacatatatgctctttgcgatcctagtagcaagagagctctctgggagtctctcaaacaactcaaaaatctgaaccctacgggcctatggtgcttgttgggagattttaacaatgtcagaaacccagcagaaagggtgggcttatcccagaggggagcggaggacaaaatcgtcagtgaatttaatgagtggatagaggatcttgaagttgtagagccaccatgggtggggagaaattacacgtggtttagaccaaatgggacagcaaaaagtaaactggatagagcacttgtatcccctgactggttcaccaaatggcctgctagatacttgactgctggctcaaggatagctcattcgagaagacaatttctgaatgttggtcatagccacaacaaaaggggtggggagcaattcagagacaccttcaagaaggtttggaatatagaggctgaattaaataagcttgaaaatgacacagctgacagacagttgacctcccaagaaattatgtatcagaaaaggttgcagcaagacttgtggactgtagccaattcacatgaatcattaatgaggaataacgcattgaatgaagtgtatatcaatggatcctgggtcgaggaaccagccagagtgaaagaggaaattctgaaacctgactttctccgcttccttgacaaattccatgctaatggaattttcccaaagggagctggaagacagttgctgcactgtgtaatcatcattaatgaagcagtggaggaagctagaaggagccaaatgccatgtttggtgttcaaagtagattacaaaagggcctacgactctatctcgtgggactttctattttacttgctgcgaagattagggttctgcaataaatggattcagtgccttggtctcggtgttgtagaagccttaactgttctcatgagggaagcagtaaacaagcagttgttcactgaatttccggtggggaaaaataaaataccagtcagcattttacagtatgttgatgatactatctttttcggtgaagccacattgcaaaatgtcaaggtaatcaatgcgatactgagagtttttgaacttgcctctggccttaaaataaactatgcgaaaagtagttttggagctgtgggaaaatctgagcagtggtgcaaggaggctgctgaatatttgaattgcagaattttgcctattccgttcatatatctgggcattcccattggggtaaacccaaggcgtagtgagttgtgggatccgatcattagaaaatttgagaggaaactggctaaatggaaacaaagacatttgtcctttgaagggagagatattcttatggggaggaggattggaacaaaggaagattgcttgggtcaaatgggaaataatttgtctcccaaaagaaaagggagggctggacataaaagatattatgacattcaacaaagcattacttggaaaatggaggtgaaagagtcaacaaagaatcattttggtgacaggacctcatggcagtcatccatgaacaacagctga

SEQ ID NO: 58372 - DNA, 723 bp, Glycine max
  Peptide Sequence Number=SeqID_175150
atggatcgaactgtcaatcttccaaaagggtatggatatgtgcagttcaagacaagaggggatgctgaaaggcattattctacatgggtggcccaaatagatggcaatgtcatgaaggcaagatatactctacctccaaggcagaaagtttcaccacccccaaaggcttttgctgttgctccaaagagagacacccccaggactgataatgctagtgcagatgttaacaaggatggaccaaagcggcaaagagaatgtatatatgtggaagttagctctatgctgttggagaagcttgttgctgctggaattgggaatcgtcctgttgtttttgttactcacagtgcttctcggccatgttcatgtgccagtgatgagtttttaaggattataagacattataatgtggcctatagattcatgatagtcaggttaggactcatagtagctgcttccattgcagccctcacagttgagcagctgaatgtgaataacacaagatcagcaacagacttagttctaactgtgactcaaattctcagaaagcatggtgttgtggggaaatttgttgaattttatggtgatggtatgggtgaattatctttggctgacagggccactattgccaatatgtctcctgaatatggtgccaccatgggcttcttccctgtggatcatgttacattacagtatctcaagttaacgggaagaagtgatgagact

SEQ ID NO: 58373 - DNA, 2990 bp, Glycine max
  Peptide Sequence Number=SeqID_175151
atgggcgacaagggaggcacaaccaagaaacaacaactgcaacaacctcaaccgaagcaacctcaatctcaccaccaccatcaacagcaacaacaacaagcacagcaaatttcatcttctcccaaagcctcacatgaggaacccatcacagaagttattaggccaatccaccaccaccatcaacaacaactgtcaccagttgtggttgcaactggagcaccccctttcattccaagtcctttatatgtttcaagtggtgcaagttgctcaccctttgagcctcagtttgagacactgaacccaaagagacccagatacagtggacaatggaagcagcttctaccttcccctcctgcacaacaacaacagtcccaaatggccatgtttcccacctcagaatcaagcccttcacccaccacacacacttcatcaaatccactacaacaacaaccccaaacacaaacagcttcttcatcagacacttcctcatctccaacacactctctcccattactctcaggagaagggaccaatcaagagggagagcaagttcaccagcaactcagaaaagggaaatacgtgagcccagtttggaagcccaacgagatgctgtggcttgcaagagcttggaaggaacaataccaaggtggtggtggtggatctgattcttcttcaagagcagaacaacaacaacaagctgaattgggaatcacaagagggaaaactagggctgataaagataaagaagtggctgagtttctaaagagacatggggtgaatagggatgctaaaactgcaggtactaaatgggataacatgttgggagagtttcggaaagtgtacgaatgggaaagagggggtgaaagagaacaaattgggaagagttatttcaggctttcaccttatgagagaaagttgcatagacttccagcttcttttgatgaagatgtttttgacgagcttgcacagttcatggggtccagaatgagatcctctcatggcagagctgtttccacttttgtgtcaagagatgaagctagaacagctcttgcttctacaagagctcttccaccacctcctcgacctttcaaagatgatgaaacccctctttcagcgaggacaaagcaattgactttagcaagtgggggtgaacctttctttcatggctcaagagggggtttattagggttagactctctcttagacgtttcgggttcttcatcatcatccaaagaactccgaagaattgggaagataagaatgacatgggaggaatcagtgactttgtgggcagaagaaggtgaagttcatagagggagagtgaagcttcaatcttcaagccttctgaacgcagatgagctcacttgttttgatgatgccatggtgccatgccccatggaatatttcgaagatggtccactgaagggtttctctgtggacagattcgtttcgggtcagcaagtcaaagtatttggcagaagaaagtcttctcccgcctcagattcttcttcttctgctggttttgctgaaagagtccaacttccctccaaagcacttcccataagatgcattggtacattgaatttccgagacccaacggattactacatggaatgcctcttacgtgcatccccgcaaaccctcccaagcctcttggagctaaagcgccacttaaaagaacccccacccgaagacctacgattccctctccgaagagacatgtacgaggatctcccccaagggaaggaactcttcttcacgacaacacccgaacccttggactgcagaaacatcatgtacgacgttgtgggccccatcatccgccccaccaccatctcccttgccacttcatcgagccgcgactccttcatccccctctgggacgattgcatcaacagaatcatccaaaaattctgccccgaacaactcaccctaatccgaaaacccacgtcaccaccacctcaatccgaatccgaatccacgaataattcacaattacaagatcaatggcccaacgtaacaggttttgttaacaactattgcttatggagaggcgaagaaacgcaccagttaaaagattcgcaacccaacccatcaaccactctagtcgctaaattactatggacctacatggatataccttacatactgggttactacgcagtcgccaatacggtgacgttttgcgcgatgagtaggtcgcaggatggaataatcaaccgcaccgatttactagatcttaatttaagcaccccaacggaaaggttaaaagttttagttccgtgtttccggatcgccttgttgttaccgttgctgagtaagcgttgtatgagtaatataagtaactgcaaggggtttacttacagtgattttgagagggtttgttacggtaatggggtggtgacggaggtgacgccgaacacgtgcacgcgggtgttttcggaaaaacggaaatggatggcggttaaggaggtttatgagattttggatcataggattcctcatgcggaggttcttgttggggtttcggagagggaattggggttgtcgtttaagccgagggggtgtcgtgtgagacctgggaactgggaggagcttgtggaggcgttgaagtacgtgacgaaggcgcttgtggcgctgcacgacttgtcgtttatgcatagggatttgaagtgggagaaggtgatgaggaggatggacagggaggaggagtggttcgtgtgtggcttcgatgaggcggcgggggcgccggagctgaaggggtggcgcgtggtgggtgcgcgtgaggggcacgcgccggagatggagagagggttgcatggggtgaaggtggatgtgtggggtgttgggaacttgataaggacgtgtgggttgggaggggtgccgaagatgctcagggagttgcagagtcggtgcatggagcagaacccggagcagaggcccacggcggcagactgctaccaccacctgctacagctgcagtcgtcgct

SEQ ID NO: 58374 - DNA, 255 bp, Glycine max
  Peptide Sequence Number=SeqID_175152
atgggggatgcaaatagcaaatttgaaattttgaattgggccttccagactgtttttcaaagatggattgcttctggaggaagcaacccagttcgcctaggcgagctgggcggcaacctcctccccctttttcctataaaaaggcaaaatggggttgttctaagggtccctgattcccctggctatgcatttcagctgttttgggtgaaaaaaattgtttttgagaagaaaattcaagctgaggtgtttccgtaa

SEQ ID NO: 58375 - DNA, 918 bp, Glycine max
  Peptide Sequence Number=SeqID_175153
atgtccgtcatcgacattctcttccgcgtggatgacatatgtcaaaaatatgacaaatacgacatcgataagcagcgcgagctcaacgcctatggcgacgacctcttcgctcgcctctacgctgctgtcgaatccagcatacaatccgctctcaataaatccgaggttgcttccacggagaagaacagggcatctgctgcggctttgaatgcggaggttcgtcgaaccaaaggtagactcatggacgagcttcctaaactccgcaaattggtccataagaaggctttgcccccatacccaacccacttcctaacccaacaacaggttaaaggtctcacaaaagaggatatggccatacgtcaggatcttgttctggcattgccagagagaatccaagcaataccagatggtatttctggtgctgctgttcaaactgcaggatggactgctacctcatctcagccgcatatcaagtttgattcatcagaggggcatcttgacagtgattatttccagcaaagtgaagaatccagtcagttccgacaagagtatgagatgcgcaggacgaaacaggatgaaggacttgatatcatatcagagggactggaaaccttgaaggatctggcacaggatatgaatgaggaaattgatcggcaagttcctttaatggatgaaattgacagaaaggtggatagggcagcagctgatgtgagaaacactaacgtaaggctgaagaaaactctcaccgagataaggtctagtcgaaatttctgcatcgacatcgttctgctctgtgttcttcttggaatcgttttgtatttatacaactgcttgatttcttacatgaaataccactgctcatttgtgtactttacaagactacttatcgtgactgctttttggcacactactaagtga

SEQ ID NO: 58376 - DNA, 375 bp, Glycine max
  Peptide Sequence Number=SeqID_175154
atgatcaatcaatggaacaatcggactgattttagggtcgatgtttatccacgacaagaaggtctactgagttttaactccgactacatggtgtggtatagacgtaaaacaaagatgtttgttgaccctaaaaactcaaacatggcgacactggagagaataattgaacctttgtcacatggtccagcaacagaacgtgaatttctaacccaacagttaaatattctccaatcaagtattgaaactaaaggcatagtcaaacgaagggagattgttgaagccgaaccatatgtgtacccacagatggcagagcgtggccatggaatgtattacgcaccactagcattttctcagtatccgacacagatgtattag

SEQ ID NO: 58377 - DNA, 345 bp, Glycine max
  Peptide Sequence Number=SeqID_175155
atgaccgtgttgatgatgagaagcacactagcaaccatgaccgcaccatacgccgtcttcatgccttgcagcatgctccaccaatacccaaccactcatagacacgcggatacatgcacaatgacgtatcccgccagcaccaccagcgggttcttcatgcatggggtttcgccactcccattggcgagataccccatgccatcagcccaagaccatcacctccatgcatccatcatgtccatgcaaccatcatccatagcaatttcagccagtcaaagtggcggtattgctgcagctcgtggaatccgccagtgccatttgtgggattccctaaggctggtttga

SEQ ID NO: 58378 - DNA, 270 bp, Glycine max
  Peptide Sequence Number=SeqID_175156
atgacgtttgcttcaggcttggttcagcataaagcacccaaaggttccgccagtgggataagcgacataccccatgccatccatccacctaccatccaccagcatgccatccatccatgcatattttccgccaatcaaactggcgcgtttgctgcagcgccatccagtgtccagtttcgcaccagttctgccagtaggcttggcgatattgccttgcagatttcgccagcagtgctggcgagaaacccttggtgcagtgccaatgtgtag

SEQ ID NO: 58379 - DNA, 775 bp, Glycine max
  Peptide Sequence Number=SeqID_175157
atgaccggcctgcattactccgaacagacccaacgcgtgtatgccgccaatggcagcggcgagatcctggtgatcaacccgcgttccaaccgcatcgaaaaacgctggaaaccgttgggagaccaacccgcactgctgctcaatatggcggaggacgaggctaccggtcgtttgttcgtcaccgacaactccaaggcgaagaccacgctggtcttggatattcacaccgggaagttattgaagcggcttgatgtgggcgactctttggctgtcgttttcaatccacggcgcaacgaaatttacatctcgcagcgtgaatccggcaatgtgctgagcctggatgcgacgacctatgcggtgaaacagcgctggccgctgccgccgaatccaaacagcttgctgctgtcggcagacggccagacattgttcgttacggtcaaacagccgtttaacaaagatcattccactcaggggccggacagcgtgggggcgctggccgcagacggcggcgccaagaaaaaccaggaggacaccctggttgtccgggccgaaaaacacggcgatttcaactccggcggcaatgatttggtgcccgcctacctggatggacaggtcgcccacggcggccgcctgggaatgttgggcgaacagaaagcgatggacgttccgttcaacgtcataggttataccgcgaagctggtacaggatcagcaggcgaagaccatcgccgacgtggtcagcaacgacgcgggtgtacaggcggtgcaggggtacg

SEQ ID NO: 58380 - DNA, 501 bp, Glycine max
  Peptide Sequence Number=SeqID_175158
atggtgattggcactcaggaaaaatatgccgcgcacaccttacataccccgctgcatctggctttctcctcctggctttttaacgcaaacggcgaatgtctgatcacccggcgcgccttaaccaaaaaagcctggcccggcgtctggaccaactccgtttgcggccacccgcagtccggcgaagagacgatacaggcgataatccgccgctgccgctttgaagtgggcgctgagctgaccgatatcaccgccgtcgcccctgaatttcgctatcgggaaaccgacccgtccgggatcgtggaaaacgaaatttgcccggtatttgctgcccgcatcaccaatgacgtgacgataaacgaagatgaagtgatggactatcagtgggttgagctggacgcgttattccgcgcgctggacgcgaccccctgggcctttagcccgtggatggtcatggaagcgacgaccgcccgcgaaaaactcaaagccttcgcggcgcaataa

SEQ ID NO: 58381 - DNA, 387 bp, Glycine max
  Peptide Sequence Number=SeqID_175159
atgcaaaaagtttatacggataaccactcgggtatttccgcccgtcagcgtgactcaaaagtcagtatgacagatcttgtgagcgcggaagataacccgcgattgacgaagggcgaagaagacgacgttagtctctgcgtgctatcaggcttttcgtcatacagacaacaaaaagtttatacggataaccactcgggtatttccgcccgtcagcgtgactcaaaaacagcaaatctttatacggataaccactcgggtatttccgcccgtcagcgtgactcaaaagtcagtatgaccgatcttgtgaacgcggaagatgacgttaatctccacgtgtcaacgagcttgtctgccgcgattgacgaaggtcgcagaagacgacgttag

SEQ ID NO: 58382 - DNA, 477 bp, Glycine max
  Peptide Sequence Number=SeqID_175160
atgggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 58383 - DNA, 439 bp, Glycine max
  Peptide Sequence Number=SeqID_175161
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtggcggggcgaagccagaggaaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaa

SEQ ID NO: 58384 - DNA, 686 bp, Glycine max
  Peptide Sequence Number=SeqID_175162
acagcctcaacactttcctagagacacctgtggtattggctgagggagaatccttacccgcttactccagatactacaggatgcccactgatattagagagattgaggctgctttgtgtatacccggcggggggtgtgttttaaatgctgaaggccatccagggaatatcctcaggaaagatctaacaactcttgctcaggtttggagtgttctctcatactccaacctggctccgacttcccacacctcagatttgactgtagatagagctaggttaatctttagcctagtctctcagatagacatgaatgtaggagctctcatctctggccagatcacatctatggcccagtctaactcttctagacttgggttccctgctgttatcacaactctatgtaggtccagaggggttgcttctgacaacctggtcttcgaacgcttgagcccggtcattaacttggcttatatcaggaaaaactattggaaccctgatgatctgacagttattattagaggggccaggagagcgagggcaaggcctgctgaggctccttccacatttgcagctcctcctccagcacgtacctcagcaactccttctaccccaccttctgcacgaacctttcacttaaagttcgtagaccacgtcttttccagtttttccgaagtttttctcaaataa

SEQ ID NO: 58385 - DNA, 278 bp, Glycine max
  Peptide Sequence Number=SeqID_175163
atgatcctagattttaagagaggtgaggactatattgaggttctttgtggcgctacaaacaaaaactatggagattatgttgggaggctaaaaattaataacgaaggtcaatatttcatcacttgtgagtgttgccttgagtgtcccttggtgaatgtcactctagaagaatttgagaaacatgctttaagggaagggagcggaaggtggaagagaaacatctgggttcattgtgaagacgaagacaaagttccactctggaagacacctctgataaa

SEQ ID NO: 58386 - DNA, 306 bp, Glycine max
  Peptide Sequence Number=SeqID_175164
atggcgccgcctcttaccttttctcctttgtcttccgctgcatctccatgctgcccctactccccctacatcagctccatctacttctgctcttccttcaccatcagcagctccagttcatccaggtccctccacttagaactcaaagcctttcatgtctatgctgcagagcttgcatcagggttagctcctgatcatgcagaatttgcaggatatggtccagcagtggccagttatgagcctggaggagtttgtttagaaagtgacctggccaggagtccagccttctcctttgggagggggtga

SEQ ID NO: 58387 - DNA, 315 bp, Glycine max
  Peptide Sequence Number=SeqID_175165
atgaatggaccaaaggatggagtgtttgagtggtttattggacctctactgattataaaagagcagctaaagaaccttgagttggaggaaactgaagagacttgcctgaaagaactagtcatgaaatgcaaaaatgaattgccagaggagtgggatagcactggattcccatctgatgatactgtcaggagagcgcaattgcaagccataattagaaggcactctcttaagcattactctatgtatgaacccttctctataaatggattaacaaaagggaaggaaaatgggcaagactcatccttcaaattttag

SEQ ID NO: 58388 - DNA, 327 bp, Glycine max
  Peptide Sequence Number=SeqID_175166
atgactaattttgcacgttgttttcaaatcatcattgtcacgcatgccttatggaataatatggaagttcggcccgaaatcgacaccttgacacccaaatttgtttcgccccagatatcaagattgggttcccacgttgggtcaatgaaagaaagggaatggaaaatcttcagaccagataaattctcggcaagattgccattctcgactggcgatatcccaccccacatgaacaaagaggaaaagaccgaaacacccagcttcctctccaaaaacactaccctcgagaaaatcctattggtccgtgatcgtacgtttgatctttga

SEQ ID NO: 58389 - DNA, 399 bp, Glycine max
  Peptide Sequence Number=SeqID_175167
atgtcgcgcaacttcacggattgcctcacgatgggtgtcaagtacctcgaagtggtcaagcgaaggtcgcatcccaacaaacagatggtacccggacgaaattacggtatctccacccaccaccggactcgctgcccctggatgacaaaaggtgcagaagacgacgttagtctctatgcgttatcaggcatcgagtcttacagaaagcaaaagcgtgcagatgactataatttgtctccgcgtgctatcggacttgattgtctctggatagtgaaaaaaaggtgcaagaccatatggtttctccgcatgtcatcggacctgccgtctctggacgacaaaaagtgcagaatgaccataatttgtctctgcgtgccatcggactcgatcatctccggatga

SEQ ID NO: 58390 - DNA, 170 bp, Glycine max
  Peptide Sequence Number=SeqID_175168
gaatccaccgtaaagggatacctgccatgggtgcctctgaaaaaaggagccaagcaaatgtggtgagcccctcacgtcaagagcttgatgatcactcgttgatcattgccatgcaaagagagatgcactccttgaagcaaagaaacgtgcaagagatgaaagacctttga

SEQ ID NO: 58391 - DNA, 237 bp, Glycine max
  Peptide Sequence Number=SeqID_175169
atgtatattgttgtggtaaaacaggggcaggatcaccttgggctaccttctggagtgaagacaaaacatgaacggcagaaaccaatcaaggtacttaaggatgaacgcaagcggggatggggtcacgaccgaccgatcgttgcccttctctgtgcgaaacaagcagggaatgtcgctgcaaggcagccccgtatcctttgtattttgcagctttcttttactatttgtttgttttaa

SEQ ID NO: 58392 - DNA, 669 bp, Glycine max
  Peptide Sequence Number=SeqID_175170
atggtgtggaggacactgtctgtgagaaatacgtcatcagcaaggaaaaattggcccagttttgccagactcacagagacccttcttgggagcaatttgaaagattattgttttatttttacaggatttgtgcaaaaaggcacaggccatccagaagcagaacactgcccccacgttttgtctcatgagggttatgactatttggagcagaagctcctggctgagaagacgaagaagaagctggaggaagttgcacagtcaggaagcgttgatggcgtcatcgaccctccatccccggtcagacgccacgtgaagtggaagatggcccgcacgaagaaaacaggagagatggcgattgaggccgcaaaggaaattgctgagaagatcctcatggcatccttcagccagatgcagtcccagatgcaatctcagggacttgcactgcctcccgagcctctggttggtccctctgatcctcgaataagcacaaagggaagttgtgttgatccctcaggaaacgatcctgagacgggtgactcagataggtgcggcttgtacatcgaagcagatcctacccgcctggttgccctggggagagtttatgagggatccattgttgtctataacactcctttgttgcttggccaagtaaaggtgggtgtggaggag

SEQ ID NO: 58393 - DNA, 846 bp, Glycine max
  Peptide Sequence Number=SeqID_175171
atgacggcctcctcggacccgagatggtccgagcaactgatcgagaaaatccgcaaagcacggcccgacatcgacgcactgtcactgacacgccagctatcggaactgcaaggcgtgaccaacccgctgctcactcttagaaaagcgcccaacccaaatccggttctcgccgcctcgcttggtggtggcttcgatgccgtgcttgatcgcgccaatcgcaagcgaaagctgaaaaagcatcgccagcacagtcgtcgctacgaagaaagcggtggctggagaattgctgagcctcagaaccaagcggaagcaaacacggttctcgatctttattttgcgatgaaggcccagcgcttccggaagatgggaatccgtgatcctttcgccgatgagaatgtgcgcaatttcttcaaagctttcttcggcgaaggattggtgaaggggcggaatctgcatgagctgcgctttcttgaagttggcggaaccctgcgttcgatcatcggaaagctgtttggcgatgcaggccctaccgtcgagttcgccgcgatcgcagaagacgaactgacttccgccagtccgggtgaatttctcttcttcgaggatatcagccgcagttgcgacgaaggccgttcgatctacagtttcggtatcggtgatgagccgtacaagcgcgaatggtgcgacatcgagctcacgatctatgacacgctggtaccgctttccgccaaaggaaagcttttcacggcgctgcaatcagcccgcaacgcagtcgccggaagcctcaagcgcaatccgcgtctctggggcatggccaaggcgctacgcagcaggttcgcgaaaaggtag

SEQ ID NO: 58394 - DNA, 561 bp, Glycine max
  Peptide Sequence Number=SeqID_175172
cataatcccaatggcgtggaagctgtcgccgatctgattgccagcggtaaggagaagcgcatcgtggttgtctctcccgaaggtgacaaggcatcggcggggacggtgcgtctgttgcgtgaattcgcggatcgcggcaagcgggcgattctcgtggatatgactgctcagggaaccgtaggtctggccatgctgaatggtacgcatctgcccggcattaccgagcttttgtccggcgagcggcgtttcaacgaggtcatccacagcgaccggttctcacaggctcacgttgtgccgctaggggaggcggatcccgaaatcgccatgcgctccgccgatcgcctgccgctcattctcgacgcgctggaaaccgtctatgattttgtcgtcgtagagtgtggtccgtcgtcttcggaacagatcgggcgcattgccgatggacctgcttcggtggtgatgagcattgtcgatccggacgacaagggcgtcgcgctcgccgcgctcgacctcgaccagggtggttatgaagacgtcgtcattttaatggacgaaccggcatga

SEQ ID NO: 58395 - DNA, 279 bp, Glycine max
  Peptide Sequence Number=SeqID_175173
atgaaagagcaaatgaccacaatgatggaagccatgatgagtatgagaaaaatcatggaggtcaacacaactacagtcgttgccgcacgtatcgccatagaagtgcacccgactcacccacctggctttaatcaagtaaatcatccagccttagatatggtaggtgatgtagctccatgtggagcttgtaggccatggatgttcttcatcaatggagccctttgcttcttgaagatcatggtaggggaatggagaaggaataaagatgattggagatga

SEQ ID NO: 58396 - DNA, 294 bp, Glycine max
  Peptide Sequence Number=SeqID_175174
atgggcccagttttgccaaacttgcagagacccttcttgggaggatgtgcggaaaaaggcaaagagcataagctcctggctgagaagaccaggaagaagctggaggaagctgcacagtcaggaagcgttgatggtgtcaacgaccctccatcccccgtcagacgccacgattcctttgaggagcaggcttcacagggatccttcgtcccccatggacatcaggatgttctcactgctgttattggacgtccagagcaccctggatgtgttacatgggatgccatcgtgtttggg

SEQ ID NO: 58397 - DNA, 684 bp, Glycine max
  Peptide Sequence Number=SeqID_175175
atgctagccatcatcagcaagtaccaagaagaattaaatctagtcacgacccacgagcataaagtggcggacgagtatgcccgagtgtacgcggaaaaggaggctaggggaagggtgatcgactcgttacatcaagaggcaacaatgtggatggaccggaaagacgccataactaaacgcgccccaaggcatccctattgcaccagatcaaaatctaggacgatgggtgaccaagaggaggtacaggaacagatgagagccgacatgtcggctttgaaagagcaaatggcttccatgatggatgccatgctaggaatgaggcaactaatggagaaaaacgcggccatcactgccattgttagttcggctgccgaagcagacccaactctcccagctatcgcgcaccacccagacgtggtaggacaagaaagaagcatactggggaacatcagcaacccccatctgggatacaaccgagtggcttacccttatggattgccacttaattacacaccaacagtcatacgtgatgacgcgggtcgtgtccctccccctatccttgaaggggaacctcctcgacagtcggacaaggtccacgaggattgttgggagcttgcccaaggagacatcgattcccactccatgttccccgccaaggggccggcgcccaatgcactaccttag

SEQ ID NO: 58398 - DNA, 162 bp, Glycine max
  Peptide Sequence Number=SeqID_175176
atggccttccagcctcccgtgacaaaagatgtgaccaacatacaacgtatgcgtgacgacatgatgcagatgcgcaaaagcgcaacagggggattgtttaaaagggcacgcagcgtgtttgctctgtgcccctattttagggacctaaacgggaggaactaa

SEQ ID NO: 58399 - DNA, 744 bp, Glycine max
  Peptide Sequence Number=SeqID_175177
ggtaatgaaatccaaggtccgattcctggtggtattcgaaacctctcacttcttcaaaatcttgacttgtctgaaaattcattttcatcttctatacctaattgcttatacggtcttcatcgactcaagttcctggacctaaggctcaacaacttgcatgggactatttctgatgccctgggaaatttgacttctcttgtcgaacttcatttgtcatctaatcaacttgaaggaaccattccaacttctttgggaaatttgacttctcttgttgaacttgatttatcacgtaatcaacttgaaggaacaattccgacttttttgggtaatctccgcaacttaagggagatagatttaaaatatctctatctctctattaataaattcagcggaaatccatttgaaagtcttggatcactctctaaattgtcaacgcttcttattgatggcaataattttcaaggagttgtcaacgaagatgatcttgcaaatcttacaagtttgaaggagtttgatgcatcagggaacaatttcactttaaaagtgggtcctaattggattcctaattttcaacttatctatttggatgtgacatcatggcagataggtcccaactttccatcgtggattctgtcacaaaacaaacttcaatatgttggactgtctaacacggggattttagattctattccaacacagatgtgggaagcactttctcaggagaaatacctgattgctggatga

SEQ ID NO: 58400 - DNA, 336 bp, Glycine max
  Peptide Sequence Number=SeqID_175178
atgaaggcgaggactttgagtcctgtgaaggtgaggaccttgagtcctctaaaggctaggactttgagtcctatgaaggcggagactttgagtcctgtgaagatgaggaccttgagtcctctaaaggctaggactttgagtcctatgaaggcggagactttgagtcctgtgaagatgaggaccttgagtcctctaaaggctaggactttgagtcctatgaaggtgaggactttgagtcctgtcaaggcgaggactttgagtcctgtgaaggagaggactttgagccctctaaaggcgaggactttgagtcctctgaaagaagccaataggtactag

SEQ ID NO: 58401 - DNA, 297 bp, Glycine max
  Peptide Sequence Number=SeqID_175179
atggaatcgacaaaagaggtagtcatgatattgcacgagattagaagacctaactctctaaaaacagtccccagtggagtcaccaactgtcgcaacctacccttcgacgggagggcgacgtggggctcacgggtgcgtcttccaagggaggaaggtgcgcggagtcgccaccaatgtttattcgaggaaaacgtcggaaaaatcggaaaggtgtggtctacgaactttgagtgtgaaagggtgtttccctcgctcctacgtatcctcaattgcgataaggaaatcagacctacgtag

SEQ ID NO: 58402 - DNA, 639 bp, Glycine max
  Peptide Sequence Number=SeqID_175180
atggcgaatcaagaggagtgggtcccgtttatggacatattagcattgctaatctttggggttgtcctctttccaaacatggatggtttggtggacctagccgcaattgatgatttccttgaatatcaccatagcaaagaaagcccggtggtagctatcttggcagacttatttgacacatttgaccgaaggtgcgagaagagtagcgcacggatcatcttctgtttacctgctctttgtggacgaggggttgtattaactacaatcccgcaccccatgaggggagcaccagcggaagagagcctttctcctttccttgtgagagatttcggcgcgcaaagtttcaagattatacgaagagtccataaggcgtgggaaagcccgttaaggaaagataaagaacttaggggcatccgtaatggcatcatcggtggttatcatgaatggctgaaagttcgtacacgagggttagattggctttccaagttaaaaattatcaatgaggagaacttcgaagctccggaagaggatgaagatgtccgagctctaaaaaccgaactaggaaaagcaagacttgccaaagaaaaattcaagttggtcactatagacatccgaaaagagtgtgccgagttacgataa

SEQ ID NO: 58403 - DNA, 405 bp, Glycine max
  Peptide Sequence Number=SeqID_175181
atggcaaaacatgtaattgcagctgaaattatcttaggtaaaaacattggcctcgctgtttatattccaagaatgtcaatgtccccttcacaatcaccctggccgtttaaactattaagaagacaatttccgattatgctatcttatgcaatgacaattaacaagtcacagggacaatcactatccatggttggactttatttgccgaaaccgtttgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttcttagtgaaaggttcgggagttgtatttacgcacggggaaggtattag

SEQ ID NO: 58404 - DNA, 570 bp, Glycine max
  Peptide Sequence Number=SeqID_175182
atggacagaccagaatatgtgtggcaacagacatggcaatggatggcagatgatatcatattcaatcatagaaaagaaggtattcgccttactgaaaaggaaacaattcatttatgcttaactgagattgagaatatgctacaagcaaacagaaggagcttgcgatattttccatccatgccatacccaataggatatgcacgaaaccaacatcataataatctgatccataatgaaatgacatatgacaaagaaatgttagcagaacaatacaacacgacataccaattgctcacagatgagcaaaaaactattgtcgataccattatgtctgtggttaacactcaatcagctgcagtttactttctctatggatatggtggaactggcaaaacatttgtttggacaaccttatcatctggtatacgctccaatggtggaattgtttgtacagttgcttcaagtggagttgcttcattactattgccttggtcggaccacacattccaaatttgctataccagtccttgcaacagaaaattcaacatgcaatattcatcaaggcagtga

SEQ ID NO: 58405 - DNA, 945 bp, Glycine max
  Peptide Sequence Number=SeqID_175183
atggcttccaggaaaagaaaggcaccctctacaccaacccaagccagatttgacagatccagattcatttcccaagaggcttgggaaagatacactgatgttattgttcctaggaagcttttgcctgaaaggaacgtggtggtctactatacagagtatgatgagttcaaggaggaacttgagagacgccactgggatgaggagttgactgattttggtgacgacaacatcgatgttgccattgtgaaggaattctacgccaacctctatgaccccgaggataaatcacctaagcaggagttagctgctaagctctgtatcccagggaggggattcgggcttaatgctgatgggcagcccctgaaaattttgaggaacaacatgaccaccctagctcagacatggagtgttctttccttctctaacctgattcctacctcctatacttctgatgtcaccctggacagagccaaactcatttatggcatcattataaagatagacatgaatatggggtacctcatctcccaccagatctccctcactgctcagcatgacacatccagacttggattcccgaccttgattactactttatgtaaggctaggggagttcagtctaactctagatccttggagagcctgaatcctaccattaatttggcttatattaagaagaactgttggaatcttgatgatccaacagtaactttcagaggacccaggaaggccagagggaatagatctgaggccccttccacttcagcaccatcagaggcaccaacaccttcttcttctacacttcctccctcttcctccacaaagatcagattgattcctccagcaccttcacagattccacttccagctccagtctctgtaggtccagcagattttattttcactcctcaaatgattcactccatgctccagagcatccatagg

SEQ ID NO: 58406 - DNA, 1269 bp, Glycine max
  Peptide Sequence Number=SeqID_175184
atgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacattggacaccacgattttcgaatcagaagagatatttcaagacctgcgcacctctattcactctatcaataa

SEQ ID NO: 58407 - DNA, 336 bp, Glycine max
  Peptide Sequence Number=SeqID_175185
atgcaatacatgcagtattggcagacaaaaagaatcatgctttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggatactttgtaa

SEQ ID NO: 58408 - DNA, 126 bp, Glycine max
  Peptide Sequence Number=SeqID_175186
atggctgaagagcaacctcgacgagtgaaaccgaagtccattcatttaaagaaatacttcctagagtccaagactactgaaggaaaagctgccatctcatcctttcatcaatttctagacgagtcc

SEQ ID NO: 58409 - DNA, 342 bp, Glycine max
  Peptide Sequence Number=SeqID_175187
atggtaagaaccaagtatcgaactctcaataagaagggaccagtcactagagccatgagcaagaggctccaagaggattgggctagagctgctgaagaaggccctagggttctcatgaacctcaggagcacaaaatttcgtgctcttctctccctctcccttcattcatctccttcttcctccaagctcttatccatggcctcctatggtgaagcaaagaaattcattgatgaagaagatcctaggcctacaagctccaatgaagcttacatcaaggaagatggtcaatgtgttggtgttcctactgggcgaatgatgctactaaagatgttctctacctaa

SEQ ID NO: 58410 - DNA, 498 bp, Glycine max
  Peptide Sequence Number=SeqID_175188
atgatgataacaaaagatgatgacaaaggtgatgacaaaaagctcaaagatcaatcaaagaacaactcaagtgaatcaaagatcaatcaaagaacaactcaacacccaggtcatgtttgtgctatcggagttggtgtgaccatcgggcactactttggacatgcatcacgtggttgtagttcttctacatcgatcaacccacaacaactagctaagttgatagggagccttaaagaggagtggatgaaaaaagtggatgagaagaacaaacatagagaggacaaacttctagagaacatgaaggttttctgtgaatgttttgatgatgccaagacaaaagcaacacaagttttatttcaagtccaaatcaagaccaagaaaaaaaaaagatcaagaagaaagctaagtcttagtctatctttgttaaaagagtctcttagtgatttcaaaggtttggcctcacaacatagtttccaaattgataataaaaaggtttaa

SEQ ID NO: 58411 - DNA, 219 bp, Glycine max
  Peptide Sequence Number=SeqID_175189
atgaattcatttcctagcactgttcatgtgtcctccgttatcaagcgcggagcctctggtgactgggaaatatgtgtttctgttattttctggatcggttcctttgccaaacatgtgtataaaaaaggagtagagacaagagtcgtcatcacgggaagggcaggacggacgaaatcagtgtcttatctttgctttcctcttatctccgatgagaggtaa

SEQ ID NO: 58412 - DNA, 243 bp, Glycine max
  Peptide Sequence Number=SeqID_175190
atgacaagtaaacttcaaatgctcataacttttgctacggttgtccgtttgaggcccactatatatcaaaacgctcagaattcagaggagaatctagataaggggatttggatagaacctgtatcaagagccaaagctctgataccagatgatgcgaacctgagtaggagcggatcgtttgatacaggctacggaggtttttggatgacgccacttccggtgaaggaagataagtcagggtag

SEQ ID NO: 58413 - DNA, 1122 bp, Glycine max
  Peptide Sequence Number=SeqID_175191
atgtcaaccataagagagcttacttctgatgagatgaaactgattggcggttgtggtgatggaaataacggcggcgatcgtgacaggccaagcagaggtacaccaaactcctgtgccaatcaggttggaatgggtatcatcattggcgcatttaccggtttttcaggtggcccgccagggatgataggtatggcggttgccggtggcttgatgggggcggtctcttgcgccgataacagccccgcagggaataataagaataacggtggtgccttgggtggcaataaaaacgccaatagcgttaatgggcagtgtcgatgtgcgccgccggcgcttacctcgctaagacaccaactccaatcccgccacgcggcgccagtagccgttgcagtcggcgtgatcggtcaaggccagcggcttttcgccgcgttcgttggcgcggaagtcatcgatttgcgccagcgtctcggcgccctgcggcgacagccgcacgatgtccaccagcccctgcatgctcggcagctcgttgccgaggttgtagcagtagccgctcatggtctgaatgccgttgagcacgaacacctgttgttgctcctgcgagcgcatcatgcggccctgcggatacttgatgcagcaggtttcgcactcgtccttgccgcggttctccgagcgggcggtgaagcagcgcgccgaataggccagcggcaggtggccgtagctcagcacctccacctcgaaatcatggcggaagcccagctcgtcgcactgcgtcagcaggttggccagccagtcgcgcgacagctcgaccggcatgcaccagcgcatcatgccctggcggcgcagcaggcgcagggtataggcgttgtagcagttcagcgcgtggccggcgacgaacggcaagccgcgctccgccgccatgttcaccgcgcccagatcgttggcttcaaacaggaactcgccgttctccacatagcgtttcagctcattcagctcggacggcgcctgcagcagcgccagcgtagagatcaccacctgcttgccgctgcgggcgatttcgcgcgccaacgccagccaatcgccgaccttcatctcgcgccgcttggtgcagacgctctcgccgag

SEQ ID NO: 58414 - DNA, 378 bp, Glycine max
  Peptide Sequence Number=SeqID_175192
atgaagtaccgcacgagtgggtatataggaatccaaatctgccgaatcactcatgttatgatcttctacatcctaggtcttcccgttccttcatctggcttatgttcttcatgtttcgccgtaaacctagttggttacttccaattacgtaaatcaatagttcaaaccgcactcaaaggtagggcatttcccatttttataggaacttctgtaccagaaacaatgacgcttatgacctccccctctatgccctgcggtaatgattcctctggcattacggcctttaccacaacgatgctgtccatagatcaaatgatttcgtggattggattttacttgactgtctacggctccattgcgtgtggtgggatcctctag

SEQ ID NO: 58415 - DNA, 147 bp, Glycine max
  Peptide Sequence Number=SeqID_175193
atgacgaacaaggccaaaggaaaaggcaaggaggtcgccggaaaaggttctgctggcaagcgcaaaggtgccttcgacgacgacaagaccggtggcggccgaaagagaaacaagcccttttcgaatgaactggctcttttcgaatga

SEQ ID NO: 58416 - DNA, 225 bp, Glycine max
  Peptide Sequence Number=SeqID_175194
atgaataggtgttgtgggtgctccggatgggccgtggcggcgatggggagcaacatcagcggtggaggaggatcccttcctcttcttcgatggctctgccatttgatgaagtttttgtggattttatcggtggaaggattggtaatcgattacaggaccaataagcctactggtaatcgattacaggatgttgtaatcgattacaggctgcctgttcatgtgtaa

SEQ ID NO: 58417 - DNA, 294 bp, Glycine max
  Peptide Sequence Number=SeqID_175195
atgtcgcgggggtcaggagaccttggggacgtcaggcgagctcctggcagtcaacaaataaaaggaacaaagaccacaaagcaaggaggcttgtgtggtggctggccagctgtgaactttgagtgttatatgggatatggcctctggtttcatgtcctgagactgtgtaattcgagtttagcctctggtaatcgattaccaaggctgtgtaatcgatttccagagatgaaaagccttgagataccctttttacttacatgtagtggttatgagacgcattgtgttgctctgtag

SEQ ID NO: 58418 - DNA, 189 bp, Glycine max
  Peptide Sequence Number=SeqID_175196
atggtcgttattctgcctaaggaaaacctagttgtctggttttgttctttacataacaggccagacaactaccttaagggaataattaacagtattttaatgaagttagaccattggaaagcagagagatttaaggcgcttcgcatccagtgggcacaatattatctaaaagttagaaatcaaacatag

SEQ ID NO: 58419 - DNA, 675 bp, Glycine max
  Peptide Sequence Number=SeqID_175197
atgcgtctgcttcccggattgctggagcgtcccgagttccgcaccctgcaacgcttcctcaccgacgacagcgacctgcgcaagcgctatcagctggccgagcgcctggccgacctgttcgaccagtatcaggtctaccgcgccgactggctcaaggattgggccgctggcgagcacgtcctcaacaccgcccgcgctgaacgcaaggcgctgcccccgggcaaccgctggcaggccgagttgtggcgtgcattgctggaggatgttggtgagcagggcatggcgcagagccgtgccggcgtacatcaacgcttcatcgaacggatcaatagcctggagcaggcacctgccggtctgccggcccgggtgatcgtattcggtatctcatcgctgccagcccaggccctcgaggcactggccggcctggcacgcttcagccaggtgctactgtgcgtgcacaacccctgccgccaccactgggccgatatcgttgccgacaaggacctgctgcgccaccagtacaagcgccagcagcgcaagcagggcatgcccttgcaactggacgaccagtcgctgcaccagcatgcccaccctttgctggccgcctggggcaaacaaggccgcgattacatcaacctgctcgacagctacgatgaccccagcagttaccagggc

SEQ ID NO: 58420 - DNA, 827 bp, Glycine max
  Peptide Sequence Number=SeqID_175198
atgggtttttccccggagctagaaaggatagtcactcaggaagaccgagagataaagctacaccaacaagaaacggagatcgtaaacttaggtgttggcgatgaaaggaaagaggtaaaagtgggtacagacatgaccgcaccagtccgagatgaattggtagtcttgcttcaaaactaccaagacatcttcgcttggtcataccaagatatgcctggtttgaaccccgacatcatgcaacatcatttacctctgaatctcgagtgttccccggagatggcctcgaaaaagcttcccgcaaagagggaaagacaggtccagctgagggacgatgagttccctgaccttcaagaggagatagcccgcaggcacttggcaccactagtgacacccatggctaaattcgacctggagatggtcctagagttttatgctaatgcctggcctaccgaggagggagacgccctcagtcagttcctaggccacccactagtcttggtggagggaggccatcgcctagctattgtgtataccggggcaagatttcgcccggaccgccacggggagacaggtgcaaatcatgcacaccagcatgaccacccttatccagatatagatgacgtgagtgtgcacgcggctcagctgatttctgatgccatttatcagtttgcagggatggtgcctatgagacaccctgtggacctggagaagtccaacagggcccaggggtttcccactctgattatgggcctctatcagttctacagagtgcctgtcgcccccaacaaggtcatccggccggccatcactagagccttcattgagaa

SEQ ID NO: 58421 - DNA, 570 bp, Glycine max
  Peptide Sequence Number=SeqID_175199
atggtgaccattcaaaagaagaaaaatatagagcacgagcgagtttttacacggtctgtgattgaatcatcatttggaattggaaggataatttattgcctctttgagcacacattctacacgaggcaaagtaaagctggggatcaacagttaaatgtatttcgcttctcttcacttgtagctcctatcaaatgtacagttttcccgctggttcagaatcagaagtatgaagaggttgcgaaactcacttccaagtcattgactgctgctggaatttcgcacaagattgacacttcaactatgtggataaaatataagttctctttaatatgtacatcaataggaaaacggtatgcaagaacagatgaacttgacgtgccctttgctatcactgtagattcaacatcatcagtgactattcgggagagggacagcaagggtcaagtgcgtgttgatgtggataaagctgcctctgttgttagggaggtgactgaaggccagaggacatgggaagatgtgtggtcaacttctcctcatcattcctctacatctgcatctgcagatgattga

SEQ ID NO: 58422 - DNA, 1128 bp, Glycine max
  Peptide Sequence Number=SeqID_175200
ctctctgtggcttacaagaacgtgattggtgcgaggagggcttcgtggaggatcatatcctccattgagcagaaggaggagagcaggggcaatgaggaccatgtggccattataaaggagtacaggggcaaaattgaggctgaactcagcaagatctgtgacgggattttgaacctccttgagtccaacctcatcccatccgccgcatctcccgagagtaaagtgttttaccttaaaatgaagggtgattaccacaggtaccttgccgagttcaagactggggcagagaggaaagaggcagcagagagtactttgcttgcttacaaatctgctcaggatattgctcttgctgacttggcccccactcaccccattaggctgggacttgctctcaacttttctgtcttctattatgaaatccttaactcgccagatcgggcttgtaatcttgccaaacaggcatttgatgaggcaatttccgagcttgacacattgggtgaagagtcatacaaggatagtacgttgatcatgcaacttctccgtgacaatctgactttgtggacatcagacatcacggacgatgctggagatgagatcaaggaaacatctaagcaacaaccagtcttcggcttccaaattacgtgcagagaaagaaaggctaagcatttatcttcatcttcacttgtctttcaattccactctccctgtcttcttctacgatggtctctttccggcgccacgttggatgatttctctgctgaagagcttggtgccaggattaaggagtatgggattgtttctcctgagactaaaaatgagctttctgatccctacccttttaatttggtgtttcagacctccatcggtccctggcttcatgaagcctcagactgcgcagggcattttagtcaatttcaaggatttttttcaaaatctcattctcgaattcgcgactcttccctcatgctgatgatcctcttcttcaagaaacatcgtctgagcttgtggaacgttgatctgtgcgagcgtagggggacacgtagaactgcacccgtcaggggagcagctgtcactacggtggaggtgctcgccgacacggaggacctaggtcatgccttgtgtcgttaa

SEQ ID NO: 58423 - DNA, 324 bp, Glycine max
  Peptide Sequence Number=SeqID_175201
atgcatgaacgacaatcaattcatggggctccgaataaaagtggagaatggagaattgcactaggcaatcacttcgcgtggctccagccttattggtggaggatgcatgaaccacaatcaatgcatggggctccgaataaaagtggagaatggacaatctcactaggcaatcactacgcgtggctccagactcattggtggaggatgcatgaacgacaatcaatgcatggggctccgaataaaagtggagaatggagaattgcactaggcaatcacttcgcgtggcgccagactcattggtggaagatgcatgaacgaaaatga

SEQ ID NO: 58424 - DNA, 573 bp, Glycine max
  Peptide Sequence Number=SeqID_175202
atggctattcctggtttagctcttctacctttaaagctgaactttttatctgaggctggtctgataagccatgcattgctcttatgctacattgagaaccgatttttcaattactctagcatttactattatggatttgaggatgaggtgatgtatcctagctatatggttgtgatgacaactttattgggtttggctttggtgagaaggctatctgtagatcatcgaattggaggaaaagcagtttggattttgacttgcctcttttcttcaaagctggccatgttgtttatttcatcaaagtccgttgtatgggtttcagcagttctcttgttggctgtttctcctccattgcttctttacagggatagatccaaaacaacttctaggatgaaaccatggcaaggttatgcacatgcctgtgtagttgccttgtctgtatggttttgccgtgaaacaatttttgaagccctccagtggtggaatggaaggtctccttcagatgccacctcttcctgtgtcattgtcttaccggtcagacctaatcaagactgcccgtcactctgcagatga

SEQ ID NO: 58425 - DNA, 873 bp, Glycine max
  Peptide Sequence Number=SeqID_175203
atggtttgtgcctctgtttttgttgtcttcactcatctaccatctgctacaagcacaaagcttttgccctgggtatttgctctacttgtagctctctttcctgttacttatcttttggagggccagctgagaattaaaaatattcttgaagatagtgagataggaaatttgggtgaggaggagaagaagcttacaacattgctggcaatagagggtgcccggacatcccttcttggtctatatgcagcaatcttcatgcttatagccttggagataaagtataaacttgcttcaattttgcgggagaaggttattgattcaggtggaattaggcaaaatcattccagtcaaagtgcatctgctagtttcctgccaagaatgaggtttatgcagcatcgtcgggctactacagcaccctcctttacagttaagaggatggctgctgatggagcctggatgcctgctgttggcaacgttgccacagtaatgtgctttgctatatgtctagtcctgaatgttaaccttactggtggctcaaaccgctccatatttttcctggctcctattctgctgctgcttaaccaagattcggattttgttgctggttttggggacaaacatagatattttccagtgactgtaatcatctcggcctactttgttataactgccctctacagcatatgggaagatgtttggcaaggaaatagtggatggggtcttcaaatcggtgggccagactggatttttgtggtgaagaatttggccctcctcattcttaccttccccagtcatatacttttcaacagtttgactcttgtgacgtgcctgaagcttttgttgaagtcgatagaattgatatgcaataactag

SEQ ID NO: 58426 - DNA, 622 bp, Glycine max
  Peptide Sequence Number=SeqID_175204
ggtagagaaatggagaattgcactaagcaatcagtacgcatggctccaaaaaagtgggtggaggatgcatgaacgaaaacgcaattcatggggctccgaaaagggtaaagaatggagaattgcactaagcattaactacgcatggctcatactagtgggtggaggatgcaagaacaaaaacgtaattcatggggctccaaaaaagggtagagaatggagaattgcactaagcaatcactacgcatggctccaaactcgtgggtgcaagatgcataaacgaaaacgcaactcatggggctccgaaaaatggggtagagaatggagaattgcaataagcaatcactgcgtatggctccaaactcgtgggttgaggatgcatgaacgaaaacgcaattcatggggctccgaaaaagcgggtagagattggagaattgcactaagcaatcactacgcatggctccaaacccgtgggtggaggatgaacgaaaacgcaattcatggggctccgaaacagggtagagaatggagaattgcactaagcaatcactacgcatggctccaaactcgtgggtggaggatgcatgaacgaaaatgcaattcatggggctccgaaaaagcgtag

SEQ ID NO: 58427 - DNA, 709 bp, Glycine max
  Peptide Sequence Number=SeqID_175205
agaggactacacatcctcgccttcacaggactacatttccttgccttcagaggacaacacgtcctcgcctttagaggactgcacgtccttgtctttagagggttacacgccctcgccttcagaggactacacgtcctcgccttcagagggctgcacgccctcacattcagaggactacacgtcctcgcctttagagggctgcacgccctcgccttcaaaggactacacatcttcgccttcagaggactacacgtcctcgccttcacaggactacatgtccttgcctacagaggacagcatgccctcgccttcagaggactgcacgtcctcgtctttagagggctacacgccctcaccttcagaggactacacgtcctcgcctttagagggctacacgtcctcgccttcacaggactccatgtccttaccttcagaggacaacacgtcctcgtctttagagggctacacgccctcgccttcagaggactacacgtcctcgccttcagaggactgcacgccctagccttaagagggctgcaagtcctcgccttcagaaggcttcacgcacctcgccttcagaggactacatgtcctcgccttcagagggttgcacgccttcgccttcagaggactacacgtcctcgccttcagagggctacacgccctctccttcaaaggactacacgtccttgccttcagaggactacac

SEQ ID NO: 58428 - DNA, 207 bp, Glycine max
  Peptide Sequence Number=SeqID_175206
atgtcgtacaggatgtcacgacatcacgcttcagaacatgcagttcacgacaggatgtcacgacatcacgcttcggtgcaacctcacctacatctgggggctagcaagccagggaggaaatccactctcaatagtgttagttcaaggtctaacagcccctatttacaaccttctcacttaaccactacccgtgcgatctctacctaa

SEQ ID NO: 58429 - DNA, 186 bp, Glycine max
  Peptide Sequence Number=SeqID_175207
atggtcttactctgcgacagaggtggctttgtcggcgacggcgatggtgcaataaggctgatgggcttgatcggggaagaatggtcggagaagacgaagatgcaacagaggcgctttgatgataactttttaagtgaacccatgcctctgaacatcaacaatcttacaagtgttagggaattgtaa

SEQ ID NO: 58430 - DNA, 138 bp, Glycine max
  Peptide Sequence Number=SeqID_175208
atgtggatggaccgatttgctcttaccttgaacgggagtcaagaacttccccgattgctagcccaggccaaggcaatggtggacacctactctaccctcgaggagatccacggacttctcatctattatcttgactag

SEQ ID NO: 58431 - DNA, 155 bp, Glycine max
  Peptide Sequence Number=SeqID_175209
aagcctttgtatacggggtacaagaattccttaaccctgttgtctgtggtgttaagtctgaggacaacacgctgcctaaaacttactataaggcgaaaaagatattgtgtccgatgggtatggagtataagaagattcattcttgcccccaatga

SEQ ID NO: 58432 - DNA, 228 bp, Glycine max
  Peptide Sequence Number=SeqID_175210
atggataaccctaaggtatctccgcatgctaccggacccttgagtctgaggacaacaatgagacttttttgcggtctcggtcgaaagatgctaacatcttcgggaaagtcttggccgaaagacgctaacatcttcaagaaagaagacgctgacatctctgggaaaggtgcagatgacgactctcggctggaagatgttgacatctccgggaaagatgcagatgacgac

SEQ ID NO: 58433 - DNA, 459 bp, Glycine max
  Peptide Sequence Number=SeqID_175211
atggaagtaataggaagcaatggaagaaggaagcttacctcgatgaagaatggaagaatggagctcgctgaagaagaagaggcactccaaggaagacggaggaagactaaacggctcgcgggagaaagtagcaccagtaccagcagctcgcaggagaaggaagaaggtggaagaagaaaagccttgcggaagagaagaaaagaaagcattggaaagggaggaggaggagtaaatggactagtggcagtggctatagacaaggataaaggaagccaatatgctctgaaatgggctgttgattgtcttcttaccagaggccagactgttattctaatccacgttttgcacgggacatcttcacctgtgctgtgtctacttcacgagaccccttgcctacacaaaaacattatcacggttttgcatataccaaatttcacagctatggttttggactgctga

SEQ ID NO: 58434 - DNA, 1764 bp, Glycine max
  Peptide Sequence Number=SeqID_175212
atggttaagactagaggattaggtcgtgcgttaggtagggttgttgccagagtcattattgacgatgttgtgcatgtggtgcctgcggactcgcctgcagtaccagaggcaaaggctgttgtagttggggatgagcccatggtagatgctgccgcaccgaacaccggtgcagagattgactcacaggatattggggatgagcctgagggatttcctggtggacccagggacctatcagtgcttaccgagtatgctgaccatgttgcggccagtgtatggtctggacaggaacgtcctgagttgaagttatcctcccatgggaggaaggtgcatcacttaggcaggcttggtcctacaattgaggacatggttgctgggacaggattaagtcctttgatcgcgtgttctattgacactggcgatcggggacttatatcctcctttgtcgagaggtggcactgggagacttctagttttcaccttcctgagggggagatctcgatcatgttggatgacattgcggctcttctccatctactgatcgttggtgcactgcatgacttccagcctctgtgcaccgacgaggcggtgctgctcttggttgagttacttatggtctcaccagaggtggccatggtcgagacaggacaatgtggcagaccatacgtactcctacagtggctacaagacatataccaaggcagatgtcagaagcaacactggacagctgccactcgcgcttatcttctgcatcttttgggttgcactctctttgctaataagagttcaacccatgttcatgtcgtacacatacaggtcctgcgtgacctcactcttgctgggcggtatgcatggggagctgcagggctcgtccatatgtacgatcaacttaatgatgccattgcggagtgcaatgttgatccggactacgacgaggtgtcaccacgtgcgtgtcggtggattgtgacaaagaagactgtgaagaaggtgtctacagcgacgtacaggcaacgcctggatcgtctacggatcccagatgggcctgttgttgtcagatacagactggagagggttatgtgccagttcggctacgtccagtgcattcctgcacaccctgtccatccatgggtatcatatgatgacgtagatgatacgtggacacactactcagaccatctggcggcagcatgtgatccatgtgttgtgctaggtcagtgtgcgccagactacattgactggttcttccgtatttctcatccattcatgatcgcggcacaactatcaaatcctccagtagatgcacctcaggaggcttgcgatgccatcgccgagaggttggagcgtcacctcagcctcagggtagtcacaccaggcacattgacacatgaggtcatcaaaaaatgcctcaagattgtcaggagtgtcacccaggaccgcattgtgtacatcaacttgatccgcaagcttcatgcggatcaagttgatctgcaggtgtgtgcagacccaagggcatttttggcttttgtgaggaatgctgggtttcttcttcatcttcattctttgcgcttcttcttctttacgttcccatcaatcagcaacacttacaagcccaagtcaacctcagaggatttcttcttcttcgttgaggaggttgccgccattgttgccgaggttgccgccattgttctggacaatgttttattgggtttcgatcatcaaaagcctggtactgagcttctccctccttctcctttccacctcaag

SEQ ID NO: 58435 - DNA, 673 bp, Glycine max
  Peptide Sequence Number=SeqID_175213
gttccgaattgctgcagagatagggacgcgcttactattcctgcatcagaccaagcctgaacctttagtgcaccgtgatctgaaactagggaacattttgctggaccagaattatgtgagtaagataagtgatgttggattggcaaggcttgtcccggctgtagctgaaaatgtaacacaatgctgcatgacatcagcaactgaaacattttgttatattgatcccaagtatcagcaaacaggaatgcttggtgcgaagtcggatgtttattctctggggatcatatttctacaattattgacaagaagggctccaacgggattggctcaccatgctgaagagtctatagagaaggatagcttcgtgcaaatgctagacccatctgttactgactggcctcttgaacaagccttgtgccttgcaaaaatagcagtcaagtatgcggaactcaggcgaaaagataggccagaccttgccaaactagtattgccagagctagataaattgagagacttcgctgaacaaaacatgaccatgaccatgcccatcattttaggatgcactgcgccttcacccagccacagtgaaccttccgatttgatcagtgacctgcagcttgcacattccgaaagctcatcagctccatcaacgcccacagaaggaaaaccttaa

SEQ ID NO: 58436 - DNA, 228 bp, Glycine max
  Peptide Sequence Number=SeqID_175214
atgggggtcacgaggccattatatataacattaacagttcatctgcatcatcgcagagttaccaacttgataacaatatcaacgatctatttctcactttccgttgtcattgtacacacaaagctgcagatacgatgccttgatgtcctacttgaagacactgatgttgtgaaagcaattgagaacttggtggttggtgcaccatcgaggcatgggtttattcggtaa

SEQ ID NO: 58437 - DNA, 138 bp, Glycine max
  Peptide Sequence Number=SeqID_175215
atggtagtgataaagtggtgggatggaatagtggtggcgacgatggtgacagtgatgcggtctgatggtcgcgatgacagtatgatggtggtgacaagggcgacagtggtagtgacaattgttaacgtaaaagaatag

SEQ ID NO: 58438 - DNA, 912 bp, Glycine max
  Peptide Sequence Number=SeqID_175216
atgatgaagaaggtgaaggaatttctaaaatacatccctgtttccaagtcccaactcctagacgccatcatcctctctatccaagatgatattgatgcccatcactttcgtcttctcacctcatgcttagactctatacttcatgccgagcataaaactatcttagaggagatgcgttccgattatcaacttacagattcactccaacaacttgtgtccaatcccaatgtcaaggaggaagggaacctctatgactatcagcctgctttggacctcaccgctcttttacgatctctcgacatacctaccaagaaagattatgatacgggctccagagttaccattgctacccgtttccaacgtgctttcatgcagcttctttcaaatgcacaatttgaagaactatcagctagggacctgatgttaacgtctgcattgaacacagactatctccttaccttgccagtatatgttgattggaagagggcatatgagtctaatgccataatatttaggcgtggctatgcaactgagaagcagaagggcctattaattgttgaaaaactggattacttacagtctaagtttcttcgaagaaccttctttgctatatcagaaccactaacaaaacttggcacctggataagtgagagattatgcaaagaaattcagagtcataagctttacgaaaatgccagtcagaaacatgaagtacaaaattggacagaaagattgaggctttggctaaaggaattgtcagtatttcagaaatcactactttataatgaccctgcttcagatgagcaaataggtgaggaccaagtaccaaatgtagaacttcctatttggctggcagctcaaagggcagtagctcgatatgaagggattttgtcaccagttggtccccgttag

SEQ ID NO: 58439 - DNA, 195 bp, Glycine max
  Peptide Sequence Number=SeqID_175217
atggcgagcaaacttgctagtaagcgggagctactggaccgctggagaggcatcgaggaagaagaggataaccacgacgacgataatgctgatccctccaaacgtccaccagaaataattcaaactacagtcttactgatcgctatttgttttaataatcatggaattgcaatgttgatattagctttccgttga

SEQ ID NO: 58440 - DNA, 1631 bp, Glycine max
  Peptide Sequence Number=SeqID_175218
ggggtcaccaggccattatatgtaacattaacagttcatctgcatcatcgcagagttaccaacttgataacaatatcaatgatctatttctcactttccattgtcattgtacacgcaaagctgtaggcactgatgttgtgaaagcaattgagaacttggtggttggtgcaccatcgaggcatgggtttattcggtctccatttgtaagaggaagaggcatggatggaatgtcatgcctggacttcccagaatcagatacagacatatcatttgtaagctccgagaggccaagcagtggacgttcatcctccgtttatgactacattgacgcaggccgaacttctcgagtttctaccagttcagatcgtagctttggatcaacccgattgggggcactcaagttcaacaaccataattcaccagatacgccattctcacatgaaagcagtacaacatcattttcatattcattacagagcgtggatgaagcagcagaagctgatatgaggaggctgaagctcgagttaaagcaaacgatggaaatgtacagtaaagcatgcagacaagcacttgcatcacagcagaaggaagctgcaatgtcaattgcagagaaagagaaagcaagatgtagagcagtcatggaaactactgaagcatctaagaaaagtgcggaggaaacacagagaagaacgggtgctgaagttaaagctcttaaagaagcagaggaaattagaaagctattggacaatctagccctaactgatgtaagatataggagatactgtatagaggagattgaagcagccacgaactacttttctgaactccagaaaattggggaaggaggttatggccctgtttataaatgttatcttgatcacactccagttgctgtcaaggttcttcgtccagatgcttctcaagggaacgtgtctggactgaagttccgaattgctgcagagatagggacgcgcttactattcctgcatcagatcaagcctgaacctttagtgcaccgtgatctgaaaccagggaacattttgctggaccagaattatgtgagtaagataagtgatgttggattggcaaggcttgtcccggctgtagctgaaaatgtaacacaatgctgcatgacatcagcaactgaaacattttgttatattgatcccaagtatcagcaaacaggaatgcttggtgcgaagtcggatgtttattctctggggatcatatttctacaattattgacaagaagggctccaacgggattggctcaccatgctgaagagtctatagagaaggatagcttcgtgcaaatgctagacccatctgttactgactggcctcttgaacaagccttgtgccttgcaaaaatagcagtcaagtgtgcggaactcaggcgaaaagataggccagaccttgccaaactagtattgccagagctagataaattgagagacttcgctgaacaaaacatgaccatgaccatgaccatgcccatcattttaggatgcactgcgccttcacccagccacagtgaaccttccgtgcaacaggatttgatcagtgacctgcagcttgcacattccgaaagctcatcagctccatcaacgcccacagaaggaaaaccttaa

SEQ ID NO: 58441 - DNA, 1571 bp, Glycine max
  Peptide Sequence Number=SeqID_175219
atggccacggagcttctccaaattgatcctcctcatctcacttttatcgtggaattgaagaaacagagttcctgcttggttcatctcatcaacaacaacgcttctcactatggcgccttcaaggtcaaaaccacgtcgcccaagaaatattgcgtcagaccaaccgttggcatcgtcaagccacacggaacatgtgatttcaccgttactatgcaggctcagcgcacagccccgcctgatctgcactgcaaagacaagttcctcgttcaaagcgcgtttgtcaaagattatggaaggcttgttgatgaaaagaagctaagggtggtcctcctgagctcaccttcttcccctgtaaatggagatttcaagctggatccaaccacccaaatgcctccctctcttacagttggaaaaggactggaagcagctcaggatatggaagaggatggagctgataatggaacatttccaagtacaaggagtgttgagaaggtgggggacatgaagcatgtaaatgatgttgtgaaattgagtttagctactaaggattcagaggaattgaagtcaaggttgagtataatggatgcaaaactaagagaggctgaaggaaccatcgagaagttgaatgaagagaggcgcaggaacatccgagaaaaagatttgctcaagcaagagttggtagatgtagcatcagaagggcaaattggggaatcaatcaacaaggaaggtgtgcaattagcaaaagcaaagagaaaggatttgctagattcgaatgtcccctgcaaggatgcatccataaccaattctgttatgcaaatattcctaggagatttggataaatccattagcagtagtcattatatatacgaggaccctggccctcgaagcccagctaccaccatgcctgatcctgatgaatcctcttcttcctatgacaaacttgaggacgttctcagccgtttaaccaagcaacagctctatttgggggaatcagttaacgcgatgaccctcaagattgaggaacttcttcatcgtgtgtccccgattgtcccaccttctcagcccactccgactccattaccacatcctcaacctgcaactccaattcatcgtttaaaattggaggttccccgatttgatgggtcagaaccactgggatggatttataaaataaaccaattatttgactaccataataccccagaggcagataaacttaccgtggcgtcttttcacatggagggtcggacccttgcatggtttcagtggatgaacaccactcaccagttcccttcgtggcctgcgttcttggaggctctgcgtacacgttttgctccttcccagttcgaggacccctcgggggctttgtgcaaactcactcagacgggcaccgtggcccaatacttggctgatttcgaggacttagccaatcggaccattggccttcccactccgttcctcctgagttgctttatctccggcctcacgccggagattcgccgggaagtgcaagcgcaccaacctgctaccctcgtgcaagccgctggtctcgcacggttgcaggaggagaa

SEQ ID NO: 58442 - DNA, 720 bp, Glycine max
  Peptide Sequence Number=SeqID_175220
atgacctgggagaggaaaagcaaagcaaacaaacagctactctcctcccacgtgccatcctcgaaattaacgaaacgtactgtagttgaagaaaccacagaatcagaacctcctctactctaccctgctttatgcttcccctataaatacacacattgtccctttcttccatcacttgagacacaaactcacacactttgtactctccgtccttccttcttcgatccagatctctctccttctccctcaaatggcttcccttctgcaatgttccatgcccctcgtctctctttccaatcgagctctgctaaatgctcttggtattgggttttggctatcatcgaagatttattttacgtacccggtaccaggatctccaacccaagttcagtttccctttcaattaagggaagaagtttcccatccgttacattgcagcccagagggcgtcggtttcagcttagatgtgcggcaaaaccagagacagtgaagaaggtgtgtgacatagtcaagaagcaattggcactgccagatgaatcagctgttactggagagtctaaatttgctgcgcttggagctgattctcttgacacggttgagattgtgatgggacttgaggaggaatttggtattaccgtggaagaagaaagtgcccagagtatcaccaccgttcaagacgctgctgatatgatcgataagcttcttgaaaccaaggcttaa

SEQ ID NO: 58443 - DNA, 3519 bp, Glycine max
  Peptide Sequence Number=SeqID_175221
atgagtgatcttattttcactgttggtcaaggtcgtaattgtaatttatggcttaaagatcccactgttggtaatgttttgtgcaagttgagccacatagagcgtggaggctcgtctgttgcattacttgaaatcacagggggcaaaggttctattcaagttaatggcaagacatatcgaaagaatgcccgtctgattttaagtggaggtgatgaggtggtctttggttcttctggcaagcatgcttatatctttcagcagctcacaaataataatattaatcctgctgatataccttcttctgtgagtattttagaagcccaaagtgctccaataaatggaacgcaagtcgaagctagatctggtgacccttctgccgttgctggagcatcgatattggcctctttatctaatcttcctaaagatttatctctcctttcacctcctgctaaaactggaaagaatgtgcaacagaatgctgacatttcatcactaccttctggcaacggggatgatatgccagacagtgaaatgaaggatgccaccaatgatgtagcatctgaagttttctctgctgataaaactgttaataaaaatcctaaccttgacacagctgaagtcaacatcaatgtggatcccgatgttgggaaggttactgctgctacctatgaattgaggccattattgcgcatgcttgctgggtcatgtcctgaagttgatttaagttgtggcattaccaagatattggaggagcgaagggaattaagagagctccttaaagatgtcgataccccgacaatattggcatcaaccaggcgacaagcatttaaggacagtttacaacagagaattctcaaatctgagaatattgatgtctcttttgaaactttcccttattatctaagtgatacaacaaagaatgttttgattgcttctacatttattcatttgaagtgcattggctttggaaaatatgcttctgacctcccatcagtgtctccacgaatattgttatctggtcctccaggttcggaaatatatcaggagactttgtgcaaggcacttgcaaagcattttggtgccaggctactgattgtcgattctctctcattgcctggtggagcatcatcaaaggaagttgattctgccaaagaaagttccagacctgaaagaccatcatctgtgtgtgctaagagaagttcccagactaccacattacaacataagaaaccagcttctagtgttgatgctgaaattgtaggtggatccacgttaagttctcaggctatgctgaagcaagaggtttctactgcatcgtcaaaaggcactactcttaaagagggtgatcgagtaaaatttgttggtaactttccttctgccgtctcatcactaccaaattatccttcaaggggaccaagctatggctcccggggcaaagttctgcttgcttttgaagataataggtcttcaaaaattggggttaggtttgataaatcaattccagatggcaatgatcttggaggcctttgtgaggatgatcgtgggttcttttgttctgcaaatcatttactacgggtagatggttctggaggggatgacgcagacaaagttgcaattaatgatatctttgaggttacctctaatcagagtaaaagtggttcactagttttgttcattaaagatatagagaaggcaatggttgggaactatgaagttttgaaaaataaatttgaaagcttgccaccaaatgttgtagtaattggctctcatactctgcttgacaatcggaaggagaagacccaacctggtggccttctgtttaccaagtttgggagcaatcagacagcactacttgatcttgcttttccggataactttggtagactgcatgatcggagcaaagaaacccctaaagtaatgaagcaacttggtcgtcttttcccaaacaaagtgacaatacagttgcctcaggacgaggctttactttctgattggaagcaacaattagaacgtgatattgaaactatgaaagctcagtccaatattgtcagtgtttgcacagttctcaacaggattggattggattgccctgaccttgagactctttgcatcaacgaccaaaccctcacaactgaaactaaatataagatgtttagatttgctgccttattgctgataaaatcctatgaactcgatttcctaggtgtggagaagatcattggctgggctataagttaccattttatgcattcatctgaagcttctatcaaagattccaagcttgtgatatctgcaaaaagcattaattatgggcttaacattctacagggcattcaaaatgagaacaaaaacttaaaaaaatcactgaaggatgtggttactgagaatgaatttgagaaaaaacttcttgctgatgttattccgccaaccgatattggggtcacatttgatgatattggagctttagaaaatgtgaaggacaccttgaaggaattggttatgcttcctcttcagaggcctgagttgttttgcaaaggacagctgaccaagccttgcaagggaatattgctttttgggccccctggcacaggaaaaacaatgcttgcaaaggctgtagcaactgaagctggagcaaatttcattaacatttcaatgtccagcattacttcaaagtggtttggtgaaggagagaaatatgtcaaagcagtcttttctctggccagcaaaattgctccaagtgttatttttgttgacgaggttgatagtatgcttgggagacgtgaaaaccctagtgagcatgaggctatgcgaaaaatgaaaaatgagtttatggtaaattgggatggtctgcgtacaaaagataaagagcgtgtacttgttcttgctgctacaaacaggccttttgatcttgatgaggctgttattaggaggcttcctcgacgattaatggttaatttgccagatgctccaaacagagaaaaaattctcagtgtcattttggcgaaagaagatttggcacctgacattgattttgaagcaatagctaatatgacagatggatattctgggagtgacttaaaggttgtatatctatgtatttttcacttcctctcttggttgcttgagaagaatctgtgtgtcacagcagctcactgtccaatacgagagatcttggagaaggaaaagaaggagagaagcttagcattgtctgagaacaaacctttacctggattgtgtagcagcggtgacattcgtcccttaaagatggatgattttagatatgcacatgagcagttcaaagatgagctagcaaatggaagttcaaatggaattataagatgtgtctggtggatggatggaagttttagccaaataatgctgaatctggctcagctcaaagaattagtgtgtgcaagtgtgtcatcagagtcaacaaatatgaatgagctactccaatggaatgacctctatggagaaggaggatcaagaaaaatgagatctctgagctatttcatgtaa

SEQ ID NO: 58444 - DNA, 2496 bp, Glycine max
  Peptide Sequence Number=SeqID_175222
atggtagtcgaagctcaaatcatcaagcctatcggcaagggcatcgttcacagaatctgcgccggtcaagtcatcctcgacctctcttccgccgtcaaggaactcgtcgaaaacagcttggacgccggcgccaccagcatcgaaatctccctcaaagacttcggcgaacagtggtttcaagtcatcgacaacggttgcggcatttccccaaacaatttcaaggttcttgcgctgaagcatcatacgtcaaagttatcggaatttcacgatcttcagtctctgacgacttttggattccgaggggaggcgctgagttcgctctgcgcgttggggaacttgaccgttgaaacgagaacggcgagcgaaccggtcgcaacgcacttgacttttgataattccggtgttcttgtggcggaaaggaaaacggcacggcaaattggcaccactgttatggttaagaagttgttctccaatttgcctgtgagaagcaaggagtttagtcgtaacatacgtagggaatatggcaagttggtttctctattgaatgcttatgcccttatagcgaaaggagttcgttttgtttgcaccaatacaactggtaaaaatgtgaggtctgttgttcttaagacgcaaggaagtggttctcttaaggataacgtcataacagtgcttggcatgaacactttcagctgcttagagcccgtgacattgtctatatctgattcttgtaaggttgaaggatttctttccaagtctggacagggtaatggacgcaatttgggggatagacagtatttttttgtgaatggtagaccggtagatatgcctaaagttagcaaacttgtgaatgagttgtacaagggtgcaaactccaaacagtatcccattgctattttgaattttacggttcctactagagtgtatgatgtcaatgtgactcccgacaagaggaaaatatttttttctgaagaaaatgccatattgcaagccctgagagagggattgcaacaaatttattctgctagtaatgtctgttactctgttaatgaagttatgttgcctgctgaaaaagaagagtgtgttgagttgtgttcctctcatgggaagtctcctattgtaaggaaactatattccccaaatgccagttgtcctcagaaagagcaatgtagtgaaagtaacaatggtagtgtttctttagatgaaattgatactgagtgcaacaatgataccatttctcaggatgagcatgaggagaaacatattactgattccaaaaatgcttctgaatctattaatgaatatcggtacacacatattgatgaagggttaatttgtgaaaatgatgggagtttaatgaaccaggagtttacactcagagcacatagcgcttcaaaggatgacgatagtggaagtcggtcagcgtgtcctagtagtattatacctgatcaagctacccttgtctcaaggacagttgagagtggcagcacttctagtaaatattcatttaaccattcaagacatgttcagtccactcttaacaactttgtttctgtaaataaaagaaatcgtgatagtgtcattagagccttatctgaagtgcctgttcttagaaatcaagctcctcattgtcaattgaagactgcaaatactgaaacacaggacttgattacaagatcatcactttgttttgaccaaagtgatgaacctgctagggcgagtgagattgaatctttgaagcaacttaatcctgataatgtcttctacaaaaatgaaaatgcagtttcttttaagggtgactcctctgttagagaacctaaatctaatatggaattagatctaaagaataatacacctctaggggatacagcatcaattactccttctagcattgatatgatcactacggatgttttggcctcagaccctccattacattcatcacctgtgtggttaaattcttgcaagtcttccagtaacaagatatgttccaacatgcaattttcttttcaagagcttaagaaaaggagagagaagaggctttctctgttgcaatccagtaaatttggatgtggaaaagctaaagtcaaaagtcactattcggctgcaactttggagattttacaatcagaaattggagagcagaaagaaagggccttggcagcagcagctaccgaacttgaaagatttttcaagaaggaagacttcagcagaatgaaggtgattgggccattcaatcttggatttatcatttgtaaattggatccagatttattccttgtggaccaggatgctgctgatgagaagtataattttgagcgtttatcacagtcaaccatcttgaaccaacaaactcttcttaggggagtttcaataacccggtacaaggaaattgcttattctgatgcaaacttccagagaaggccaataaaattggagttatcccctgaagaagaaatagttgcttcgatgcacatggacataatcagttattactag

SEQ ID NO: 58445 - DNA, 330 bp, Glycine max
  Peptide Sequence Number=SeqID_175223
atgaagggaaaccaaaatattttcctttacccgagccttcaggaaaaagacttcactgctgaaaaggaggttacatgttcagggactccctcaaaattcaaaatttcctatacacttctcatccccctcttctcctttcatctcctgctccctccatcttctttcctttctgttcttttcttttttcctttcctcaaagcacagaccgaagaactcaaaaatggtgctagcgatagaggagaaagcataaatcgaaggatttttcttcctctctacaacaaccaagatcaaggctcgacaacattacccactgagagtgatttcggttag

SEQ ID NO: 58446 - DNA, 1602 bp, Glycine max
  Peptide Sequence Number=SeqID_175224
atggtgtgtggaacgtggttgggaatacccgatacccgacgggtacggggatgggacaataaactcaaacccgtcgggtattgggtacgggtatgggaatatgttgaggagccaggggttatcgtcgctctattgccgattccgccatttctcacttcgacttcgagattgttgcagcaggtgcattgtttttgcctctcaatggtatgttccccaggaagtgggagaatggaagtcatggcaaggcttctcgctgctgggactttctctcacactgtagcagatgactttgcccgtgagaagttggctgctgagtatatttgtagagaactacgtgaggcagatgaagcaaatttgcttcacgaagaagatatgcatgtctatggtgagagccccatgactgatgctttgcagctggtatgctgcaacacttgcaagaaaccaatcaaggacagtcaatttgctgctcatgcaggtactaatattgagccttccttgttttccccttccatcccccctgttattttttcagaactttgtaggtcattaaagctcacagaacagactatggtggagcttgacactgggaatcgaaaacctccaaggaaggaaaagaaaaagttaggagcttcttctgcaaaccaagcttctgcagttggggagcagagaaggtccgagtctatagacaatattgactctgctttgtcacaatcccacttgaatagtcaaatcagagtggttcccttttccaatgaggtaacaggatactcaagttgtgtaggtgcagcattgatcatggatggtactggcattgatgctggaaatagagatcactcagcctctgtaatgtatcctccaacaaaacgtcataaattgatagcaaacatacatctacctgtattagaaagccatggaacagaatctggagagacaaaaactgtgagtttcacagatggaattacttgtaatttcctggaaagaactatttcacaacgtggagatcctaaccataaaaaccgtgggcaggtccttgtgcaacatcaaggcataatgaagaatgattctcctgcaccccttgctacgaagatatattattcacaaaggaccaatcgactgcgtgccagaattcgtcatctttacttccaggacttaaatgggcaatgttgtactgatgttgtgtgtccaaagacttcacatgcagagatggtcgcattccaagattcatctctgagggacccttcatttgatcaaatggacaatgtgcatgaggctttgactttctgtttgaaggctaaagatggaaataccttccatcacccaccccaaatccaaattctcaccaagaaaagcttgggccgattgcctgctcaaaaatctgatcatattcttgcaaaaagctcagaaattggcttgcttaaggcagggggactgccaagtagtggcttgccaaatcaatttcttgataatgtttctaggtctgcaggcactaatggtggtttgactagaagcaactttcttccaacatcttattcttttgtgagcaacacaggaaatccactgggaacaatgcagcaaccaaatgggagtgttcctgttatttag

SEQ ID NO: 58447 - DNA, 696 bp, Glycine max
  Peptide Sequence Number=SeqID_175225
atggagaaattgagaggaggtatgggatttcgtaacctctttgcttttaacatggttatgttaggaaaacaaggttggaggctcttgtataaaccaaatgctttgccaggaaggatcttcaaagctaaatactatcctaccggggatttcatgggttcttcaattggtcacaacccatcatacataatggcgaagcttgttctcttcaaaggctttcagtcatggcttcgaaagcagggacatcgttatgtgacttctcccatagtgccaggacttgaaaatctggaattaagttccattgttcatcaccaaaataatgcttggaatttggagatattaaatcaaattctctccctagaggatatcaatgaaattattcatactcttgttccttcattcaaggcagaagataagctgatttgggctgaagccattgatggtttatactcggtcaagagtgcttatactatgatcatgaagaattttctgcaacatgatgacatgtgtgttgatggtggctggaagatgatttgggacacgaaaatacctcaaagggtgaagctaatgatatgtagatcttttgcagggattatcttcttcccagaagaagcaacttacgaggaagaggagtccaatgcccgattacttgcccactatgcgaaatcacttctcacattgtccttacttgcccagtga

SEQ ID NO: 58448 - DNA, 2022 bp, Glycine max
  Peptide Sequence Number=SeqID_175226
atggccttacccgattttcaggttccattcacggtagaaacggacgcttcaggtaacggcatgggagcagtcctatcacagaaaggacacccaattgcttactttagcaaaccgttcactcagaaattattatcggcatcaacctatgtccgcgaattgttcgccatcacttctgtcgtgaagaagtggcggcagtatcttttgggccaccaattcacgatcataacggaccatagaagcctgaaggagctcttaactcaggtgattcaaacccccgaacagcacacgtatctggcgcgattaatgggatttgattaccaaatccaatatcgatcaggcgcgcacaatcaagcggcagacgctttgtcaaggtcaccggaaaatgctccaccggaatatcctgcttcccaatttttgatactctcagttccctgtctaacatttctggaagaattgaaacaccaggtgactattaatcaacaatattgtcagaagcgacaagctattcttgattctccagactcgcattctgatttcaccattcatcagaatttcattcttcagaagggtcgattatggcttccgcgagatctccctattattcagtccctactacaagagtatcactccactccaatggggggccatgctggggttaccaagactttagcacggctgtcggagaatttcatttggccaggactcagggctgatgttgtcacctatgtcaccaattgtagggaatgtcaggtcacaaaatatgaaacgaaacgcattgcggggttgctatgccctctcccagtaccattcagaccatgggaggatctttctattgactttgttgttggtctacccccctttcaaggcaaaacggtgctcctggtgatcgttgaccgtttttcaaaggggatccatttgggcattctgcctcaggcccataccgctcacatggtagcacagctcttcattaacattgttgtcaagcttcatggtatccccagaagcctagtatctgatcgtgatccattgttcattagtgggttttggcaagagctcttcaagcttagtggcactcatcttcgaatgagttatgcctaccatccacagagtgatggacagacagaagtcatgaacagagtaattgaaggttatttacgagcttttgttcatcgtaggccaacatcgtgggggaagttcttaccctgggtagaactatctcataatacttcatggaatagcagcacaggctcaaccccttatgagataacatatggacgcaagcctttttcttttccagattatattgcaggatcctctaaaattgatgcagtagatgatcttctcttgtctcgtgatgaagtgttcactactattcgccggaaattactcaaggcacaagcttccatgaagaaaactgcggatgccaaacggagagaggttaattatgagcccgacagttgggtattattgaagcttcgtccttatcgacaaagctcagtgaagagtgctcaggcagtgactggtaaattgtccaagcgcttctatggaccgtttcagatcatagaacgtgtgggtaaggtagcctatcgtttgaagcttcctgatggggctcgtatccatccggtatttcactgttcccttttgaagccattccacggagaccccattcttgattcacccaattcactgccgacacgctttattaacggtcaaccgatgcttacaccgcttgccattcttgattatcggcgacataaggagagggacacgtgggaagtattggtccagtggcatggactttcccctgatgaatcctcttgggaggactgggaacagcttaagcaggatcatcaccttgaggacaaggtgattctccaagggccgaaggaagttgatagcagtatattaacagatgtagcatcagaagggcaaattggggaatcaatcaacaaggaaggtgtgcaattagcaaaagcaaagagaaaggttatcaggcccgcatatctcaaggattatgtctga

SEQ ID NO: 58449 - DNA, 222 bp, Glycine max
  Peptide Sequence Number=SeqID_175227
atggaaacagaaaggttgagaagaacaggcaggaacaaagaaaacaaggaagagaaggaactcagaaacaaggaaacacatgaaggcacaagtggtcagagagcaaaggtttgtgctagtgtgtcatcggagtcaacaaatatgagtgaactactccaatggaacgacctttacggagaaggtggatcaagaaaaatgagatctttgagctatttcatgtaa

SEQ ID NO: 58450 - DNA, 165 bp, Glycine max
  Peptide Sequence Number=SeqID_175228
gagagaagcttagcattggctgagaaccaacctttacctcagttgtgtagtagtactgacgttcgtcccttaaagatggaggattttagatatgcacatgagcagtcattcgcattgtcatctagtgacgtatatccttcattcttctcctttcacatggactaa

SEQ ID NO: 58451 - DNA, 720 bp, Glycine max
  Peptide Sequence Number=SeqID_175229
atggctgaagggttgtcagcagaaattgaaaaaagcatggtgcatgaagaaaacatagcgagcaacctcgacaagaggctcatgggggaagggcttttgatgaatcccgttgtgatcatgcgtgcgtggagttggtttacgtgttttgtggttgtgcattttgggagtgtggtgagtgtgggaatggcggcgtcaccagctaccatttctgacgccgaagtcctccaccgacacacttccgtcgttcgcctccgatggcaccttgcgaaactcaccgtttctccactcgaaaactcctcgcccagagaaggcacgcagcaagcgctcacgcgcggcgccgggggactggtccacacgcctgctccacttggtcgtgctggagcagatgaagccgccgctggcaaagaaatgagagggaatgaatgtggagcgttccagacgcaaatgccttcactgcggtgcggagaagacgccgcagtggcgaacgggaccgatgggaccaaaaactctatgcaacgcgtgcgacatgaagttcaagtccgggaggctggtgccggaatattggctgatggcgagtccaacgttcatatcaatgaagcattcgaatttgcatcagaaggttttgaaattcaggcggcagaaggagatgcgacgatagcagcatcatcggccattgatgagtcaaagttcaattttcgatatatccaacggtggcgatga

SEQ ID NO: 58452 - DNA, 393 bp, Glycine max
  Peptide Sequence Number=SeqID_175230
atgtcaatgttcatcatgcctacactgtttttgctgttgttcattgtgtttaacaccgggtatttggagaaccgcatttttcggatcaacttgatccgtaagaggcttacggatcaggtgatccgtaaactgcctagcaacttcccgatggcggtttctgccatcgccggcaacaatggtggaagaagaagaaaggcgaaggagaaacgtacctcgaagaagaagcagaaactcgaagaagaagcagcaacgcaaagaagaagctttccacttgatcccgacaacaatggcggcaacgaagatgaggaagaagcagaaacgcgaagaagaagacttcacttgggaagaagaggcagcgcgaagaagaagaagaccgaagaaggtgcagaatga

SEQ ID NO: 58453 - DNA, 336 bp, Glycine max
  Peptide Sequence Number=SeqID_175231
atggatacattaccgttggtgaacaatgcacctcaggaatggacaatgaataatactcatttgatggtgaacaatgtggcattgggtgctagtgtacaaaacctattcatgctaagtgtgatttttcatccatcgggcgctctacaaaaaaaactgagtttatgtatctccatgaaagttgtagatattttcacccttgaggttttggcattggtcccaagtcattttgatatttataagttgagatatgctcaaaacaattccacctatgttagtgttgttagggcaacaattaacttcaacttcaagcccaattttctcaatgattcacattga

SEQ ID NO: 58454 - DNA, 285 bp, Glycine max
  Peptide Sequence Number=SeqID_175232
atggctaaccacattccaatagagattagtgcaaggcatacttctattagggcagtgttagccttggtaaacattcaggatttgcactcggagcatatgtatttgaagacaacttttcttcacggtgatctagaggagcaaatttacatggaacaaccagaggggtttaatcaagatggaacgaataggctagtttgtaagttgaagactaaggatcacccccggttccccaacaattggtatcaaaacatggttcgctcaggtggtcaactcagacaagtataa

SEQ ID NO: 58455 - DNA, 378 bp, Glycine max
  Peptide Sequence Number=SeqID_175233
atggcgtgttgctgctcaagagaaaatccggttcttcctttggcaagctttttgtgctgcattgccaaccaacaacaagcgttttgcttgcaatctatctccctttgcagctctgcaccgaaggagaacattctacatgcctcgagggattgcccacactcgaaagaagtctggcggcgacttgggttccagtctaggagaattctgacttgcaaagataataaagaatgggttctagcagatgaatggttgagtcatgatgtaatgggggatggtggggttcttcgcgactccaatggaaactgggtgtttggttttgctcaacattacggactggggagccctctgaagggggagctgttggcatttgggctttaa

SEQ ID NO: 58456 - DNA, 681 bp, Glycine max
  Peptide Sequence Number=SeqID_175234
atggacacccgtctccgtgtgattggtgatcccatgaatgaagttcaacgggttaaaattcacacaaattgctttgtcccagttgtgttcccagttcgactggcacacaagattgacttgagtaagtgcgtggtgttattgacgcatccatcatttgaagtggataatgataaaagaagaagatcaaattggcgttgtggtcgtggttcggaggaatgggaagtgcaggaagcttgtagggccgtttcaagttatcttggagaattgggagtgtcgttggaggattcggtgtggatggcgtcaaagtcaccggagtacgtgaagatgttggtggaaggtgtgagggatttggagcagtggcatgagtgggatgcaggcctaagcttcagggacaagattcttcatatcgcccctcaaaaaggggacaagggcaaagttgcctacttagagactctgggcttctctctctcttcctctatgaacatcgccagatatttctccgctgacactctcacccttccatctctcatgcacaaggttactcgtatcaagcaactattgttcttttctccctctcccgaccaccacttgcttcttatcaaaaacattcccctcatgatgcgccacctctctatttccgttgaccaagacctgcaacacactctctccttttttttttaa

SEQ ID NO: 58457 - DNA, 589 bp, Glycine max
  Peptide Sequence Number=SeqID_175235
atggatatcgataagggcaaacattggtgggtgtggaattgggaagaaggtggatctagtgatttgtgggtctatcaaggggaaggagggaggtggaagaaaggaaagagcaaggatttgaatgttgtaaaattcaaaggccacgtttatttgaataatatacttgagttgggagcagaaacaaataaggggtgctccctccatcttcgagcacagatacctgatgttgagccaaagaccccactaaatgcaaggcttgtgggtttgaatgacctaaaagagcattgtagttgtctgggctgcagaagagttaggggaaagaaatgtgccttccgccttgcaacaacagctcaaattgaacttggtgtcatagtaataacacaagcccttattgtggggatcaacaatttcggccacactaaggtttttgtaatgggtgttggggagaaggttaagggacgaaaatggattgggttgaggagaaggagccaaggaattttgtgggaagggtgtttagagtttcgcgagagccatggcctggataagggtgatgggttggtgtgcttagacttcacgacgaatctcaggg

SEQ ID NO: 58458 - DNA, 3495 bp, Glycine max
  Peptide Sequence Number=SeqID_175236
atgaggtatagaagaacccataaaatagcagtggaagggtgtttgtgtttgtgtcgctcatggcattcatcatcgaaatggcggaggaggaatacagtgaacagcgagtcattgtcgagatgtccatctgatttgattgccctctcccttttcctttggtcagcccaacgtcgccgccacgactcattcgccttcgatcgcatagtgactgtgctccttcggctcactcaccgctacgacaccgttccagccattctctctcacttggagaccatcggctgtgcctctctcacaaaccctgtatctcagttggtgctgttgaggatttactcgcgtgcgggtatgtatgcaatgctcttggaggcttatcaccacttgcaagcctcttacgcttttgtccccgatacctttgctcgcaatttggtcatggacgctctctttagggtcggtcactcccatctcgctctcaccctcactctctctctcttcagccacactcatccccctaatttcttcaccttccacattttgctcctccatctttccaaactaaacaacaacaatctcaatctctacctccctcacattgctcgtatactcagacttctgctctgggccggttattctccctctcctctcacttttcagatgcttctcaattctctttgcaagattaatgcattcccacaggcttatcagctcctcgctctcatgactgctctcgggatcaatttctctgtcaatatttggaccattctcatccataactactgtaaattcggccgccttcgtcttgctaacaacctcttccacaatatgcttcaaactggttgttctcctaatgttgtgacatataccatcttatttaaggcttttatgcaatccaacatgccaacccctgcttttcgcttgtttaatatcatgttatcttctggccaatctccggatttaattctttgtaatgtattaattgattgtctttcaaaggctggaaggtgccaggatgcaattcaagtttttctcagtttatcagagcgaaacttaaagcctgattcttatacctttgcttcattgttatctacaatttgtcgttctagaatgttttatctcttacctaaactagttctagtctctagacatatagatgctgatttagtgttctgtaatgctcttttaagctctcttactaaggccgaccttccttctcttgctgttggattctatgaccatatgattgatgaaggttttgtgccagataaatatacttttgctggattactaagtgcactctgctgtgcgggaagagttgataaagcagttaatgtgtaccatggtgttgtaatgagttatcatgacactgatgctcacatccatactgtaataatagttggtcttctaaagaccggaaagtttcacaaggctgtcagtgttttaagatttgcagtaatgaataaatatccactcgacactgtagcatacacagttggcatctgtgcacttcttagaggtagaagaactcaagaggcttgcacattgtatgaccagatgaagaacaatggtctgaaacctagtgttcatacctataatatgatgctgttcactttttgtaaagaaagggatctccagatgataaaacagatactgcaagagatgattgattcaaggatatatctgagtggcagaaatttctccaacttgtgtaaatatatgtgtagatcagatactcatctttctcttttaaaattgttggctaagatgagagatttgaggcagttggtgatccgatatgttaaacaccgtgctgttcttggtgccaaatatcatcgcatagattggacatccatttctgatcttccagcttctccaatcgcttgtatgagaagaatgaatttattgaatagtaacatgagatttaggaaagccgtgaataaactctgtaacatgctcagtgaacgatatgcaaagcaactggaaaagtcccagtacccgtcattaaacaatgattgcaaacagtttgtgcgatcccagtcctgtgaaggtatcctcaataattctagtcctgatgctgaaattcaaattacaagtctaaacaaagaagcttgggatgactttgagaacaaaaataccaagatgtcccttgatgagattcttcgctgcaagttgatggctaagctgggtgcctcctcccaaaaaggtcaattgcaatatggtgggtggtcagatgcaaatgcgaatgctgatggacttgttgggggcactggcaatgaacgttttgaactatcacaacatttcttgcagagtgtttccaagtcaccatttccatttaatactggaaagcaagctgttaaattttctgcatggctggaggaaagaggcaaagacctcacagaagtgggcgctaatcttgctgaagatctacaatgtggggacatttttcatttgcttgatttagtctcatcgggtgaactttcaatttctccattcctaccagataatggtgttggagaggctgaggacttgagaagtgcaaagcataaatatgatactaccaagtcttcatatagtgataaagccaaaaagtcaaaatccttctttggagtagaaggtgaaattatttctcgtcgggaaaaaggttttcctggtatcatcatttctgcacaccaaacaacaatttctagagctgatattttaaatttgttgaaggataatgataactgtggccaaccttttgacgaagatttccaattaaacattggccaaagcagtaattattcacttcctgaccatatcttggaaatcactaaatcttctgaccctgtcttcagggttgtttatgctgccatccaaaaggctggtgaccaaggattaagcatgggagaaatttcccagatagatgtcttgattgttgatgctcttcaagcatttgggcaagccttaaaggttaatgcttatgatactgtccgtgttgttgatgtcttataccgtcacaagtactttttgacacctatgtctgattttcatcttcatgttgtacaaccttcctcaacaaaaaccatcgagaaaagtgatcatacatgtgagctttatgaatcggaggaaagggatactacttctgttgatactttgagggaaagaaacaccgctattgatagcgtgcacacattgacaattctcaatcttccacatggggatgtggatcctgaaaatcaagcttgtgataggaatgaaggctgtaagcaaaacagacttggcttatccagagtcaatcataagaaagaaactctcgaattttcttctggtgaatcatgtgtgccaatattgccatgggtcaatggagatgggatcatcaacaacattgtttacaggggactcagacgtcgtgttcttggaatagtgatgcaaaaccctgggatattggagatttctaacagaatcataaaagaagataagaaagatattttgagagagagagagaacttgggaagcaagaagtga

SEQ ID NO: 58459 - DNA, 507 bp, Glycine max
  Peptide Sequence Number=SeqID_175237
atggaagaggttggtagcaagacaaaggcggccgaatttacagtagttatggatgagaatggtccaaatattgatagagaaattgatctcgagagcggtcatgagagcgaggagctgtttggaaatatggaggagagaaatgtggaaggtgaagaaattagggggatgagtgtggttgaagagagagagagtgagggtgagagcgagatgggagtgaccgaccctaaagagagcgtccatgaccaaattatgagcaaaggtatcggggacaaaagcgtaagaggcttgcaagtggtgataacccttcaagagcatcacatacatacccgcacacgagtaaatcctcaacaacaccgactgagatacagggtttgtgagagaggcacagccgatggtctccaagtgagagagaatggatggaacagtgtcgtagcggtgagtgagccgatggagcacagtcacgatgcgatcgaaggcgatggtgtcgtggcggcgacgttgggctga

SEQ ID NO: 58460 - DNA, 2460 bp, Glycine max
  Peptide Sequence Number=SeqID_175238
ttccttcgagatgggaaatgggttgaggaggatgctagcattcttgttccgggtgatataattagtgttaagctaggggatattatccctgcggatgctcgtctacttgaaggcgatccactgaagattgatcagtctgcacttacaggcgagtctcttcctgtcacgaaaggccacggtgatagtgtttattcgggctccacatgcaagcagggagagatcaatgcagttgttatcgccacaggagttcataccttctttggcaaggctgcccatcttgtggactccacaaatcaagttggccattttcagaaggtcctgactgctattggaaacttctgcatatgttccattgctgtgggaatgatagtagagatcattgtcatgtacccaattcaacaccgggaatatcgtcctgggattgacaatctgctcgtgcttcttatcggaggaattcctattgccatgcctactgttttgtcagtgacaatggcaattggatcccatcgcttagctcagcagggtgctattactaaaagaatgacagcaatagaagagatggcaggaatggatgtattatgtagcgacaaaactggaactttgactttgaataaactgacagttgacaagaatcttattgagatttttgctaaaggagttgacgtagatactgttgttctgatggccgctcgggctgcgcgattggaaaaccaagatgctatagatgcctctattgtaggcatgttgggtgatccaaaagaggcaagggctggtattcaagaggttcacttcctacccttcaatccaactgacaagcggactgcgatcacttatatagacagtgaaagtaaaatgcatcgtgtcagcaaaggagcaccggagcagattttaaatcttgcacgcaataaatcagagatagaacgtagagttcattctgtcattgataagtttgcagacaggggcttacggtctcttgcagtagcctaccaggaagttcctgatggaaagaaagaaagccaaggagggccttggcaatttattggactgttgcctttatttgacccacctagacatgatagtgctcagacaatacgaagggcattaaatcttggagtaaatgttaaaatgataacaggtgatcaactagcaataggaaaagaaacaggacgccgtctggggatgggaaccaacatgtacccttcatcagctttattgggccaaaacaaggatgaatcaattgctaccttgccagttgatgagttgattgaaaaagcagatggatttgctggtgtttttcctgaacacaaatatgagatcgtgaaacgtttacaagctaggaaacacatatgtggaatgactggtgatggggttaatgatgctcctgctcttaaaaaggcggatattggaatagctgttgctgatgctactgacgcagctcgtagtgcttctgacattgttctgactgaacctggtctcagtgttatcatcagtgctgtattgaccagtcgagcaatattccaaaggatgaagaattacacaatctatgcagtttccatcacaatccgtattgtgcttggtttcatgttactggccctcatatggcaatttgattttccaccattcatggtgctgattattgctattcttaatgatggtaccattatgacaatatcaaaggacagggtaaaaccatctccatatccagatagctggaagttggcagagatctttaccactggaataattcttggtggttatttggctatgatgacagttattttcttttgggcagcatacaaaacagattttttccctcaaacatttggagtctcaagtcttcagaaaaaagatagggatgactttagaaagcttgcctcagcaatatacctacaagttagcacagttagtcaggccctcatatttgttacacgggcacggagttggtcatttgttgagcgtccaggcttgttacttgtagcagcttttgttattgcccagttgatagctaccttaattgcagtttacgcaaattggagttttgctgcgattgaagggattggatggggctgggctggtgttgtttggctttacaacctcgtcttttatatcccacttgattttatcaagttcataattcgatatgccttgagtggaagggcttgggatcttgttattgaacaaaggattgcttttacaaggaaaaaagattttggaaaggaagaacgtgaacttaaatgggcacatgcacataggacgcttcacggccttcacccaccagagactaagatgttcaatgaacgtacaagttacacagaacttaatcagatggccgaagaggctagaagacgtgcaaacattgcaaggctgagagaactgcatacactgacgggccatgttgagtctgtgtttagactgaagggccttgacattgacacaatacagcaagcatacactatctag

SEQ ID NO: 58461 - DNA, 696 bp, Glycine max
  Peptide Sequence Number=SeqID_175239
atgggcatagtgtggcttgggttgttgttgctggtgctgagtcaggtgacattggagcagaatgagccactgagttccgtcgaggagcgagaatcgttgctcgaactaaggggttctctgggaatggtcgtgtcgttgggatcaatatctctggcttcagaagaaccagacttgggaggaggaacccgcaatttgcagtggatgctttggacaatttcaccctcttgcggtccttcaatgcctccaatttcccccttcctggccctattcctgattggtttggtctctctcccttcactcactgtgcttgatcttcgttcttgctccattgttgatgctattccctccactcttggcaatttaaccaacctcactagtctctatctctctgacgacaacctcactgggaatgttcctgggactttgggtcaactcttggccctttcggttcttgatctttccaggaattctcttactggctccttaccagcctcctccgcctttcttgggaatctttcctcccttgacatgctgcagtacttgaatctttccaacaatggcctttcttctttgcctgcccaattggggggccttgctagcttagttgaccttgatcttagtgagaattctttcgttggtggtggattgcctcctgatccccacgctaacactaaactattttcacataagatataa

SEQ ID NO: 58462 - DNA, 210 bp, Glycine max
  Peptide Sequence Number=SeqID_175240
atggacacaaaaggggcaatgtgtcacgaaaagcagcgggttttccggtgcaaaggacgagggaacgcagaatgctgtttcttcgacacgtggcatcgatctcagccgttgaaggaacatgggaagaagatcgcagcaccgtggttttgtcattatgccaagttaaacacgcaggcttcagacacaaaaggagaaactgctcagaactaa

SEQ ID NO: 58463 - DNA, 291 bp, Glycine max
  Peptide Sequence Number=SeqID_175241
atgatgatcaggggccataggaggaagaacatctatctaagaaggaagaggtcccttgtgtggcttcagaagggagcaatggaaagcgatgtggattttggaagtaaaagtgctcatgcgcaagaaagtaccactaagcttaaaaagttatctctaaaacttgcttataaaatttgggtcgcgatcaaagacggtgctatggggaaagccatgaagtgtgcacacgatatccaaaaacaactgagccaccttaaaggctgtaaaatgggtaagcaatgctgcaaaatgtga

SEQ ID NO: 58464 - DNA, 162 bp, Glycine max
  Peptide Sequence Number=SeqID_175242
atggatttttcaaagggggatattgatagcacaactcctaacaacatttgtgttgcatttgagtacgccaggtggggtggggtgtgggagtccaagatgttcgacttgaggatgctcgaacttgctggggtgttccttttgcgtgaaggccctatgtattga

SEQ ID NO: 58465 - DNA, 510 bp, Glycine max
  Peptide Sequence Number=SeqID_175243
atggctgctcccctgaatagcaagtgcagtttcatgtgtccccctatgcctgcacccaatcgacgctccgcgagtggaagaaaggatgaagctgccgctccggtcgcggtggttcagattcacgccaacctccgtcagcagcttcacgcagggctccaagtcgagtcctgcgatgaagaggagtgtggtgctgccatcgacgtccatggcgtcgatttcgcgaccatcgttggctctatgccgagtcctgcgatgaagagaagctgctgctgcttcttgctgttgttggttttggaaaacgatggtgatggtgcggagggtgcatcagacaagcagataaagagggcgtataggaagctagctgtaacgtgcataaagaaggaaggagatttggcacaaaattctgttagaagggagggacacatggctcacgatccgcaaagtgagggaggcaggcgtagcacaagattgaggagggagaatataaggctggaggattacatgttttag

SEQ ID NO: 58466 - DNA, 672 bp, Glycine max
  Peptide Sequence Number=SeqID_175244
atgaaactcgtttggtctcccgaatcagccttacaagcttacatagacacggttaaatcatgtgagaaattcaaggaaaccggggtaccagagttgctatcagccatggctgcagggtggaacacgaaattcatagtggaatcatggtcctacggtggtcccatagctgcaagcgtaggcctagcagttgcagctcgcaacacgggtgcaagacacgtgtgcatagtcccggacgagcgatcaagggcacagtacataaaggctttggctgagatgggggtgtcgccgcctccggaggtggtggtgggggaggcggaggtggcggtgtcgcagctcgcggggctcgactttctggttgtggactgcaagaggaaggagttcgctagggttctaagggtggccaaagtgggtccaaaaggagcagtcttggcatgcaagaatgcatggcagagaaacttttgtggcggcttcagatggagcgtggtgctacaaaagggtgtccgtgtggttaggtcagttttcctcccagttggaaagggtttggatattgcatacataggaagtagtagaagtggtgcagcagcaacagcttcaaagggccctcgccgttggatcaagcacatagatcaacaatcaggagaagaacaccttttcagaaagccatctcattag

SEQ ID NO: 58467 - DNA, 897 bp, Glycine max
  Peptide Sequence Number=SeqID_175245
atggtcacgggtcttcctaaaattacacctccctcagaaatttgtgaagaatgtgttgttggcaaacaacatcgtagtcaatttccaaaagggaaatcatggagagcaaagggtgttttagagctggtgtattcagatatatgtggtccaataaaaccgtcttccaatggagcgtattgtgaacatcatggcattcgaagagatcttacagcaacatatacaccacaacaaaatggtgtatcggagaggaaaaacagaactatccttaacatggtgagaagtttgttaacaagaggaagattaccaaaaaccttttggccagaagcagttaattggagcattcatgtgctcaatagaagcccaactttttctgttcaaaacatgacaccgaaagaggcttggagtgggagacaaccatctgtgggtcatttcaaaatttttgggtgcatcgcctatgctcatatcccgaatgagaagaggaagaagcttgatgacaaagctgaaaagtgtgtctttgttggtgtaagtgaaacattaaaagcatataagttatttaacccactaacaaagaagattgtgaccagcagagatgttatttttgatgaagacaacacatgggattggaaggagcagcaacccaattcaattattgatgacaatgaagatgtaaaagaattgcagctacccgtaaacattgtcttaacatctccaaatgcagctcaaatagctcctgagacagagatttcaacaccaacaaatgctggaacaacagacgcaacgacaacaactcaatctaaatattgtgaccctacaacatttgagagtttcatcaaagaagaaaaatggcaaaaagcaatggatgatgaaattgatgccattgaaagaaatgatacttag

SEQ ID NO: 58468 - DNA, 897 bp, Glycine max
  Peptide Sequence Number=SeqID_175246
aacaacaaccaaagcagcgagattccaccagcggagaccctattctggtacagcaaaaacgacgacgtttcatcctatcaccgagggtttgagctatggaaccagcatcaggagcaccagcaccatcaccacgcgatgcatcatccacatgcgcgtccactcctgcagcgagatctttactcctccggagtgggacccagccgcggcggcatctccgatgatcactcgtcgtcgagatcggcggcgttcgtggcgatgcgcgcagccggggccgagggaggaggaataagctgtcaggattgcggcaaccaggccaaaaaagactgccctcacatgcggtgcaggacgtgctgcaagagccgcggctatgactgccaaacccatgtgaaaagcacatgggttccggcttctaaacgccgtgagcgccaacagcagctcatggcgttacatcagcaacagcaagaacaacaacaacagagagacatctccaagcggccgagggattctcgtttgtcctcgtcagggttagaggaagaagggcattttccttctgtggttagttctccagcggaattcagatgcgtgagggttagctgcgtggaggactctgatgatagatacgcataccaaaccgctgtgagcattggaggacatgtgttcaaaggaatcctctatgactatggtcctgagaatagtaacaacaacaacagtaataataatagtaataattacatggctggagaaacctctgctgttgctgcaacagctcagcccttgaaccttgctgctgctgcttcttcagctgcacttattgatccttcgtctttgtattcagctccggctaacgcattcatggctggtagtggtacgcaattcttccctcacacaagatcttga

SEQ ID NO: 58469 - DNA, 1524 bp, Glycine max
  Peptide Sequence Number=SeqID_175247
atgacatctgctcctgtattggctattcctaatttcaaggaaatttttgtattggagattgatgcctcaggaagtggagttggcaaaattatgttacctcctgatgttgggttgcttaatcagatcatggaggaatttcatagttctaagattggtggacattctggagttaataaaacaacaactagaattggtgctccattttattggaatggtatgagaagtgatattagtaaatttcctcttctcattcctccacaaatatgggaagacatagcaatgaactttatttttcaattgcctccttcacaaggatttacaactatttttacaatagttgatagattgtccaaatttgggcactttatccctatgaaatctgagtttaacaacaaggtggtggctgaagctttcattaccaacattgtcaaaattcatggttttccaaaaaccattgtttctgacagagacaaaatttttatcagcactttttggcaacaattattcaaagctcaaggcacaacattggccatgagctcttcatatcaccctcaatccaatggcctgactgagaatcttaataagacccttgagatgtatctaaggtgctttgtatttgatcatcctatgagttgggttactatgctaccttgggctcaattttggtataatacttccttccaccaaagcttgggtatgacaccatttcaagcagtttttggtagacctccaccaatggtgatgcattacgaggttgatcctaaagatcttgatccactcaaggatttattacaactatgtgatcaacttttgagcaagcttaaaggtaatttactaaaggctcaacaatatatgaagatgcaagatgataagaaaagaagagatttgcaatttaaggttggtgatttggttttagttaagctacaaccttataggcaacattcagtggctttgaggaagcatcggaagctaggcatgcactattttggtctatttccagtgattgaaagaattggtactgttgcatataaagtacaactacccgagtctgctaaaatacatcttgtatttcatattgctcttctgaaaccatttcatggcaaaagtcctccaccatatcttccttttccactcacttctagtgaactgggaccaacactttgcccatggaaggtgttgaatgttcgagttgtcaaacatttagaagctaccatgtctcaattgttgattcaatgggaagcaattaaagctaagggtgctacttgggaatatttgcgggatatatcattgaagtaccatcctgataagaacctcaacaatgaagaagctaataagaaatttgctgagattatcaatgcatatgaagtgttgtcggattgcaagaagaggaatatttatgataggtatggtgatgatggtttgaagcagcatgctgcaagtggaggtagaggtggtggagtgaacttccaagatatttttagcacgcaagtcattaactacaacttttgttcatttagttcttaa

SEQ ID NO: 58470 - DNA, 624 bp, Glycine max
  Peptide Sequence Number=SeqID_175248
atggagaactttctccagtcaaaggagtattggcctatcattgaatctagaattcaagagccagaagaaggcgcaagtttgacaaaacctcagaaagccatcgatcgccccatcctggaaactattctttgcaaagaaacttccaaggacatttgggattctatgaagaaaaagtatcaaggttctactagagtgaagcgtgcacagcttcaagccttaagaagagattttgagacattagcaatgaaggatggtgaatatgtttttagttattttgcaagaacaatggagataagcaccaggatgcgattccatggagagaagatgaaagatgtcaccattgtagaaaagattttgcaatccctaacaccaacatttgactatgttgtctgtgcaattgaagaatccaaagatttagatgcactttcccttgatgaattgcaaagttccttgttagtacatgagcagaagatgaaccgaagttcaaatttgacagcagaagagcaagctttgaaggcttctaccaacactcattccataggtagaggaaggggtaaaggtataggcagaggaaggggtcaaggccgtggcagaagcaactatagaggaaatcagcaccaataa

SEQ ID NO: 58471 - DNA, 483 bp, Glycine max
  Peptide Sequence Number=SeqID_175249
atgttgaatgccaatcctcctttcattggattggcattcaactgcaatcagcaccattccaaacacaccattagttgttggccacacccttttgcttataggttgcaggagaggaatgaaaggctattttacaagttgttacttgatcatgttgaggagttactcccagttgtgtatacttcaactgttggtgaagcttgtcagaaatatgggagcatcttcatgcatcctcaaggtctttatataagtttgaaggagaaagggaggattcttgaagtactaaggaattggcctgagaagaacattcaattcattgttgtaattgatggagagcgaattttggcttttggggatctacgctgtcagggttcagaaagttgggtggtcatcgtaaaagacatccatgcatcgaaggcccttgatttgagttataggggattaaagtacattgtgtatggggtccttctattatatttcgagtaa

SEQ ID NO: 58472 - DNA, 558 bp, Glycine max
  Peptide Sequence Number=SeqID_175250
atgtctgagccctccaaccaagcttcgcagtctagagactatctgtgcatttttagggatttcaatgatttaccgtcaaacaatgaaaaaattagattagtagatcatccaaattggctcatcaatgactttcgtgaagttgttagtgattgtaacctccatgaccttcctattgaaggttatcaatatacttgggctagaagaaaaggaaagcatgttgaaattcaagaaaagctagacaaaggccttgctacaacagattggatagaccttttcccaaattttaagcttataaacgagattgcaacaaaatctgaccattctcccatccttatatgtcttaacactgctcaaaggagaagaaacatccatgtctctacttccacttatgataatgactccagtctatccctttttactattgatgaattcaaagatgcttttttttcccagatgaattcagacaaatcaaacggcctaaatggtcttaaccctactttttccaagaaattttggcatctatgtggtgctgaaattttccaaagtgggaccacttag

SEQ ID NO: 58473 - DNA, 144 bp, Glycine max
  Peptide Sequence Number=SeqID_175251
atggtgtttcttgtgtaccattcaactggtgcatacaaaccatacagtcctaatagtaaaaagatagtgccgagcagaagtgttactgttgatgatgagagcaaagaaacaattcagattcagtcacagtcctcagataactag

SEQ ID NO: 58474 - DNA, 168 bp, Glycine max
  Peptide Sequence Number=SeqID_175252
atggctcaccagatatggatggaattatcaacatgcaagagaggcaccattgatacaaaacgtatcagtatcccaagagatatgttctggaagactttggagaaaaaaggtgtgcccatggcttatatccgaaccattcaagacatgtatgaagggctactagagtga

SEQ ID NO: 58475 - DNA, 255 bp, Glycine max
  Peptide Sequence Number=SeqID_175253
atggagattgcttgggctcgtagagggaccgccaaagcttacaaactagaccagactccccctgagcaacaaatccaggcggttgctccttgtcatgaaggacaaggattcatcgtaggggaagctaatggagaaggacatgaatcagaagactcttcatgtaatgtaagactagttccttatgccttgtgttgggatatcaaaagaggtgatgaagataactcgactagacgattggttggagggagagaatga

SEQ ID NO: 58476 - DNA, 225 bp, Glycine max
  Peptide Sequence Number=SeqID_175254
atggtgaaattgatgaggatgtcacacataggatacaagcaggatagcaagcatcaaggtttatttgtgatcgcaaagcaccaaccatactcaaaagcaagttttatgatagaatacgaaatgacgttatatgagaaaaggtggtttgggcgaaggccacaagaggcgccagttagaagagtagaccgtaagatttttagcctggagaaaaggagaagagggtga

SEQ ID NO: 58477 - DNA, 162 bp, Glycine max
  Peptide Sequence Number=SeqID_175255
atgaaacttctctctctaacaagcgcagtttcaactttctctctcatcgcttcgctggaatcttgccacctccgtcgtcggaaagggtatggcgtaaaaacatggtctatatttacttctaagattgttaggggtaaaaatgaccatgtccctatggcataa

SEQ ID NO: 58478 - DNA, 249 bp, Glycine max
  Peptide Sequence Number=SeqID_175256
atggatgacgaggttttaaggtggagtcagaacaacgagactccaagttgcagcgcaagtgtcaatgtaaaacccgcattggataaaaataagcaagtgagcaacataaaagtgagaaaaccccataaacctaatatcttattaggttttgggttgaatgtggtgtcaagttcacttgtttggtgtgcttgtggctcgttgatggatttctcctttgtgttttactcccctcatattccctacaagtag

SEQ ID NO: 58479 - DNA, 219 bp, Glycine max
  Peptide Sequence Number=SeqID_175257
atgcataagaggagtggtgagcctagttgcgaggtgagagatgtaacatacacttatgcattagatgaggaagtgtgcatgataggtgatgtaaactctagtgagcaagaaagtgagaccttagtaagaggtcaaagagtaggagtgatatttacaagccttagtgcattagttgccttcaatttggcaaaggaggttaaactcttgttgtctaattaa

SEQ ID NO: 58480 - DNA, 216 bp, Glycine max
  Peptide Sequence Number=SeqID_175258
atgctaaagttgctgtcaaagataaaggttcagaaaaatcatacttttatggtggtttacaaacgcgattactgtgacgtaaagggacgggcactagttgaagcgttgaatcagcagccagagaatgatcgggagggggccttggaggctgaattagtggaacaatcggacatctttggaaacaatgacaaaacagatttcgatgtagaagagtga

SEQ ID NO: 58481 - DNA, 404 bp, Glycine max
  Peptide Sequence Number=SeqID_175259
atgttgaagtccctggtcacaattattgtattcttgttgattgttcgtgctcaagatgatctgggtgatgattctgtttttgatggaaagaaaactgtgcgtgttttaaatgcgatgaatgatggcattcttgtgtatctccattgtcggtcgagggacaatgatcttggcaaacatgttcttgccgttggagagtaccaacaatggtccttcagagataattttcttgactcgactcttttttggtgcaagatggatgcaggcaatgtgcatgcgcgttttgaagtttatcgtgccaaaattgaggagacgttatgtgattccctatgcaatcgagctctaacaaacgatggagcctatttttatgatcagttccgtggctactggcagaagagattatcatg

SEQ ID NO: 58482 - DNA, 540 bp, Glycine max
  Peptide Sequence Number=SeqID_175260
atgtttgagtgtagacaatttttccctcacagtaatactgttacgcatatcctaatacaaggaacaccaacttatgggaggataaggaaggaaatgaaactcagcttctacttagagctagacatgtgtttaaagattgaacaaaagcaaggcaaatttctgatagggtttgtcagatttgcattcattcacagagcgattcttagatggtgtccgatatacttgaaagccagatcgcaacctcaatgtaatgtggaattgaaggacatcactccaaagaaacagaaacaatctaactgcaaaaattgtagatgcctcaaaacgtactgtgagtgttttgcagctgggatccattgtcatggctgcaactgtgtaaattgccataataatgtggataatgagcctgccagattggaggcagttggaataacattggaacgcaatccaaatgctttcagaccaaaaattgctaccagtccgctagaaagaagagattccaataaggggggagacagggagagagagtatgaagagaattaa

SEQ ID NO: 58483 - DNA, 330 bp, Glycine max
  Peptide Sequence Number=SeqID_175261
tgttggatttacgaacatttccatacaattgcttccattattactgatgaggattaccatgagaggaaaccatgtgtttgtcattggaagtttgggaaggcattaccaatgacaacttatctagactacatggagtggttctataggatatctcaccccttcatgagtatgacacaacttagggaccctcctagacatcctctcgtggtgcatgatgatacatttattgtaccaaatcctcctcatgagcctgcctacacaacaactatgccacaaccacttgtacctacagctgccgatgtagacgtgcctcgacatgcagttgtataa

SEQ ID NO: 58484 - DNA, 267 bp, Glycine max
  Peptide Sequence Number=SeqID_175262
atggagaatgtcaacggaaatgtaaagttccaaaaccactatagtcgcatacatgtggatctgagtggaaattgtaattcttggagatcagatattatatctgaagacggaggctggttgtctgccaatgtttttgttgacactattgagcagaattggcatgctaatttaaaaattgataatctttttgtcccgctgtttgaaaggatccttgaaattccaattacatggtctaaagggagggctagtggcgaggtttttttctag

SEQ ID NO: 58485 - DNA, 1995 bp, Glycine max
  Peptide Sequence Number=SeqID_175263
atgagtctaaaaaaccacaccttgtttttcgggacaagtctgcatggttctttggaaagtggcaccagcaagaggagcccttttcgtttggacaagaggcagttgttgccgcagaaggttctctgcagttgcacgtgctgcgtgtccccaaaacggtgtcgtctggtaagccaagcgttacggttttcaactttttctgggcaaaatgtggggttattggggaaagacctgattttgagaagtgggtcgcggttagaatgttcgagggatccttattttagaagcgaggcattggttagttatttgatacctttgtggaaagaggggcttcttttgataagggcttctgtttacactgctgttatatctggggtatgtatgttggtgtggtatgggcagaacaaagcaaagggtttcattgaggccaatttgttgccttctgtttgttcagcaatcagtgagcacattcagcgtgaccttgtgtttggcaaggttcggcaaatttcgctgttgagcatcacgttggagtcgtgctcgtttgggcctcataaggaggagttttcgtgtggcgaggctcccacggtgaagcttcgcctccgtccctttgtgagcttgaggagggggaagttggtgattgatgcagttttgtcgcatccaagtctcttggtggtgcagaggaaggactttacttggttgggaatacctttcaatgaaggtggcagggagagaagctgctcggctgaagaggggatagattatcgcacgagaaccaggaggcttgcacgagaggaagcctttgctcaatgggaaagagaaagggatgatgcagctagggaagctgctgaggtagggtactttgtttctgagcggagttgtggtctatcccaaggtgatgatggtttgaaggagattgaaactcgatcattggagtcaagtgagtctgcgccctttttctgtatgaatgatgggaagcacgatcatcggttgatggacaaaggtgttaattatgatacaaaacactcagctttggaaaaatcatttggagtaagatttcctggaacaggacttcgattttggtctagagtaatatcagggcctaggaaacacaagtttaagaggaaggctactgggagtaacatctttccatctggtggtgctatcaaaaagagaatgtttgaacgtagtgcgtcagctgctcatgcatacttttgtgatcaatcacaatggaagtttggggagccttcctcatcttctgaaagttatggttttatgagtcatgatatgcatttggtgaaaagtgaggttgaccgaaatacaatatctgttattgttggtgatgaaaatagaagtgatgataaccaaagtggaacacaatacagagatctgggattccagtcctcctcagtaaatgaaaatgttagcagtcaatcagattatttaaagtttgtctgtgatccaactttacagacaagggagagtgaaattgaaaatttgcaatctactgatgatgttgcacaacctgctaatccaaatagtagtacagtgaaaaatgaggagtgtgtaccatatgttgctgacaatcaaattgatgataacgacaattcatcagggggccaacgaggtttgccgtctgaagatttggggtttttgaagcctaagcctcagttggcaacttattttcaaaatccatttgtgcccttgctcgtgaaatttggcttaacctcatttttaaaaaatattgaagatttgatatctcattttctttctggttccattgaaatgttgaagtctgatgtgggtctgaaagttgaagatattgtttcagaacatgttgatggggtagattttgtgcagtctgaaggcattacgaagactctgcctattacgctggattcagttcatttcagaggcgcaacactgatgctacttgcatatggtgacaaggaagttagttttatcaatggtggatggcagaaggccaaaatcctgccataa

SEQ ID NO: 58486 - DNA, 888 bp, Glycine max
  Peptide Sequence Number=SeqID_175264
atgttgaagtccctggtcacaattattgtattcttgttgattgtccgtgctcaagatgatttgggtgatgattcaatttttgacgggaggaaaactgtgtgtgttttaaatgggatgaatgatgacattcttgtgtatctccattgtcagtcgaggtacaatgatcttggccaacatgttcttgccgttggagagtaccaagaatggtcctttagagataatattcgtgacacaactctcttttggtgcacgatggatgcaggcaaggtgcatgcgagttttcaagtttatcgtgccgaaattgaggagaagttatgtgattcccaatgcaatcgaactctaacaaacgatggaggctatttttatgatcagttccatggctattgggagaagagattatcatgtaaacatcccacaaaaactcgtggtaataaagatatcatcactgattcaccttttcttccgcccttgttaggttcccataaaagctgctggtttgataaggctttactactaagttatgagaaagtaaagaacaaaaacaataactcaaacaaaagtaaagtggaaataaaaagtgcacagcggaaaagtaaagagtgtaaggaagaagaaagcaaacacaagatttatacttgttcagccacaacctgtgcctacgtccagtctcgaagcaacccacgtattacaacccaagtagatgtacgctctacttgtaccacaaaggatgtacgctccaatgtgttaagacaaagaattctctttgaacaaccaagtaaccctctacttgaagcgaacgataaaggatgtaccctcccttgtgttcactattacaaccaagaaactacccgcttcttacacagaattcttagacggttagttctttga

SEQ ID NO: 58487 - DNA, 333 bp, Glycine max
  Peptide Sequence Number=SeqID_175265
atgtctgctttgtgtttcttgcccagcctccttattgcagcccgtttaaccccccccaattcctcttacattgtaggatattatattcatgatgatatgtatttgtttcccagtccctcagcctcctttctgtctctattctccatttcacctatcttgttgatgatatttgcgtggtctgagttgctgttcacccccaatatttttgctaactcccattgggatgatgcctcttctctgatgttgagtccgtgtccgaagttggagacttgccctgggggagttggtgaccactctgttggccctatttctgattacacacctttcttctaa

SEQ ID NO: 58488 - DNA, 285 bp, Glycine max
  Peptide Sequence Number=SeqID_175266
atggcgtctccgggcttcaacgcccaccgcctctggctcgccttcatcgtcctctccaccttcacctattggttcaatttcaaaggcaagaccaagaccaaggccaaagctcaagatccctcgcctatgcaacccgatgctaaagactacaacgtcatctcacgcgctgctcgtctcgactgtggagatagccctgttactactcctcaggagaatactgttgctactctatatttctatttggcttcgtttttgagaataaccaacgtgaacagtgaacattga

SEQ ID NO: 58489 - DNA, 486 bp, Glycine max
  Peptide Sequence Number=SeqID_175267
atgcgggatgaaccggatgagtgggttactagtgcccaactgcgcgctaacctagaccccacaaagggtgttggtcgattaagacaagcaggacggtggtcatggaagtcgaaatccgctaaggacctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 58490 - DNA, 171 bp, Glycine max
  Peptide Sequence Number=SeqID_175268
atgtttggggttacgcttagcgtgccatgttgcgttaagcctgagctactctctgctaagcgcaccctatgtgttaagcctaagggttattctagtgaggctaagctaagcgcgcaacgcagcactaagctcataccctcttctattttgaaaattgaagatttaggctaa

SEQ ID NO: 58491 - DNA, 195 bp, Glycine max
  Peptide Sequence Number=SeqID_175269
atgcacgccggaagtgatcaagaagatccttccggcttttattttagctgccagcctgagccagcaacgccaacgcctgctgccgggccagctcaatcttccgccgctgctgctaaagccgcacctgctcctggcgcagccggctctcttcgcaactgtcggggatcgacagcagacagccgtccagcaacttaa

SEQ ID NO: 58492 - DNA, 304 bp, Glycine max
  Peptide Sequence Number=SeqID_175270
atggcttgtcctttgacactggcaatggtcattcggcaactgcggagcttcttctttgggtggttggagaaacggatgaatccccaaactacacaggtgtcattggaagtaggaaaagaagctaaggggatcttgacgattaagaagaagatacaaaggacaagtggaagtgacagacaagaggagagggacaggttgagtgagttccctgattgtgttctgctccatatactggaatttatgaacacaacagatgcagttcgaacttgtatattgtctaaacgatggaaggacctttggaaag

SEQ ID NO: 58493 - DNA, 573 bp, Glycine max
  Peptide Sequence Number=SeqID_175271
atgtcacctgtgtgtgccacctacagcgagtggcatgtatgcaagaacatgtttcccaaaaccaggttggaaaattccctagtcaatcctccaaagggctcgcaaaacctaaggtccgcccttagtgagtcccaccaattcacaccaccatgcctccagtactttccactttgtaaaaggcatgtatgcaagagcaagcaagttcgtcaccaatacatgccatcctcggcaagtgccatgtatgccaaaacacaacacttacacgcacacaagactcgtcaaacccaagcttcgggtttgctgatctttacaagtttacagaatccaaggcctatccttggaatacatgcttatcaaaaacccaaggtcttcccttggtactcacatctacaaaaccctaagtctgcccttggtacacacttctacaaaacccaaggtcaagacgacccaccacccgattgcatgacaggactttcaatcaagtgcaactcatacttacacctcgtaaccatcataggagtaactcaacaggtcaaacgacctatcccatcactagttaggcaagacctttaa

SEQ ID NO: 58494 - DNA, 357 bp, Glycine max
  Peptide Sequence Number=SeqID_175272
atggacttgatgaccaccttcggtcagggcaagctctctaggagcttcaccatcaaatatctactggttgacgcaaacacatcatactttgccttaatcgaaagaaagacacttaatgagcttgaagcaatattctcaactcctcatctgacaatgaaattccctacattaaaaagggaaattgtaaccaccatggttaaccaaaagcaagcatgtttgttctatgcagagagcctaaagttagtaccatatcctcccatccaagagcctacagtgcctcaccccacagtagctgaagacactcaagtcatgacagtcgatgaagggcgtagtgttcgaaccctaaccgtctactaa

SEQ ID NO: 58495 - DNA, 423 bp, Glycine max
  Peptide Sequence Number=SeqID_175273
ggttatctgttttcaatttcgagcgtctcgatatattacgggactcagtcggacatccgagtaaaaagctattgtcgtttgaatttgctaggagcttctgttttcaatttcgagcgtctcgatatatttcaggactcagtcggacatccgactaaaaagctattgtcgtttgaatttggggcatctgttttcaatttcgagtgtctcgatatattgcgggactctatcggaaatccgaataaaaggttattgtcgtttgaatttgctacgagcttccgttttgaatttggagcatctcgatatattacgggactgaattggcaaccgagtaaaaagttattgtcgtttaaatttgctcagagtttctgtttcaatgtcgagcatcttgatatattaccggactcaatcggacatccgagttaa

SEQ ID NO: 58496 - DNA, 820 bp, Glycine max
  Peptide Sequence Number=SeqID_175274
tggaaatccatttgaaagtcttggatcactctctaaattgtcatctcgttatattggtggcaatctttttcaaactgttgtcaaggaagatgatcttgcaaatcttacaagcttgatggagattcatgcatcagggaacaatttcactttaaaagtaggtcccaattggcttcctaattttcagcttttccatttggatgtgagatcatggcagttaggtcccagctttccatcgtggattaagtcacaaaacaaacttgaatatttagacatgtctaacgcagggattattgattctattcccacacagatgtgggaagcacttcctcaggttttgtatttaaacctctctcataatcacatccatggtgagagtgggactacattaaagaatccaatatctatccccgttattgatctaagctcaaatcacttgtgtggtaaattaccctatctttcaagtgatgtgtctcagttagatctttcaagcaattcattctctgaatccatgaatgactttttatgcaatgatcaggacgagccaatgcaattacaatttctgaatcttgcatcaaataatttgtcaggagagatacctgattgctggatgaattggacatttcttgggaatgtaaatttacaaagcaaccattttgttgggaacttaccccaatccatgggttccttggcagagctgcagtctttacaaattcgtaacaacacattctcaggaatatttccatccagtttgaagaagaataaccaattgatatccttggaccttggggaaaataatctttcaggatgtattccaacatgg

SEQ ID NO: 58497 - DNA, 830 bp, Glycine max
  Peptide Sequence Number=SeqID_175275
atgaagttatcttctatcggtggtggtgtatccttcaatatttccaaaatccgtgctcgcggcgaggctatcaaaggcgtggaaggtcgcgccggcggtgtacttccaattatgaaaattatggaagatactttttcgtacgcgaatcaattgggtcaacgcccaggtgctggggcagtatacctcaatattttccactccgacatcgaagaatttttagattgtaaaaaaatcaacgttgacgagaaagtacggatcaaatcattgtcgatcggtatcatcgtgcctgataaatttatggaattagcagaaaaagatgaaccttgctatttgatctacccacataccgtgatgcaagagtatggacaattcttggatgagatggatatggacaagatgtacgacgaattgatcacgaatccaaacgtgaaaaagaaaaaaatcaatgcccgtcatcttttagtgaaaattgcacaaacacaaaaagaatcaggatatccttatattttcttcaaagagaacaccaaccgtgtccatgcgttgaatgaaatcggtcaggtatctcaagtatccgatattgagatctatggcaaacaagacactattcgttacggaatttcatgtaacctcggttcgttgaacattgctacagtgatggacaataaacgtatcaaagaaaccgtaaaaacggctatgcgtgctttgactgtcgttactgacgtgaccaacatcgacatggttccatccattgcaaaagcaaaccgcgaattgcattctgtaggacttggcgcaatgaacctccatggttaccttgcaaaaagcttcatcat

SEQ ID NO: 58498 - DNA, 264 bp, Glycine max
  Peptide Sequence Number=SeqID_175276
atggcaagcaaaagcggctcgtggcagttagtggtggtggaggagaaggttgggggtgttgggggagggtttaggggaagatatggagataaaaaatggttgttttatgctgttggacgtatttgtagcttgcaagactcacccaagagaaatttggctcgcccgagcaattctgctccaacaaattttactgcttcgtccaattgtgaaggcgatccaatagttaacgaatccaggattgagattttagtggaacaagtttag

SEQ ID NO: 58499 - DNA, 333 bp, Glycine max
  Peptide Sequence Number=SeqID_175277
atgtcgagtgatggtgaagcctctattcatccaaccatcccaaagatcaacacaaccactatgcatatagcaaatgagcctaccaactacattgagtacttcttcaacattcactatctggagcacattggtttggatatgcatgaaacctttctaagttgtggcataagaagccaaacaacaaaattttggtgtgataaacttcaagaccatgaagttagagataactttactcaaagggaagtacctcaagtagacgagaaagaaagcaacaaaagaccatgggagtgtattacacatgtacttgctgctaaagatgatgctctaccttag

SEQ ID NO: 58500 - DNA, 381 bp, Glycine max
  Peptide Sequence Number=SeqID_175278
gatggtcctgtctggaagaaagctcaggttgttcccaaatcgagaaaagatgactcaggctctaacaacgacatgaagaaaattcctgttaagaacaggatggaacggtggaaagcaacaggagttgtggcattgtctgaatgcaacttggaggtcatacctgatgaagtgtgggtttgtggatcttctgcaagagttctagattgcaacaacaattcaattacagatgtccctgatgaaattgcacgtcttaccggtctagatgtttcagtctcttctccttctcgtttgggaaccctatcagagcagtcagaggaaaaactaaaggaatctcaagaaatcgctagagatgtcgctattgctgtcacaatacacacgtga

SEQ ID NO: 58501 - DNA, 315 bp, Glycine max
  Peptide Sequence Number=SeqID_175279
atggccacaaggatggaggccatgatgagcatgaagaagataacggaagccaatgtggttagaattgctgctaccagcgccgttgctaaggtgaacccgatgcccccatctggcctcaaccaaatgaatcatccaaccccatatatggtggacaaagatttgggaagtacgagcggcccccattatgtgcaaattcaaaacaaacacgccttcacgccatatggcttgccttccaactatacaccacccaatgtggcgtacactcccaatgagaatgtcaataactccactccgatactcattgatagccaataa

SEQ ID NO: 58502 - DNA, 247 bp, Glycine max
  Peptide Sequence Number=SeqID_175280
atggatatgattaagtccctttccagtaagcctgaaaaatttacggaaataaaaacttcaacttcctctactgatatagttcaaactgatgcaaccattaagcatgatgtttctgataaagatattttatgtcatggacgcattttaagtgctttggctgataacatatataagattttttgtcataccaaaacttctgttgagttatgggaagcacttgaattgaaatatggatctgctgaaaaag

SEQ ID NO: 58503 - DNA, 324 bp, Glycine max
  Peptide Sequence Number=SeqID_175281
atggcggcgcagctaatccatgatcgagtagagatggagtgcctagagggagcctgggagaccctcgaaggcaacacgaggtgccgatttcggggcaccattcgattcacggctacttctttggtgcatccagatgaacctgcacggacgcttcagcgcacggtggagtggacaactttttttggattagttttatatacttttgaggacctgatgtataggaatttgattattgtatacttgtggctgaagccaccactatggacacctttgctctggatgacactgtattttgtaaaactcccatattttgaacagctttaa

SEQ ID NO: 58504 - DNA, 1839 bp, Glycine max
  Peptide Sequence Number=SeqID_175282
atggtagagttacaacttaatacaaagatcaaggctctgcaaactaatggtgccaaggagtaccttgcgttgactaagtaccttgcagatcatggaatacaacactgcatcccatgtcctcatacacatgagcataatggtgcccaagaaaggaaacatcgccatttgactgaaacaggtctcaccttggtaactgcttcctcccttccttcaaaattttgggtagaagcatttagcactgccatcttcatcatcaatcgcataccctctccggtgattaactacaagtccccctttgaggttcttttccacaaaacccctgactactccattttcaaaccgtttgggtgtctttgctacccctatttacgaccctacaccaaaaccaaacttgattttcgatccacctcttgcatattccttggctacaacaccaaatacaaaggctataaatcccctgaacaagctccttatcctactcctacaaccaatgttcatcccatgactactcgagctaaatctggtgtctttaaacccaaagctttactgaaagagatcactcctcgatgtaccaaggatgaaatgcaagatcctcaatggttagatacaatgaaggaagaatacatggttctgacgcagaataaaacatgggatctcgtccctttgcctcctcataggaaggctattggttctaaatggatatatcggttgaaatacaatgttgatggctctgtagccagacataaagctagactggtagctcaggggtattctcaacgaccaggacttgattataatgagacattcagtcccgttatcaaacacgtaaccattcgaacggtcttgagcattgctgtcaccagaaaatggaatatacgacaagtagacgttaacaatgctttcctaaatggttccattcaagaggaagtatatatgcagcaaccagaggtcttcatttttgtcaatcctcatcttgtttgtaaattgaaggaatccctctacgggctcaagcaggcaccaagagcttggttttccaagcttgcatccagtctaatttcctttggttttaagccaactaggtgtgatacatctctttttgtgcatgctacaccaaaattcatcacttacattctggtatatgttgatgatatcataataacaggcatctcaaactctgcaatccaatatgtgatttccaaactccactctctgtatcctctcaaagaccttggtaccttacattttttcttaggcattgaagccaaacacactactactggtgctcttctcctttctcaatccaaatacataaatgatctcttatccaaagtcaacatgcataatgcaaaacccataaagactcctctagcccctggttcacaactgcatatggatgcattttatccttcacaaaatcttttcatcactggctatagtgattcagattgggcttgcgactcctctgatatgaggtccacctcaggattctgtgtttatctgggcaataatcttgtttcctggcttgtgaagaagcaacattcagtttcttggtctagcactgaagcagaattcagaagtttagtagccctagttgttgaaattaaatggataaagtcccttcttactgaattgcatgtcatccaaacgaagtctcctttactgtggtgtgataatcaaggtgcagtaatgataacagctaatccaattctacattcaaaatcaaaacattttgaattggacctttgttttgttcgtgaaaaggctgtcaatggagaaatagttgtcaagcacataccctcccaattagtttggggaggatgtctagggtgcgaaagttaa

SEQ ID NO: 58505 - DNA, 2772 bp, Glycine max
  Peptide Sequence Number=SeqID_175283
atgccggatctggagcgattaacgatagcttccttctacatggagggaccagcattgtcaaggttccagtggatgcatcgtaatgcgcagttgtcctcgtggtcagctttccttcacgcccttcactcgagctttgctacgacaacgtatgaagatcctacggggttactttgcaaacttcagcagcgttcgtcgctaatggcgtacctctcggagtttgaatccctagcaaataggatagttggtttaccggcgcaatttgtactaagctgttttatctcaggattgagtccatctattcgtagagaagtgcaggtgttgcaacctatctcgttagctcaagcagtgtcatacgcacgattacaggaaggaaagttacttgatgctcgtcgcccttcaccatatcgcacaccaacctccacggcgggatccaccactgcacgttcttcatccgcaaacacgacaccgtcactgcttccaaaaccagtacgcaactcaacatccattccctttaaacgattgacgccggaagaactggcaagtcatcgcgagaaggggctatgttttcattgtgacgagaaattctctcgaggacacaagtgtgcatcctccttatttttgctagtcatggaagatgaggaacctatggtggaagtagaccaactgcgcgatgcttcgcctacaccagagttactaccagaatcaccaccggcacagctgagtctccatgcgttatccgaacacaatttcctccataatcgcgtggtagtaaacttagggctaaagccaacagaaacaacaccactccgtgtcacggtggggaatggagaggagattcgctgccatcagttgtgcaccgccgtacaggtccatattcaacaacaatctttcaccattgatttccacatgttacctttatgtggagatgatgtagtgctaggagtgcaatggttaaaaacccttggaccagttttaacagactacggcgccttaacaatgaagtttatcacggatggcaagctaatcgagctgtttgctcacacaaatcctactagcactttttttcacattcgtattgaatcaaccaccaaacttactcctcaaacgacccaccccttaccagaaatcgatacattagtaaccaaatatgcttcccttttccagcctctcatgaacctgccatcgtcacggccaacagaccataccatcaacctattaccaaactcaaccctagtgaatgttaggccttacagatacccctattttcaaaagaaagaaacagaagaacaagtagcagccatgcttgcgagaggagccctcaatgccatcaccgtgcgcgatcgtttccccattctaacgatggacgagcttctcgatgaactgggaagggcggcactacgagtttcgggtgatgccctttggattatgcaatgctccttcctcttttcaagccacgatgaaccattagaatatctcgggcacatggtagctggtaatggagtcacaccgataccggagaaggttaaggccatacaacaatggccaacacctcgctctccacgagctttgcgcgggtttctcggcctcgctggattttatcggaggtttatccgagggtatgcaaccttggcagcaccactcacgaaacttttgtgccttgggcaattaagttggaaccaggacgctgctgaagcatttcagaacctcaagaatgccctcacggcggctccagttctcgcgttgccggatttcagtgcaccattcgtggttgagacaaatgcatcaggtgcgggtatgggggcatttctgatgcaaggaggccaccctctcgcttacttcagtaagcaattttgtcctagactactgaactcatctacatactactttttggggcaccacttcgtgatactaacagatcatcgtagcctaagtgagctcatgaaccaaaccattcaaacaccagagcagcatcgatatctagctcttctgctaggcttcgactatacaattcagtaccacgccgggaagtccaacgtcgtggctgacgcgttgtcgcgagccatggaatgccaagctgcctctctttacctcttgtccatgtcgcgattcgtcttccttgaagatcttcgtaaggaattagcttctcttacggccttcctggacttacgtgatcgcattcgagaagatcctgtagcatatgcggattatacactgactgaagggttcatcctgcaccgaggacgcatttggctcccttctaactcttccttcatcaagcttttactagaagagttccaccaatctcctaccagtggtcatatgggagtgcaaaagactctacatcgcctgcaagacaacttcacatggcctacgatcaaggaggatacccaaaagtttatcgcaggttacgtgacatgtcagtacactaaatacgataaccgcaaaccagcagggcttttttgtcctctcccagttccgacgcgaccatgggaagacctatccatggacttcatcactggtattccagcgtatcacggcaacacatacatcttcgtggtggttgatcaagcagtggacgcgatactgagtcaacgtgaggttgtttttgagctgttgcgtcgcaagctactcaaggctcaagaccgtatgaaaactaatgctgatcgtcaccgtcatgaccaagaattcaaggtgggggattgggttatggttaaactcaggccacacaggcagacatcagtgactggtgcagcttactcgaaattgggataa

SEQ ID NO: 58506 - DNA, 120 bp, Glycine max
  Peptide Sequence Number=SeqID_175284
atggacttgggaaggttccaagttagtgtaccaagtaacaactaccccacagttcctcatcttttgcgtatgcccccatcttccgacaatacatctttagatggttcttggggcaagtag

SEQ ID NO: 58507 - DNA, 183 bp, Glycine max
  Peptide Sequence Number=SeqID_175285
atgtcacctgacttcatggtcaggacgacaaaaggtgcagaagatgatgttagtctccgcgcgtcaacgggctcgtttgcccctggtcgacgaaaggtgcgggtaaccataaggacgacaaaaggtgcagaagacaatgttagtcttcgcgcgtcaacgggctcgtttttcgctggttcatga

SEQ ID NO: 58508 - DNA, 1086 bp, Glycine max
  Peptide Sequence Number=SeqID_175286
atggcgcgtctggagccgttaacgctgctgtcggcgctggcggtcaacaccaaacgtattggcctggcggcgaccgcctcgactaccttcagcgacccgttcaccatggcgcgcagcttctcgtcgctggaccacattagccgcggccgcgccgcctggaacgtggtgacgtcgttctctaccgatgtggcgcgtaacttcagccgcagcgatatgcctaatcatgcggagcgctacgcgcgcgcccgtgaattccttgatgtcacctataagctgtgggacggctggcaggcgggggcggtgcagcccaacaaagagaccggtcagtacttcattgatgacaaaattcagccgattaaccacgtcggcgagcatttccaggtgcagggcccgctgaacattacccgctcaccgcaggggcgtccagtgattatcgaagccggttcttccagcgatgggcagaagctggcggcagagaccgccgaggtgattttcaccgcctcggccagcctggaagaagcacagagcttctaccgttcgcagaaagatcaggtgattgccgccggacgcaatcctgatcacgtggtgatcatgcctggcgtgatgccgattattggccgcacgcgcgaagaggccaaagcgctgtggaaagagctcaacacgctggttgatatcgacaacggtctgcgtcagctctcgctgcgcttcaatatggatctgagccagtatccgctcgacggtccggtgccggaagtgccgctgggtgaaggtaaccagagccgcgtgaaactgatgaccgacatggcgaaacgtgaaaatctgacgctgcgcgaactggccgcggtagccgccggatcgcgtggtcaccgggtaatcgtcggtaccgcgcaggatattgccgatgacgttgagctgtggctcaacgagggcggcgccgatggtttcaacatcatgccggcgatcatgtccgagcagctggatttgtttgtggagctggtgattccggaactgcgccgtcgcggtctgttccgggaagagtacgagttcgccacgctgcgtgaaaacctcggcctgccggtggtgtga

SEQ ID NO: 58509 - DNA, 1690 bp, Glycine max
  Peptide Sequence Number=SeqID_175287
atgacacttgagtttcgtcaggtcacagaagacgaagtggacacttatcaggcgctgatgcatgccgcctatgcgcccacgctggcgctggggatcaaatttgatgcggccaccgctgaccgcgagaaaacgctgcggcatctgcaaagccacggcgtgtatgcgctgtatgcccagggcgtgatggtctcctcggtcaccgtgcgttatccatggggcccgttgccgggtccgttcggcctgccgcacatcggctggtttggcgcccacccggactatgcggggcagcagtttggccgccaggttcaggatcgcctggagcaggaaattttacgcggccagttacgcgcaccggcggtttcgctcggcggcatcacaaggaagccaggcatgagccaactgaatgaaacagcgctgggcgagcagctgatcgcctttcgccacgaactgcaccgttttccggaactctctaatcaggagtttgaaaccaccgcccgcctgcgccagcagctggaacagcaccagattcgcatcgttgatttgccactgaaaacaggtctggtggcggaggtcggcccggcacagggaccgctgattgtgctgcgttcggatattgatgcgttgccgattgaagagcagtcggacgttgcttttcgctcggagcgtcccggcgtgatgcacgcctgcggccacgattttcacgcttccgctgcactcggcgcggcgattctgcttaagcagcaggaggcaacgctgcccggccgcgtgcggattctgttccaggccgccgaagagaccggccagggcgcgccggatgtaatcgccaccggcgcgctgcaggaggcggtggcgattttcggcattcataacgatccgtcgctgccgcctggcgtggtgggtagcaaagccggtgcgctgaccgcggcggtggatcgcttcgatatccgcatcaccggcaccggcagccatgctgccaaaccgcatcagggcaacgatccgatcgttatcgcggcgcagattgtctccgcggcgcaaacgctgattagccgtaacgccccctccgctgacaacgcggtggtgtcgatcacccagctgcacagcggcagcacctggaacgtcattccggacagcgcctggctggaaggcacggtgcgcaccttctctcagtccacgcgtgagcgactggagcagcgcttccgcgaaatcgtgctcggcctcggtgcggcttttgccgcagaggttgagtttaactggcacgccggcatgaacctgagccacgcgctggctgagcgcatcctgcaaagccagccggatgcggcggcacgtgatgccgcgcgcactggcgtgcaggattttctggctgtgagctggccggtgttacagcagcaggtcccggacagcggcttaccggcgctgcgacaggtttatggcgacggcagcgtacgctcacaggcgttgctgctgggctatgccggccatgcgctggattacgatgatttccatgccgattttcgcggccatcccagcgtggcgattctgcccgcgctgtttgcctggcagcagcagcagcccgccactaccgaagcgttccttgatgcttatgtcatcggcgtggaagtggctggccggctgggactggccgccagccagcagcactacgcgctgggttatcccaacacggccacgctgg

SEQ ID NO: 58510 - DNA, 414 bp, Glycine max
  Peptide Sequence Number=SeqID_175288
atggataaggccaggcgattaaacgccgtactacaccgggatgtgatgatgaacagtaatctgcttaacctgcgccagcagcgcgcgacgcgcacgctattttttatcgccggactgggcatggccgcctgggcgccgcttattcccttcgccaaagcgcaactagcgatcaatgacggcatgctggggctgctgctgttctgtatcgccgcaggctccatgtcagttatgccttttaccggcgcgctgatagcccattttggctgtcgcacgctgctgctgctgtgcggtgccggactggccctggatctgccgctgctgatgctgctgtcctcaccactgccgatggcgggcgcgctgttgctcttcggcgcgatcaacggactgatggatgtcagcatgaattatcaggcg

SEQ ID NO: 58511 - DNA, 1002 bp, Glycine max
  Peptide Sequence Number=SeqID_175289
atgtctaaaactcagcggcttcccgaactgctgcaattgcttcgctgtcatcgctatccgctgaccgcgcagcgtatcgctgaacagctgcacatcagcgtgcgcaccgtctatcgtgacattcttagtttgcagcagcagggcgtagagattgagggcagcgcgggcgttggttatttactgaaatcagacggccatttgccgccgctgatgttttcccgtcaggagattgacgcgctggtgctcgggctcaactgggtcacccgacacaccgacgatgagcttaagtccgccgcgcgccatgcgctggccaaagtccaggctgtgattccgccgcatcttacgcagagtatcgatcaccagtcgctgctgatcgcctcccagggcgaagcgttgttcgaaacccatctgccgcagattcgccaggcaatccatcagcgcagcaagatcagcctgcgctacaaagatctgcaggataacctctccacgcgcaccatctggccggtggtgattggctactttgaacgcgtgcgcctgctgtgcggctggtgcgaactgcgccaggagttccgcaatttccgcgtcgaccgcattgaagcgatcagcgtcaccagcgaactctatcccggcacgcgtcatcagttgctgaagcgctggcgggattatcaccatttgcgtcacccgccgcgtgcagcagtaatcgcaactcaacattacaacagtcagtccatcaccgctttcatccgcgaggtaatattcatggccacaagtattcgtttagacgatgacttcgtgagcgacgtaaaaattcacgctgaagccgccagccgcagcattccaaagcagattgagcattgggcgaagatcggccggattgctgaggataatccggacttaccgtatagcttcatcgctgaagtattgatcgcccaggctgaagtcgataatcagaaggtttcgccgtatgtccgccgaacaccccgatccaaaaccacaaaatag

SEQ ID NO: 58512 - DNA, 384 bp, Glycine max
  Peptide Sequence Number=SeqID_175290
atgcttaccgctaatatgaccattatttatgtgcccaacgtcgtgaaaagtgctgacttttatgccgcgctgttcgacatcaaacccgcagaactcagcccgacctttgccatgtttgtgtttgagagcggctttaaactgggtatctggtcgcagtatatcgttgaacccgcactctccctgactgccagtgcagcgcgtagcgaaattgtgtttaaaaccgcgcgcaaagacgatgtcgattttctttatcacgaatggggcgtgctgcgtgaaatcaccattattcagtcgccggtgcgcatggactttggctacacctttaccgcgctggacccggacgggcaccgcctgcgtgtctgctatttacagctggatgagtaa

SEQ ID NO: 58513 - DNA, 1089 bp, Glycine max
  Peptide Sequence Number=SeqID_175291
aaagccagcgcgtcaccggcttgttcgataaggcggaccgcaaactgccgctgccaccgggcaccggcagcggcacggttgacgtccacggcggctggtatgacgccaccggcgattacggtgtgcacctgtcgcaccagaatctgacctcttatttcaatccgcagcaggcgccgctggtggcgtggagtttattgcgcggttatcaaaatctcggggcgcgtgataacccgaactttgacgagtatcgccggcgcatgctcgacgaagggctgtacggtgccgatttcctggtgcgcatgaagcggccgggggaatccttcttccaggcgatctcgtcgccgggcaaagagaagctggctcaggaccgggtgatcgccaatcccaactggcgcacgcagatcaaagagaaggagtcagattccaccattgttgaagaagaggcggtcggcccgctggcgtggcaggccagcttccgctccggtgccggcatgtcaattgccgcgctggcgctggccagcaccatggagaatgacggcaacttcacgcggcagcagtatctgcaaaccgcagaagatgcctttgccttcctgcagaaaaataacctgcgcatggtgaacgacggcaaagagaacatcgtggatgattacaccgcgctgctggcggctaccgagctatatcgcgcctcacaaaaagcggtgtatctggctgcggcgcagcagcgcgcggagagcctgatggcgcgactgacgtcgctggataactggcatgactactggcgtgccgacggcgaaaaacgcccgttcttccatccgtccgatgccggtctgccggtgatcgcactgctggagtacgcgcgcatcgcgccgcaggcgcagcaggcgaacatccgccagacggtaaaacgctcgctgggctttgagctggcagtcaccaaagagagcaataacccgtttggctatgcgcgccagctgattcagctgaaagacggcgtgaagcgcaccagcttcttcttcccgcacgacagcgaagctgcgccgtggtggcagggcgaaaacgcgcgtatcgcctcgctggccgccgcagccc

SEQ ID NO: 58514 - DNA, 2250 bp, Glycine max
  Peptide Sequence Number=SeqID_175292
cggcgtgtttgtcttcctgccgctgtttattgccgttaccgcggcagaccgtttcggtgccagccgtttcaccgcgctggcgctgacggcggcgatggtgtttccgctcacccagccggatctgccggcgcactttacgctgttcggcctgagcatcagcctgaagatttacggcggcgcggtgattccggcgattctggcggtgctgctgctgagcaagcgctggtgtttgtgccgtgcctgtcgctgctgatttgcggctttgtggtgttcacggtgattggcccgctggcagattacgttggcgtcggcatcgccagcggctacagctggctctatcagctcagcccgatgatctccggcgcgctgctggcgggcattggtcagctgttcgtggtgtttggtgtccactggggcatcatcccgctggcgctgatcaatattcaggtgcagggctacgacaccatcatggcgatgtttatgtcggcggtgatggggcagtttggcgcggttaccggcgcgatcttcatcgcccgcagcctgcgcgaccggcagattgcaatctcggcgtcgctgtcagcgttctttggcatcaccgaaccggcgctgtacggcgtcaatctcaagtaccgcatgctgtttatcttcggctgcatcggcgcggcgctcggcggtggcatcaccgggctgctgcaggtgaaaacctacagtttcctgccggtgctgaacgtgtttgaactcggcctgttcgaaggcccggagtcgaagatgatctatgaagtggcggcaattgccgtggctttcctcaccccattcattctgacgctgatttacggccgctggacgctgcgcagcgtcatgaacacattcaccaggagaaaaaaggcagcgctgctgccgctggccaccctgatgctgggcgcggcaccgccggcgctggcggaaggatttgttgaagacagcacgctggagggcaccgtctattactggcagcgccaccgtgagcgtaaagatctcgatccgcacagcacgcactatcagcactatcagaccaacctgcatcacagcacgctgaccggcgcgctcgattatcagtccggctatctggccgataccgtgggcattgatgtggcggccttcgccacctgggatctgtttgaaggcagcccggcgcatcccaacgagatcagcttcagtcacgggccttcgatgtgggaagaccgtggcgttggcgaacgtaacgggctggatctctaccgtgccgcgctgaaactcaaagccggcgactactggctgcgggccggttatatccagccgagcggtcagacgctgcttggcacccaatggggatttctgcccggcacctaccagggcgtggaagtcggggcagtctatgactatggcgctgccggcgcgctgtcgctgtcgtggatgggcgccaacaagtacaaagcaccgtggtatcgcaaaatgtacgagtttcgcgaaatcgaccggcaaacacgcattccttgtctgcactcgctgggcgcgaagtatgacttcaaaaacggcaacacgctggagctggcgtggggtgaatctccgcattatctcgacaaatatttcgccaaagcggcgcgtcagaccacgctgtgggataacccgttcagcgtcagctggcagttctacggctcgcaggatcgtaccggtcgccatgatgtttacgatgaatttgcctggcagcagggcctgacgctggcgtaccagtgggatcgctaccagttccggctcgagggcagcgcggtacacgcaccggggaaacaaggttactacaccgtggcgatgacgccgatctatcccaactccgcgggccgcatcgatatgtggtgggattcgcgctctgacttcaacgccgacggcgaaaaagcgctgtttgcaggcctgatgatcgatctcagcgacatcgtctggccgggcgtcagcatcggtggctcgtttgcctggggctgggacggtaaaccggcgcgcggcggcgactggtcgcagcagcagcgcctgacggaaaccgccatcaacggcgatttggtgtggcaggtgcagtccggctgggccaaagacacggtatttaagctgcatctcaccgcctacaacaaccatagcgataaccccagctggggcggcggctatggcaatgttttccaggatgaaaaggacgtcaaattcatgatgattgccccttttagcctgttcaatcactcacgacactaa

SEQ ID NO: 58515 - DNA, 1694 bp, Glycine max
  Peptide Sequence Number=SeqID_175293
atgaatcagctctcttcctctgcggatgtgattgccgtggtgccggctgccggtatcggcagccgcatgcaggccgcctgtccgaagcagtatctcactatcggtccattaaccctgctcgaacacagcgtggcgcgcctgctggcgcatccggcggtaaagcaggtggtggtgccagtcagcccggatgacggctggttcgatagcctgccgctggcgcaggatgcccgcgtgctgcgcgtcaccggcggcgaaacccgcgccgagtcggtgctggccggattacagaccatccgccacagcgcctgggtgctggtgcacgacgcggcgcgtccgtgtctgcatcctgatgatttagcgcgtctgctggcggtgcgtgagcacagcaaagtcggcgcgattctggcggcaccggtgcgcgacaccatgaagcgcgcggagcccggcaaaggtgccattgcgcataccgtcgaacgcgatgatttgtggcatgcgctgacgccgcagtttttcccgcatgcgctgctgaccgcctgcctgacgcgcgcgctcaatgaaggcgcgaccatcaccgatgaagcctcggcgctggagtattgcggttatcatcctgagctggtcagcggacgcagcgacaatattaagggctttattgcgcattctgacggcgatgtggcgctgcatgcgctgaccgacgcgctgctgggcgcggtggcgatgggcgacatcggcaaactgttcccggacaccgatccggcatttaaaggcgccgacagccgcggtttgctgcgcgaagcctggcgccgcatccagcagaagggctaccgcatcggcaacgttgatgtcaccatcatcgctcaggcaccgaaaatgctgccgcacgtgccgcagatgcgcgtcaacatcgccgaagatctcggttgccacatggatgatgtcaacgtcaaagccaccaccaccgagaagctgggctttaccggtcgcggtgaaggccgatcgggcatgagtgagctgctctacctgcacggcgtgcccgctgccactggggtgattaaagccagtcccgaagatttcgtggtaattgaagatctcggctatccctatgacggcgaaggcgagcagctactggtgcgcatccgtaaaattggctgcaacacgcgttttgtcgctgaggcgatcgccaaattcctcggcgtgcatcagcgcgatctcagctatgccggtatgaaagatcgccacgcggtcaccgagcaaacgctgtgcttccgcgtgccgggcacggcgatgcccaaccttgccggcttccagctggaaggcgtggagatcctgcaggtgattcgccacaagcgtaaactgcgcaccggcgcgctggcgggcaatgcgtttcgtctggtggtacgtcaggtgtccgaccgcgcgcaggtggaatcgcggctgcagcagattcagcagcagggcgtgcccaactactttggcgaacagcgctttggccgcggcggcaataacctgacgcaagcgcgcctgtgggtagaggagaaattccgtccacgcgaccgcagtatgaaaggcattctgctgtcggcggcgcgcagccagctgttcaatcagctgaccagcgcgcgtctgcagcgtgacggtgcgctggatcgcgtgcagcccggcgatgcgctgcagctcagcgggcgcggcagctg

SEQ ID NO: 58516 - DNA, 403 bp, Glycine max
  Peptide Sequence Number=SeqID_175294
atgcaacctgctcatcacatactgggaactaaagcattcgacaagagtgtcaaagctgccaagggaccagagagtgagtctttcataccatgtcaatgttgcccctttgagggacattggaaagactcaacacatgatcgcatcgttattggtgtagagattagcctaggcaggttgacctccatgatgcgatcaatgaaggggtgtcatcgagttgttcgtccttcatggcgatatgttatggtcgtccagggtattgttggtctaacggtgatgcaattcaccttgggtgtgcttgttgatcatgtgggcgaaatgttcgtcgcctcacacgagcctccaactcatagtggtcggcctgttgaagcaagatatcatgatgttttgatgatgccaaagaaag

SEQ ID NO: 58517 - DNA, 267 bp, Glycine max
  Peptide Sequence Number=SeqID_175295
atggatgaagaatccctaataaagaccctgactgtctatgaagcaattaagggagatcgagatgacatgttcgatgtagacccacatgatgacactatcgacaaagacttgaaaccaatcgaagaatttgtcaagctacaacatggacctaaacccaaacctgggcagcctacttgggccttccaggatgttcctccagaaggcggttgcttctggagtaagcaacctagctcgcctgggcaagctgagctcgcctgggcaagctga

SEQ ID NO: 58518 - DNA, 546 bp, Glycine max
  Peptide Sequence Number=SeqID_175296
atgtgtggtttcaagccgattatccgcatcatctcggtgaaggttcacatgcattgtgacaaatgtgaggctgacctaaaaagtagattaataaagcacaaaggtattttcaatgtgaaaactgaccagaaggcacaaaatgtaacagtggaaggaaccattgaagttgagaaattgatatcattttttagaaaaaaggtgcataaaaatgctgagattacttccataaaggaagtgaaaaaggatcaagagaagaagggcaaagaggaactgaagtcttcagaaaccaccaaagagaaggatcacagtaagtctggtgaatcaaccaagaaaaaagatgatgataataataaaaaatcaggtgaatcaaccaaggaaaaaggagacggcaaatctagtgaaacaaccaaaataatagaggttcatcaagggcacccaaaagaggaaattaagataaaggataataatgttccttatattattcattatgtctacgcgccacaacttttcagcgatgagaatccaaattcatgttctattttataa

SEQ ID NO: 58519 - DNA, 829 bp, Glycine max
  Peptide Sequence Number=SeqID_175297
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcactggcattaaatcatgttgaatctcttttacctttcccagcatcaatatgcagcagtattggcgcaacatatttgcttcaacttgcatcctcaactacaccatcaaacgcagccacaaataatactaatacggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 58520 - DNA, 3372 bp, Glycine max
  misc_feature (3296)..(3296): n is a, c, g, or t
  Peptide Sequence Number=SeqID_175298
atgaacaagagctatcgcgttatctggaattatgccctgcaatgttatgtcgtcacctcggaactggcgcgcggcaaagtcaaatcatcctgctccggtaaagcggcgaataaatcagcactgatcggcggcgcgctgggctcggcgctgctgctggccggttcaccggcggcgctggcggccaacggtgccaccatcagcgatccggcgcagccggttgaactgaataatcagacgctgcaggcgaccggtgacaaagcctatggactgctggtgcagaatggcggcaaggcaagcgccacggatgtgacggtgctgaatgcgggcagcagcggctacggtgtgttttccaccgccggcgctgcttctgcggagatgacgcgcggtagcgtgaccaccaccggcgccggcggctacggcatcgtggccagcctgaccggcgcggtgaagaccaacggcactaaggtggaaacctccggccagaacgcctacgccgcctacgcctcttctggcggtatcataaacagtactgatacagactatgtcactcatggcgacggcgcgtatggtgcttattcgcgcgcggcgggttcgctgatcgatctgaccggtggcagcgttaccaccagcggcaacaaagcctacggcctggtggcgggtaacggtagcaaactcaacgccagcggcgtgcaggttaccaccagcggagatcagtccaatggagtggtcgccaacaatgccggcacggaagtcacgctgatgggcggaaccgtgaacacaaccggcagcaaagctgtcggcctggcggcgaattccggcggcaaactcaacgccagcgatgcgcaggtaagcacgagcggcgcacaatcatatggcgtggcggtcagcaacgtcggtacagaagtgacgctgacagacagtacgctcacaaccaccggtgataacgcctatggggcctatgccgcaaacggtgcaaagctcagcatttcaggaacaaagctgatcacctcaggtaaaaatgctgatggcgtttataccagtggtgaaggctctcttctgaatgtgaatgacagtaccattgcaaccagtggcagcgggtctaatggcctgaaggcggacgggaaatcgacgctaaatgccacaaaaaccgccattgagattacgggcagcggctcaggcacttacgcatcgggaaccggcacggtgctgaagctgtctgacagtcgcattcaaatggggcagaatgctggatacgccgtactggggataaataacagcacgaccaacctcaaaaatgttgaaattatcactgacgccagtcactcagctttggcagtgggttttggcgctacattaaacagcgacaatgttaacgtgcagacgcgcagcggcggttacggcattgaggttcaggatggcagcaccttcagcggtaataatattacccttgaaaaaagcggcattgattctacaggtttaaacgcagcgattaacgtgcttaatttataccggccagatgcacagaatgatatttccctgacgagttcagatattaatgtctcaggcgaaaacgccaccggtattctgtcgcagtatcaggccacgctggcggatattaaactggcgaataccgctatcaccgccaccggcggcaccgccgtcaacgtgctgaccggcaccagcatgaacatcgacgccgacaactcggtgctgagcggcagcacgctgctgaaaaccggctataacaccgcagaaggttcaaccgccggctcggtggtgctgaacggcagcaacaactcgctgtttgaaggcaacgtagacattgaccgcagccagacgcaggacagccagatcaacctgagcggcagttcggtgtggaccggcgcgtcatccggcctgaatacgctgacgctcagcgacaacagccagtggaacatcaccggcgacagcagcgttgatgcgctgagcgccagcaacagtacgctgaacttcacccacgacggcgccggcttcagcaccctgacggtcaacggcaactacagcggcgacaacagcacgctggtgatgaacgcggcgctgggcgacgaccactccgccagcgataaacttcacatcctcggcgacagcagcggcagcaccgacgtggtggtcaacaacgccggcggcagcggcgcgcagactatccagggcctgaacatcattcaggtggatggcgctaacaacggcgaattccgccagaaagggcgtatcgtcgccggcgcctatgattacagcctggtgaagggcgcggatcagcacggctggtatctggtgagcgataaaaacggcagcgagcccgatccggtggtgacgccgggcgaaggcgagggcggtgaagtcgtcgagccaccggtgagccagcacgacatgatcgtgcgtccggaagcggcgagctacagcgccaacctcgcggcagccaacacgctgtttaccaccagcatggatgaccgtccggcggaaaccttctacaccgacgccagcggccggcagcagagcacgcgcctgtggctgcacaacagcgccggccacagccgggtgaaagacagcagcggccagctgaagtcagacaccaaccgctacgccatccagctgggcggcgacgtggcgggcggcacgctgaccggcagcgacagcctgcgcctcggcgcgatggccggctacggcaacgcacagagcaagtcgcgctcggcggtgagcggctatcagtcacgtggccaggttaacggctacagcctgggcgtgtacggcagctggcagcagaacgcggcagagcagagcggtgcatttgttgacagctcactgagctacggctggttcaacaacagcgtgaagggcgatgacatcggtcagcagtcgtataaatccaaaggcatcagcgcgtcgctggccggcggctaccgcgccgaagtggcaacgctgagcgacagcaccagcctgtggctgcgtccgcaggcgcagctgaactggcagggcgtgaaggcggacgacgtgaaagagcagaacggcagccgcgtgcaggccaccggtcaggacaacctgcagagccgcctcggcgtgcgcgcctcgctgcgcacgctgctcgacccgcaggcgcagagcgccatcgagccgtacgcggaagcgaactggctgcacaacagcaaggcgttcggcaccgcgctgaacggcgtcaacattcagcaggcgggcacgcgtaacgccgccgaggtgaagctgggcgtggacgcgcggctgaacgcgaacgtcaacctgtgggncggcgtggcgcagcagctgggcaaccacagctacagcgacaccagcgcggtggcgggcgtgaaagtcagcttctga

SEQ ID NO: 58521 - DNA, 608 bp, Glycine max
  Peptide Sequence Number=SeqID_175299
atgaggggcactgtgcatgagcctcaagcgaacctagggggtgaacccttgggtactagtaccctcacctttagagaactacacgtcctcgccatcaaagggctacaagcactctccttcaaagggctacacgccctctcctttagaggactacacgtactctcctttagaggaccacatgtccttgccttaagagggttgcacgcccttgccttcagaggactacacgttctcaccatcagaggactacacgtcctcaccttcgaaggactacacgtcctcgcctacaaagggctacatgccctcaccttcagaggactacacgtcctcgccttcagagggctacatgccctcgccttcagaggactacatgtcctcgccttcagagggctacacgccctcaccttcagaggactacacgtcctcgccttgaggactacacatcctcaccttcagagggctacacgccttcaccttcagaggactacacgtccttgccttgaggactacacgtcctcaccttcagaggactacacgcctttgccttcagagggctacacgcccttgccttcagaggaatacatgtcctcaccttcagaggactacac

SEQ ID NO: 58522 - DNA, 1587 bp, Glycine max
  Peptide Sequence Number=SeqID_175300
cgtgcacatcagcacgctggtcgatctgccagcggtgctgaccccggaacggcaccagtggattcagtcggtgtaccgtgcctgcgaagccgtgacgcagcaacctgcggaagcgcgcatcgtgccctattttaccgatgcctcactgctgatgccggcgctcggcgatctgccctgcattattctcggtcccggatagtcgcggttatgcccgtcaattttgacctcaacgatctctacgccttccgcgcgctggtggagtacggcaactttcgtctggcggcggagtcaatctgcctgtcgcagtcagcgctcagccgcagaattgagaagctggaagcggcgctcggtgcccggctgtttgaccgcaccacgcggcgcgtcacgctgacgctgtatggccagaactttgctcagcgctcggagcagttgctggataatgtcgaatcgatgctggccgacgtcgagcgcgccagccaggatcgcaccggcctgatcaccgtcgctaccgtgccctcgggcgcttactattttatgccggaggtgatccgccgctttcaggcgcgttacccgcgcgtgcgcatcaagctgattgatagcagcgtcggcaacgtgatggatgcagtgagcagcggacaggccgatttcggtatctgctttgcgcgcaatttaccgccggagcttaccttcacgccgctggtggaagatgtttacgtcgccgcctgtcgccacgatcatccgctggcgacgcgccagcagctcagctggcaggagtattttgcgcaggattatgtggcgctggataagtgcgctggcgcatcttacgcccgcccggcaaagtatctgcgaaacgcgccatgtcacgacgctgctggggatggtagaagcgggcatcggcattgctgccgtgcccgcgatgtcgatgccggcgaacgggcatccgctactgcgccagctggcgctgaccgatccgcaggtcacccgttcggtgggattaattcgccgcagcggacgtatgcaatcttacgtcgctgcggagctggaaaagctgattatcgaacagtctcagcacgcttaacgcgcggtttgcaacgtcagcgcgcggcggcgataaagcgcggtagagaccaccggcgtgaagccgccaaacagcgcggttgccaggctgtaggccagcgagaaaccggcgacgcgcacttctgccggcatcacttcagtcagcgccgggatcatcgcaccgttatacaggccgtaaataaacgacagccacagcagcacgctcagcatcatgctgaaggtcggcgtctgcgccagcagcgtcagtgccggataggcggtcgccagcgccagcagcgtcatcgccagcagcaccggtttacgcccaaagcggtccgacagcgccccgccaactggcagccagataaagttggagatcgccaccagcagcgtcaccagcaggctgtccgaggcgctcagcatcagcacttttttgccgaaggtgggcgcatagacggtaatgaggtagaacgcggtggtggtcatcgccaccatcagcatcccggcaatcaccaccggccagttctgtaa

SEQ ID NO: 58523 - DNA, 609 bp, Glycine max
  Peptide Sequence Number=SeqID_175301
ggcttctcggccggggcagaactgggtggcgtgtcggtttatctggcagagattgccacaccggggcgcaaaggtttctacaccagctggcaatccggcagtcagcaggttgccatcatggtcgctgccgcgatgggcttcgcgctcaatgccgcgctggagcagagcgccatcagcgcctggggctggcgtattccgttcctgtttggctgcctgatcaactggccggtggtgattgccgggatgctgatggtggcgatgaccaccaccgcgttctacctcattaccgtctatgcgcccaccttcggcaaaaaagtgctgatgctgagcgcctcggacagcctgctggtgacgctgctggtggcgatctccaactttatctggctgccagttggcggggcgctgtcggaccgctttgggcgtaaaccggtgctgctggcgatgacgctgctggcgctggcgaccgcctatccggcactgacgctgctggcgcagacgccgaccttcagcatgatgctgagcaagtgcgcgtcgccggtttctcgctggcctacagcctggcaaccgcgctgtttggcggcttcacgccggtggtctctaccgcgctga

SEQ ID NO: 58524 - DNA, 699 bp, Glycine max
  Peptide Sequence Number=SeqID_175302
atgactttcaaggtctcattcacaccccaactccacccagcaaagaatatgcgaagtttctatgcagtgccagaatctgttttggacaaaaggtcaagtgcatacaacaagggcagggtgtttatccatggtgctagtgagatcaccgcaaatgcttacaaaaatcaattccaaacagacttagcaagcttcttgagatcaagggcagtggaactgaagagaggggggtccatgttcttggtttgcttaggcagaacttctgtggaccccacagaccagggtggggctggcctcctctttgggacccactttcaggatgcttgggatgatcttgtccaagagggattaattagcagtgagaaaagagacagtttcaacattccagtgtatgcaccaagcctgcaagacttcaaggaggtggttgaagctgatggttcatttgccataaacaagcttgaggttttcaaaggtggaagtcctcttgtggtgaaccagccagatgatgatagtgaagtagggagggcccttgccaacagctgcaggagtgtgtctggtgtccttgttgatgctcacattggtgacaagcttagtgaagaactgtttctgagagtggaacgtagagccacaagccatggcaaagagttattagagcaactacagttctttcacatagttgcatccctttcttttgctctatga

SEQ ID NO: 58525 - DNA, 201 bp, Glycine max
  Peptide Sequence Number=SeqID_175303
atgggaattagtggatgccacttggttggctcaagaagggtagtagggggcaaagataacgaggaaggagatgtggttatatgtgtggactgggaaatgggatggggcaaccttgtcgatgcgcttggtgatttagaagggcctgcaaaaccgtttggccaacttttggaagaatgggcttgcacaaagcgttggcgataa

SEQ ID NO: 58526 - DNA, 570 bp, Glycine max
  Peptide Sequence Number=SeqID_175304
atggaggcggtgggttcgagactcagccgcgcctcctcccgctacggcgcccccaccgtgttcagcggccccgtcagaaagtggaagaagaagtgggtccacgtcaccccctcttccttacccaacaacagctctcactctcacactaacaactccaccaccaccagcagcgcttcctctcgcctcctccttcgccgttggactcccgccaccgtcgacgacgccgccggagccgtctccgacgagcctccccgaagaaagttccgttacacccctaaacagttgaagtttgggaaggaactgccacacacaagtctagttgttgtcctagaagaacagaaaaagatgaatgttgtgaaggctgaacatgaacccacaattgagactgaccaattggctgctaggaagacaaatgtgactcatgagatgcagggaaaactgaacatgaatgaaatgttggaggaaaccaaggattcaaacattggtaatttagatcttggttcagacttccaaagcaacaccggtggaaacagccagaacagtgattctcaattggaaaatagtatgtaa

SEQ ID NO: 58527 - DNA, 948 bp, Glycine max
  Peptide Sequence Number=SeqID_175305
atgtttgcttacagggttttgtcccgttcctctgccatcctttctcgaagcttcacccttttctctgtttcacgaaattcccaacctttctccaccaccctgtccaataacttccattccctccttcacccatctcccaacaagctgattccggttcaaaccaattttctgaattcatcattgacttcgagattcgggttttcttcaacggcctcgcatgagcatgcaagtgaagaagcaaaggtatctgatcagtctgaacaagctgaagctgcggatcaaaccaaagaatcagatgtagagagtgaatgtgatctgtccagggatgatttgataaagcttgttgctgagaaggaacaacttttgaagttgaagcacaaggagattgagaaaatgcaggataaagttctgcgaacttatgcagagatggagaatgtcatggataggacaagacgtgaagcagagaattcgaaaaaatttgctatacagaattttgcaaagagtttactagacgttgctgataatttgggaagagcttcctcagttgtaaaggacaacttttcaaaaattgaatctcctgaggagtcttctgaagcagcacaactcctgaaaacacttctagaaggtgttgaaatgacagagaaacaacttgcagaggtaacagttgtttttgagaaagagggttggggggttgatttgcccagaataggagatgaattttggctcctactggtactcaaaaagtttggtgtggaaaaatttgatcctacaaatgagccatttgatccacacatgcacaatgccatcttccaaatccctgatgcttcgaaggcccctggcactgttggagttgttctgaaggcaggatataagctctatgatcgtgttcttcgtccggcagaagttggtgtaactcaagaagtggaggataacaaagcagctgagtga

SEQ ID NO: 58528 - DNA, 171 bp, Glycine max
  Peptide Sequence Number=SeqID_175306
atgggagaaaatttcatactcgccaaggacaaggatgggaaagggatttggggagaggttgaggatagggaatcacacacccgtcctcgcctcgttatcatactttcacatggtgcgaaacctgtttctcttgcacatgctagccaccatcaagaagtaaaacataattaa

SEQ ID NO: 58529 - DNA, 344 bp, Glycine max
  Peptide Sequence Number=SeqID_175307
atgacaaatagtagcgtggagaatgccatgccctcaaccattgtctttgacatgctcgccagcaaaggtcttaaggtgaacttttctaagagcaagtttggagttattggagtggaaagggatgtagttgagagaatggtggagacatggagacccattgtggaaaagttctctaagaagttggctaaggacttaaagaaagtgtgtggaggtggagcccaaagtgattggtgtgactggagtatggttttggagttagggaagggtgatgcagcgaggaggttggcagcttctttgccacaagaccctgctgcacatttgtggcaacaaactagaatggaaag

SEQ ID NO: 58530 - DNA, 303 bp, Glycine max
  Peptide Sequence Number=SeqID_175308
atgcttcctcaacgcatgaagaaagccatcactgataaccctaagaagcttgccaacttgattgacctcgtcaaccttccatccacgctaagagaatttgtgggtcagtctcagatttcccgcttaggctgttttaagtgcgtttggttttacatcaaaaccaataatcttcaggatcagaacaacaagaatgtggtcaactgtgatgaaaagttaaaaagtattttgttggggaaacctcaggttgagttagcagaacttcctgcacttatcaagatgcattttccaaaagagcccaaatga

SEQ ID NO: 58531 - DNA, 345 bp, Glycine max
  Peptide Sequence Number=SeqID_175309
atgaatcttaataaaatcaatgagtttgtaaaacgagcacgagctgctaagatacatgcttatattattagtcatcttaagaagcagatgcctgctatgataggcaaagctaaagctcagcaaaagctcattgataatttggatactgaatttgttaagatacaaaaggagttccatctaccacctggtgactttccaaatgttgaacatttcaaagagaccttgagtggttacaacattgacaagtttgagaaattgaacaaaaaaatgatacaaacagtggatgacatgcttgcttatgatgttcctaacctcttgaagacattcagaaatccctatggctaa

SEQ ID NO: 58532 - DNA, 504 bp, Glycine max
  Peptide Sequence Number=SeqID_175310
atggtatgggccattgcagattcaaaacgagaaggatatcttggtttcaaagaatttgtcattgctatgcagcttgtttctttaggacaatgtggatactcaataacacacgatttgctaactagtgatgctatgagacatgcaaaaccacccataatggatggtttggatgtattgcttacaaagaaaaaacgtaaacaaaaagataaagaattgagtgttagtcctcctcacccatcaccgacaagtaaatggtttactgcaaagtcagcaaaaaaggttcctgcttcctcagtgacatcaattgtcgatggtttaaaaagactttaccttcaaaagttaaagcccttagaagttacttaccactataatgatttcgtatctcctctcttgacaaatagtgactttgatgccaaacctatggttttgcttttgggtcaatactcaactgggaaaacaacatttattaagcatatgcttaaaagcagttatccaggcaagtga

SEQ ID NO: 58533 - DNA, 264 bp, Glycine max
  Peptide Sequence Number=SeqID_175311
atgaaaacttctccctttgaacttggatctgacacacttccttcacccaacactgtcaatctttggatgcaacagaacctccaacctccaaaaggatccaacaaacacattatttttggtgtagcccttcggtacttttttacaaaagaattaggatactccaaggtttggattgagactggttcaaaagtgatggtggatcttttgttgaagctaattagagcaaatcatcacatgggatcccagattcagatggctagataa

SEQ ID NO: 58534 - DNA, 231 bp, Glycine max
  Peptide Sequence Number=SeqID_175312
atgaatgaagcaaattcagacctgaatgctttagatgaagacatcttagttgaattaagacaagatgctagtggtggtgttagtagtgcacctatgaatgatttggaggttcctccaattgttgatgatgatgaaggtggaggatatgctattaataaggaggaagatgaagatcacatggaggatggctatcttgatttaactttgaatgatcttttagacctaccctag

SEQ ID NO: 58535 - DNA, 201 bp, Glycine max
  Peptide Sequence Number=SeqID_175313
atgattgtccctgaagagagagaggtttctaaggggcaggaagaatcatcaagtcagagagagaaagagaggatagagaaggaacctgagaagaagaagaagagacagaaagtgagggaaccaaaggcagtggccggaactgcgtcgacggtggcgcgagacgaacttgacggtgagtgtaagatgagatctaacgaataa

SEQ ID NO: 58536 - DNA, 1395 bp, Glycine max
  Peptide Sequence Number=SeqID_175314
atggctccaaaagaagcaaatcttgcaaatgagcttgatccaagtttaaacttcattgcttgtgatatcatggtttgcacacacaaggaatcgcagcttacacgtatcaatgttttgtatccaaatggaggcactgtattggttcacctcattcttactctacacctcccatgtgcaccaccagcagcgtcaatcgccagcgaagctatttattttcgctcttccaaactccccacacgccacaaccattcccattcgcaactcccaatgaaagacaccaccaccaccgccaccgcctccacggcgctgctagatcgccgtggcaagtacaaccgcagcgtctccaacttgaacgacgagttccacacgttccgctcctacatccggtggatgtgcgtggaccagtccaaccccttcaccgccgcgctctcatggtccctgttcctcctccttgccgtcgccgtccccgccgcgtcgcacttcctcctcgcctgccccgactgcgacgcccgtcactctcgcccttacgacgccgtcgtccagctctctctcacctccgtctctgccctctccttcctctgcctcgccgtcttcgtccgcaagtacggcctccggaggttcctcttcttcgataagctctgcgatgagagcgagaccgtcagaaccaactacatggcgcagcacaatgtcactgaagatcctttcggtgtttgtggggccatgtttcgtggccgagtgtgcatacaagatatggtggtacacatccggagccccacagatccccttcttaggaaacgtgtacgtgagcgatgcggtggcgtgcatactagaactgtggtcgtggctgtaccgaaccacggtgatcttcctggtgtgcgttctgttccgtctgatctgccacctccagatcctgcggctctgcgacttcgcaaggatcaggaggcacctgcgaatcataagccacaggttccgcgcgttcatcctactcgcgcttgtattggtcaccggaagccagttcgcgtgcctcctgttacactcctttctgcgttgtgcatcttgttgcgtagtgcaacgaaaataacacacaaagcccaagcgatcacggggcttgctgccaagtggcatgtgtgtgcgacgttggattttgatggagttttaacggaaggtgggacaccaacggctcctcagagttcccatgaaacaatgtttcctaatgtgggaacggatggggaatcagagactgatgaagctggtgatgaagaagatgaaattgatactaccaagttgatcccatcctatgcttatagcaccatctcttatcagaagagacaagctcttggtaacttaatttctcacaccctattatattttcttaactacatgtctaagttatga

SEQ ID NO: 58537 - DNA, 224 bp, Glycine max
  Peptide Sequence Number=SeqID_175315
ctagaacacgaggtttaggtcgtgctataggtagacttataggcagagatagacaggatgaccatgatgcagttgatgttcccgagaggcgtagacctgctgcttcagccggtcgacaacgggttcatcagatgactgcggatgcacctgatatggttgaggatgttcctgacatgactgaggatgtccctgatatggctgaggatgcacctgagatttggtaa

SEQ ID NO: 58538 - DNA, 828 bp, Glycine max
  Peptide Sequence Number=SeqID_175316
atggtgcagctggtcggcgcgcagcagcgtgttgttgatgcgcttgaccaccgccggcaccgaatcggcggggtacagcgactggtccgggtacatctggccggccaggttggcgtcggccgccacctgccaaccggacaggtagatggccttcaggccagccttgacctgctgcatggcctggttaccggtcagcgcacccagcgcgttgacgaactcgcgctcatgcagcgacgcccacagcttctccgcacccaggcgggccagcgaatgctcgatgtggacggtgccgcgcaggcgcaccacgtcggcggcgctgtagttgcgctggatgccttcccagcgcgggttggtatcccagtcgtgctggatctgttcggcagtgggcagcttgctcatgtctttctccagttcggccggcagggtcaggaaatcggtcagttcgtcgctgcggctcagttcgccgagcagggtgatggcttcgccgatgcgtgtaccaccaggcagcgcggcggtatcgcccagccgtgccggcagctgcgagagagtggaatccagcagcgccagatcgatcgcggtgccgtcgtccagttgctggcccggcgtatgcagccactgccacagctggctgcggctgatctcggcggtggccgcgtcctccatcaggtggtggatcggcacgcaaccgttgccatccagccacgccgccaggtagcgcacgcagacttccacgttgccttcgaagccggcacgggtgatggtgcccggcgggcgcgcgatcagttcatcgcggcccacgcgcacatcctggcgcagcacgctgtgctg

SEQ ID NO: 58539 - DNA, 198 bp, Glycine max
  Peptide Sequence Number=SeqID_175317
atgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 58540 - DNA, 450 bp, Glycine max
  Peptide Sequence Number=SeqID_175318
atgctcaatggaatgccctggaactcccccatgataagcacatgtcacattcgagttaaatcctcagggaaatggaggttaggaatctttgttgggcttatgtctaccattgtattattgagtacatatggcaattttgtggtcgatttaggggtggcctttgtggttgattgggtgatcttgggtggtagagtgatgggtaatgggttctccctccttcttgtagaagcaaagcttcatgatgaatcaagattgattcaaagatgttttgatgataacaaaggtgatgacaaaaagctcaaaggtcaatcaaagaatgagttcaagatgttcaagattgaatcaagaacacttcaaggttcaagaggacatttgatttcacgaatcaagattccaggttcaagcttccaagaatcaagatcaagattcaagaatcaagagaagacttaa

SEQ ID NO: 58541 - DNA, 453 bp, Glycine max
  Peptide Sequence Number=SeqID_175319
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgacccttttgcgtgcacgcacgctcccaacgagacctcagaggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaacggatgggggccggcgatgtgtcccggtcggatgtggaacggtgagagccggtccgccgatcgactcgggacattgaccgacgcggattgcgatggtggcccaagcccgggctgttga

SEQ ID NO: 58542 - DNA, 786 bp, Glycine max
  Peptide Sequence Number=SeqID_175320
atgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaaatccttgttagtttctttttcctccgcttattggatatgcttaaactcagcggggagccccgccctgactctgaggtctcgttgggagcgtgcgtgcacgcaaaagggtcgtcgatgggtccagaactgaccggctcgcacgtgattggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 58543 - DNA, 319 bp, Glycine max
  Peptide Sequence Number=SeqID_175321
cttgggaggattgatggggacccggtgttgagagaaacgaggatatgggctacgtgggagtacgtgagctcagttggaggtgggcaacaggggatgagtggtacctggagatatgtcgcgggggtcaggagaccttggggacgtcaggcgagctcctggcagtcaacagataaaaggaaaacaagaccacaaagcaaggaggcttgtggtggctggccagctgaggctaagatggtctctgggatttgggagatgatagaagcctctggtaatcgattaccagcctgtgtaatcgattaccccgaggaatgggtcactg

SEQ ID NO: 58544 - DNA, 438 bp, Glycine max
  Peptide Sequence Number=SeqID_175322
atggttgcgccggcgcagctggctgatcagggcctgctcgttggtcagcacgcgcatgatcgtgcggcgcaggaagtaggcgaccaggccgggatcggattccaccaggcgatggaaatcggccgggcccagctccagtacttcgcagtcggccagcgcgcgtgcactggcgctgcgcaggtgatcaccgaccagcaggccaagctcaccgaagaactcatgctggccgagcgtcttgatcaccaggtcctcgccgaagtccagttcgatctggccctggaggatcacatacatccgttcgccgcgatggccacgctggaacaaccactgtccggcatgaagcttgcatggacgggcaaatctggcgaacaatgccacctcggcagcggacagcagcgcgtgcacgatctcggccatcgccacccgggcgatacctga

SEQ ID NO: 58545 - DNA, 627 bp, Glycine max
  Peptide Sequence Number=SeqID_175323
gcgcggccagcaggcagcgtcaatcaggcgcaccccgtgtgccggcaacttggccgaaaccctgtgaaacccggcatcggattgatccagcaggagttttgcccggacacccgtgaccagaacgggccaccatcgatcttcacatcaatcaagatcggcagaaggggaatgaccggcaggggtgcggccgagaacagtgatgtgacgtcaggtatcgcccgggtggcgatggccgagatcgtgcacgcgctgctgtccgctgccgaggtggcattgttcgccagatttgcccgtccatgcaagcttcatgccggacagtggttgttccagcgtggccatcgcggcgaacggatgtatgtgatcctccagggccagatcgaactggacttcggcgaggacctggtgatcaagacgctcggccagcatgagttcttcggtgagcttggcctgctgcgccagtgcacgcgcgctggccgactgcgaagtactggagctgggcccggccgatttccatcgcctggtggaatccgatcccggcctggtcgcctacttcctgcgccgcacgatcatgcgcgtgctgaccaacgagcaggccctgatcagccagctgcgccggcgcaaccatga

SEQ ID NO: 58546 - DNA, 243 bp, Glycine max
  Peptide Sequence Number=SeqID_175324
atggggggtgcaaatagcaattttgaaattttgaattgggctttccagagtatttttcgaagctggattgcttctggaggcagcaaaccagatcgccttggcgagctgggcggcaacctcctccccctttttcttataaataggctgaaggggactattccaaggatccctcagccccctggctatgtatttcagctgtttttggtggaaaaaattgtttccgtaaagaaaatccaagcctag

SEQ ID NO: 58547 - DNA, 211 bp, Glycine max
  Peptide Sequence Number=SeqID_175325
gagcagtcgcgctcagcggaccatttgggctcagcgtgcatctgacgctaagcgcaactttagcgcgcttagcgtgacaagggaatttggcagagcacaagaatcaaggccactcgctaagcacaagattagctcgctaagcgagatgttcatctcttgccaagctcagcgcgtggctggtgctaagcccatatacatttactcacgctaa

SEQ ID NO: 58548 - DNA, 297 bp, Glycine max
  Peptide Sequence Number=SeqID_175326
atgttccaacagaaggcggtgccttctggtggaagcaacccagctcgcctgggcgagctgggtggcaaccacctccctcttttccctataaataggggaaagagggcagagcaaattcgttcaaccctcctggtatctgaaattcacttgaaattagggagaaaaattgtttccgtgaagaaaattcaagccggggcgcttccgagacgtttccgtgggcgatttcgtgaaggttttccaccgttcttcatctttcttcgttcgttctttgtcgttcttcggtcttcaaccgaataa

SEQ ID NO: 58549 - DNA, 768 bp, Glycine max
  misc_feature (618)..(618): n is a, c, g, or t
  Peptide Sequence Number=SeqID_175327
atgaccaatgcattgaaagaggctattaaaaaagagttgtcaaataaaggatccccagagtcgctccaaattcagttggacatacaacaattaggtgcgcgtgtcagcactaagggaagtaatgttgttatcaatgtccagccttcacaagaacatcatgctgatgccataccattgatgggactgtatgtgcagcgtaaggatggtacactaaggttggtggccatggggaaaataatggagggggattcaatcatacacacagtggcatatgcagatgatgttgtcagggtaagtgtggaaacaattatcgatcctgaggctgaggtcccctatgccacctcagaaatacaatatgtgaagcaagccgtcaatacatttgtagcttggcccacacaccttgtgaaagctgtattagatgaggatccagaaagtattccgcacaacgaggatgcacatgcgccaaagccggctaatgtggacgcagatgatccgttgcgtggcttgataaagtacagtttcgatatttacgacaagccagttgaaatcaactttgatgggagctgctttggaattgtagatgcaccttgtcataccctaatttcgtccggggacctntgctcgatgacgtgcgaccattctttggtcctcaaggcggttgcttctggaggaagcaaccctgctcgcctgggcgagctgagctcgcctgggcgagctgagctcgcctgggcgagctgggcggcaaccacctcccctattttgctataa

SEQ ID NO: 58550 - DNA, 282 bp, Glycine max
  Peptide Sequence Number=SeqID_175328
atgcagaccattcatgctcctcctgtcgattcaagggtctcgtatgatgatatacacgacaggtggatgcactacgatgatcatatcgtacttgcaagtgagccccgagtcatccctcaggccccgcagacgaatatccatcgcgtgccagagccaggagcatcgtcgacatctgcggaggagcccagacatgcagtggaagtttgtgatgacattgctgagaggttggagcgtcatctgagtctaggggtgtcacgcctggctcatcgacacatgaggtga

SEQ ID NO: 58551 - DNA, 777 bp, Glycine max
  Peptide Sequence Number=SeqID_175329
atggagttcttctcaaatgagaattttgaatgcttccaagcatttgaaaacttcaatcttattccattcatgtctctgaaattacctgtctattctgaattagtcaaagctttctattctaatttagaaatccatgaaggtaccctaatttctgaagtttatgggattaagatggtcattgaccaatccctattttatgacttaacaaaattgcctagtgaaggtgtaccttttgagggtgcactgattgatgaatggaaattcgatttctctgtgcatgatgcccgccggttggtttgcaccaaccaagtggatatgaccgaaagacttcttgccggttcattggcttttgagagccgcatcctccattaccttattgttcgcatcttactccctagatcttcaaaccttgctcaggcattgcgattgaatgccccattgccttatcctcatcttgttacccttttccttcaacacttcaacatccttcttgattttgaaccctatgttccaatcaagagatcattccttataggcactagagtcatagcatcctttggttatattaaggagcatgatggctcttggataaagaagggtgctagaaatgatggtgaagaaggacatgagggagaagattcatctcttctttcgaagattttggaaaagtttgatggtcttaaaacctttgttggtgagaggtttgacactttggaaatgcaagtggatatgcgcttcaatgaaatggagtcaagaatgacaaaggttgaagaagag

SEQ ID NO: 58552 - DNA, 1291 bp, Glycine max
  Peptide Sequence Number=SeqID_175330
tattgaagatgctgcctttccgaatctacattcggagagcgataatggaacggtaaccaatctttttgagcgctcccagcaggatcataaacttgaaaaagttcgtgaaaagctgcgggattttacagtaaaggttgtgttcaccgctcaccctacacaattttatccaagttctgtacagaggatcattcaggatttaaggtcagcgattaccactgattctgttaccaatattgatatgcttcttcagcagctgggaaaaactccttttgttaataaagaaaaaccgactcctattgatgaggcattgagtatcatttcctatttacgctatgtgtattacgataccatcggtgaattgtttaccaagatcagaaaaacattcggaaacggacattttcatttgcatgaagatatcatacagcttggtttctggccgggaggagaccgggatgggaatccttttgtaacggctgatgttaccaaaagagtcgctgaagaacttcgttctgcaattttaaaatcttattacagccatttaaaatttatcagaagacggttaagtttcagaggcgtgtcggaagttttacaacagcttaatgatgaattgtatgcggctatttttaataaccacaaaattaccactgaagatattctgaaaagggcagatgaagcagaacatattcttatacgggaacataactcattatttttagatcttctcgtgaatttcaaagaccgggttaaaattttcgggacccatttcgccacattagatattcgtcaggacagcaggattcatcagcaggttattgatgaggtctttgcaaaattatatggagatcaggaagccgatcataatgaaaaattcaaccgattaattcaggattctaaaacagttaaggctgatgattttgaaggcattgtaaaggatactttgcttacggtttcagaagttgctgaaattcagcaattgaatggtatgaggggaatgaaccgttatattatatccaactccgatgctgtgaaagatgtgatgaatgtatatgcatttttcaaaatttgcggttatcaggaagaaaatatcaatatggacattgttcctttgtttgaaaccatggaagggcttgataatgctgaaaaggtaatgaaagaactttacgaaaatccggtttataaaaaacatcttgaaaaaagaggtaatcagcagaccattatgctgggcttttccgatggaacaaaggacggtgggtatttaaaggccaactgggagatttacaaggccaaagaa

SEQ ID NO: 58553 - DNA, 266 bp, Glycine max
  Peptide Sequence Number=SeqID_175331
atgccaatctccccctgcaaaagtatcagttggtctgtgtcgtcccgacatggggatcgcacccacaagacacccagtggacccgaagaagtccaacagggccctggggtttccagctctggttacgggcctctatcagtcctacagggtgcccgtacccccccctccccggcaaggtcacgtcatcatagggatcgtgcccgcaagacacctagtggacccgatgaaggccaacagggtcttggagttgccagctctaaatacgg

SEQ ID NO: 58554 - DNA, 225 bp, Glycine max
  Peptide Sequence Number=SeqID_175332
atgggggtgcaaatagcacccaggcccacttgggccctccagaatattcctccaaaaggctgttgcttcaggaggaagcaacctggctcgcctgggcgagctggggaggaagtgaagaagaaagggttcagccctttggcacttctctctctttcgaatttgcttggaaaaattgtttccgtgaaagaaaatctaagccgaggcgcttccgatacgtttccgtaa

SEQ ID NO: 58555 - DNA, 133 bp, Glycine max
  Peptide Sequence Number=SeqID_175333
atggatgatcagacaaaaagcatacaaacattaagcattgaaggaagtattgaacatagcaaacataatcaattagatattaggctccgaattcgtgacattgtgctttgcggcgacctcgtgcttagtgcgg

SEQ ID NO: 58556 - DNA, 443 bp, Glycine max
  Peptide Sequence Number=SeqID_175334
tccagagcaagcattccttcccaccatatggcttgcctcccaactatacaccacctaatgttgaacaaactcccgatgagaatgtcgacaactctgctcccaaacccattgagatccaacaccccgagaccacaatctacgtacccttgccaaacactttggggggccctcagtatcgcccacaaccacaacccttgcattttgcggtgggaaaagttcctcctacaatggtggaaagggagagatttgatcatatagaggagaggctaagggctattgaaggaggcggagattatgcctttgctgacatggcagaactgtgcctagtgcccgatgtcattatccctctgaagttcaaggtgccggattttgataaatacaaggggactacttgccccaagaatcacctgaagatgtacaacaggaaaatgggggcatactag

SEQ ID NO: 58557 - DNA, 348 bp, Glycine max
  Peptide Sequence Number=SeqID_175335
atggctaaatatgacccagaaatagtcatggaattctatgctaatgcatggcacatagaggagggagtcagggataagcgctcctgggtgtggggccaatgggtcccttttgatgaagataccattaatcagttcttgggcaaagatccacaagggatgtaccctcccttgttctctttgaacctagtggatgtaccctccactagaactgatccacaagagatgtaccctctcttgttctcagtcaacaacccaagtagatgtactctctacttgtaccacaaaggatgtgccctccaatgtgttaagacaaagatctcaggcggtgaaacctttgatactttgtga

SEQ ID NO: 58558 - DNA, 249 bp, Glycine max
  Peptide Sequence Number=SeqID_175336
ggatcgcgcctgcaagacacccagtggacccgaagaagtccaacagggtcttggagttgtcaagctctaatcacgggtctctgtcagttctacggaggcgaaacaccacagcagcctggggatggtcggtagcgggcaatagacacaccgccaccacctctagagttaacctcagctcatccgcaaaaaggttagagcgttgcctacgacacatggccgaccagcaggcgaccaaatccaaagccaaag

SEQ ID NO: 58559 - DNA, 544 bp, Glycine max
  Peptide Sequence Number=SeqID_175337
ggctacacaccctcacctaagaggactacacgtgctcgccttcagaggactacacggcctcacctttagagggctacacgccctctccgtaaaaggactacacgtcttcgactttagagggctacacaccctcgcctttagaggtgtacacgccctcaccttcagaggactacatgttctgacattcagaggactacacgtcctgaccttcagagggcaacacgccctcacgctacacgccctcgccttcacagggctagatgccctcacctttagaggactaaatgtcctcgccttcagaggactacgcgccctcgctttcgtggggctacacgccctccctttcagaggattacacttcctcaccttcacagggcttcacgccctcacctttagaggactgcacgccctcgccttcaggggactacatgtcctccccttcagaggagtacatttcctcaccttccgaggactacacgtccttgccttcagatggctacacaccatcaccttcagagggctacaggtcttcgccttcagatga

SEQ ID NO: 58560 - DNA, 313 bp, Glycine max
  Peptide Sequence Number=SeqID_175338
atgactagaggcaatccacctgacttacatccctttgatcctaagatagataggacatttcatagattagttagacatcatttagtaccttttgagcatcctgagcattctgttattggtgattttgagcattatagttttgaacattctgagaacatggcacaacctccaccctgtgagaggactctaagggaaatggctgcacctgatttcacctacgaaagcttgtacatccaacaccctattgaggatgtcccatatgttcttaaaactagactgatccatttgcttccaaagtttcatggctttgcag

SEQ ID NO: 58561 - DNA, 378 bp, Glycine max
  Peptide Sequence Number=SeqID_175339
atgggtgaagtagaggaggtgcaaatgaaggccgagatggaggccatgaaagagcaaatggccacaatgatggaggccatgatgagcatgaagaagataatggaagccattgcggttgcaattgccgctaccatcgttgtcgctcaggtgaacccgatgcctccatctggccttaaccagatgaatcatccaacctcagatatggtaggcaaagattcgggaagtacgggcggcccctgttatgcgcaaattctaaacaagcatgccttcccagcatatggcttgccccccaagtatacaccacccaatatggcatacaataactccgctgccatactcattgaaagccgacaagctcatcatgtacatgtctcttaa

SEQ ID NO: 58562 - DNA, 273 bp, Glycine max
  Peptide Sequence Number=SeqID_175340
atggaatatctaagctctgattcccttgataaatcagaaaccagtgagaattcgtatttccaatcaattactactgaattccttaattcattgaaaacatccggtttgccaactcattctatcaaacttaaaattggaagtcctataatgctgttaagaaacctcgaccaaaatcaaggtctatgtaacggtactagattagtggtgacaaagatggcagaacatgtaattgcagctgaaattatctcagggtcaactcagcaaaaggattaa

SEQ ID NO: 58563 - DNA, 252 bp, Glycine max
  Peptide Sequence Number=SeqID_175341
atgaggctattcttcctgagccaattgtgccagttatacatgagactgttgaagcaggtagcagatcctcttacaccagtacatgagagacaagcagatcctcctacacctatcatggagatgccagaagaccttaccacgccagtcctgagactgtcatccactcctccagctaccccagttttacatctaacagatgaagagggtatgcaggacacacagggcacacaggaccagtcacaggaattctaa

SEQ ID NO: 58564 - DNA, 216 bp, Glycine max
  Peptide Sequence Number=SeqID_175342
atgcagcatctccgtggcaggcaaatgggtatgattttccaggaacccatgacctccttgaatccggccaggccctcaaacaaaaaggttgctgccctcttggagcaggtggggatagatcctgcacgggctaacagctatccagatgagctttctggcggccagcgccagcgcgtcatgattgccatgagcattgcctgcgaactgcgctgctga

SEQ ID NO: 58565 - DNA, 593 bp, Glycine max
  Peptide Sequence Number=SeqID_175343
atggcgatgctgtttattacacacgatttcggtgtcgtggctgatattgccgatgaagtcatcgtcatgttcaggggtgaaattgtagagactgggaatgttgaacaggtcttgcaatcgccacagcacccctatacgcgtgccctgcttgactgcgtgccggatgccgaaggcaaaaaaacgatccatgcgctggacaatgtcagcctgacactgaaacaaggcacgacattagcggtggttggagaatccggtagcggcaagtctacactggcccggggcgtgatgcgtctactgccgctggatagcggagaagtcatttttgatggcgacgatttcctggccttagataaagcggccttacgcacggcacgccgccatatacaaatggtgtttcaggatccatttgcttcactgaaccccagaatgcgtgtcggtgaagttattgctgaaggcctggtgattcatgagattggcaacaaatcacagcagctggatatggtcgtacaaatgctggaaaaagtggggctgcaggcagaggatgttcataaatacccgcaccagttttccggtgggcagcgccagcgcatcgg

SEQ ID NO: 58566 - DNA, 262 bp, Glycine max
  Peptide Sequence Number=SeqID_175344
cagcctcgcgcgacttcgacgcaacgatgctgttggattggacgagagggagggtgatggccatgaaggacacgagggcaaagagcgccacggggttcagccccgcctcagaggagtcgagagcagagatggtggcgacaaagtacgcgaagggaaagtggtgcgactaggttggagcgaagggcgacgagagtggcgaggaggtggcggtgctgcaatgcactggtccatgaggtgctacagggcgacggagttggcgtag

SEQ ID NO: 58567 - DNA, 261 bp, Glycine max
  Peptide Sequence Number=SeqID_175345
atgacacatggtggtccaataaacctaaaatacagagtgcaattctcagccctgaattttcagtttttcaacatacctataaccatgattcaaaacaagctcaagaggttgctcaagaggttggcattaacaaatccacttaaactgttacaagaacacaataagggattagaccaaacatacctacgtgaggtggcgaaggagaagaagcacaaacttctgacgatgctcgagtgcgatgaacacgatgctcgaccttag

SEQ ID NO: 58568 - DNA, 219 bp, Glycine max
  Peptide Sequence Number=SeqID_175346
atgatattgcacgagattagaaggcctaactctctaacaatagtccccagtggagtcgccaactgtcgcaacctacccttcggcgggagggcgacgcgagggctcacgggtgcgtcttccaagggaggaaggtccatgttaaccgataaaagcaaaggggaccgtttaaggctttggaccttaaaacggtttttagtgatttttgcggacaaagcttga

SEQ ID NO: 58569 - DNA, 940 bp, Glycine max
  Peptide Sequence Number=SeqID_175347
atgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattctcctcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatg

SEQ ID NO: 58570 - DNA, 252 bp, Glycine max
  Peptide Sequence Number=SeqID_175348
atggggaagaggaagttggagctaggttttgaagatcagaaaattgattttgatttgtttgttgaagacaagcctactccagaacacaatgttttcttacaggtaatggaaggaggtcaagaggttctgaaagtaagaaccaaaattcctttcattaagcgcaagcctcgcgctaagcgcttctttggtcatgcactaagccaagagtctctagcgcttagcgctcaacccttgcatctcaggctgatttga

SEQ ID NO: 58571 - DNA, 221 bp, Glycine max
  Peptide Sequence Number=SeqID_175349
gtggccttgttggtgcttgtctgcttaacgcaaatctggatcacttagcgcgcattagtgaattttggcttaacgtgtgtcttctcgctcagtggatggattcaagcggtgcgcatagcaggatgagccctcgctcagggaacatgcacaactcatccttcttccagattcttcctcgtgctcacccaagggaatggtgcgctcagcggatggctcgctaa

SEQ ID NO: 58572 - DNA, 132 bp, Glycine max
  Peptide Sequence Number=SeqID_175350
atgacgttccttgtaaaacctgaaatgctctcagctctttcatgtagtgatgcttgtgtgaaatcgacgagcaaggacaaaaaggaatcttcaagtgacgcgacgaggaatccgcggggtagcacacgatag

SEQ ID NO: 58573 - DNA, 171 bp, Glycine max
  Peptide Sequence Number=SeqID_175351
atgcaacagggacagccagatatcctcatagctaggttccctgaccctaactatggtgttaaaacggataacgtgtacaaagtctctgtctctaaggtttttcaaaggaagcataagacatgcaatggcggttccaaagtcagaaaagatgcaaagacaagatgtaactaa

SEQ ID NO: 58574 - DNA, 330 bp, Glycine max
  Peptide Sequence Number=SeqID_175352
atggtggcaggaaatacgaccgtagaaaaacctagggaacagtggagtgaggaggaaagaaaattagttcaatacaatttaaaagccaaaaatataattacatctactttagggattgatgaatactttagggtatttaattgtaaaaatgcaaaagatatgtgggataccttacaggaatatgaaatggaattgatgaaattgaatcaacatgaggagaatgataagaaaaagaaaggaattgctcttaaagcttcatcttcaacccaagaaggaagtgataaggaggattcgattgaaatagacgaagatgatgatcttagtctattt

SEQ ID NO: 58575 - DNA, 837 bp, Glycine max
  Peptide Sequence Number=SeqID_175353
atgggatcgaatcaaacacccttgtttaagaaaaggttctatcatgtcaaaattaaaagcctagaggttgccagtttgcaagaatttgggcaattgatgaatcagctccaacgtcaagcttttcgcaagacctatggaaatatttgggatctagctatgatagaagtctctgttgaagccattgcatccctcactcagtattatgatcagtcgctaaggtgctttacatttgtggactttcagttagtaccggccgtggaagagtttgaagagatcttgggatgcctgctaggaggaagaaagccatatcttttttctgggttctacccctccatggcgaggatagccaaggtgatcaaaatctcggtgcaagaattggaccgagtaaaacaaaatagaaatggggttattggaataccaaggaagcacttggaggagaaagcgaaggcattggtggatcaaggtgaatgggcttcattcattgatgtcttggtgctattggtatttggagtcgtcctctttccaaatgtggatgggctagtggacctagcagcgatcgatgccttccttgcttatcaccataacaaggaaagtccggtcgttgttgttttggccgatgcctatgacacatttgatcgaagatgtgaaaggagcggcgtaaggatcatctgttgcacacccgctctttatgtatggctggtcttgcacctctttcgtcatgaaagtagacccgtctgtcccctacaaggtcaccgcatatacgccgagaaagggaaggccaattgggagcaactcttggctagtatggtaggggcatccattaattggttcccctga

SEQ ID NO: 58576 - DNA, 161 bp, Glycine max
  Peptide Sequence Number=SeqID_175354
cagttggaggattgagatgctatgagagtccaaagaataagattactgcagtacctactgaggaagaagaaatctggggtgcattcttcaaggtaatcgtagagcttaagaagttagagttgaacatccattatgtaactaggattgcccgttgcaactaa

SEQ ID NO: 58577 - DNA, 834 bp, Glycine max
  Peptide Sequence Number=SeqID_175355
atgattgagtttcaaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaatatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcacat

SEQ ID NO: 58578 - DNA, 147 bp, Glycine max
  Peptide Sequence Number=SeqID_175356
atgtcgcgaaacttcacggattgcctaacgatgagcgtcaaggatctcgaagtgatcaagagagggtcgcatcccaacaaacagatgatgagtgatttcagtcataagctaatgataaagtttctgtggggatgtaactgtgtttag

SEQ ID NO: 58579 - DNA, 318 bp, Glycine max
  Peptide Sequence Number=SeqID_175357
atgacgataaaactggctttaacgctccttgcggtactggtttcgggtcacgccaccgcaaaaacctgggtgctgaccagcgctgaaagcggcgtagaaaaaggaaactggaagatttccagcgatgagctgaaaattaacgaccggacgttcagcattgagcagaaagtgttgcacggcggaaagcaggaaggcagtaaagttatcattatcagcagtaaaaacggtctgacaattaccctcagcccgacgcgtggaatgactcttctgcatgtggaaggtttttggtacccgactggggtggaattctcccgttaa

SEQ ID NO: 58580 - DNA, 359 bp, Glycine max
  Peptide Sequence Number=SeqID_175358
agaccagttaccgagccagtcagatgcttgcctggccttgtctaactccccagtttcacaagcaagccaggcagatcaccttgttcaaggatttcagagcgagtacttccaacaaaacgtctgcctagacagagcttccaaccacttggacccgatgatacacctgcaggtcatcctctgtgaatctgcaagacagggagagaaagacatgccggactcacaagagaaagacagccaatgcagtcagaatgccctattgagcgtcatgcctgaactcatgttccggagagtgcctgtcggatcacttatgcctatgcaaggagagagcaccgctaagggaaagttcaatcattgggaag

SEQ ID NO: 58581 - DNA, 455 bp, Glycine max
  Peptide Sequence Number=SeqID_175359
atgggggagacatatgaagtaccccaccacaatctagccgactttgagccttgcctcggatatgccattcaggggcaagcagttgggggtgtagccctgccaaacactttggagggccctcaatttcgcccacaaccacaacccttgcattttgcggaggggagagtccctcctgctatggtggaaagaggaaaattttatcatagagaggaaaggctcagggccattgaaggaggtggagattatgctttcgctgacatggcagaattatgcctagtgcctgacatcgtcatccctctgaagttcaaagtgctagattttgataagtacaaagggactacctgccccaagaatcacctgaaggtgtactacaggaaaatgggagcatactcaaaagatgaaaagttgctgatgcatttcttccaggaaagtcttattagggcagccatcacctg

SEQ ID NO: 58582 - DNA, 228 bp, Glycine max
  Peptide Sequence Number=SeqID_175360
atgacgttagtctctgcgtgctatcatgctttgagtcttagagatagcaaaagaaagtttaaaagtgcgggaccaaatggttcccgcatgtcatcgggcccgccgcctctggatgacaaaaggaagggaccaatcactagaaccatgagcaagaggctccaagaagattgggctagagctgctgaagaaggccctagggttctcatgaaccttagggtagatttctga

SEQ ID NO: 58583 - DNA, 474 bp, Glycine max
  Peptide Sequence Number=SeqID_175361
atggctacaccacccagctttcctcctcctcctcctcctcctactgttagggcagagagaccgctgatccatgtcgatcctgcaactaggaaagccgatggtccccacaaaaagaagttaagaacatatttggggatcataacgcgtgataaggttgaatttgatatccctgaagcatgtgatctgaggacaaaaaagaaaatacttcagattgtgagagagcggtggagacaatttaagtctgatttgacattgaaatgggcacttgtagctgacaaggaaagtgtcaacgacactgtatgcgaaaagtacgacattagcaaggagaagtgggcccaattttttcaaacccacaaagacccttcgtgggaggatgtacgaaagaaggcacaggccatccagaaacaaaacactacccctcacgtgttgtctcgtgggggttatgaatatttagaaaacaagttgatgggttag

SEQ ID NO: 58584 - DNA, 540 bp, Glycine max
  Peptide Sequence Number=SeqID_175362
atggcaatatctgtagaattggtagttttaaacactctaaggaatggaggtgggaggaaagagattaagccgtcaatgagagttgcatgccatccattttctttatctgttgtctctggaattatttatctacatttatttgaaaagtggtttcatcatcctagagacaaggctgggattgctggaagagttgccttgaatattttaggctatcctctccgcccaaatgaaccagaatgtggttattatttaagaactggacaatgtaaatttgggaacacttgcaaatttcaccatcctcaaccaaacaatatggtgctttccatgcgaagttctcctgtttatcctactgtccattctccaactacaccaggtcaccagtcatatgcgacaggaattacaaattggtctagttcatcgtatattcctagcccacgttggcaaggcccttcaagttatgcacctttaattctacctcagggaatggtttcagtgtctgggtggagtgcatacagtgtaagctcatccattctttcatag

SEQ ID NO: 58585 - DNA, 396 bp, Glycine max
  Peptide Sequence Number=SeqID_175363
atggaacccaaacacattgatgatggaatgcaagatgacaactgggtctttcgcaacaaactggatgaaaatggtaaggttgtgagaaacaaagcaagattagttgctaaaggatacccacaaaaggaaggtatagactacaaagaaacttatgcatctgtagcacgtttagaggcaatatgcatcttactttcatttgcaacttatagcaatatgagattgtatcaaatggacgtgaaaaacacatttctaaatgacttaatccaagaggaattttatgttgaacaacctctagggtttaaaagtgaaacatttcctcaacatgttttcaaactcaacaaagccatatatggacttaagcaagctcctagaacttggtacgaaaaactaagttaa

SEQ ID NO: 58586 - DNA, 839 bp, Glycine max
  Peptide Sequence Number=SeqID_175364
aggttgcgtcccttgtgacgggcatgtggggtgctaataccttccccacgttttcctcaaataaacgttggtggcaacttcgctcgttttctcccttggagacaaacactttggcccatctattttggccttttcgcacccccatcgaagggcaggttgcgacaggtttgaagatagaaagattgatggacattattgtcagtcctgagctggcagtggtggtgaaggtggaggagtacaagtgcaacaacaactccaagcatagacattcgagcctattaaatgttttgaagaagactgacaccaaggttagagaactaggtggtaatggcattttgcatggagagcttggattgctcaatctcttggcattgtcacttggcaaaagattctatggcttgttcaatcatatcttgcacttgatctcaagtgacagtggcaggttatgcatagttgagaggagtggggtcggaactgttatagttgcatttgatgcctcaggagtttcgtccatgacaccaatgtttgtaagattaatgatgactctatgtacaatggtgtcgtccacaactttagtagatgctttagcttggatggaggaagcatttactttcttagcagcaacaacttcttcttcagccccatcttcctttattgagcttcatggagttgagtacatgagctatcatttggtcttcaatcatcttcttcaaattatatgtgcattcatattgaatagtgggatgtttgagaaaatgttgaatgaacaggtaactgtcagcatccttggtgaagcagacgcaagcatcatcaaagtggtacttcctaacaagatgtaa

SEQ ID NO: 58587 - DNA, 849 bp, Glycine max
  Peptide Sequence Number=SeqID_175365
atgggacagtggacttacaattcatacccactaatgatcagcttgctaaaaagacaaaaaatcccacttgatggagaacctccctttgaccttccatacaccatatacatcaacatattgaggaacctgaaaggcttaggtggtttgaatggcatttattatgttgttcccatcaacaagcttctgtgggatcaagaagtgtaccatgtctttaacaagatggatgaagactctaagcacaccctaatagtcaagggttcagatgaaggtcttgtacaagtagcccttcagaagagtaaagcaactactctagttgcccctacaccaaaaaggactaagaaagtccaactagtctctgaaccacagccgcttatcatcccctttactattcgaagatgtatcaagaagaggacgaccaaggccaaccccaagattggtgacaaggaatgggcagtttcctttactgcaaacaagaaggattcaacctcttcatcctcatcagatagtaagtccatagatgccacccttatctctcccctttacaatcatactccatccactcaactacatccacctccaccacctctttatctagacagattcaaaaaggctacttcatgggaacctttaatagatgctcaaagggccactgatatcaagatggttgttgataaagtgagtccacacctactagtttgggatgctgacaagaagggatttaagctttattacagtgaagatatttgcataagaaagatgaagagtcagatcgtgtggatggactctcaaaaagcctctacttctttctatgatggaagtgataatgttgagcatcacgatgtcatttag

SEQ ID NO: 58588 - DNA, 144 bp, Glycine max
  Peptide Sequence Number=SeqID_175366
atggtaaacggggcacccttagagggagacaacagggggcagatgggttttgttggagttgcatctgagtcttgtgaacattggttgggaatctttctgacctcagctgggctaaacccatgtgctgttgaaagcatattttaa

SEQ ID NO: 58589 - DNA, 1008 bp, Glycine max
  Peptide Sequence Number=SeqID_175367
atgcttctgtggaatcgttccagcggtttctttactttgtgttgtcttgcttttctcgactttattctttgcacaacgctacaacgagggattcagattcctccaaaatttgaacatgaaaaccagtgcaggactggtggaagtcatgcattacctgaaggcataatctccaacacttctgatttggaaatgcggcatttgtgggatcttcctatgactaagacaatagagaataaggaaaatgcatcaaccaatttgtttgcaatggcagttgggataaagcagaaagatcttgtgaacaaattggtcaaaaagtttctatcaagcaatttcgttgtaatgctcttccactacgatggtattgttgacgaatggaatgactttgaatggaataatcatgtcattcatgtggctgtagccaatcaaagtaaatggtggtttgcaaagcgtttcttacaccctgacatagttgcagaatatggttatattttcctatgggatgaggatcttggagttgaacacttccaccctgataggtatgtttctattataaaaagtgaaggactggaaatatcacaaccagcacttgatagtaacaaatcagaggtacatcatcagattactgcacgtgggaggaggtcgaatgtgcacagaaggatttacaaaactggtggtagtggcaaacgttgtgatgaaagtagcactgctcctccttgcacagggtgggttgaaatgatggctcctgttttctcaagagctgcttggcgttgcgtttggtatatgatccagggtgatcgaacaaaaaatgttggtgttgtggatgctgaatacatagtccactacggtcatcctactcttggaggcttagatgtgaatgaggtttcatctcggacaaaggatcatagagttgatgtgaggagactgtcttaccgtgaattacaagtttttagaaaacgatggcagaaggcagttgaggaggatgattgttgggtcgatccatttcaataa

SEQ ID NO: 58590 - DNA, 1041 bp, Glycine max
  Peptide Sequence Number=SeqID_175368
atgatagggtgggaagatgtatacaaagtagtggtagcagtggtgccactctattttgctctattattagggtatggttcactgaagtggtggaacatcttcaccaaggagcaatgtgaagcaataaacaagctagtttgttacttcacattgccactcttcatcttcgagttcactgctcacatcgaccctttcaagatgaacttctcgttcatagcagcagacaccatatcgaagttcatcatcatggtggtacttgccctctgggccaagtgcactcctaaatgcaccttttgctggtccataatcagcttctctttgtgcaatctcaccaacgctgttgttgttggggttccaatggtgaagcccatgtatggagccctaggtgtggaccttgtggttcagtcctcggttcttcaggccaccatatggctccctttgcttctctttgtgatggagttttggagaacgggaattgagggcaccaccaccaccaccgtaaaaccaagatcaaaaacaatgatcaataagaatgaaggtggaggagggaaagatgtggaggctgttgacgtgaaagaagagttgatgttggaagagagtgttactagtaggcttcctttttgcaaggtgatgaagcttgtgtggcgcaaacttgcaacaaaccctaactcctatggctgtgtgattggcatttcctgggctttcatatccaacaggtggaatttggagatgccaagtatgttagaagggtctatacagataatgtcaaaggccgggacgggcactgccatgtttagtatgggtattttcatggcacttcaggagaagttgattgcttgtggaccaagcatgaccttaatcggtttggttttaaagttcattgcgggccctgcggctacggctattggtgccattgctgtaggattgcgtggtgacgttttgcgagtcgtcatcattcaggctgctgtgccacagtccatcacatccttcatttttgctaaagaatacggattgcatccggaggttctcagcactgcgtaa

SEQ ID NO: 58591 - DNA, 345 bp, Glycine max
  Peptide Sequence Number=SeqID_175369
atggggtcggaccaagtgccaccttttaaaaagaggttctatcatgtcaaagtcaagaatctagagctagctagattgcgaaaactagggcaatggatggatcaagttcagtgccaagccttcagcaaggtatatgggaagatctgggatctggaaatgatagaagtgtctgttgaagccatcacatctctcactcaatactatgaacaatcacttagatgcttcacttttggggactttcagttagcaccaaccatagaggagtccgaagggatctcaggatgcccgctagggggaggaagccataccttttttctggattctatccttctatggcaagaatag

SEQ ID NO: 58592 - DNA, 276 bp, Glycine max
  Peptide Sequence Number=SeqID_175370
atggtgggttacacaccttcaagctttgcggatttggtcttcgccggcgaaaggatcaaagtgggtctagaaaaaggcaaatttgatcatcctgctttgatgaatgcgaaaaatggggaaaatgaagaggatgagaataagggagaaacccttgctatgactgccattcctacacgccataacccctgccagggttcctcaacctccatttttccgaggatacaactcgaatgcaacatgtgcatatcatggaggagttttgagacattccattga

SEQ ID NO: 58593 - DNA, 164 bp, Glycine max
  Peptide Sequence Number=SeqID_175371
atggtgctggtagcggctattgcagccgcattgacctccattatctcctttatgctcatcatggcctccatcattgtggccatttgctcttttaaggcctccgtgtcggtcttcatctgttcttacacctcctctacttcacccattactctagctctagcacg

SEQ ID NO: 58594 - DNA, 471 bp, Glycine max
  Peptide Sequence Number=SeqID_175372
atggggtttatagagtttcaaaggtgtaatgatgatgatgatgataatggtcaaatggtaatggccggtgattttgagaagaagaaaaagagtgagtttcgtggaagccaattatcaatcggagttaaggcttgccctggatttggatttggatttggattgggaagctatcatcaagtctggttgacaatacaaaagaggtgtgtgtgtgtcgcctgtgcaccaccactagaccgcgaaacaccggatcagattcatccagcgtcggtcgttggcggatctggcaccggcgtcaaggatctcccttacaccatcgctgaatcttacccttctgcttggggctcttggactcattctcgcggcacctccaaggatgacggttctcctgtctcggtgttctcactctccggctccaatgctcaggatggtcacttagctgctgcacgcaatggtgtcaagcgtcttcgaact

SEQ ID NO: 58595 - DNA, 1167 bp, Glycine max
  Peptide Sequence Number=SeqID_175373
atggtttccctttccaccaccccttttcttcccttcactgcaaaaaatgcttctactagaatccctcctcccacatcattctcttacagcaagcaacgtagtaacagggatcccaggaaggttgtctgcgcctgcatcgctcctcctcaaaacttcaagagccaggactcttccgccattcatttcaatggttcgtccaaatcagagcaattgagcactgcgcgggatcatgaggatgattctgatgttcttattgagtgtagagacgtgtacaagtcttttggggaaaagaaaatcttaaatggtgtcagcttcaagatcaagcatggtgaagctgttggaataattggtccctctgggactggcaaatctacagttttgaagattattgcaggacttcttgctccggacaagggggaagtttatattcgaggtaaaaagagagttggtttagtaagcgatgatgacatatctggtcttcggattggattggttttccaaagtgctgcactctttgattctttgactgttcgtgaaaatgttggttttctcttgtatgaacactcaagcatgtctgaggatcagatatcagagcttgtcacggaaaccttggctgcagttggattgaagggagttgaggatcggttgccttctgagttatcaggtgggatgaaaaagcgagttgctttagctcgatctattatttgtgacactacaaaggaatcaatagagccagaggtgctcttgtatgacgaaccaactgctggacttgatcccattgcatctactgttgttgaagatctgattcgctctgtgcacataaaaggacaagatgcacgtggaaaacctgggaatatttcatcttatgtggttgttactcaccaacatagtaccattaaaagagccattgatagattgttgtttctacacaagggaaagattgtttgggaaggaatgactcatgaatttacaacttcaactaatccaattgtccagcaggtcactcggtcttgtgcaggattgtcgtaccgtagggggtgttcattagacccgggaaccaacctgatccaattatattggattgggtttttcagtgttcaagtcgaaaccgacccgatccaattaaacaggtcgggtaatggattttatttttttagtccaacctga

SEQ ID NO: 58596 - DNA, 1253 bp, Glycine max
  Peptide Sequence Number=SeqID_175374
atggcgtcggtgttcgtgtaccacgtggtgggcgatctgacggtggggaagccggagctggcggagtttcacgagagtgagacggtggagtctgcgattagggcgattggggagtcccctgaagggagcatacccatttggaagaagagatctcaattggggattgagaacagtgacatgagacagcagaggtttgttggtattcttagttcctttgacatagttgcgtttttggctaagagtcggtgtctggaggatcaggacaaggccttgaagactcctgtttccgaggttgttgttcataacaattcgctgctcagggttgttgaccctgcaacaaggttgatagatgcgctggacatgatgaaacaaggtgtgaagcgtctgcttgttccaaagagcatagcatggaagggcatgagcaagcgattctcagttatctactacggcaagtggctcaagaatagtgaatctcctggcaacagcagcaacaatctaccacttagcatgaatcggagcccctcaacttccgttactcctatccctgataagtactgttgtctctctagagaagatgtgctccgtttcatcatcggttgtcttggcgcattggctccccttcctctcacttccattgctgctcttgaagcaattaattcaaactacaactatattgaatcttctactccagccattgaagccactcaaaagcttcctcaagatccaagtgctgttgctgtaattgaaagcgcatcagatggtcagtgcaagatcattggagaaatttctgcatgtaagttatggaaatgtgattacttatccgcagcatgggctttagcgaatctctccgcaggacagtttgttatgggagttgaagataatgtcaccccaaggtcactgcctgagtttagtttagattcaccatctggagacattgatttagttaatagtgggggttcaaggaaaccaaggaaatttagtagcaggagtgtcgggttcttcagcaattctgcgagccataactttagttctagaagcatgtataggggtaggagtgcacccctgacatgtaaaattactagttcattggctgcagtattggctcagatgctatctcacagggcaactcatgtctgggtgaccgaggacgagaacgatgaagttttggtcggtgtggtcggatatgctgatattttagctgctgtaaccaaaccacctacaaccttcattcctgctaatagatctacagaggg

SEQ ID NO: 58597 - DNA, 405 bp, Glycine max
  Peptide Sequence Number=SeqID_175375
atggaggaagatgaggagaagatcgagggcggtgatgggagggcggtggaggatcacggcagagaaagagttagccattgccatggagggagaacgaaaaggttaaggcccattcaattgaatcagatcagagagagagagggcgtagcttttggggaagatatgatatgtagagatttggataagattaataatgacttcagaagcagtgtctatgaagtttatgcgagatcaccaatgatatatgtagttaatagcaacaagttgaggaaagaggtttggatgaatgtgtggctgtttaatgttgggtggtggtgtggtggctatgactacgaggttggtgttggaaaatgttgtcaattcaattgggattcggtttgcaaagttgtgataactttgagttga

SEQ ID NO: 58598 - DNA, 2154 bp, Glycine max
  Peptide Sequence Number=SeqID_175376
atggtgatgggacacaccacacccctcacacttctctgtgtgattcttctttttgcaactccttctcactcaattgatgttcacccacaagacagaatctcactttcaatgttcaggtcatctctgccaaaccccaaccagagtttgcccagctgggtgggctccaactgcacttcatggagtggaatcacctgtgacaacagaactgggagggtgctttccatcaacctaaccagtatgaacctttcaggcaaaatccaccccagtttgtgctacctttcatatctgaacaagttggggttgtcccacaacaacttcacatcccctcttcctgaatgttttggcaacttgcttaacctaagagccattgatctcagccacaacaggcttcatgggggaataccagactctttcatgaggcttaggcacctcactgagcttgttttgagtgggaaccctgatttggggggtccactgcctgcttggattggtaacttctctgcaaatctggaaaggttacatcttggtttctgttcattcagtggtggcataccggagagcttgctttacctgaagtccctcaagtatttggaccttgagaacaacctcttgtctggtaacttggtcaattttcaacagcctttggttttgctcaatcttgcttccaatcagtttgctggtactttgccttgctttgcagcttcagttcagtctctaactgtgttgaatttatctaacaattctattgtggggggactacctgcttgtattgcttcttttcaagctttgactcatttgaacctgtcagggaaccacttgaagtatagaatatatcctaggcttgtgttctcggagaaacttcttgttttggacttgagtaataatgctttgtctggtcctattccttgtaaaattgctgagacaactgagaaacttggccttgttcttcttgacctttctcacaatcagttctctggtgaaattcctgtgaaaatcactgagttgaaaagcttgcaggccttgtttctctctcacaatcttctctctggagaaattcctgctagaattggaaatttgacttatctgcaggtcattgatctctcacacaactctttgtctggaaccattccattcagtattgttgggtgctttcagctgtatgctctaatacttactaacaacaatctttctggtgtaattcaaccggagtttgatgcgttggatatcttgaggattctggatataagcaacaacaggttttccggggctatcccactcactctggctggatgcaaatctctggagattgtagattttagttccaatgagctttctggatccttgaatgatgcaataaccaaatggacaaacctcaggtatttgtctcttgctcagaacaagttcagtggaaatctgcctagttggttgttcacatttaacgcaatagaaatgatggatttctcgcataacaagtttactggcttcatacctgatattaattttaagggtagcttaatatttaacaccaggaatgtcactgttaaagagccattggttgcagcaagaaaggttcaactgagagtttcggcggttgtttctgatagcaatcagctcagtttcacttatgatctttcctcaatggttggaattgatctatccagcaattcgcttcatggggaaattccaaggggcttatttggtctagctggcctagaatatctgaacttgtcatgcaactttctttacggacagcttccggggttgcagaaaatgcatagtttgaaagccttggatttgtcacataattccttgtctggacatatcccaggaaacatttctagccttcaagatctgtccattttgaatctttcctacaactgtttttctggatatgttccccagaagcaagggtatgggagatttcccggtgcatttgctggaaatccagatctgtgcatggaaacttccagtggagtatgtgatgatggaaggactcaatctgcgcaaggaagttctttcagtgaagataggatggatggcccaatttctgtggggattttctttatcagtgcctttgttagttttgattttggtgttgtggttctcttctgttctgcccgggcaagaaattacattctccaaacaaaagtttga

SEQ ID NO: 58599 - DNA, 1086 bp, Glycine max
  Peptide Sequence Number=SeqID_175377
atggagttggcaaaatcagactgggatgcaattaagaagtctcctccatgggccatagattcttggggcatgggttgcctaatctatgaggtattctctggattgaggttgggcaaaacagaggagttacgcaacattggttccattccgaagtctctgcttccagattaccaacgactattgagttccatgccctctcgtagattaaatacatcaaagcttatagaaaacagcgaatattttcaaaataagttggtagacacgatacatttcatggaaattctcagtttgaaagatagtgtagagagagacaccttcttccgcaagcttccaaatttagctgagcaacttcctcgccagatagtgttgaagaagttacttcctttattagcttctgcccttgaatttggttcagctgctgcctcagctttgactgcattgttgaaaatgggttcctggctttcagctgaggagtttaatgtcaaggtacttccaacaattgtaaaactctttgcctccaatgatcgagctatacgagttgcccttcttcaacatattgatcaatatggagagtctttatcagcgcaagctgttgatgaacaagtttaccctcatgttgctactgggttctccgatacatctgcttttctcagggaactgactcttaagtctatgttaattctggctccaaagttgtctcaaaggacaatgtcagggtcattattgaagtatctgtcaaagttgcaggttgatgaagagccagcaattagaacaaatactaccatattattaggcaatattggaagttacttaaacgaaggaacaagaaaaagagttttgattaatgcatttacagtccgtgcattacgtgatacttttccacctgctagaggagcaggcattatggctttatgcgccaccagttcctactatgacatcactgaagttgcaacccggattcttcctaatgttgttgtgctcacaattgatcctgacagtgatgttagaactaaggcatttcaagctgttgatcagtttttgcagatagcaaagcaacattatgaaaagatatcaatgaatgaataa

SEQ ID NO: 58600 - DNA, 1113 bp, Glycine max
  Peptide Sequence Number=SeqID_175378
atgtcgcagggcggtgctttatggttccagaatttaacagaactctctcatggttattcagggttcatcttcccttttctgattgctggtttgcactacgtcactgttcagatatcctttaggaaacctttggttgcagaaacacgggatatttttgacttattagccaaattttataagcaatacttggactttctaacgatacctatagctatcacgggtttttgcattcctcagggcagccagctctattgggttaccaatagttcattaaccctcattcagcaaataacccttagacatcctgctgtccttgcaaagttggggttactagacaatagtcaaaagggagcttctgagcaaattgctgcttctaaaacagctccttcaccagggttacaagataatattccaacagcagctaccaaggaaactgtttcgcctgaaaaaaatcctctggattcacctgaaaagtggcatagaatacctatagaggagatgtcccctaaagaactggttactcttgcagtcccatttttaaacagtgatgataaagaaagtgcaattcctttactaaaactagcccttgataaggaccctgactatgtacgagctttagttttgatgggacgggttctattgctgaaacatgtaaatgatgaagctaatgagtactttgagcgtgcaatatcaaaactttctcttgctggacattcagctgatgcggaagaagttgatcttttgattctttcatcccagtgggctggaattgcctgcgaacggcaggtttttggatatatggttaaagaaggcttgaatatgcatttgacagagggaatctttagataccttggaaagagggccgaaggacgggcacactttgaaagagtagcaaatatgcaggagccagaagatcctactagcaaaggctattattttgatgggttactgttgcttgccagcactctatttgatgcaggtcaaaaggccgaagctgcgaagtacctacgtcttgttgttgcttataaacctggttataaaaaattcttggaacagtgtgaaaaagatgatgattttacaagtgatcttgcccgtagtaggagagacctctaa

SEQ ID NO: 58601 - DNA, 1206 bp, Glycine max
  Peptide Sequence Number=SeqID_175379
atgtggattagtgaggatgatcagaaagtggtcactaaacgcaaaacagaacttggtggagctttctccatggcaagttggatactatttattggtttatttgccgtgttgctgtaccagatcatatcaaagagatcaattgaggtgcacaatgtcagagcaacaaatggaccggagttagcctcttttatcaatgacatggagttcaatataacaactgtatctagtatgagctgtgcaaatctacgtaatctgggtaatatagttacggggaatcctggcttcattgaccaaagagttgttcctctctcgactttagcaaactactcttgttacaactcaagcatgggaccaactatagcactcaagtgtaaaaactgcaaggtcatctatgatcacatgtacatttcatggcagtttgttgatctccccaatagtcctgccattgctgttggttttgagtttagactcacttcaatggatattgctaagaaacatgtgagtttcgttagtggaacactaaagaatgggagtgattttgatgatagcccggttacattcagagggaatcaatcgaatattgtgaaattcaatttgttccctcgaatatatcataatttacatgagctaaagctcatacagcctttatttcacgagttcatcccaggttcagttttgcgtgatactaatgagcttcgagcatcccttgaaagttctactgatggactagtcaacactacattgtttatcaattttctctctgattatgttgtggaaattgataaacagaatattttgggtcctgtgagcttccttgcggaccttggtggcttgtattgtattagcataggcatctttttctacctgttgatacagtgcgagtataggataaagaagctcagaaatgaagatagcattatgcgcagaattagaaatcggcgtaaagctcaagaacattgggacaaactgaggaaatatgtaatgtacacctacggctgtcctacaatagacaacaactacaatagcactggaaaggaaacagattgtggtggatgtatgttgcattcagttcgtggtagtggttcatcacgtaaacgaaggctgaaaagcagaaaagattctataagtttgtaccagaaacctagcttacctgataacaaggtaaagcttttcattattgatctcgcctgcatttgggaagtttaa

SEQ ID NO: 58602 - DNA, 288 bp, Glycine max
  Peptide Sequence Number=SeqID_175380
atggcaatgcagcaacataatctctgtcgtaagtcatcaacaaaaaaaatttcaattgagagggcgagccctggtgcagcggtaaagttgtgccttggtgacttgttggtcatgggttcgaatccggaaacagcctctttgcatatgcaaggcttagcttggaggttgcttttggctgtgatgttattagtaaagataatttgggaagaagaagaaggaaaatacattgccgtaggattcatcagcaatgtttcccatgaagaactagatatctcacctgtacaatga

SEQ ID NO: 58603 - DNA, 156 bp, Glycine max
  Peptide Sequence Number=SeqID_175381
atggacatatcgttgaatctcctccgcagacgtttgggtggtgctacgtttgaaatctcgctggagaatgagaggttgatggagatagagaaattgttaatgacgtccgtcaaaattggcaaaaagggtaatattgatgcaactttaaaaacttga

SEQ ID NO: 58604 - DNA, 1263 bp, Glycine max
  Peptide Sequence Number=SeqID_175382
atgagaatattgaaggctgggaagctgactgagaaagttctgagactttttatagcaactggtaaggatgaagtcctctcatttgttcaggcactcaatatccaacatattttgacccctgtgcttcctaccatagctgttcctgtagtggcaaagggtgttctgaggcaaaaccagactattagtttgtgggatagtctgtattctgtaccttgcaagatgtctcaagcagttatcaacgaaaatgaagtggacattgtgattggtgcactgcactctgatcttacaacttttatgaatgaatggaagccaattttctcccgttttcacctgataataataaaagatcctgatctcaaggaggaactccgaattcctgaagggttcagtgtggatgtgtatacaaagtctgagattgagcgagtggtgggttcttccacttctgttcgcttctctggctactcttgtagatattttggcttcctaatttcacggaaaaagtatgttgtctgcattgatgatgattgtgttcctgcaaaagataatttagggatactggtggatgctgtggctcagcatattgtgaaccttcagactcctgccacccctttcttctttaatactctgtatgatccattctgtaagggtgcagattttgttcgcgggtacccattcagcctgcgaagtggggttgattgtgctctgtcatgtgggttatggctcaatctggccgaccttgatgctccaacacaagctctcaagcctggacagaggaatttgcgatatgttgatgcagttgtgactgttccttcgagagccatggtgcctgtgagtggaatcaacattgcctttaaccgtgaagttgttggtccagcattagtcccagctttgaggcttgcaggggaagggaaattgaggtgggaaactatggaagatatatggtgtggaatgtgtgtgaaagttatatgtgatcacctaggtcttggtgtgaaaagtgggttaccttatgtttggagaacagaaaggggtgatgcgatacaaagcttgaagaaagaatgggaaggggtgaaattgatggaggatgttgttcctttctttcagtcattaaggttacctcaatcagcaactacagcagaggattgcgtggtcgagatggccaaaacagtgaaggagcaactggggaaggttgatcctatgttttcggcggctgctgaagccatggaagagtgggtcaagctctggaagtcagttagatctgtttga

SEQ ID NO: 58605 - DNA, 639 bp, Glycine max
  Peptide Sequence Number=SeqID_175383
atggagattcacttgaaaaagaaatccaaacggttatggctctcacaacaaggttatgttgagaaggtgctagacaagttcaacatgaacaatgcgaagcctgtgagtactccattggcaaaacattttaagctttctatagatcaatgtttgaagatagatgttgagttggagtacatgtcaaaggttccctatgctaatgctgttgattgcttgattctggatcttgaggtactaaagggaacaggtcatgatattatatttggtagtcagcaaggtgatctttcagttgtaggatatgtggattttgaccatgctggtgatctggatgacagtctcttgctagcaaggaagctgtggttagtagggctagtgaaggagttgggcatcaagcaaggtggagttcagttgcattgtgatagccagagtgcttttgacttgacaaaaaatcaggtgtattatgctaaaactaagcatattgatgtgaggttccacaagatcaaggagttgatgacatctggtcagattttgttcaggaaggttcacactttagataatgcagctgatatgttaaccaaggcgatcacaactgacaagttcaagcattgcttggatttgttgaatgttgccaagtgctag

SEQ ID NO: 58606 - DNA, 543 bp, Glycine max
  Peptide Sequence Number=SeqID_175384
atggaggctttgaatttggaggagttgcaaaagaaggctacaacaaccatacgcttatgtttggcagatgaagttctctatcacgtgatgaagttgatgtctccgggggaggctgcacttatgtctcactctaaacggagacaaaatgcagtggagagtttgcaaggcgatggtttgtatgtgaaggggaagcatgaatgtgaaaggacacaagacaagagttttggtgataaacagaggaagaagtccaaaacgtctcgcttagcaaatgtggcagagactgatgatttagactactacactaaaggagatgtctactacaatgagagagatgttctctctggttcatgtagtcagttgacagatgcatggattcttgattctagatattattaccatatgactcccaacagggagtggttcactacatacaggtccgacaattttgacagtgactgtatgggtaacaacaaaacaagtaatggagataaggataccctcagagtgtgtaaaggggcgttgactgtgatgaaagcacaatag

SEQ ID NO: 58607 - DNA, 1320 bp, Glycine max
  Peptide Sequence Number=SeqID_175385
atggcttcccacgttgctcttcttcgtgtccctcctcctctttcaatctccactcaacgcttccatgccaaacagatttgcataaacggactcaaactcaccaacacttcttcttcttcttcttcttcttcttgttttccatgttccataacaacacaaagagggtcttgttcctctgtgattacatgttcatcttcaaatggcagagacccaaattcggtggatgaggaagatgtaaaacaagtggagcgcattctcgaagagaaacgacgagctgcattgtctgctaagattgcctctggggaattcaccgtgaagcagaaatctggtttactttcaataatggagggcttggcaaaggtgggggtgcccaatgaagttctggaatttttgtttggttggtttgaagggggtggcgagcacccgaaaattcctgaggcaaaagggtcaatcaaagctgttcgaagtgtggccttcttcattcccttgtatgaactttacctcacatatggtgggatttttaggttgacctttggaccaaagtcctttctaatagtatcagatccctctattgcaaaacacatattgagagagaattcaaaggcttattcaaagggtatcttggctgagatcctagactttgtaatggggaaagggcttatcccagctgatggtgaaatatggcgagttagacgtcgtgctatagtcccagcattgcaccagaagtatgtagcagctatgattggcctttttggacaagctgcagatcggctctgccagaagctagatgctgctgcatctgatggagaagatgttgagatggaatcacttttctctcgattgaccttggacatcattggcaaggcagtattcaattatgattttgatagtttatcaaatgacactggtatagttgaggctgtttatactgtactgagagaagcagaagatcgaagtgttgctccaattccagtctgggagatcccaatatggaaagacgtatcaccacgtctaaggaaggttaatgcagctctcaaattaatcaatgatacgcttgatgatctgatagcaatatgcaagagaatggtggatgaagaagagttacagtttcatgaggagtacatgaatgagcaagatccaagtattctacacttcttgttggcgtcaggagatgatgtgtcaagtaagcaacttcgtgatgacttaatgaccatgctcattgctggacatgaaacatcagctgctgttttaacttggaccttttatcttctatccaaggagccaagagtcatgtccaagctccaagaagaggtttcatga

SEQ ID NO: 58608 - DNA, 480 bp, Glycine max
  Peptide Sequence Number=SeqID_175386
atggcaagcttcaccctagtcacatccctcccaaagtttggccatgctggagcagcaattgctaggactcgtgtctggaatcctagggttttcgcagctgctacacctagaactatccaagttccaagagaaggaccagcaaccgctgaaggcaccacacaaggagctagtgaaacagtcaataacagtttgaacgaagcgcaagacaaggcttacaccacagcggaacatgtggctaacaagacaaatgaggtggctggtcagatgtcagcaagtgctcaaaatatggctggtaaagcaaagcagacaatgcaagaggcatgggaattcagtaagaacaaagccaataccgtggtaggaaagactaaagaatcagctgaacacgccaaagataatgtggtaggaaagactaaagaatcagctgaatacgtcaaagataatgcagaggcagtgaagaagaacatgaactcaaagaactga

SEQ ID NO: 58609 - DNA, 1380 bp, Glycine max
  Peptide Sequence Number=SeqID_175387
atggcggaagcaaacactcgtcaccaccgcgcaacctcttcttccagtgacatctcagtctatttggacgccgaccactcttctgttcccgctgcttctttcggtcctattgacaggaatccatcatcctctacgccgccgtcgtcgtcgcggaacgccgccgctgcaccggctaatcaagttaacgataagaacgctgctgctgctgttgctaaagttgttggtaggagcaagggaagcagtgcaatggcgcttgccaagttccttgacgagaaagttcccttcagggaaaaggatgatggtacagttgaaattaaagtatcaggagaaggaagtaatattgagcatgatgttaaatgcgatgaatctcatgatgaattttgcgatgcaatacacagtcaggatattcagcctattgaaccacttcaaatcgtaatgcttatagttggcacacggggagatgtccaaccatttgttgccatggggaagcgtcttcagctctcatatcaaatagttgatgctttaatctggcttggaatacgagacttgataaatgagtttaggaagaaagagctgaagctaaagcctattacttatctaagtggatcttacactcacccttttgatgtgccccatggttatatatggagccctcacttagtccctaaaccaaaagactggggacctaagattgatgtggttggattttgtttccttgaccttgcttcaaattatgtaccaccaaaatcgctagtagattggcttgaagagggagaaaaacctatttatgttggatttggtagccttcctttacaacaaccagagaaaatgacgcaaattataattcacgctctggaagaaacagggcagagaggtgtcatcaacaaaggctggggtggtcttgggtctttggcagaacaaaataaatctgtgtatttattggacaactgtccgcatgattggctgtttccccgatgcactgcagtggtacatcacgggggtgctggaacaactgccgctggtcttagagctgaatgccctacaactattgtacctttctttggggaccagccattttggggagatcgggtacgtgctagaggagtaggtcctgcacccatcccggtggatgagttttcatttgataggctggttgatgccatacactttatgctgaaaccagaggtgaaaaagcgtgcagttgaacttgctaatgccatgaaaaatgaaaatggggtgctaggagcggttaaagccttctataaacattatccggccgagttcaagcgattagcctccacagccgaacccaaatcagttcataaatatttctctatacgaggatgctttggttgctctaaatcttctggatataaatag

SEQ ID NO: 58610 - DNA, 294 bp, Glycine max
  Peptide Sequence Number=SeqID_175388
atgatggtagctacactttttggcaagctaagggagtatgatttagagcttgggaggctaaaggatgaagaagaagttgacaagaaaaagaagggattagccttacagacaagttcttcacatcatgaagctagtgatgaagacccttctgcgaaaagcaaaggtgcatctttccaaaaaggagaacacgcaggagtcgccaccaacgtttattcaaggaaaacgttagaaaaaccaagaaagaaaaggtctaataattttgaaaagaagggtttgggagttgtttacacatag

SEQ ID NO: 58611 - DNA, 207 bp, Glycine max
  Peptide Sequence Number=SeqID_175389
atgaagcgtgcactgattaatgttcacgaatttgggttaactggtgaaggggaaactgccaggaagccatattataaacgaaacctcaaagagagttgggcttcgtcctcaaaaggaaacaacaccagaaaatctagccttccattgattcaaacagaaaacgcacatgaaactaaaagcagaaacgtaaatgaagcagaaacgtaa

SEQ ID NO: 58612 - DNA, 180 bp, Glycine max
  Peptide Sequence Number=SeqID_175390
atggaggggcaattgtcataccctaatttcgtctgggaaccattgtttggtggcgtgcaaccttcgcttgaccgcctcaagcaacctacctcgcctgggcgagctgggcggcaaccacctcccccgttttgtttaaaaatggctttcgaggcttttgggactcccataatgcttccgtaa

SEQ ID NO: 58613 - DNA, 2287 bp, Glycine max
  Peptide Sequence Number=SeqID_175391
gcctaagcttaactttgtgtttccatttccattcatgctcctcattactcactggtttctattggctcttcatggcagtgctgagacttccacatatatagtccacatggacaaatccctttttcctcatgttttcacaacccatcatgattggtttgaatccaccattgattccataaaatcagcaaaacttggtcactcatctaaccaatcacagaaactagtgtactcctataaccatgccatgtatggttttagtgctgtactaacattagaagagttggaggctgttaagaactctcatggctttgttgcagcatatccagacagaaatgtcaccatagacaccactcacacttctgaatttctctccctagactcttctagtggcctatggcatgcctcaaattttggggaggatgtcattgtaggtgttattgacactggtgtgtggcctgagagtgaaagctttaaagatgaaggaatgactaaaattcctaacagatggaaagggacctgtgaggaaggacaagacttcaacacttccatgtgcaacttcaaactaattggagctagatatttcaacaaaggtgtgattgctgcaaattccaaggtaaaaatcagcatgaactcagctagagacaccgtgggtcatggaactcacacatcatcaacaattgctggcaactatgttcatggagcctcttactttggctatgctaaaggggtggctagaggcattgccccaagagctaggcttgccatgtacaaggtcatttttgacgagggtcgtgtagcctcagatgttttggctggaatcgaccaagccattgctgatggagttgatgtgatttccatctctatggggtttgatggtgttccactttatgaggaccctatagcaatagcttcttttgcagcaatggaaaaaggggtggtggtttcatcttctgctggtaatgaaggtcctgatcttggtaccttgcacaatggaatcccctggcttctgactgtagctgcaggcaccatagaccgcacatttggtactctaattcttggaaatggacaaaccattattggttggaccttgtttccagcaaatgccttggtggaaaatcttccacttatctacaataagaatatatcagcatgtaactcagtcaagcttttatccaaagtggccaaacaagggatcattctatgtgactcagagtcagaccctgagttaaagatgaaccaaaggagttttgttgatgaagccagtttgttaggggcagtgtttatctctgatcaacctctattaaatgaagaaggacatgtttcctctccaactattgtaatcagctcacaggatgcaccatctgtgatcaagtatgcaaaaagccataagaagccaacagccaccatcaaatttcaacgaacatttgttggaataaagccagcaccagctgttaccatttactcttcaagaggtccttcaccaagctatcatggggtcttgaagcctgacataatggcacctggctctaatgttcttgctgcttatgttcctacagaaccagcagcaacaattggcaacaatgtgatgttatccagtggctacaatttgctgtctggaacatccatggcatgccctcatgcttctggtgttgctgctcttttgaaagctgcacacactaaatggagtgctgctgctataaggtctgcactagtaaccacagctagtcctcttgataatacacaaaatccaattagggactatggttacccttctcaatatgcttcccctcttgccattggagctggtcaaattgaccccaacaaagcacttgatccaggtttagtatatgatgccaccccacaggactatgttaatctcctttgtgctttgaagtacacacaaaagcaaatcctaaccattacaagatcaacatcttacaattgtgcaaaaccatcgtttgatcttaattacccttcatttatagctttctatcgcaacaacacaaggtcagttgttcacaagtttaggaggacagtgaccaatgttggagatggtgctgccacatacagagccaaggtgacacaaccaaaaggctctgtggtgacggtgtcacctgagacattaacattcagatataaaaatgagaagctgagctacgatgttgtgataaagtatagcaagtacaagaagaaaaatatatcatttggggatcttgtttgggttgaagaaggtggaacacacagtgttaggagtcccattgtagtggcaccaagtggaattgtatga

SEQ ID NO: 58614 - DNA, 195 bp, Glycine max
  Peptide Sequence Number=SeqID_175392
atggccaaagcgaacactcacctccgccgcgcttcctcttcctccagtgacatctcagtctacttggacgccgacaacacttccgttcccgccgcttcttccgggcctattgacaggaatccatcctcctctatgttgtcgttgtcgccgtcgcggaatgccgaggctgcgccggttgctcaaccggccgatcag

SEQ ID NO: 58615 - DNA, 3669 bp, Glycine max
  Peptide Sequence Number=SeqID_175393
atggagctttttcacaacctcaacattttcagcacaattctgctcctatgcatgtttcctcactcactcaagtgccaacaagcatacctcaatggcactgtctatgactgttctgataacccttcagcaccaaaagggtatctttgcaatggccttcagaagtcatgcacctccttcttacttttcaggtcaaaacctccctatgatagccctgggataattgcttaccttcttggctctgaggcatctaccatagcctcaatcaacaggatctcaagaaatgacaagattccttccaataagtcaatcattgttcctgtgttctgttcatgttcaggaaacatctaccagcataacacaccttacactgccagcaagaatgacacctactatgagttggtaaaagaaaccttccaaggcctcaccacatgtcaggctatgatgggtcagaattactatgcttcaatcaacattgcaattggtgctgagctcacagttccaatgttgtgtgcttgtccaactgaaaatcagacagcaagaggggtcacctctttgctggttcacttggtgaactatggtgacactattaagtccataggaagggcctatggtgtggatgaacaaagtgtgctagaggccaataagttggcagtttcacaaagtaaaaacagcagcatggacctccttgccttgacacctattatagttcctctaatagggaagagctgcaaagagaacccagataaattctattgtagatgttaccaagcaccagatggaagctccaaggggcccttctgtgatgaatctgatggtcagaaattccctgccaaattggttgctggtttaggagttggaattggtgcaggctttttgtgtttgtttcttttggggtacaagtcatatcaatacatacagaaaaagagagaaactatccttaaggaaaagttattcaggcaaaatggtggctacttgttacaagagaagctctcttcttatggaaatggagaaatggcaaagctttttacagctgaggagctgcaaagagcaacagataactacaataggagcaggtttcttggtcaaggtggttatggcacagtgtacaaaggaatgttactagatggaaccattgttgcagttaaaaagtcaaaagagattgaaaggaaccagatacagacttttgtcaatgaagtagtcgtattatctcagatcaaccacaggaacattgtaaaactattaggttgttgtcttgagacagaaactccaatactagtctatgaattcattcccaatggaacactgtcccatcacatacataggagagacaatgaaccctccccttcatggattagtcgccttagaattgcatgtgaggttgctggagcagtggcatacatgcattttgcagcatctatttccattttccatagagacatcaaacccaccaacatacttttagacagtaactacagtgccaaagtgtctgattttggaacatcaagatcagttccactagataagactcatttaaccacagctgttggaggaacttttggatacatagaccctgaatattttcagtctagtcaattttcagataagagtgatgtgtatagttttggagttgtgcttgtagagctcataactgggagaaagccaatttcattcttatatgaagatgagggtcagaatttgattgcacaattcatttctttgatgaaggagaaccaagtttttgaaattttagatgccagtttgcttaaggaagcaaggaaagatgacattcttgccattgcaaatcttgcaatgagatgcttgaggctgaatgggaagaaaagaccaacaatgaaagaggtttcaacagaattggaagcattgagaaaggcacaaagttcattacagatgaaccatgatcatgagcacacaactagtgacatagttcaagaatgcacagaggaaagcatcactgtctatgactgctctgagaacccttctgcaccaaaaggatacctttgcaatggccttcaaaagtcatgcacttcattcctagttttcaggttcaaatctccccatgacaaccctgtaagccttgcctaccttcttggctctgaagcatctaccatagcctcaatcaacaagatctcaagagatgacaagattccttccaataagtcaatcattgttcctgtattctgttcatgttcaggaaacatctaccagcataacacaccttactctgccaccaagaatgacacctacttcaagttggtcacagaaacttacctaggcctcaccacatgtcaggcactgatgggtcagaattactatgcctctgatggcattagagttggttctgagctcacagttccagtagtatgtgcttgtcccactgaaaatcagacagaaagagggatcacttccttgctggtttactcagtgaaaaatggtgacactattaagtccattggagaggtttatggtgttgatgaacaaagtatgctagaggccaatgggttgccagtgccaacaagcacagagaacagcataatcatctatgccctaactcctatcttagttcctctcagaggcaagagttgcaaagaggacccggatagtttctattgtacttgttcccagggaatgcttgcggttgtggatttaaccttcacgggattccactgtaatgaatctgagggtaataattttcctgccaaattggttgcttctttaggtgttggcataggtgcaggctttctgtgtttgtttcttttggggtacaagttatatcaatacatacagaagaagagaaaaagcaaccgtaaggaaaagctattcaggcaaaatgatggctacttgttacaagagaagctctcattttatggaaatagagaaatggccaagcttttcacagctgaggagctgcaaagagcaacagataactacaacaggagtaggtttcttggtcagggtggtcagggcacagtgtacaaaggaatgttactagatggaaccatagttgcagtgaaaaggtcaaaaaagattgaaaggaaccaaatagagacttttgtcaatgaagtggtgattctatcccagatcaaccacaggaacattgtcaaattattagacaaaatgagccctcccttctatgggacagtcgccttagaatcgcttgaggtttctggagcagtggcatatatgcattttgcagcttctattcccattttccatagagacatcaaacccaccaacatacttttagacagtaactacagtgctaaagtgtctgattttggaacatcaagatcagttccactagataagactcatttaaccacagatgttggaggaacttttgggtacatagaccctgaatattttcagtctggtcaattttcagataaaagtgatgtgtatagttttggagttgtgcttgtagagctcataactggtagaaagcctatttcattcttatataaacatgagggtcagaatctgattgcagagtttatctcttccgtgaggcagaaccaagtttatgaaattttagatgccagggtacttaaggaaggaaggaaagatgacattcttgccgctgcaaatcttgcaatgagatgcttgagacttaatgggaagaaaagaccaacagtgaaagaggtttcagcataa

SEQ ID NO: 58616 - DNA, 170 bp, Glycine max
  Peptide Sequence Number=SeqID_175394
atggcgtttgtcgtactggtgcagcgtgccgtcgggctccaccagcaggaaacggtttaccgcgccctggtcgctctgaatcgccgcgctgccgccgaccagggcattcagggctttggcatgaccgtgcagccacgccactacctgatcctgcggcagcgaactggccg

SEQ ID NO: 58617 - DNA, 351 bp, Glycine max
  Peptide Sequence Number=SeqID_175395
atgggttctccacctgcctcccctcctcctcctcctcctactcctccttctcatcatcctcttcctcctactactactccttcggacacatcggcttcgccgtctgccgtgaagcggacacgcaaagcctcactggtccatgttgatcctgctatcggcaaggccgacggtccccacaggaagaaattaagaacatatttggggattgtggcgtgtgataaggtggacgtcacctacgagaactggaaggaggtccctactgctcagaaggacctgatttgggaggatattcaggcgaaatttgatatcctagaggcttctgacagtaggacgaaaaggaagttactttag

SEQ ID NO: 58618 - DNA, 910 bp, Glycine max
  Peptide Sequence Number=SeqID_175396
atggtagctacaacttaccaaacctcccatgaatgttcagaagagaccattatggatatcttagtggcaggattttctggacaactgaaaggatggtggtatagagatactttcctaactagggtttacacaagagaagatagtcaacaacctttttggaaagaaaaattcctagctggtcttcccagatcattaggagacaaggttagagataaaatccgtagtcaatctgccaatggagatattccgtatgaaagtttaagctatggtcaattaatttcttatgtccaaaaggtagccttaaaaatttgtcaggatgacaaaattcagaggcaattagccaaagaaaaggcccaaacaaagaaggacttaggtcacattagcaaatattgtagactaaaaaagaagttaagaaaccttaacctagaacccgcaattgaagagcaaataaacaatttgcctatagaaacctcggaggaggaaacagaaacttcatcctccgtgctttccgatgaaaacctaaacctaatccaacaagatgaccaactatcatcaacagatgatgatgatgggcaaatcaatactctaacaagagaacaagatctcttgtttgaagcaatcaattccatacctgacccccaggaaaagaaggtttttctggaaaaactcaagaaaacattggaggtaaaacctagacaaaaggattttattacaaacaacaaatttgatgtaagtaacatactcaagagattagaaaattcttcaaccaaaccaacgacaaaccaagatctccaaacagagataaacaatctaaaaagagaggtaaaagaacttcgtcaacaacaagaaattcatcagatcattctttctcagcttgaggaatatagtgattctaaaagtgccaacaaca

SEQ ID NO: 58619 - DNA, 567 bp, Glycine max
  Peptide Sequence Number=SeqID_175397
atgttgacagaggaaggtatcaatacttgggaggctttcaagataaagtttctcgtgaagtattttctcaaggatttacgcaagcactatgtacacaaattcatagatttgaaacaagggagtatgtccatggagaatatgcttaagtttgacgaacttctgaagtattttccctattatcaagaaaatgatgctgctgcgatttattctaagtttgagaataaattatgggatgacatcaaacaagttgaaggttatctacaaatcactaattttccaacattgaactatggaaagtctggacacacgactagcaactatttgttagcaccaaagaatggacaaaacattgggggtgttgcaagaatgaacaacaaggatggtagtggacaaaacatgaagccaagagttgatggaaaggtttttacaatgagtagctctaaggttatggaaactaatgaaccaattcaagtgcttagaaaggttgtcccaaaacaattgccaagaggtgagaactcaaaggaacttttgaagcccatttacatgatggagaatgcttccctctga

SEQ ID NO: 58620 - DNA, 165 bp, Glycine max
  Peptide Sequence Number=SeqID_175398
atgggtcaaagtcaccttgggtgtgctctcgaggttcttcacgggcgcctcctacaggctagggttgttgaccctcaaagatggatgggtaggatttgcctaagtggcagtgttggcggcaacaactgcgaccatgtttctttccatcattctcttcatgtttaa

SEQ ID NO: 58621 - DNA, 556 bp, Glycine max
  Peptide Sequence Number=SeqID_175399
tcctacgaagttcccatcacccccagtaaagtaatccgactgccgatcacccgagccttcatcaagaagtacagcacgcctaggcaggtccagggtgacgcacatcaggctgcagacacaccgccaccacctcagcaagccgatccagctgggtcactgggcgtagagcgttatctacagcatttggttcgccagcaggcggccaatcaccgtgggcagcagtttggggctgaggtcacatggcctggagactggcccgatgcccaggcaggggaggagcctgtaggatcccccggtgaggcggatgagtcccatatggatgaagagatgactgacctgctcagtttcttgggagggagcggagccactcgtctgcgcttccgtgactacaaccacattgtggagatcgtgtttgtggagatcgtcttatccattgagggcgtgtttctccttctgcctgagttcgtttttgtcgcaaactgggttgcgcttccgtcactgcaaccacattgtcgagttcgcgtttgtggagttcgtgtctgcgcttccatcgaag

SEQ ID NO: 58622 - DNA, 169 bp, Glycine max
  Peptide Sequence Number=SeqID_175400
tggacagggtaggcaacaaatttgtttggtggagagacttacaaaaggctttcaccagctcacaccaaggacagattatccaacagggaatgaagtggagtgtgggcagcggataccaaataaagttttgggaggacaagtggaatggggaggaggaatcattggctga

SEQ ID NO: 58623 - DNA, 546 bp, Glycine max
  Peptide Sequence Number=SeqID_175401
atggtggatgggagaaaagaagaagaaggctgctttctcgcgtttctctgcgtccgccggggccagttttcgaaagcaagcaatatatatatcaaaacgctcagaataaaaccccgagcgtggttcagagagtctttagacgaagatgacagtgttgatggtatatctgatacagacaatgaagtcaacgagatgattccaccagtgtacaaggaattcaaaatcccattttggaatgatgctttgcattataataatatcaactggagtcatcctgatgaggaggacatttgtggtttggagatgccatccagttttaatgttggccaagaattatatgttggcatggattttgatagtaaagatgcgatcaagaatgcagtcaaacaatatgctatgaaggtgcatcaaagtttcaaagtggttgaaagcaaatgggacaagtatgttgtttgttgcttgaataaaaatgcagattgtccttgccctttctatatgagggcaattctatctaaaaaaactgattcatggaaagtcactcaatag

SEQ ID NO: 58624 - DNA, 1445 bp, Glycine max
  Peptide Sequence Number=SeqID_175402
ctggcgcggtgcggtgctggcctcggcggtgatggcgtttccgctgatggtgcgcgccattcgtctggcactggaagcggtagacagccggctggaacaggcggcacgtaccctgggcgcgggccgctggcgggtgtttttcaccatcacactgccgctgactttcccgggcatcatcgttggcaccgtgctggcgttcgcccgctcgctcggcactgcggcgcggctgtgcgcggtggcgattgcgctggcgctgctgtcgctggtggcctcagagctgctggcgcgctggggccgcaagcggctgggagcggcctgatgctgaaaatcaacattgcgcaacagctcggtgagcatcagctcaacgtcgatgtggaaattccggccagcggcatcaccgcgatctttggcgtgtccggggcaggaaaaacctcattaatcaatgctatcagcggcctgacgcagccgcagagcggccagattgcgcttaacgatctatggcatggcgcccaaaatgaaagcgcagttcggggcgctggtgacgctgctgggactggacgcgctgctggatcgctatccggcctcgctgtcgggtggcgaaaagcagcgcgtggcgatgggccgggcgctgctgagcgcgccggatatcctgctgatggacgaaccgctggcgtcgctcgatctgccacgcaagcgcgaactgatgccctatttgcagaagctggcgaagcaggtggagattccgctgctgtacgtgagccacagcctggaggagattgtccagctggcgaatcaggtgctgcgcagcagcgtactgcgcgtgcaggtgctggagcagcatccggattacccgatgaccgcgctgtcgcttggcgatcagcacatctgggtcagccgggtgaatcagccggtgaaaagcgtactgcgcatccgtatcgcctcggcggacgtgtcgctggcgctgcagccgccgcaaaatacctcgatccgcaatatcttaccggcgcaggtggtggagctgctggagctggacgaccaggtcgaagtgaagctgcgcatcggcgtcagcgagctgtgggcgcgcatttcaccgtgggcgcgcgacgaactgaatatccggcccgatcagtggctgtatgcgcagatcaagagcgtgtcgattaccgcgtaacacaaaccggacgacagctcggtacgtccggtctgcggatcagcgcgttttttcgcgcttttttccggccaaccttactgatgccttgtgccgcgaccagcctggcattacagcacttcctggtagatcacctgcgcaatgcccggctcaaggttggtgccgatcactttgcgcgcgcgtgctttgatggcgtcatcggcattgcccatcgccacgcccagcccggcctgctccagcatgctgagatcgttgtattatcgccaaacgccagcac

SEQ ID NO: 58625 - DNA, 156 bp, Glycine max
  Peptide Sequence Number=SeqID_175403
atggaggttaaagatttgatttgggaaggattggatgaggggaagtgtggttttcgaaatctgcactttgtgcagatttttgctgtgaaattgtgcagcagaattttgcacaagtgcagaaaaatgcttgtgtgtgattggttgtggaaagagtag

SEQ ID NO: 58626 - DNA, 678 bp, Glycine max
  Peptide Sequence Number=SeqID_175404
atgattgactacgtctgcgttaactggaaccagccggacgccggtatctgggagatgcgcggcgagccggagcactttctgcattcgcgcctgatgtgctgggtggcgctggaccgcgcactgcggctgggcatgaagcgttcgctgccgatgccatacgatcgctgggaccgggtgcgcagcgagatccgcgacgacatctggcagaacttctggaacgatgaactcggccacttcaccgccacgcgcggcggtaaatacctggatgcgtcgatgctgctgatgccgctggtgcgctttgtcagctcgaccgatccggagtggatcgccacgctggatgccattaaaacccatctggtgagcgacggtttagtgcggcgttataacatcagtgagacgcccgccgatgcgctgaccggtggcgagggtgcgtttgccgcctgttcgttctggtatgtggagtgtctggcgcgcgccgggcgggtgcacgaggcgcatttcgagtttgaaaagctgctgagctacgccaatccgctgggattgtacgccgaggagtttacctcgcacggcaacgcgctgggcaacatgccgcaggcgctgacccatctggcgttgatcagtgccgcgtttttcctcaaccgtaaactgagcggcgaagtgacgctgtggcaaccgtaa

SEQ ID NO: 58627 - DNA, 1215 bp, Glycine max
  Peptide Sequence Number=SeqID_175405
atgacgccgtggtcgtcaattctgcgtttaatcttgctcatcctgcctcctgaacgctatccaattgttaactatagacgaaacggcagaatcggctgcgacgtggcacagaacgataacttctatactgtgaagacacccatcaggcaggagaacgttatgacactgggcaaacagaaagtcgccgtagtgaccgcttcagattcggggattggacgcagctgcgccgtgatgctggccgaggccggttacaccgtcggcattacctggcgctcggatgaagagggcgcgcaggagaccgcgcggctggtggagagtaaaggccagctggcccaggtgcggcagctcgatctgtccgatccgcaggctggcgggcagcagctggcgcagctgatcaattcgctgggccgcatcgatgtgctggtgaacaatgccggcgtgatgaccaaagccgattttcttgatgtgacctttgaggactggcgcaaagtcttcactgttgacgtagacggcgcctttgtctgcggacagattgccgcgcggcatatggtggatcagggcgacggcgggcgcatcatcaacatcacctcggtgcatgagcatacgccgctgccggacgccgccgcctataccgcggccaagcatgcgcttggcgggctgaccaaatcgatggcgctgagcctgctgccgcatcacattctggtgaatgccgtggcgccgggcgccatcgctacgccgatgaacgacatgagcaacagcgaggcgcacagccggcgcatgccggaaatcccgattggccgccctggcgatacgcgcgaaatcgccagtctggtggcgtggctgtgctcggaatgggccacttacaccaccgggcagtcattcgtggtcgacggcggcttcatgctggccaacccgcagttcaaggcggcgaatcacaaagcgcagcacgatgccgaacacaattgccgccgccagccagatgaagtgcttgaggtgctgatcaagcttgtgcagccacggcgtgatgatttcaccggcgaagtagccgagggtgacaaaaatcagcgcccacagcgcggcgccaatgacgttaagcacgaaaaagcgcagcggcttaaggcggctggtgccaataataatcggtccaatcaggcgaaagccgtacatgaagcgcacgccaatcacaaacaggctggggtgcttctgaatcagccg

SEQ ID NO: 58628 - DNA, 2844 bp, Glycine max
  Peptide Sequence Number=SeqID_175406
atggaggtgctgtgggtcacaaggcatggaagaatgtttgaggggagggtgttgttgctcttggttttgttcttgtggattcccacacaggtggtggtgggaaggacaagagctaccatcacaaactctactacttcttcggcaccaagagttttgagagttggagtactgtttactcttaattctataattggaagatcggctaaacctgcacttatggctgctttcgaagatgttaatgctgactcgagtgttctccctggcattcgactggaagttattttacatgatacaaattgcagtgggtttgttggaacaatggaagctttgcagttgatggaggatgaagtggttgctgccattggtccacagtcctcaggaatagcccatgtcatctcccatgttgtcaatgaactccatgtccctcttgtttcatttggggcaacagatccttctctatcttcccttcagtacccatattttgttcgcagcacgcagagtgaccattatcagatgtatgcaattgcagacttggttgattactatagatggagggaggtcatagccatttatgtagatgatgacaatggaagaaatggaatttcagtacttggagatgctctgtcaaagaaacgtgccaagatctcttacaaggctgcattccctcctggtgccctcaagaaagacatcagtgacttgttaaatggagtgaacttaatggagtcccgggtcttcattcttcatgttaatcctgaaacttttttgaatatcttctctattgctgataagttaggaatgatgaacagtggctatgtgtggattgcgacagatgcacttgcttcaacacttgattcattagagccggttgatcctaacacaatgaatctcctacaagggattttggttttgcgtcatcacactcctgataccaatgaaaagaagagttttctctccaggttgaagagactaaaaaccaaggagactccaagcttcaattcctatgcattgtatgcatatgatactgtttggttggtagcccgtgctcttgatgcttttctcaaaaaaggtagtgtggtatctttctcctctgaccctaagttgcaggacacaaatggaagcatgttgcatttacaatcgcttcgtgtttttaacgatggccctacgtttctcgagacaattttgagcaccaacttcactggtctgactggaacagttcagtttgatattgaaagaaatagaattcatccagcatatgatatcttgaatattggtggatctggcatgcgcagagttggttattggtctaattactcaggtctctcagttgtgactccagaaattttgtataagaaaccacctaacacttcaacaagcagccagcaactgtatggtgttatatggccaggagaaactgcagctaaaccaagagggtgggtattccccaacaatggaaagccactgagaatagcagttcctaatcgagtaagctacaaggagtttgtttctaaagataagaaccctcctggagtaagaggctattgcattgatgtctttgaagctgccataaacttgttgccctatcctgtcccgcgagaatatatattatttggacctggtaatagaaatcccagctatgatgaccttgcaagtcaggttgcactaaataactacgatgcagctgttggtgatgtcacaattgtcccaaacaggacaaggtttttggattttactcaaccttacatggaatcaggactggttgttgttgttcctgtcaaggagatcaaatcaagtccttggtctttcctcaagcccttcactgctcaaatgtggtgtgttactggtgccttttttatctttgtgggaactgttgtatggattcttgagcaccggcacaatcctgagttccggggtagaccgaggaaacaactcatgacagtcttttggtttagtttctcaacaatgtttttctcacacagagagaacacagtgagtggtctagggagattggtgctaatcatatggctttttgtggtgttaattatcaattcaagctacacagctagcttaacatccatcctcacagtgcaacaactgtcatcacaaattgaaggaattgatagcttgatctcgggtactcaaccaattggaattcaagaagggtcatttgcacgcaagtatttgacagaggaactcaatatacaaccatcaaggatagttacgttgaaaaatatggaggcatatattgatgcccttgagaaaggaccaaaagatggaggggttgtagccgttgttgatgagcttccttatattgaaattttaatgtcaagtactaactgtaagttcagaaccgttgggcaggagttcactaaaagtggttggggatttgcattccagagggactctcccctagctgttgacatgtcaactgctattcttcaactctcagagaatggtgacctgcaaaagatccatgacaaatggcttttaaaacgtgattgttctgcaccagatagtgatgctgatttaaataaactatctctgggtagcttctggggtctctttcttataagtggtattgcatgtctccttgctttggttacattcttcattagagtgctatgtcaatacacaaaattcagcccagaacccgagcaagatgacgaggaaatttcaccaaataggcctactaaaagtaaagggctttttagaagcactactagcttcagggacttgatttattttgtggataagaaagaaaaagaaatcaaagatatacttaggcagaagagcaagaaaaggagacgcagcttgagctcagatggccaatccagttcacccacctaa

SEQ ID NO: 58629 - DNA, 249 bp, Glycine max
  Peptide Sequence Number=SeqID_175407
atgagtagctcatcaaggccggtgccgaggagagagagtccatggggagtcaccggagagaatcatcctgagcccaaagctcaccgctgcaatgaccgtgtcgaggatgttattcaggcttgctttgagggaaacccattcaagactgttccaggacccttcaagctcttctggcagtgcatgcgttcaaaacccgggtcagattatcatctactcttgtcttatgattatgtatatctcattttatga

SEQ ID NO: 58630 - DNA, 252 bp, Glycine max
  Peptide Sequence Number=SeqID_175408
atgggggctactgaagaggccttacaaaatcttgtaaatgtaaacgttgttgatgcagaaaatccaaaaaatattaaagttagtggtacagaagattcggtagtaaatgacaaagaattaggtgctaaagaaacccctattaaagataagaaagatagtattccaggtgaagtaaaagagatgttgaaatcattggcaagtgaatgggagaatgtagttgatatcaatgcatttgcaagtgatccctcttaa

SEQ ID NO: 58631 - DNA, 276 bp, Glycine max
  Peptide Sequence Number=SeqID_175409
atggtagctcaacaggacagggctgggatggggagtagtctctcatccccaactaaccctgtcctcgttcttgatccttattgtgggagaagggtggaaaagaaacttgactccctgacaacaaccgaagacggcaatgggtgcttcccagtgaaagaacgacacagagaatgtgatcgatggcaagtggcgatgggagtggatggcaccacccaatatgagaacaagagtgaggggatccctgacgacgggagtagatggcgttgcacagtctaa

SEQ ID NO: 58632 - DNA, 210 bp, Glycine max
  Peptide Sequence Number=SeqID_175410
atggctcaacctccaatcttgaggacttaccatgatagtgataccgactcctcttctgagctcgaaggaagtaacatgtctccatctcacgaaacaatattcaaacgggattggtggcatggtaacataactgttgaaattcacaacagttttcaatttacattacactgtttcaaaaaattaaatgtctcaccagcaaaactaacataa

SEQ ID NO: 58633 - DNA, 405 bp, Glycine max
  Peptide Sequence Number=SeqID_175411
atggcgacactggattccgacgtgaccgtgtttccggccggcgaagcctccagcagcgccggtccttcttcgtccaccaagaagccgaagcgtttcgagatcaagaagtggaatgcggtttccctctgggcttgggatattgtcgtggataattgcgctatttgtcggaaccatatcatggatctctgtattgagtgccaggccaaccaggctagcgccactagcgaggaatgcactgtagcttggggcatatttcactttcaatcttaccctcctcaaaatcatcacacagaacaggtgttcaccctcaggcctcaccatatgagttattgtgatgacaacttttgtggtaggccttggcagcagcaagggagtgggaaacagcagggaataagggtgtggtga

SEQ ID NO: 58634 - DNA, 522 bp, Glycine max
  Peptide Sequence Number=SeqID_175412
atggctaatagaggcctcaaaatttgcttggctgtgtctctactcttcttggtcatcgttacaattatgattgtgactttatttatgaccatctttaagcccaaaaatcctgaaatcactgtccaccctgttggtctagaagactttcaattttccctttcacccaatttgaccataaatgtgactctaggcatgataattactataaggaatccaaactatggaagcttcgagtacaaaaactccactggttatgtgaattttcatgataccgtggtagccgaagttccaatagaagcagagttagttccagcacgtggccagattaatgtgaacacttcagcagattttatggtagaaaagttaatcaatgatcctaattttttgtcagatgttctaggtggaactttgaatttcacatcaacaactgcacttcctgggaaagcccgaagtatatttctattggagtatatatatgtcttctttggcattaaagaatatggcagtatcttgtacaagtag

SEQ ID NO: 58635 - DNA, 435 bp, Glycine max
  Peptide Sequence Number=SeqID_175413
atggcttctaaaggcctcaaaattaagttgcttggccatatctcttctattcttgatcattgttgccattgtgattgtgatcttaatccaaactatgaaaactttgagtacccaaacgccactggttatgtcaaatttcttgacaccgttgtgggccaagttccaattgtgggagagttggtcccaccacgtagccagattaatgtgaacacttcggcaaattttatggtatcaaagttaatcaatgatcccaattttctgtcagattttcttagtggaattgtgaatttcacatcaacagcttcactgcccgggaaagcgcatatgctaaagattatcaaattcaaggccacagtttatagcttatgtgacatctctattaatataacctctcgcaatgttgattccaattgcatatccaagatcaagatttga

SEQ ID NO: 58636 - DNA, 405 bp, Glycine max
  Peptide Sequence Number=SeqID_175414
atggcagagggagaggattcaattggcgacgagaagatcgtcgatgacgagatcgggcgagtccgcggcgggattgacggggacgaagaggatagacttggcggccatgagcttcttccgctgcgggcagcgcgggccgtagatcctggcaaggaagaacgggaagctggcatcggcggcgttggcgttggcggtggcctgaggctggtcggagttggggagcggcggcggcgagggagggcggttgagggagatctggtggcggaggagggagttgaggcggtgagatctggcgctgatgcgagagtctcggattcgagcaagcgcgcctggtttgaggtacttgtggaagggatgagggatgcttggtctggttctgcggttcatggcgaaaggagaaagtga

SEQ ID NO: 58637 - DNA, 192 bp, Glycine max
  Peptide Sequence Number=SeqID_175415
atgccctacacattcatggtagtgacagataatgacattgcatggatggagactttgaagaatgaccccgtttctgcggcaccaagtgagtacatgcatggtgcaatggctttagttatttggaaactaagagcaaagggagaagacgtagaccacttgaaaagggcgttcaaatatttatgtcatttttga

SEQ ID NO: 58638 - DNA, 258 bp, Glycine max
  Peptide Sequence Number=SeqID_175416
atgtttgttcaagttgtttgggcaaaaagtgcttttgagaacttctatgctggaaacataggactttttccagcagagaagctcccaagaacacttgtgacaaacgcaactgatcatgtgagacagggtaacgatgctctccaaactgcaaaaagtttgcaaaagaagtcaaggaaatgcatgatgatttccattatattggtcctcgtcattgccatcattatcgtactctctgttttgaaaccatggaagaagtga

SEQ ID NO: 58639 - DNA, 507 bp, Glycine max
  Peptide Sequence Number=SeqID_175417
atgccacttagtctgacccaacaagaacttccagttcttcttgttgttgaactggacaccgtgtgtggaacctataaacaaggcacagagttctccaatgctattgatgaaatggtgaaaggagacatcttgtcaaggtttatagaattggaagaaactgatccaaagtaccttggagatatttccttgagttttatccttccagggaaagatacaatatcagttactctttcttggtttctttacaaactttgcaagaacccttatgtgcaggagaagactgcacaagagattagacaaacaacaaatgtagaagttggatcaaccattggtgaacttgtagctagagtaactgaagaaaacatggacaagatgcagtacctgaatgcaacattgaatgaaacactcaggctccacccagcagttccagtggaaggcaagttttcttcaaggaagtcaatgtcctcatcaagaactgaaactgaacctggactttttgacccatga

SEQ ID NO: 58640 - DNA, 342 bp, Glycine max
  Peptide Sequence Number=SeqID_175418
atgcgtatgctacagctacacacctctgatataaagcagcacataaagaaagaagcatcgatccgcaatacggctactccatctggttcaatccacagacaaagaagaaacgatccgcaatacgaaattgaattggggcttttgattcctcgtatctggtctgtgtcattgaatggagggtctaagaaagatgatgcggtatggtgtcgtgtgctcccggcaccctcggcgtttgtacgccacgaaaatggacctgagaaagccccggccaatgattctgaagagaatcgagaaacgggcacagacttacccggttcgcggcatggttccggttgccaatga

SEQ ID NO: 58641 - DNA, 768 bp, Glycine max
  Peptide Sequence Number=SeqID_175419
atgttattctgtccagaggtatatattggtgagcaggggcatttgattcaaacttgctggggttacaagcattgtgccaagaactgggttcatgagtgggtcaaaggtggtttgaatgatatactcgtccctgttgaatcatttcacctggacaagatgtttcaaagtgttattaggcacgatgaaaggtttgactttgatcacatccctgctgttgttgagctatgctggcaagcaagggatgatctccatgaagaaaaccttaattcaagtagttggaacttggaagttgccaatggaagtgttccaggagctgagtctttgtcaccaaacaatcttacctctatagctaataaaacattaactgcttgggagactcttaggtctggggtggagaagttgttgttggtttatccagtaaaagtttgtaaatattgttccgaggttcatgctgggccatctggccataaagctaggttctgtggggtgttcaagtatgagagctggaaaagtgctcacttttggatgaaagctaatgtggataatttagtgcccccaaagattgtgtggagacgaaggcctcaagatcctcctgtccttttgaatgaagggagaggcttttatgggggtgttccagctgtattggatcagtgctcaaaagctggtgccgttgtgcctgcaaagtataattgtatgatgaaggtgcaaggtttgtctggtcaggtcaataataatttttttgggatcactagagaatcaaactcttga

SEQ ID NO: 58642 - DNA, 477 bp, Glycine max
  Peptide Sequence Number=SeqID_175420
atggaagattacccaatagtgactgaaggtacaaaagttgacctaaccatcaaaccagtggagccacaccctaacaaaatgcaaatcacggaaaaattttcagctagaaagtttgacattgaggtggacagaacagacactgttcgcagcttgaaagaaaaaattcacatcattgatagtaccctcatcaaaagaatgacactatacttttcagggagagaattggatgaagattttagaatcttgagtgagtatggcatacgcggattttcggaaattgctatgagagatgcaagcacagtcggagacctgaagcagttactgataagcagaaaaattcttccagttgatgactatttgttcatacacaagcagaggatcatgcgtgatagctgtagcctcaggtggcatggaattgaaaatggagactgtctctatgtgtttaaggggacagttagtcgcagtggttatgcatga

SEQ ID NO: 58643 - DNA, 258 bp, Glycine max
  Peptide Sequence Number=SeqID_175421
atgagcaacagccaccggtgcgtgcggcagcggcggctggacaaagagtcaacatgcccgcaggcggggcgaaaggcagatttagcgcagctcatcgcagcacagcgcgtggccgtaaacagagaaaccggcggccagcgtgagcagaaactgcgtgagacggcgatggcgaaggctgttcatcagtgcgatatcctgtcgtatgagaggctcaacgtaggggatatcctcaccgatcgccctggcgagataaaataa

SEQ ID NO: 58644 - DNA, 921 bp, Glycine max
  Peptide Sequence Number=SeqID_175422
atggaacgactccgtcgacaacataatgcccagtggtatcacgaaacccaaagcagcgtgcggggcgatgcgccgctggagccgcaggcggctaccctacgcgatcgttttctgctggggctgggcgccttcgccgacgaagcgctaaatgcagcgctcagcgcccgcgccggggtattcaacgcctcgctggccggttaccacacgctgtttcccgaccaggtgtcgctgtcacgatacgtgacattgtcaccatacgatcgccttagcaccgcgttgaccgtcgctcaggtgacgggcgtgcaatcgctttgtagccactacgccgcccgcctcgccccgctgcacagcccggacgcctcccgggaaagcaatatccgtcttgctcaaatcacccaatatgcccgccagcttgccagccagcccacgctgatttgccgcagggcgctgcaacagctcggcgacgtcgggctgagcccggcggatatcgtaaccttctctcagacgatcggttttgtcagctatcaggcgcgcgtagtggcgggcgtcgcggcgttggccggccgcccggcggtggtggtgcccggcttcccgaacgtcgaagacgccgatggcgtcgatttcagtgccgacgagttgagctggactgctcgtctgccgacaatcgacacggaagccgccgccgccgaacagcttgacgtgctggatcagagccacccgcaggcgcgcgccgaatcttattatttgctgttggcgcacgatgccgccgcgctgcgcgagcgtaacggcgtgtttaacggcatcaatgccgaaggatacgggttatcgggccgattgaaagcgctggcgacgctggcggtctcgcgcatcaacggcagccgctactgcgcggctacggtggcgcatgaaattgcaggatga

SEQ ID NO: 58645 - DNA, 1023 bp, Glycine max
  Peptide Sequence Number=SeqID_175423
atggccgatggggccgtggatgcggttgccgatcagcggatacaacgccgaccgcagggtcagcggcaggccgtggcggaagctgaagaacgccagcgtcagcgccaccacggcgtagatggcccaggcgtgcaggccccagtggaagaaggtgatcttcatggattcgcgcgcggcggccgcggtggcgccctcgcccaccggcggcgacatgaagtgcatgaccggctcggccacgccgaagaacatcaggccgatgcccatgccggccgagaacagcatggcgaaccaggtgaagttgcgatagtcgggctcgctgtggtcgggccccagcttgatgtcgccatagcggctgatggccaggaacgccaccgaaagcaggataatggcgaccaccaggatgtagaaccaactggcgttgcccaggatccaggcctggatcgattcgaacaggttctgcgcggtcctgggcgccatgatggcaaagcccaccagcagcagcgtgaataccgccgctgtgtagaagaccgggcggttgatggtggatggctgcggcgctggccccctcagtccagccggcgcgccgttgtaattactatcacgcgaacgagcaccgtgacaatgcccgcgatgccgcggtcgccgcggccatggcccgattgcccggcagtgtggcgctcgcgggcggccgcgctagccgctgtcgcgctcgccgaacaccacgcggcggaagaatcccgccagcaccgattcggtcgtctcggcgctgacgttctgcggatcgaaggcgaagctgaactgcatgccgtcggaaagcgccaagaggccgatggccagttcgcgcgcgggcagcggcagcggcgtgccgacgcgctcggaaaactggcggatgtactcggtggtggcgtcgcgcagttcgcccatgcaggcgatgaagccgatgcggaactccgggtcgcgcgccgcctgcagcttggcttccatccacaacaggaagcactcgttgtcgcggaaatggttgct

SEQ ID NO: 58646 - DNA, 1056 bp, Glycine max
  Peptide Sequence Number=SeqID_175424
gttgccacaattgcttggttggaagctgattctgtttgtggcagccactctgttgcaatccctttggttcttgtcttgccttatcttttccgtttaaaccaatgtctccggcagtacaaagatactggagagaaaactactcttctgaatgctttgaaatattcgactgcagtgcctgtgatttttctttctgcccttaaatatcacgtcttccctgagaggtggacaaacttttataggcctctctggcttctgtcaggtgttgtgaactcatcatactccttctactgggatgtgaatcgagattgggacctaagcaatctggttttgcgttgcacgtggacatataagctgtctgcccatcttcgtcataattacctcacggtgttcttcattgctgctttggagattttccgccgcttccagtggatctttttccgtgttgaaaatgagtggaacaagatgaattccaaatcacactcgcatctctcagtcaatgagatcccagatgatgaagagaaattacttcattccattaactacagtgactacagcaaccatggccggccgctgcagccggaaacaagcttggccgagctgaacttgccaagagtgctctgcgttctctcttccatgttagagaagctggtggctcgtaatgaaaagctcattgatatcctgagccaggagctagatggactgaacagtggctcagtaagacttgggaacagcttgaatacatttcatggcgtaagagcaccaagcataagcatacctaagtacttggagaggatatacaagtacactaattgtagcccttcgtgttttgtggttggctatgtgtatatagacaggttaacacatagacaccctgattctcttgtcacatccttgaatgtgcacagactgctagttaccagtgtcatggtggcttccaagatgctggatgacgaacattacaacaacgccatatatgctcgagtaggaggagtaagcaatgctgaattgaacaagcttgagttagagttactctttctgttggattttagagttatg

SEQ ID NO: 58647 - DNA, 476 bp, Glycine max
  Peptide Sequence Number=SeqID_175425
gtgttaacgctcctgctaatagtccacacttacgcaagtctgggagtagacctgtcgtttatgatcttgatgaacatgaggtggaaaatggcgtcgaggagggtctattgcatcccgtggaggcatctgattcaaagggtggtgtgattcccgtgagtgctgctgcaatgatgccatcgcccgttttgttgtggagattcaagattgagataatgggccctgacctcaaggatttcatcatatttctacaaactggaggattgcaggttggatgggattctgtcatgagaatgagtgcagacaagcgggagttgttcctttatgaagcatttttgtattttaatcctcttcttctagcggctttgatggtttggctgtggggaatcaacttatggtttttttctcaaggtggagtcaattatgcaaaaatatttgatcttgatcaaaatcatctgactcatagagaaatatggaag

SEQ ID NO: 58648 - DNA, 309 bp, Glycine max
  Peptide Sequence Number=SeqID_175426
atggcttccacagcctcttcgctcctccgagcttctaggtccaaactttcttcttcctcctccgcttctctatctagaaccttcgctcgctccgctcctcgtcgatcccccggctcctccgccgccgccacccgctccttcggctccgccgtcccgcgatggagccgcggcgtcgactggcgctctcctctcggcctccgccctcatattagagccgccgctcccctcatcgaacgcttccaccgcagaatcgccactagcggtacttccccgccctctcccataatattggagctctgttgcttttga

SEQ ID NO: 58649 - DNA, 252 bp, Glycine max
  Peptide Sequence Number=SeqID_175427
atggaggatgatgcaacaaagttcaccaagtcaaagttgttctctaaagaagttgaagttgttgcttttaaatgggcatcattaatgtcaattgagttatctctatccgaagtagttcaatttgaaccaatttgccttcaactttgccaagcgtggagcaataaaggacaaagtggaagaagtctatgtggaagcaatgccttccaagattattttgatgatgccaaagaatcaagagtcaagcaagtttaa

SEQ ID NO: 58650 - DNA, 687 bp, Glycine max
  Peptide Sequence Number=SeqID_175428
gaatgtcctaatctaggaattcatgatgggagtgaactttgtgaaggtttcaatgttgataaccttcaattaaactttgaaagtgctgatgaaatatttggctgttcacaagatgccacaagataccaccttgaagatggaggaatggactgtttattgatggataaaaacatatcagtcacagaatctaattcacttattgagagtgccttggaggcatcatcatctatccaacaagattgtgtggcttttcaatcatccagggcgggtgggtcagctagtgtgatgcaggttatcaacagcaatacaaattctgcactaatgaatcctagctgcactagaaacatcagtctgggatttcctcagggtgttcattcaaagatgccacttcaatttcccaacattgttggtgaaaataattctactgaatatcaagactgcaggttttcgcaagtgtttctgccgggtgaatccccctgggaatcaaatttggagggtacatgcccacaagcaagggataaagctaaaatgagatacaatgagaaaaagaaaactcgaatgtttggtaagcaaataagatatgcttctcgcaaagcaagggccgatacaagaaaacgtgtgaaaggtagatttgttaaagcaggtgaagcatatgattatgaccctcttgggacaagggacatctaa

SEQ ID NO: 58651 - DNA, 441 bp, Glycine max
  Peptide Sequence Number=SeqID_175429
atgaggctagttgttaggccatgccaacaccaaaaccaaaaggcatatgggcttgccctttgccgtggcgacgtgtacttggacactgatttccttggcaaaattgacaacacaaacaagttctacatgtggaacttgaaaaatgtgagtgaccctgcaacgtttaattataagactagagagttgttgagccagcttgctcagaaaacttatgtgatgaataataaattgtatgcaactggagaggtaaagcttgagaattcagagacactttatgggttgactcagtgcactagagatctttctagcagtgattgcaagaagtgtcttgatgatgcaatcaatgaactcccaaattgttgtgatgacaaagaaggaggtagagttgtgagtggaagctgcaacttccgttatgagatatacttctttgttaaggagtaa

SEQ ID NO: 58652 - DNA, 345 bp, Glycine max
  Peptide Sequence Number=SeqID_175430
atgtctgctcagggtctgagagcttcacagctcgtagtccctttgaaaataatcatcctcaagctcatttacaatccctattcttcaggttttgtggcagcctcaatgggtcatttcgaggaccagagaacctacgaccttgctctttgccgcggcgacaacgtgttggcctcagaatgcaaaacctatgtctctgatgcaaccaaagaaatccgcaatcgctgcccttacaacaaaggtgccaccatatggtatgactactacatgttcaagtacttggacactactgatttcaccggcaaggttgacaacacaatcaagatctatatgtggaacgtgaacagc

SEQ ID NO: 58653 - DNA, 291 bp, Glycine max
  Peptide Sequence Number=SeqID_175431
atgaaggaagacatagaagccatcattgaggctgagatggagttgaacaaattttttagactaaaggatgataacaatgtcctttatgatgatgaggaagatgtggcgaaggcaatgggatttcctgatacatggatctcccttatgatgagatgtgttagcatagtttcttttgcaatgagggtgaatggaagccctcatagggagttccaacctcaaagggaattgagacagggagaccctttgtcaccatacttgttcattttatgtgttaaggcctttccactttga

SEQ ID NO: 58654 - DNA, 516 bp, Glycine max
  Peptide Sequence Number=SeqID_175432
atggaccaagtgaacggtctagccttgtgtcgcggtgacgtcaacgccacaaactgcatggcttgtgtcaatgaagcaaccaaaaagcttcaagagaggtgctcaaagaagaagggggcaatagtatggtacgattactgccttctcaagtactcaaatgaatacttctttggtgaaattgatgagaagaacaagttctatatggttaacatatacgacgtggatgacccctctactttcagtgataaagtcaatgagttgctaagtggtttgtcttataatgcttctcaaactcccatgttgtatgccgtaggggaattgcaactccaagagtcaaaaacgttgtacggtttggctcagtgtacaagggacctccttggccctggttgtaagaagtgtcttgatgatgctattagtgatcttccaaattgttgtgacggaaagcaaggtgcacgggttgtgggtgggagctgctatgttagatatgaactataccctattgttgaggacccctag

SEQ ID NO: 58655 - DNA, 414 bp, Glycine max
  Peptide Sequence Number=SeqID_175433
atgcccttcctccgccacctttaccttggcggcaacttattctccgaccagatccctcccaagtacgacacctggcaacacctccagtacctcgccctctccggcaacaagctctccaacaacatgctctccggcgaacagagtctgacgttggagaggatggtgatggaaccgactacggcgtcgccatggcggtaccggagaggaagtagtagattctggagcaaggggccttcgccattcgaatcattgggaaagccgagggtgttttcgtccaagtattatagagggatgaagtcactattcttctggaggaggggttttttcccgttgtcggagtcgagcgtgaggtacaatagcagggggagctcgttgcggcagagcaagtcgatagcaagtccgatgtttctgtag

SEQ ID NO: 58656 - DNA, 315 bp, Glycine max
  Peptide Sequence Number=SeqID_175434
atgtttcattctcaagggtttttcaaaggaagtgtaaaaacatccaataatggtttccatgtcagaagagatgcaaagataggctcaaactaccaaggagaaggcttagaattacggttacctcaaagaaaccgcgaaggaaggattggaggcttcattctctaccgaatcctcgagttgagtttgaagattccgctccaattaaattgttcttctccgtgcgatgatctaaaggcaagcaaaggcagctcatggcggtcaccggtggtcagtggtggtggaggaggaggttggggatgttggggaagggtttaa

SEQ ID NO: 58657 - DNA, 652 bp, Glycine max
  Peptide Sequence Number=SeqID_175435
gggccctcgccttcagagggttgcacgccctcgccttcagagggctacatgccctcgccttcagaggactccgcgtcctcgccttcagagggctgcatggcctcgcgttcagaggactacacgtcctcgccttcagaagtcttcacgtcctcaccttcagagggctgcacgccctcaccttcaggggccacacgccctcgccttcagagaactacacttcctcgccttcagaggactacatgtcatcgccttcagagggctacacgccttctccttcagagggctacacgccctcgctttcagagggctacatgccctcgccttcaggttgcacgccctcaccttcaaaggactacacatcctcacctgcagaggaaaacatatcctcgccttcagaggactacaaatccatgccttcagagggctacccgtcctccccttaggagggctgcacgtcctcgcaatcagagggctacacaccctcgctttcagaggagtccacgtcctcgccttcaaacgggtacaccccctcgccttaagagaactactcgtccacgcctttagagggctacacgtcctcgccttcaaagggctgaacaccatcgctttcagagggctacacgccctcacctttagaggactacacgccctc

SEQ ID NO: 58658 - DNA, 219 bp, Glycine max
  Peptide Sequence Number=SeqID_175436
atggaatgccccagggctcctccacgatatgcacatgttgcgttcgagtcgtatcctcagaaaaatggaggtttgagggaacctagcaggggttatggctaccattgcattatcaagcttttcgctgcaaaattcatttcttggttggtgtattggtttgtgccaaaggtggtgtttagcattggttgtgtggtaaggagaagggttgttattggctga

SEQ ID NO: 58659 - DNA, 312 bp, Glycine max
  Peptide Sequence Number=SeqID_175437
atggacatgaattcctcaggtggtgcctgcggttggctttatgattatggctttgatatccctgttgctggttctgacttcatggcttcagactctggtggtttcagttgggggccccagagttacaacttcaagggtccttcaaatatgagcttggaaatggaatactcactggattcaactgtcatggaaaatggtccttcaaagcggttaaggactgaatcatgtgcatctggctccaaggcatgtcgtgagaaattgcgaagggataaacttaatgagaggcatgctattattttgcatattgtgtga

SEQ ID NO: 58660 - DNA, 1755 bp, Glycine max
  Peptide Sequence Number=SeqID_175438
atggtgtgtatggtgcctttcttacattcgaggggtagtgatgcttattgcacctcagtcacgtcttttcaggtacttgagaaaggggttgcagccataattggtccacagtcatctgccgtagctcacacggtttctcaaattgctgatgctctccaagttcctcttgtttcatatgctgccaccgatccaaccctgtcctccctccagtttccattcttcattcgaactacacaaagtgacttggcacaaatgactgcaatggctgatctaattgactttcatggatggaaagaggtcattgttgtattcttggatgatgattatggaagaaatggagtatctgctttgagagatgagcttgaaaaaaggagattgagaatttcttataaattgcctttaagtattaagtttgatttggatgaattcactaacttgctcaatcaatccaaagtgtttggtcctcgtgtgtatgttgttcatgtcaaccctgatccgagattgagaattttttccattgcccataatcttcaaatgatggccaaggattatgtctggcttgtcacggattggctctcagctacactagattcattatctcctgtgaatcagacctctttcagtgttctccatggggttgttggtcttcgtcaacacattccagattccagcaaaaagaaagcttttgtttctcgatggatagaaatgcaaaaagaaggattagcaaatactagtttgaactcttatggaatttatgcttatgacacagtttgggcagttgcacgtgcaattgatatattcatcaaagtacacaatactattaccttctcgtttcctgataactataacttatctcatatggtaggaattggtattcagcttgacaagctcaaaatctttgctggtggatctgatcttgtcgacatattattacaatcaaattttactggtgtgagtggccaacttcattttaattctgacagaagtattgtaagtggtggttatgatattataaatgtcaatcagatgggaattaaaggtgttggtttttggtctaataattcaggattttcagttgtaccccatacagctcttaaaaaacggaaatataacaggttttcccaagatcagaagcttggaaatattacttggcccggtggaattaccgatcgacctcgtggctgggtgattgctgataataccaagccactgagaattggagtgccaaaaagagcaagttttgttgaattcgtaactgaactgccagatagtcatcaaattcaggggtactgcatcgatgtcttcaagaaagccctagaatttatcccatatgaagttccttttgtattcaagccttttgggaacggtaaagcaaatcccaattatgatgcacttgtgaaaatggttgatgaaaatgtatatgatgcagttgttggagacattgcaattgtgacaaatcgtacaatgattgtggatttttctcagccttttgcatcctctagccttgtcatagtggctcctatcaacaaagcaagatcaaatgcttgggtgttcctccaaccatttacggcagatatgtggtgtgccactgctgcatcatttttggtggttggagttgttatatggattcttgagcaccgagtcaataatgacttccgtggtcctcctaagaagcaaattgtgacaatgttaatgttcagcctctcaacattgtttaagaaaaatcgtaagaaaacatttggctccatagtctaa

SEQ ID NO: 58661 - DNA, 435 bp, Glycine max
  Peptide Sequence Number=SeqID_175439
atgggcaaagatctcggcctcagctcgaccatgttcgggctggcggcgacgttgttctatgtcacctacgtgatcttcggcattccgagcaacatgatgctgagccgggtcggcgcgcggcgctggatcgccaccatcatggtgctgtggggcatcgcctccacctgcaccatgttcgccaccgggccgaccagcctgtacgtgctgcgcatgatcgtcggcatcaccgaggccggtttcctgccgggcattctggtgtacctcacctactggttcccggcgttctaccgcgcccgcgccaacgccttgttcatgatcgccatgccggtgaccatggcgatcggctcgctggtctccggctatatcctggcgctggacggggtgatgaacctgaagggctggcagtggctgtttctgctggaaggcattccgtcg

SEQ ID NO: 58662 - DNA, 108 bp, Glycine max
  Peptide Sequence Number=SeqID_175440
agaaattggacaattttacaaggtagtctcgctcaagggaggtataggtcgctcaagccagctcaaaccatggaaaagacgaaattttacagaagatatcttgcttaa

SEQ ID NO: 58663 - DNA, 321 bp, Glycine max
  Peptide Sequence Number=SeqID_175441
atgagtgaagaacaagatgaatctcttagtgttcatggcccttactacttgcaccctagtgaaaatccaacaatcgcattagtatcacctcttttggatcaaataaaaaacaattattggagcaggtcagttctcacggccttgagtgtgaacaacaaagtagaatttgttgatagttcccttcctcgaccggtctcaaataatagattgtatgcaacttggaaaataacaaataatctagtgatttcatggcttgtacactcagttggaacttccattcgtcaaagcatcttatggatggacaacgttgttgatatctag

SEQ ID NO: 58664 - DNA, 588 bp, Glycine max
  Peptide Sequence Number=SeqID_175442
atggctagacaaaacgaatcagtgctaagacaaaaggcaaggatcaattggattcaaaatggggattacaactcgaagttctatcatgcctatgtcaatgctagaaggattttcaatttgataaagggtctagagcacgaaggacgatgggttaaagaatcaatagagaacattccttttaagtgtttatccaatgaccaaatatcttccttggtgcaagactttgaggagatagagatcaaggaagcaatttggggttgtgagggctcaaaggcacccaaatcggacaatttcaactttaagttcttcaaagagttttggcctctattaaagaatgatattttgctctttatgaagaaattccacatgcatgggcaaagtgccttccttgaaggaaggcacctcatccacagtgccttggcggcatcccaagtggtcgatgaagctagaaggaaaatgaaaagcatggtttctgttcttataaacggaagcccaactagtgagttcatccccaagaaaggtctaaggcaaggtgatccgctagcacctttactctctaatgtggcagcggaggcactaagtggtcta

SEQ ID NO: 58665 - DNA, 210 bp, Glycine max
  Peptide Sequence Number=SeqID_175443
atgttgtgttacctgaagaaggttgtgggagaagagagtgtagtgggggcttcgaatctcagtgacactaaaagaatgaggcttggcggggcgatcctcattctcctcgaagcttttccatcagaacgttgccatcgttatttacaagacgagaagggtatcaaattcttccatttcccttaccttttctttctcccaaacacgacctaa

SEQ ID NO: 58666 - DNA, 345 bp, Glycine max
  Peptide Sequence Number=SeqID_175444
atgtctgttgagccaactatattgacaaatttcatagccttcaaaacttgttattctttctggaaaaaggcaaaaattgtttttgctaatgaaattcaacaattgtatgatgatgctcagaaattggccactcttaaacaaattgatcatgacatggttgcctatgtttcgaaagcccaatctgtagtggatgagttaaaattatcattggaagctgataaacttgaagacataaagacaaaacttgataatctatatatggtgttggtactacgtgggatgcatccagattttgatcatattcatgacccaagtattaactgggccaagaagttccttctttag

SEQ ID NO: 58667 - DNA, 192 bp, Glycine max
  Peptide Sequence Number=SeqID_175445
atgaggagaggagaagattcagaaggagaatggtggttggagttttggagttgttctgacactgcccatgtttttgttctgacactgccaaatatggagttggaggatcgatggatgggatgctttgggccttttcgttttttctattccagttttatgaactctggaaaacacatggacacttaccagtga

SEQ ID NO: 58668 - DNA, 1749 bp, Glycine max
  Peptide Sequence Number=SeqID_175446
atggccgcagctttggagtgctggtcgcgccgcgccaccaccaccgtcgacgaggaccacgccgtcctcatgcagccacccgaacaggacccaacaataccccaaccaagagactcttcttcttcttccattgttcacaagaagcttcaaaaactcacgcgcaacgtctccgaagccattgcttccctcaaaaactcccttaacagcagcagcaccgttagcgtcgagtcctccaaacccgacgcgcctcgcagcctcgtgtggaccaccgtcctccgccacctcatccacctctaccccggttcccagctccccgagaagttagtgtgcaacattcgcaagcactatgattccttgcctctcagttattctaaggcagggtttgaagtgaaagatgtgtttcttcacatgaagctgatggagcaagctttggaggatgagcaggccgcaattttgattcaagaggagtgtgatgatgagattcagcttcaggggtcagtgttcaagttgacatttgcttgcaactctccaatttcatggcctgcgatgtcaggtgcattggatgcttactccatttgctgcaagaagattcagatctttgagaagaaatgtttcacccttgggattgtgcttcttcttgttctgtctggtggtgggcaagataagttggtcagaacccgggttgaaagcgctctcaagattgccatgaagaggcccaaagccggtggcgtgaagctgccctttgggctttgtggatgtcaagaggagaactccaaggggagaagacttggagagattgaagaagatggatgggatgcatattgtggaaatggatttgagaatttgagccaaaagattgagcttcaagtgccattgcctagttcatcttttcttgtagtggtagatgaatggcagactattcaatcaggtggggctgagattgaaaaatggttgttgaactcagatagtcttgagtttgtagaacagattgcgcccaattcgtataaggggacatacatggggaaaaaggtcggcattgagaagctcagagggtgtgagaaagggaactcttatgagtttgagctcaggaaagatctgctggcactgatgacttgtgggcatagaaatattatgcagttttgtggtgtttgtgtagatgacaaccacgggttatgtgtagtgacaaaatttgttgaaggtggatctgttcatgacttaatgttaaagaacaagaagcttccaagtaaggatattgtaagaattgcagctgatgtagctgaggggatcaagtttaagaatgatcacggtgttgcatacagagatcttaatacgcagaggattctgttggataagcatgggaatgcttgcttgggtgatatgggcattgtcactgcctgcaagaatgtcggagaggcaatggattatgaaactgatggttatcgatggctagcaccagagataattgctggtgacccagagagtgtgactgagacatggatgagtaatgtttatagttttggcatggtaatttgggagatggtaactggtgaggcagcatattctgcattttcaccagttcaagcagcagttggcattgctgcttgtggcctaagacctgaaatccccaaggactgccctcaaactttaaagtctctcatgacaaggtgctggaacaacaccccttcaaaacgccctaacttttctgaaattttggccattttgctgcgatcaagcaactacaataggtag

SEQ ID NO: 58669 - DNA, 464 bp, Glycine max
  Peptide Sequence Number=SeqID_175447
atggcgtcctctagctccagcaagaagatccatgctgatactactgacaaagaactcaccgaacaagaagaagaactcgagcactttgatgatttcactctcgcttcttcgtgggaacggtttatttctaaaatagaggcagttttacgggtttggatgtctgatgggccaaaaaatttattggaaaaaggtgcagttctcttggaggatgccggtaatttgtacaaggtgaaatctgaaatgaagtatgccatgaaaagttactgcatggagttctattttatgactgaccctgatggaaaacttgctgactggaattttgatttgcatgatctgcagttatgttttggtgtgaaggagtttttggtgattgctcctcagagtgcaagtggcgtgattcttgatgcgccagagtctagcaagctcttgagtgctattgcaattgctttgtctaattgttcaag

SEQ ID NO: 58670 - DNA, 1099 bp, Glycine max
  Peptide Sequence Number=SeqID_175448
atggttgaaagttctatggaaatggctgaacttgaaaatgcttcgcctcatgaagctgagaagtggttgatctctctaagacttgaaggttccagtgggaatcgggttggattcgcatctgagttgtgtcttctggttgatgcattgcaagtgtcatttgaggcacaatttatggaagattttgtttcagttgaaaatccaggttctgataatttaaaatcaatggtgatacctccaccaacagtcagagaccgtgtgctgaaagaactgtttattgaggagggtgagtggactacggtgaggaagagagggagaggtaacctgagagtagtatctaccgagagaaaggatcctagacagagctacgggggagccaggcaacggcaatatgctaaccaagtatacccaaactggaggaacagagcggacataacgtccttttacttcacgaggtttccagaggaggtacacgaggcggagctatggaaccacttcaagaagtgggaggatgtgagagagatatttgtatccaaacagaggaacaaagaaggaaggagatatggatttgtaagattcaaaggagtggatgatgtgagtagacttgaaagacaacttgacaacaccatcatcggaggactgaaacttcatgtaaacataccaaagtacgcaagaggaaagctggaaaaaggagagagcaataatagatggcaggggaccaaccaaaaacagaaggaagggatgaagaccatagcaactactgcagcacataccacggtacccacaaggacgtatgcagtgatactggcgacacgctcgggtaacgcggggcaacacagaaacaaagtcacaactcaagccagacacggaggatcacattcttctattcaattagacatcccgaaggaggaggataaatggtacaagaatgcatgggtgggaagactaagaaaaccagagatattcgaaaggttggaagatgagttaacgtggattctagggtctgacgtcacgcctaaatacttaggtgatgacatggtcatcctccctggtctccacgatgcaaaggccgaagaattgatcaaggaagaaatagacaatg

SEQ ID NO: 58671 - DNA, 354 bp, Glycine max
  Peptide Sequence Number=SeqID_175449
atgggtactgtatttactagaaggttcgaagcagatcgaattggtagtcaggtcccagtaaaacttatgcatttggaggggctgtacgagttatttgtatctaagtttgcctactccacattggatctatctgttcataatttcaaagtccgatgtgcaatgaagctaacattcagaacgcttccctacgatgatgacaatatgaaagatgccaaaattagcaaatctggagaaaatcttaccggtccaatgtgcaatgggacacaatgggatgatgattgttcttggagcgagtggtattctgcagaagatcctgttaaaggtaaattctgggatgtagggacttgtatgtag

SEQ ID NO: 58672 - DNA, 895 bp, Glycine max
  Peptide Sequence Number=SeqID_175450
ggtgaccgtcgacgaagccaacgacggcagcaatgaccctcggtccgacagattccccagcggaaggttaggaacagaagatcccctgggtaatgaccaatacggcccaacccacgagaaccctgtgacagatgtcacagatgccaaccaaacaggggccacaccagacccacagacggatgttcagacatgcaacgaggggcagcaaacaccaaaacagcaagttacgctggaccaaatcgaaagggattgcgcagatacccaaactgaaatcgcagtcaacaagaaggggagaagaaaataccgatggtacactactggggaaaaaaggggagttcacacaagccctcaacctcaacaggaaaaaggaagtgactggaaggtgtattcaaggggaaaggggtgcagaaagaaatggaccccaacaaacagccaacagatctcatcgaacccagactcaaaggacctcgacccacagtctacaacaagaggaggcagcactgttgggaaacaaaaatactccaccatgaatatcctgtcctacaacatcagagggctggggagaggggctctatggggagacacagacttgagctgggaaatataccctgccatcaattcagctggtggattgttgtgtatttggaatgacggcatgtttaaggctgctgcaaagagagaactatggttatccatcaagcagattaaacaacttcatacagatggaaaatggtgtattgtgggggattttaatagcatcaaacacccagatgagaggttgaccatgtcacaaagagagggggacagcaacagtatctcagaattcaatgaatggatttcagatcttgaagttgaagaagtgccaagcgttggcagaagattcacatggatttga

SEQ ID NO: 58673 - DNA, 980 bp, Glycine max
  Peptide Sequence Number=SeqID_175451
atggctttgttactagatatgtcagcatttaaggcagcaaatccagatgctgtctttgaagattttattcggtggcattcacctggggattgggaagaggatgatgaccctgagggaagtaaatcatcatcatccagtgctcttgacattaagaagtcaaaagacagttggcctccacaagggcagctttctaagagaatgtctgagcagggaaatttgtggagaaagctttggaatagtgcacctgctcttcctgcttctgaacagaagcctcttcttgatccaaatagggaaggagaaaaggttcttcattatcttgaaactctacaaccacatgaattgcttgagcaaatggtgtgtactgccttcaaagcagcagccgacacactttgtcagactagttatggagaactaaaacaggtggagactgagatgcaacaactttatcttactatggcatctgctttgaggcctttgcaagttaattgcttgtctggagacagtgagattgttgaagacttgagacgactaactattgcttttgaacaagttgagaagttattggctcttgcagcttccctccatcgcaagcttatacaagcaccacgtgtctccagagaaattttcaacaattactacaatttttatattcaaacaacaggaaagggtttgatagaggacattggtgaaaaggagtttaacaagaaacaagaagtaaaggaccatgagagggaagttttgtcaaacatgtttgttcctcctactgcaaaccaatcttggagaaaggttttgagcatgggaaatcttctcaatggccacgaaccaatcctgagggagattattctttcgctgcgtgatagagtaagtggtaatcactatgcagctcgtagtggtagcgtttctcaacaagaaattgaaacttacagaatgtatatatgtgggacgtcgaatgacctacgagtagcactttctgttgtctc

SEQ ID NO: 58674 - DNA, 309 bp, Glycine max
  Peptide Sequence Number=SeqID_175452
atggatgccgcacttctcctattatggtcatggctcaaagttatggagaaggacttcactatgcattacaaccaatggtcatctcaactgggggagagaaaacacaaaggagaaatcctcctttcacacaagggaatatccctgttccactctggatacaactcgatgcccctccttgtccaggatccctttatacttctcagtccaactccctctaacagaattagctgtctaacagttctaagtgaaaggtctaacagaattaacagtgttctgtttttagaatctttccctcctcctatatactaa

SEQ ID NO: 58675 - DNA, 411 bp, Glycine max
  Peptide Sequence Number=SeqID_175453
atgatgttcaagcccaaggcttgggctcacaaagctaatcctttctccacctctggagcagggaagcaaatggacgactatgtggcatctcaaaaagggattgatgcccctagtgatgagaatcctaaaactacccaaatacagggacccatgactaggagtaggaccaaacagtcagaggataccctccaacaaatgaagtggtgtcatccaaactctgtgacctgtatcaagcgatccgctcctagtaagcaaacggaaaactatatggcatctcaaaaagggattgatacccctaggaagtatgtgcaagaccctaaacgcaagagactaagaaatgaatctactaaggttgttatgtggttcccaagattcagaccaaataccccaatcctcaaaggaagaacctag

SEQ ID NO: 58676 - DNA, 405 bp, Glycine max
  Peptide Sequence Number=SeqID_175454
atgggtttggaagacctacctttgattggtagaagatttacttggactagaccaaatggaaaatccataagtaggatagaccgtatgctagtatctaaggagtggttagatttatgggaaggaagcagcttgcgggcacttaatcaaaagttctcggatcattgctcattggtgttgaagaaccaaaagtttgattggggacctaggcttttcaggtttctaaattgttggcttgaagatacggattttaaaacatttatggaagagaagtggagggttttcaatgtcataaggaggggagcttttgttctaaaagaaaagttgaagttgcttaaaaaggagataggggcatggaacaaaaaccaatttggtgacttgaatgcaaagaagaagattttggagtag

SEQ ID NO: 58677 - DNA, 765 bp, Glycine max
  Peptide Sequence Number=SeqID_175455
atggaggaggaagatgggctatggaagaaggattgtttatgcaaaacatgggaaagggtagactccatggactcacactcatccatggttggcgaaagggaagggccaacaacatctcagtttgaggaagataaaaggaaaaacgctttgtccgatggtcatagttttggaccagcaactcaaaaaatagcatggtgtcactctctacccaaagcatacaatttgggttatggaacaaggaagttagttggtaatggatcctttgaattgggcctttattaccatgtggaaaacaacatgggccaaccaccttttggagaatgttttgcttacaaagaagagcaggtgcaactagaaaatacttcacaggggaggatatatgattttggacccgaacctataacagacttacaactacaagccaaggtcgatgatatttctcatgagcatggttcaaccttacaaagcagtaataagacaacatcaggggaacataaacacaacaaaggaagcgtggggagagacttcaagacaataagaaaaacttactttggtggaagaaaaaaaatgataaagacaaaacagatttgggatatggctcaaaagctgggtatcacctttgatggaagctatgtaggcattgttacaagtttcatggaattggatagaagggatattgaggcaatggaaggaccaagcaggaagctgatctatcatgaaggagatcaatttagttgtaaattaagattgcaactcacagcgtaa

SEQ ID NO: 58678 - DNA, 363 bp, Glycine max
  Peptide Sequence Number=SeqID_175456
atggcaatggaaaacaaatacaattttgacatttttttcacccccgatctacaccaccagagctgcgggaggccactcttgttctcaagagatattttttctgccctgcagagacttccaaattgtgccatgccacatgtaaatgcctgcggtcaacacatgaccatcctcagaagagttggacctccattacagtggaaagttgaggcccttgatggaatgaacaaatatgttttacaaccatggtatgatttcctcagggctagtgatttgtcacacggtgatgagctctccttctattgcaggatctacgacaaaatatgggaaatggtgatccgccgcaaaattaattgggatcgttaa

SEQ ID NO: 58679 - DNA, 456 bp, Glycine max
  Peptide Sequence Number=SeqID_175457
atggacaacctcggtaggcaacaactacaggacaacaaaggaagtcacatttcatactattgtaataacaaagtacgacaagttcatgatatgcataagggtaatgtggagcccattgcttatgataagatctggggacctcaatacaatgtttcacatacttaccctatcaacatggaatactgcctgaaaggagtatacaggacttacgggagtggacgcgatcggggcattggtcgtcgtcatatgttaagggtgggttctacttctgggcaacagtacttaaaagagaccaaaggtcaaagggttgcaagggaaaagaactgcaacggtattgcaaccgacaaacacacatgcaaggatacatttcagggccggagaaactacggtaaaaacgcaaagcactatcaacagccaaaacaagttgcagaaaatgaagacggagccaacaaataa

SEQ ID NO: 58680 - DNA, 822 bp, Glycine max
  Peptide Sequence Number=SeqID_175458
atgacgacgaccaatgccccgatcgcgtccactccctcacctcgcagtttgtcgcggtgcacacctgtatactcctttcaggcagtattccatgttgataggaactacattgaggtccccagatcttatcataagcaatgggctccacattaccctgcttatgtgaagatagaatacaatggagcgccgcacatcattaagttgttgcctaccgaggttgtccattttgttgatgcttcaacaccatttatgactgtgcaacatagcagtggcgttcgtgacatatggaccatctccatgcataatggtgaacaacatgtcgatgacccttggaacagattgttaacggacaatgacttgatgggtggagacgaggttcaaaggtgccaacaccgcaacaatggccatgtcgtagtaatttattatacatatgacatgacattcccacagggccacaagattttgttgggatgtactaaagtccaccattttgaagcaacattggatgttcacaaaaactacatccaagttccattaaactaccacatcaattggtatcccaaatacccgacttatgtggtcctcaaagttaacagcgacaacagttattttgtcagagttcgaaggtatgaaaacaaaatatattttgcagatgagatcaaagaattcagaagcgccactttccatgtctccttctcaactcctgcttatagacaactatcggcaacgtcacccgtaacaacccgacgccatgtttttaccgtggatgttgatgaagatatgctgcaacagaaaaagccattggtaggtgctgtcagctga

SEQ ID NO: 58681 - DNA, 576 bp, Glycine max
  Peptide Sequence Number=SeqID_175459
atgctaacgtatttgttgtttatatgttccctaaaggaatgcattgaagccgttgcaatttgggcaaatttacgtaagggggttcattttacaaagtatttacgggatggggtctgtttcaaaacaaataacggagggggtttgttttgtggaggaaaccgccattgccactggcggcatggctcaacccgccattgccagtggcggcaaaggaggagagaagggtgtattgccagtagcagtggcgagatatggccacgtaggatggagagaggagggtgtcgccaatgggaacggcgacacacccagctgatggagagaggagggtgtcgccaatgggaacggcgacacacccagctgaagccgccagtcggactggcgatatggcccacgccattgttagggcagatttttgcttcagaaggatgcagtaatagcaggtctaggcatgtggagagtaaacttccaacgacacttaacattcaaaaatttaacattgaagagagtatcagtgtggaagaggaagaaaaagtttcatttgaagagagtattttgaagtttgctgcttctatatag

SEQ ID NO: 58682 - DNA, 255 bp, Glycine max
  Peptide Sequence Number=SeqID_175460
atgtcttgccagctagttgcgataactttcttccaagggatatgcttcaaaagctccccaaatttgagcttcatttctagatcagagttgtccttgctccataaaactgttcctgtgatgaccatgatggagacacaaatgaagatacagatgatgatgatgaagacagatggaagccagagccaaggccctgtaaaccacctccaccaccacaaaggaggagtgaccctgaaaatggacagtggatggggataa

SEQ ID NO: 58683 - DNA, 519 bp, Glycine max
  Peptide Sequence Number=SeqID_175461
atggagacacaaatgaagatacagatgatgatgatgaagacagatgaaagccagagccaaggccttgtaaaccagctccaccaccacaaaggaggagtgaccctgaaaatggaccgtggatgggataaagaagaaatatccacaagacccttcttggaaggagaaaaggatgacaaaaattctagaaaaacagacctagggacaaaagtttcaaccaagccttacataatttctacggaagtagggtcagaggggaagcttaaaagccctagccaagccgaagaagtcttaaacgggcagacagataatgctagagcccagaataatctcttgaaaaagataaatgagaagattgacaagatatgtactaaagtgagcacaaatgatgaaaatttaccgtatctgtccgaaaggatggagaaacaacaccatcaactttccaaggaaatttctcgccttgaagaagaatggagaaagaccactttcgaagcacttctgatgctaaagaaaaggaaataa

SEQ ID NO: 58684 - DNA, 294 bp, Glycine max
  Peptide Sequence Number=SeqID_175462
atgtattctgaaaagagtgaactagataaggagactgaatttgccttaaatcagacagattcttcagacgaagaatctccagcttctccaatcctcatcttctctatacaagaagaacaatcgatcaagccagcgattcctcaaccatgtgttgaaattcaaaagccccgccagaagttggagagtttaaagaaaagatttcctccctatgcgcagacagtcatgaagatttcaaccatccatatcctttatggaaaaacaaagaatactttgttgatctaccattctgattaa

SEQ ID NO: 58685 - DNA, 534 bp, Glycine max
  Peptide Sequence Number=SeqID_175463
atgggggtcctcgttcaattcctttgcagctacgtaactcttcctctctatgctctcgtgacacagatgggttcaacaatgaaaccaaccatattcaatgaaagagtagccagagctctaaggaattggcaccacacagcgaagaagcatgtaaaacaaaatcgtggattgcaattgcaaaccccttcatctgcaccctcaaccccaaatcaacctaagtctcaggccaatctcctacgccagtgccatagtgaaatgtacacctatcccacttctccaataagatttgactcagaggcccatcatccctatgagattgactcacccccatcctccatctcacatcaccataagtccaaggtcaatgcttcttcttctagttctattcatcaccatgaaatagaaatgggtcacctagatcatgatccgccacaaaatatcaatgagcccaactcaacccttgtgagttcaggttcgaatcaacacgagattgatattgaacacaagaaagaattttcttttgagaaaagatga

SEQ ID NO: 58686 - DNA, 570 bp, Glycine max
  Peptide Sequence Number=SeqID_175464
atgaacgcacccatcattgaccccttacagggagattttccagaagtgatagaggagtatttggaacatgggtgtatgaaatgtattgcctttaatcgtcgtggtacacttcttgctgctgggtgcaacaacggaagttgcgttatctgggattttgaaacccggggcattgctaaagagctacaagatgatgaatgttcatctccaataaccagtgtctgttggtcaaagtgtggtaatcgaattcttgtatccgctgctgacaagtcattgttgttgtgggatgttatgagtgtgtccttgccgctgccactggtctctcttcaccacgccactgcgccgcagttccaccttgccactgcagcattcacatccttcgacacgacatcgccgcgatacatcaaacaacacgccatgtacttgccgtggcgagggtcacacttggccatcatggaggatggctcaaaggcactgttggtgatctcagcaacggaaagctgctcatggtatgctttctcagcagtgataacaggggcgtatgaggaaagcatgaaatggatcctaggataa

SEQ ID NO: 58687 - DNA, 303 bp, Glycine max
  Peptide Sequence Number=SeqID_175465
atgaagttaataattactcagaatactaatgatggtcaaatccgaacagagatttatgttccagaacctgagtttcaaaaggtaaaagatttggttgatgactattttgcattagaacaagactggaaagactacaatgctcaattgatagagaaattgttacacaaaaagagatatcattatcatcacccagtatacggaagtctcaccaggtcagaagtgtgttgtaaagagagtaatcttcaggataaggatgaccgcaatcctatcctcgtcatcgtgtgccacgtgtcagtcgtttag

SEQ ID NO: 58688 - DNA, 402 bp, Glycine max
  Peptide Sequence Number=SeqID_175466
atgggaggaaaaaccttacaggaaacacctacatgggctgtggccgttgtttgcttcgttttgctctccatatctatcttgatcgagcacatcctgcatctcattggaaagtggttgaagaagaagcacaagagagctctatgcgaggctactcgaaaagatcaaatcagagcttatgctattggggttcatatcgttgctcctaacgaaaaggttgcggggacatttcacccctgtccaaaaaaatactataagaagaaggaagagtcagagcaccgaaccaataatggtcggagattactagcggcttttctcgattccgataaccaaaatcaccgtcgtattttggcggcgggaggtggtgacaactgtcccccggtatgtatgtattcatgcatttga

SEQ ID NO: 58689 - DNA, 674 bp, Glycine max
  Peptide Sequence Number=SeqID_175467
atgttgcaaccttggaacaaacctcgttcttctccattctcatgttcttccttcaaagacattcaaaccctcttcttagatgaacccaccaccaccaaacccaaaccctctatcttccaccgagtcacactcgccaactcgctcctccgcgcctggtcaactaaccccaaaatctcctcacgcgcccacgacgaagccccacgcgccgcccaaccacaccctccgccgtccattctccgctcggagcagcgcgtggtggtctacttcacgagcctgcgcgtggtccgcgccacgttcgaggactgcaaaacggtgcgttccatcttgcgcgggttccgcgtcgcgctggacgagcgcgacgtgtccatggactcgggtttcctctcggagctccgtcgggtaacgggtcacaaatccggtttgaccctgccacgtgtcttcattaacggaaggtacgtcggtggggccgaggagctgaggtggctgcacgagagtggcgagctcaagaagcttctcgagggcttgcccgcagtggattcgcacctccgtgtgtgccacgtgtgcgacgatcataggttcgtgctgtgcggggagtgttccggtgcgcgcaaggtgtacgcggagaaaggtgggttcaagacgtgtacggcttgcaacgagagtggcttgatcag

SEQ ID NO: 58690 - DNA, 383 bp, Glycine max
  Peptide Sequence Number=SeqID_175468
ccacagctctaagaaagtggcaccacacagcgaagaagaacgtaaaacagaaccgtggattgcgattgcagactccttcatcaaccaggcccacgaccccgaaccaccctaagtctcaggttaatttcctacgccgctaccatagtgaaatggccccttatccctcgtctccaataaggttcgattttgaggcaaatctttcttatgaggtcaatgctactagttcttctattcaccaccatgaaatggaaatgggtcaccaggcctatgatcatgctgaaaaggttgatgagcccagctctacccttgtgggtttaagtctgcctcaacgcgagattgatatcgaacatggcaaggaattttcttttgataataaagaatga

SEQ ID NO: 58691 - DNA, 498 bp, Glycine max
  Peptide Sequence Number=SeqID_175469
atggataaatgccccaggtgtcaggtatcacggtataaagtgaaggatgatgatgaatgtagcagtgacaaaagcacaaagaaaggcccccaacaaaggtgttatgatgacgcaaaagaccttacatggcatgtagatgggagaaactgcgatggaatgctctgccatctgactgattcctcccagtggaaaaagattaattgtctgcattcggattttgggatagaggcaagaaatctaagtcttggacttaccactgatagaatgaatccctgtggcagtttaaaaaatgacatcgatgtttatcttagtcccttgattgaagacttgacaaagttgtgggatgagagggttgctgtgtttgatgggtatcgaaatgagacattcaagttgcatgcaatgctattttgtatcattaatgactttccagcatatgggaatttgagtggatacagtgttaagggtcatcatgcatccctatttgtgaagaagacataa

SEQ ID NO: 58692 - DNA, 174 bp, Glycine max
  Peptide Sequence Number=SeqID_175470
atgggtcaaagaattcaacaacgaggagaagttgtaaagggagtgccactggtgcaacctggggatgacctcttctggtttaacaaacctcgacttattctctacctcattaatttcgtgctctttcagaatgcttttcagcttgctttcttttcatgggctgcggacttgtga

SEQ ID NO: 58693 - DNA, 297 bp, Glycine max
  Peptide Sequence Number=SeqID_175471
atggatgattacgtaatctcaaaaaagacaaaggtgtatttagtaaataggggggtgcaaatagcaaccagacctacttgggccttccaggaagttctccagaaggcggtgccttctaaaggaagcaaccgaactcacctgggcgagctgggtggcaaggtcctccctcattttcctataaataggggaaggagggaagaacaaaaatgttcaaccctcctggtatctgagaatcacttaaaattagtgagaaaaattgtttccgtgaagaaaatccaagccgaggcgctttcgtaa

SEQ ID NO: 58694 - DNA, 279 bp, Glycine max
  Peptide Sequence Number=SeqID_175472
atggggaaatggctgacgacggagtcttccggaagacccgttaggggttcttccggaagttccggaagaacgttttccggaaagtttccggaagaagtgtttttccggaaacttccggaaaacgtcttccgggaactttccggaagaagtggttcatccggaagaattccggaagacgcccacttccggaagaagtttcaaacttccggaagacctttccggaagaacccttcttccggagtgtttccggaagaaccacttcttccggaaattttatga

SEQ ID NO: 58695 - DNA, 931 bp, Glycine max
  Peptide Sequence Number=SeqID_175473
atgcaggcgcggcaacgcgacggggtgctgacggtggcgcttggtgaggggctgcgcagcgggacggcggtgaaggtctggtggccggagcgcaccatgccgaagacggtgcgtgtggatggacgtagcgtttccgacttcgatgccgaaggtagcgccgggccacgcccggcgtcattgcagcgtcggcaaccccggcggattggtctgcgactgcggcaccgcttcctcggccacattccatcgcttcagcgcctgcgcataggtgccgctgccgatctgggtattcagcgcctgcgtcaccgcgtcggccaggccgctgcccttgcgcgtggtcaccgaaatcgccgcagcgttcggccatccccctgggaacaggccaacacgccgcaccttgccatcgcgtgccgaataagcgccggtggcattgggctcgaacgagacatcggcgcggccggtgatcaccgccaagcggccgaccaccgcgtcgtcgaagtactggtactccaccggcttcaggccggcagcgatgttctgctggtcccactggcgcaggatctggtcctggttcgtgctggcgcccaccaccaccttcagcccggcgacgtcggcgggcttttcgatcttctgtatcggcccatcggcgcgcgtgtagatgcccagcaggtcgtagcgataactggagaaatcgaactttttcttgcgctcctcagtgaccgtcacattggagagcaccgcatcgtacttgcccgattccagccccagcggccagtcaggccaggccaccggcacgatcaccagcttcaggcccagcccatcggcgatcagccgcgcgatgtccggctcgatgccgaccacgtccttgctgtcggcaccatagacggccagcggcagctgccccggatgagtggcaacggtgaatgtgccgggg

SEQ ID NO: 58696 - DNA, 507 bp, Glycine max
  Peptide Sequence Number=SeqID_175474
atgttgggtagaggtgaggaagaactcacgagaatcccatggctgattttgactcaactaatagtcctctttctcctcttcgcactcctctttttcttcaccctcctcccttttgatcccgaccacgaccaccacaacaaccttgtcaccgccgacattccccctccgacgacgacaacctcttccactctcttctttttcgacgatattcaaattcaccagattgactcaccgcttactaatcacgattcgtcgcccactcatccaacaaccaccctgcagggtggccagaacctattaataaaaggcgaaatagcaaagggtccaagttcaagcatgagaagggaagaagagattatggaggaggaggaggaagcttcatcattgtattttcacccttgtcattattttcagttagccacggtagcatttctcaaatgtttcggcttggattctacatctgatagcccttcaacacgaagacataggaaaagaaaagaaagctga

SEQ ID NO: 58697 - DNA, 1236 bp, Glycine max
  Peptide Sequence Number=SeqID_175475
atggctttgagatctggtttctcttccttcacctacgacgtgttcctcagcttcagaggctcagacacacgccatggtttcaccggcaatctctacaaagctcttgccgacaggggaatctacactttcatcgacgatgaggagcttcagagcggaaaggaaataacaccaacgcttctgaaggcaattcaagagtccaggattgccatcaacgcgctctctataaactacgcttcttcctctttttgtttagatgaacttgcaaccatccttggctgcgccgagaggaaaacactcttggttttgccggttttttctcacgtgcgacaccgggaagatagttatggagaagcgttggttaagcacgaagaaaggttcgagcataacacggagaagttgcagaaatggaaaatgactttgtatcaagtagctctcttgtctggctatcatttcaaatatgggtacccaccttaccgatcttccttacactatggatatgagtatgagttcattgggaggattgttgagcgggtctgcatcaagattaatcttactcatttacatgttgcgggttatttggttggactagagtcacaagtgccaagagccatgaagcttttggatgttggatctgatgatgttggatggcttatccaaggcaagtttaaagagtacattttcctcaccacggaatattttcctcatggatctactcgacattccgtaatgagtgagcttttgtatccgtatcgaagaatccggttatctactcggcagctattgaatcagcaaccgctgcatcttcagaaaattagagggattccgccaaatttaaggtttttctttgcaataaactgtaaatccttgacttccttgggtacaagcatgttcctaaatcaggaactgcatgaggctgctggaaccactgtgtttcatttcccggaagcaaggattctagagtgtcccaaacccatggtgttcatcaatgtcaaagctcatgaatctgtcattagttggggtgatgaaatggttacatatgtgggtgtgataaagacttcaatccttaaagcaagcggagtccatgtaatcaaacaggaaagaagcacggaggatattcaatttgctggactagagtgttcatttggggtgcatgtaggagttcaaattgttgtttcagtggtgacaaaaaaaacaaatttgcttgtgttcgagaaactgaatgctataggattgtga

SEQ ID NO: 58698 - DNA, 1084 bp, Glycine max
  Peptide Sequence Number=SeqID_175476
tgcttgtgctgtgcgccatgattgtatcgctctctgcgtctcgcacacagaaatgcagagtgccctgcgattccatttccaagcttcaaacccaggcatcgttgttccgcacacgaaccacgctttcgccaccaaccttaactcacaccgtaccctctcctgcacaaaacgccgttcccttcccctgtgctccttcaccgcacaaccttcgaaccaaacctccgccgttggatctccatcgcttcaacactggaacctcaccaatcgccacgtcaccgttctcaacgtctttgcctgcgcgacggcgatatgtgcaacgtggctgttttgctccgcgattccgacgctcctggctttcaagaaagcagcggagtcgatggagaagctcatggatgccacgagggaggaacttcccaacaccatggccgcaattcgattatccggcatggaaataagtgacttaaccaccgagctcagtgatataggccaagagattactcaaggtgttagaagctccactcgtgcagttcgcttggcagaggagaggcttcgccgcttgactactgtgccttcttcagcttcgttgcaggggatgacgatcaacccgaaagctgagtatgatgatgatgagcctgcggtggccagaacagcgaggggcgtgagagagggtattgtcaagggtcgtgctacgttgcagatgtttttcaccctcacccgattttcaaggtttgctctaaactttatcactgacgaaaaatggttgatttgggcacgtcctgcgcttaacggtggtcttggtggcctcctcattgctcgtgatgttgtggatgtgactcatccatctttggcagaagttggatcaagacccaggcaattagagaaagctttcacaacttgttccattaagtggcatgtcaatctggtgaatttgaatatcgtcgaaaaagaagagagtggaagaggttgtcgtcgtcggagggggaatgtcggcggtgacaaggttgttgtggtggtcgtggtcgggatcaaaagggaggagggtgaagaaaaagaggagtgcgaagaggagaaagaggactattag

SEQ ID NO: 58699 - DNA, 345 bp, Glycine max
  Peptide Sequence Number=SeqID_175477
agagtgaattttaaagtttggaaagcaagtttctcttcaacggaagctcagtcctcccaagccggaatcttagactccggcggctaccactgctgtggactacgtctccacaatcaagaaccaacgcggcaagatatgtattctcgccatcgacgacggcggcatgcgaggaggtatctgaagcagaggagactgcagcaacacagaacaaagaaagagagggagcttgaaacccgagagagaaagagaagagaagcatccaaagaaataagaagagtggcacaaagaccatcgcagagagaaagaagaatagcagttatagtaatacctatgagaggagcatag

SEQ ID NO: 58700 - DNA, 219 bp, Glycine max
  Peptide Sequence Number=SeqID_175478
atggagttgcaactgacacgtgtcaaggaaaacaccggttgggttggtgacttggctgctgagttaacgggaatcgcagtggtgtggtggacaacgttgttttccctctatagtgctgttgctgggtcaattatacgtttcactgcacttggcttcatgaacaacatattcggttttggagaaaaaaagatgccacctatttcattttctttcttttga

SEQ ID NO: 58701 - DNA, 3459 bp, Glycine max
  Peptide Sequence Number=SeqID_175479
atgtctgaagatagcccgcgagttggtggattttcagctggtctggctgtgatattgaacggcaaggatggtaagaaaaattcgccaaaaactcggcttatttcttgctgtgacgatttgggtcagcagtcggtggagcgaaccctggagtacgtgtttggcctcccgaacagatcactcaattcattgactggtccagttgatcgtgatttcattcggtctgttattaggaatgatttttcaagatataatgggaaatcaaattattcttatcgggaaagagacgggatttgtgttaacggtaaaaatggcaatgggcctgatgttataggcctagaagaatccagcatctgcggtgatattaaagtcatcaagtcaccttttcttatagagagcatggcgatgttcagtagtgccagggctagtgcttgtgtttggaaaggaaaatggatgtatgaagttatgttggaaacatctggcatacagcagcttggttgggccactctttcttgccctttcactgaccataaaggtgttggcgatgctgatgattcatatgcttatgatgggagacgagttagcaagtggaacaaggatgctgagacatatggtcagtcatgggttgttggcgatatcattggatgctgtatagatttagatcgagatgaaataatattctacaggaatggtaattcccttggggtcgcattccaaggaattcgaaaattgggtcctggttttggttattatccagcagtttctctctcccagggtgaaagatgtgagttgaactttggagctcggccctttaagtatccagttgaaggctaccttcctcttcaggctcctccctctaggagctactttgtcacccaattgctgcaatgctggtcaaggctgttggacatgcattcggtggaacgagctgagcattctttagctcggaagttgagaagagtgaagaggtctgtttcattggaagaaattttccatccagcttcttattccatatgtgaggaattattctctatccttgaagcagatgttgggatcacagagtatatggtctggggtccaatgttgtctttcatgtttgaagtttttggtttgcatgcaccccatgattacttaagcttggataaagtagttgaggttctgctacaatttcaaggatcacatgtgctatttgaacacatcctaaatgccctttcctgtggttgtaaaatagcctcattagttctaactgagtgtccttactctggctcatattctcaccttgcattggcatgtcatctactaagactagaggaacttatggtgctttggtggaagtcaccagattttgaattcttgtttgaaggttttctttcacgaaagactccaaacaaacaggatcttgactccatgataccaactgtttggtggcctagttcatgtgaagatgcatctcatgaaggtaacatgatgttgacaaccacagctttgtcggaatcaatcagcaagattgaggagaagcatagggacctttgtcgcttagtgatacaatttataccacctacgaatcctccccagttacctggagcagtatttaggacatttttacagagccttctactgaagaacagaggagcacaacgaaatattccaccccctggagtttctagcaactcggttcttgtttcaatttacacagttgtactccattttctatctgagggatttgccttgggtgacatctgtggctggttaaagacctgcaaaacagatgttggtttccttcatagaggtggtgaacaaagttttcctgtacatttatttctgaaaaatgatccccatagagctgatatttccaggcttgggggatcctatagccatttatcaaagctacacccaacaattggtcatgaaatggaagtgattcaatgggatgaaggttgcatggatagtgaagaaaccagggtcactcattcaaccaggcagaagccatgctgttgttctaattatgattctgattttacaaggaacttcaaggttccagctaaatacctggccaaaggttctcgtggtcattgtagctctattccagaaagacctgctcatgtcgctgctgaatgcagtgatgggagtttgaatgatgagataactgataaaccaagctccagtgatcaatctgaacctgagtatggttaccgccaaatgcatcatatgaaatctgtaccaaaggatactaatatgtctacagataggctaagagaagaagagctagttgatgctttgctatggttgtatcatgttggtcttgctctgaattttaagcaggcatcatactacatgactcatcaggcacagtcaatttcccttctggaggaaactgataagcaaatcagagaacgagcttgcagtgagcaattgaagcatttgaaagaagctcgtaatgaatatagagaagaggttattgattgtgttaggcattgtgcttggtaccgcatctctctattttctcgatggaagcagagaggaatgtatgcaatgtgcatgtgggttgtccagttgctactggttcttagcaatatggattcagtgtttatctacatccctgaatattatctggaagctttggtcacctttgtagttacccatttcaatgatccaagaatatcaagtgcagatcttagggatcttcttcttcagtctatatctgtcctggtgcaatacaaggagtatttggctacctttgagagcaatgaggcagccacccaaagaatgccgaaagctttattatcagcatttgataacagatcttggattccagtgatgaacatactcctacgattatgcaagggttctggttttagtttttcaaagaatggagaatcatcttcgtcgtcagttcttttccaaaggttgctaagagaagcttgcataagtgatggagggttgttttcatcttttctaaaccgtctgttcaatacactcagctggaccatgactgaattttcagtttctgttcgagaaatgcaagaaaagtaccaggtaatagagtttcagcaaaggaaatgctgtgtcatatttgatctttcatgtaatcttacaaggattctagagttctgcactcgtgagattcctcaagcattcctctctggaccagacacaaacctccgaaggttaaccgagttggttgtgtttatcttaaatcacattacttctgcagtcgatgctgaattctttgacttgtcccttagacggcatagccaacctccagaaaaagtaaaccgaggcatgatattggcacctctagtagggatcatcctaaatttattggatgctacaagttcagcagaatatcgagaaaacaatgatcttttagatgttttcgcaagcatggactgtccagatactgttcagtatggattccagtatcttctggattataactgggttagttgttgtcacccttaa

SEQ ID NO: 58702 - DNA, 1173 bp, Glycine max
  Peptide Sequence Number=SeqID_175480
atggaaattatgagttctaaattgactctcaataaagaggaatgctcaggtgatattgttacagaggtcggtcattcaagacatgctgaaatccaagatcaatcaattagtcatgattctcctgaagaggtcagggataactttcatatagattcaattggtcgcgattctcctgaagaaggcagggataacattcataataattcagttagtcttgattctcctgaagagagcagggataactttcatatgggttcagttagtcgcgatctcactttgtatgggcaatcaaaccaaatggtttccttttctcaaatatcttttggatctgtaaataatcctatggttagtatttttgagaagtccatcatggagcagtgtcgttctaatgacctcaagacacttgaacttggccttaaaatgaaggaattgaaattgaaagaggatgaattggctctcaaccttgattcgaataatttaaacagatcaaaattagtcatgggagaatcaaagcaatctttcaaagaggaaaagttcaagacccagttagaagatacgaggcatggtgaactcaaaaagaagtgcattgactgtcttattactggtttgcttatcatgtcatcctcacttttgtatggtgcctatgtttattcctacgagcggattactaaagctactgaatcatgtacaccatcaacccaggcaagaatcttcctcctggtggactcccaagtcaatggtcttattcaattcaaagttgcatattttgtggtgtcaagttcaagttatgagccgaatggcatttggcatcttgatgatttttgctgttgcatatttgctcttgcagcggtcgaccacaacatcacagactatgccagtcactttcatccttttaatgttgggaattttttgtggctattgtggcaagctatgtgtagagacattgggtgggagtggtattgtgtggctcttatactgggagattatgtgcttgctgcatttcttatctctttgctggacatccgctttgttccggatccttcatggaccagtcactccatcacaaacaatggaggagaatacaattcttcggtattggattcgcagagttctgttctatgctgctatgcttgtgtttctaccgttgttttgtggtctcatgccatttgctag

SEQ ID NO: 58703 - DNA, 817 bp, Glycine max
  Peptide Sequence Number=SeqID_175481
atacactgataatgttctgggaagaaacattttacctgagaggaaagtagagctatatcacactgagctagatgactttaaggccgagctggagaggcataatttccataaacacctcaccaatttagccgatgggagcatagatctggctttggtgaaagagttctatgcaaatttatacagttttgaggaccatccaccaaagcagtccagagtcagagaccatttggtgaaaattgatgctgacagtctcaacacatttttagagacacctgtgattactgaaagccatcctgggaagattctcaggaaggatctgactacactagctcaggtgtggagtgtcctctcatactccaacttggcccccatatcacatacttctaacttgaaagtggatggagctaggctcatttttggcctagtttctcacttggatatgaacataggagcgctgatctctgaccaaatgacctctatagcccagtctaacacctctagacttggcttccctgctctaatcaccgcattatgtagagccagagaggttgtctctgacagcctcacctttgagcgcctgagcccggtcattaacctggcctacatcaggaagaactgttggaaccctgaggatctaacagtctctatccgaggggctaggagggcgagggaaaggcaagctgagcttccttctacttctgcagctcctactctagcatccacttcagcagccccttctgtcccagctcaaacaaattatcagcgctttgaagccatgctacaaagcattcatcagggacaaatcattttactatag

SEQ ID NO: 58704 - DNA, 321 bp, Glycine max
  Peptide Sequence Number=SeqID_175482
atgatgcatgcacctgactcaacactcaaatgcaatgtggtacgtaccaacaacaaccaaatctcaggaaatagcctaagcgtgtccacacgacactctcacttagggaattgtgcagagtttgtcgagaccacccgggtgtgcacgttgtcacaaaatgcccttttgcgggagcgtgaggcgaggctcacgggtgcgctttccaaaggaggaaagatgcgcgaagtcgccaccaacgtttatttgtggaaaacgtcggaaaaaccgaaggaaaccggtcaaaaagaatattccaagttcgggagttgtatttacgtttga

SEQ ID NO: 58705 - DNA, 702 bp, Glycine max
  Peptide Sequence Number=SeqID_175483
atggaacgccagctgcgccacttcgggctgcaacccgcccgcttcgaacaaggctatgcgctgttgaaggcccaacgccggcaaccgttcgatctgctgtttatcgactataacatgccgcgcccggacggcctgacgctggccaggctgatccgccgcgacgaacagcggctgcaacgcccgccttgccgcatcgtgctctgttcggcagacgtgcaggagtttacccgcattcctccggggctggtggcgatcgaccacttcctgaccaaaccgatttcactggcggcgatcggccaggtgttggctcagcaaccgcaggtgcaggaagcaaagtcagtccttactgacctgcggcaaacgctggtcgaaatggcgggtggcgatcgcgccatgctgcagcggctggcgcagacgctcggcgatacgctgcggcaagaccggcagcggctcgcggacgccgtcgccgcgaacgactggccgcgcctggagcaggcggcgcaccgtatcaaaggcagcctgctgatgctgcaactgccggaagccgcgcagctgtgccagcagctggtggaaaccgcacgtcggggcgcgcttgccgccgccgcttatactaaattaaaggcgttagtggcgcagatagtgccggagctggacgctctgctcgccgccgccccctctttggctatgcataaggatgaataa

SEQ ID NO: 58706 - DNA, 117 bp, Glycine max
  Peptide Sequence Number=SeqID_175484
atggagggattcgcgatgaacacgctaagcgcgcctactgcgcttagcctgttcatcgcaactgttaaaatttttcaggtttctgatgatcacgctaagcggaccatgtcgcgctaa

SEQ ID NO: 58707 - DNA, 469 bp, Glycine max
  Peptide Sequence Number=SeqID_175485
ccttccagaagcttcattgcctaacaggccaacttacaacagcaagccccaagagactcagcataaggatgtagaggccaaagttgagtatgtgaaaagattgtatgaccaagtgaaggtgcaaattgcagagaagaatgaaagctatgccaagcaagccaacaagaaaaggaaggaagtggtacttgaacccggtgatgatcctggacatttgagggcaaatgttttccaagaaggagggaatgatgagaatcctaaaattggccaaatacaggctaaaggcccaaatggagaaggacaaagcccccgagtggagaaggatgaaggcccagaggcagagacactatcaagactattaattacttatcaaggtaatccttgtggcgtctaccctgacttatcttccttcactggaagtggcgtcatccaaatctccgtagcctgtatcaagcgatccgctcctagttag

SEQ ID NO: 58708 - DNA, 540 bp, Glycine max
  Peptide Sequence Number=SeqID_175486
atgtctcttggaaattattttctgaaaatcccctctggagtcattagacttaatccatcaactgaaagatcctttaactatttctcgtccttggaaaaattctttttgcaagaatcaactgcttctttcattcttcctcactacgaggtcgtgaaaacaagacaacaattggtacctctaagccctacactgggggcaacgaaagggcaccatgcaaaaacctcaagcgaacctaggggccagattagaagtattcacccaataggttccctcctacaagtctgcatttaccaaaatttcacgacaaaggttgcatgcatctgcatccccaaaaattatgttaactgcatagatttcctacatctaatgtccaaatcttgtggatttgggatgaccggccctctcgatgagtcgatctcttgctttctcataagggtggacccttgggtacttgtacctatcaccttcagaggactacacgtcctcgccttgagagggctacacgccctcaccttgggtactagttaccctcaccgttga

SEQ ID NO: 58709 - DNA, 1029 bp, Glycine max
  Peptide Sequence Number=SeqID_175487
atggtggcaggtgataaggttgaggtacaagtcgctgccaaaggcggcggctctgagaataagtccaaactggcgatgctgaaccctaatgaaagcattgtcgactgggtgttggaagtggtgccagaaatgggtgctggctggtgcccgcccgggatgctgggtataggcataggcggcagtgctgaaaaagccatgctgttggccaaagagtccttgatggcaccgattgacattcaggaattacaagcgcgtggtccacaaaaccgcattgaagaattacgcctggagttgtatgaaaaggtcaatcagttgggcataggcgcgcaaggtctgggtggcctgaccacagtgctcgacgtgaaaattctggattatccaacccatgccgccagtttgccggtagccattatccctaactgtgccgcgacgcgccatgtgcactttacgctggatggttccggtgtggctgaactcacgccacccaacccggatgtgtatccggatgtgcactgggcaccaagcccgcaagctaaacgcataaatctggacacggtgacaccggcagagacgcaaacctggaaaaccggtgataccttgttgctcactggcaaaatcctgacggggcgtgatgccgcacataaacgcatccagaccatgctggccaagggcgagccgctacctgtggatttcacgaataagtttatttactacgttggtccggtcgatgctgtgcgagatgaagctgttggaccggcaggcccaacgacggcaacccgtatggatagctataccgatatgatgctgaataccggcttgctaggttccattggtaaagccgaacgtggcgaagaagcactggctgaaattgccaaacacaagtcggtatacctgatggccgtcgggatggaagccatttatgaatttgaagtggtggatatgccagtgacggtagcagtgagtgcggatggagagtctgtacaccagaccggcccggcacaatggaaaaaaacgatcgcgttgcaagcg

SEQ ID NO: 58710 - DNA, 171 bp, Glycine max
  Peptide Sequence Number=SeqID_175488
atggaatctcaacctccacagggagtactgtctccataccatacaccaaagagaagggggttgcccctgttgaggtacgcactgaagtgcgatacccatgctaagcatacgcttcaactgcgccattcatctgaggtctgtaaggagaagaattgtgatgctcaatcttga

SEQ ID NO: 58711 - DNA, 213 bp, Glycine max
  Peptide Sequence Number=SeqID_175489
atggacgcgtggggtgctaataccttccccgagatggctccgagaaagctcctcgccaagaggtccaagaaagacatagttggagagggttccagtgcggccccacaggctaatgtggacttcaatagtcacaggtccaaagtgccgaacaccaatagcggtttgagaccatcaatggctggtcgttcctcagagagacgaagagtttgctaa

SEQ ID NO: 58712 - DNA, 399 bp, Glycine max
  Peptide Sequence Number=SeqID_175490
atggttaaggaggagtgcaaggaggtaagtgtctcctccaagaggttaactatgaaggaaagaaattttgaaataaagacaaatattaaagaaattttccctcttagacaacctccacattttctcctttttaaaaagacacgtgttagcattgccacacctcttaggcttgagtttattcctcaagtacaggagttattggatgagggtttggttcgcaagagcttaaatccttgtgctttgttggtgcccaaaataggcattattaggcaccgaatccctaaaataggtggtgttgagggaaggagcccagagtatgaagaacctcgggatttgaggtcaaatcctttacaaggtggagggaatgatgcaatcctatcccgcaggggcattgggtag

SEQ ID NO: 58713 - DNA, 381 bp, Glycine max
  Peptide Sequence Number=SeqID_175491
atggcgccttctctcacctcttctcctttgtcttccgctgcatctccatgcctccatagaagccccacaagcaagcttccatcatctaggaagaggaaaagcactgcttccagacctcaagctcagtatgataccaggagattccattctttggacgcttggaatagatacatggataacattctcggccggaatatcctttcggagaaaaatgtgcagatttatcatactgagtttgatgagtttaaagtggaattggagaggcggccaaccatggtagcttctcagaaaagatctgatgacactggccctgagatggagtgtcttctcttactccaacctagctcccacaccccacacttcagatctaaatatggatag

SEQ ID NO: 58714 - DNA, 742 bp, Glycine max
  Peptide Sequence Number=SeqID_175492
ggctacacgccctcgccttcgtagggctacatgccctcaccttccgaggactacatgtcctcaccttcagaggactacacgtcctcgccttcagaggacaacacgtcctcgccttcaccttccgaggacttcatgtcctcaccttcataggactacacgtactcgccttcagaggacaacacatccttgtcgtcgccttcatagggctacacgccctcaccttctgaggactacatgtccttaccaccttaccatcagaggactacacgtcctcgccttcagaggacaacacgtcctcgccttcaccttcgtagggctacacgccctcacctttagaggactacacgtcctcgcctttagaggactacacgtcctcaccttcaatgggctacacgcccaggccttcaaagggcgacatgtcctgaacttcagagggctgcatgcccttgcctttagagggctacacgtcctcactttcagggccagtaatttccttttatcaattcctgggccaccccctgatcctggaggagggccaactatgcaaatacaaccagaggaggaggctatcgtgcagctactgtgcatattagggcaagatttcacccatgccactgcaaagagacaagtgcagatcatgcgcaccaacatgaccactcttacacagatatggatgacgttgctacttagcagcattctttccaacaaccacaatgccgatctccccctgtggaagtattag

SEQ ID NO: 58715 - DNA, 177 bp, Glycine max
  Peptide Sequence Number=SeqID_175493
atgatatgtccattacgatgccatgaagggatgcatgatgtaatcaaggaacaagccagaggaatatcagcgaaaatgcatcgccaaaagaggaaaactctatatgaggcttcaccgttatcaagcgagtcagagaaccaacatgacgacaaatcgacctccactccctattgttag

SEQ ID NO: 58716 - DNA, 809 bp, Glycine max
  Peptide Sequence Number=SeqID_175494
atagttttcgaccacctcccacaagaagtgagaaagaactcaaagaagaatggaagaaggctggtcctcggcctcgaccccttcccccacctccaggcagaccaatttaccagcatgaaaaagaaggttggtatgcttggatcactgagacccctacagaacctgatccttcccctatggatctgaggatgaaagcacacaggttactttgggatgcgcttgattacattgtttctttggaagcagatgccttctttcctggatttaacaatgatggtagtggatggccagatatttcaagccttgtcatggggcatcgactgtacgagacagcttcttttagaacataccgaccagacaggaaagttgttgcggaacttttcaacacgactcgtgaaaatctgtaccatcctaagcataattggacgattttagtacaggaacatcttaacaaaagtttgactgaagaaggcctcataaggcaatctcttttgtcaaaacctgcaatgttcctttcacatccatttccagaatgttcctgtagaatagcttcaaccaaggctactaatcatgtcaaaggtgagaatggccaggttctatatggaggtgaagatatatgccccaaatggatgcaacatgctaatgacgcaggtaaattggagaaagaaggcgtcaaatcccaagatgaagggctggcagactatgaaagtaatgattttgttgatgaatctgaatctgacaaaaatggtagcaaaaccagtcagactccactctgggatcaagatgaggaaatggatccaaatgactaa

SEQ ID NO: 58717 - DNA, 246 bp, Glycine max
  Peptide Sequence Number=SeqID_175495
atgaataataataatgaaagaagaagaaaggaacccccaaaatctgttcagctcctcagaaaagttaaaggggggggggggggggggggggaaggagccgcagaatattatttgaggcgaggaaaaatcagggagaagacgaagggtggagaaggaggtgctaaacgacggcgtagcgtgatagcgccaatggaggtggtgtttgtgagatttgggagtattggtttggtggatggaaagggataa

SEQ ID NO: 58718 - DNA, 222 bp, Glycine max
  Peptide Sequence Number=SeqID_175496
atggccatgggaagtttttttgcagctgcgcctgccgttgctgctgctgttggattttatttcatagacagaaactttgtcaaggaaatcaaacaagggtcatctgtatccaatctaaaaatgctagcagaagtgaaagaacgagcgaagacccttcaaaagccaaaattggcgccacagcttgatggtttacattgtttcgaaaccttggtgatgaattga

SEQ ID NO: 58719 - DNA, 984 bp, Glycine max
  Peptide Sequence Number=SeqID_175497
atgtcaaaggctttgtataacttatacctcacaaggccacaacacagattttgttggtttccaaaggagcagagcaatggtttcatatatgcaaaagtttttggtgggtttgcaaagataagatcatcgatccccgatcttgttgctatttctagaattttaaatgctactcttgtcattcctgaatttcaagaaagtactcgctcaaaaggaattagctcaaagttcaagagtttttcctatctttataacgaggagcagttcataacatttctcaaaaatgacgtaatcattgcaaagagcctgccagaaagtttgatggaaaggagaagaagaaatgaaattcctacatttaagcccacaagttcagcttctctaaacttttacatcgaagaaattttaccaaagctaaagaaatcaaaggttatcggattaattattgccgatggtggagctctgcagtcaatactcccacttagcatggctgagattcagaggctaagatgcagggttgctttccatgccctgcaatttcgtccagaaattcaaacgcttggccgtcggatggttcacaagttaagagcattggggcaaccattcttggcattccatcctggcttattgagagaaaccttggcatacaatggttgtgcagaactttttcaggatgtacacactgaactcattcaacatcaaaggtctcaaatgataaaggaaggaattcttaaggatgaattgaatgtggattcacacttgcgaagagaaaaaggtctatgtccgatcatgcctgaagaggttggcattctccttcgagtaatgggttatcctgccaaaacaatcatttatctggctggctctgaattatttggtggtcaacgtgctttaattcctttgcgttccatgttcatcaatactctggatcgcacttccttgtgcagtgagaaagagttgtctgatttggttggacctgaaacacctcttcct

SEQ ID NO: 58720 - DNA, 417 bp, Glycine max
  Peptide Sequence Number=SeqID_175498
atggattccggtgtccagggttgcatcttagccactttaattctccacgacgaggaaattccagtcaccgctgagaagatcaacgctctgttgaaggcctctaatgtctccgccgagtcatactggcccagcctcttcgccaagctcgcccagaataagaacatcgaagacctcattttgaacgccggtggtggtggtggtgccgccgctgccgttgccgctcccgccgccggtggtggtgctgccgctgcagccgcacccgccgccgaggaaaagaaggggcttttgatttttgttactgagcatacttatagttgctctaccaggaattttgtgaaacttgtaattggttattttttactggaagaagtgaaggaagaaagtgacgatgacatgggtttcggcttgtttgattag

SEQ ID NO: 58721 - DNA, 336 bp, Glycine max
  Peptide Sequence Number=SeqID_175499
atgccattcttaactaagataaaatgggttgttctttctgtagtcactttatctctggcatctatcatcattcatctatctttgacaaagttgtgggctgttaacatagtgcagtataaagcactacctagtcttcctgaagaatttggatctgtgttgggtagacaggttataaagaataagaagctatggggttccattgagtctttggaaacattacagcctaatgcaaatgctagaagcaattattctgttgatggagccaatttagtgggtttgtcaattcttgacaattttgccaacaagagaaagtacatgggtgactttgcaaactaa

SEQ ID NO: 58722 - DNA, 561 bp, Glycine max
  Peptide Sequence Number=SeqID_175500
atgagcaccatcctcgctgagctcttctgcatgggcgccaccctctccaaaacaaacaagaaatgccccaggaaacagaccaaccctaaaatcttcctcgcttcctccgccgccgccaccaccaccacctcctctaaatcctccgccccagtccccgcccccgccgctcccagtagcgacgcgttggtgccggaagtggaagatgaacccgccgcggatcgcgacgaggacgaggaggaggggaacgagttgaaggggttcacaaagagcgaggtgacggtaattgacacgagttgccccgggtggaaggtggacaagttcgtgttcaggaagaacaacgtttggaaagtcagagagcggaaacctaagaacaggtttctcgccaagaggaaaagtaactccactttcgcacctcgtgaagttgatgtcaatgcaattgagaactccaatggcaatgtcggtgttcttttaactgttttgtcatctcacgcacggaagtttttgcttggatttgacaatgatttgatgaagaataaaattgcaacttctagtgcaatgtag

SEQ ID NO: 58723 - DNA, 879 bp, Glycine max
  Peptide Sequence Number=SeqID_175501
atgaggccacattctagcgctccagtccaattaaagcaaaaagtgggaccagaagagttgacaaccacagaaatgagacacaacgaccctcccctctctgccggatctcctcctcacggccctctccgtctgcttcctagtctcctcctcgaagccccacatcggtggttccacccgctgccccttcccgcgtcgattcctcaaaatccccgccatgtccctcacaacgataacaacaacctcaacatcctcgaaaaacaacaacaacctcaattcccacctccctccccgccgccacagcttcgcgtccccgcagtcgctctcggaatggctgaagccgcggctcccctcggaatccttcgcctcggcgaaacctccctcgccgactccacccctccggttcgaaccgtacacgtcgtcctcgtccgcgtcaccggaaaacacggcagaatcctagtggagtcgcatcaggatttgtcggacggcagcgttaggaagcgcgggaggcccctgtcggagaagatgaagcccaacgaggaccccgaatccgccgccgtcagagggattatggaggagctcgggtctgcgattggtggcggagcgaagaattttgaaatcgatgacattgtcaccattgatcccaattcgtatgagatgagggttgaagagcgagattcgggttcttacccgggtttgcccggttgctacgttttgcacacgctcagtgccaccgtggagtgtttgcccgaaggggatttttgcacctacgaggtggatgagtatggaggggtttttgaagacaaaattgttgcggatgaagctgtttctgttaagaagcattattggacttgggttagtgctgattccatcggcacttga

SEQ ID NO: 58724 - DNA, 183 bp, Glycine max
  Peptide Sequence Number=SeqID_175502
atgggtagtggtggtgggacgggaatcattttcgaaactctttcaagtgcactcttcaagaaaagtttgcttgctaaacctgcaaccaccttaaggtatattatatatcacgatctacagaaagggcaaatgagaaaaacggttttagaaagcatatacagatcaagtgcttctggtatttaa

SEQ ID NO: 58725 - DNA, 1125 bp, Glycine max
  Peptide Sequence Number=SeqID_175503
atggagaattcgaccgaagaatcccatctccgatcggaaaactccgtcacttacgagtccccttaccctatctacggcatgtcattctccccctcccacccccaccgcctcgccctcggcagcttcatcgaagaatacaacaaccgcgtcgacatcctctctttccaccctgacaccctttcggtaactccccacccttctctctccttcgaccacccttaccctcccaccaaactcatgttccacccccgcaaaccctccccttcctcttcctccgacctcctcgccacctccggcgactacctccgcctctgggagatccgtgataactccgtggatgccgtctccctcttcaacaacagcaagaccagcgagttctgcgcccccttaacctctttcgactggaacgacatcgaccccaaccgcatcgccacctccagcatcgacaccacctgcaccatctgggacatcgaacgcaccctcgtcgaaacccaactcatcgctcacgacaaggaggtttacgacatcgcctggggagaggccagagtcttcgcctccgtctccgccgacggctccgttagaatcttcgaccttcgcgacaaggagcactccaccatcatctacgagagcccccaccctgacacccctttgctccgcttggcttggaacaaacaggacctgaggtctcccactacccctgttgcggagttagagaggcaccgtgggagtgtgaacgccattgcttgggctcctcatagctccacgcatatttgttctgctggtgatgatactcaggctcttatttgggaattgcccacgcttgcttctcccactgggattgatcccgtctgcatgtactctgctggctgtgaaattaaccagctgcagtggtccgccgcccagcccgattggattgccattgcttttgccaacaagatgcagcttttgaagttgtgcaaactagtttgccctcctcatgttttacttgtggcgaaattaacgatgttcaatttgtctgttaaagatggatttttaacctgttgtgaagcatttgtctggggctatttcaatgacaaattcccgttctctgtacactgtcgcgctcctgaattgctgcttctttaa

SEQ ID NO: 58726 - DNA, 2214 bp, Glycine max
  Peptide Sequence Number=SeqID_175504
atgccagaggtggtgatgagtggagagaagaactcactgggagtggaggggcttgcgaaggaagatagtggtggaagtgggagcaagggtggtgctgctcatttgaagggctttatgaggtgggagaagttcttgcccaagatgattttgagggtgctattggttgaagcagatgattccaccagacagattattgccgcgcttctcagaaaatgcagctacaaagtggctgctgttcctgatggcttgaaggcgtgggaattactgaagggaagaccacacaatgttgatctaattctgacagaagtggatttgccatccgtatctggctatgcacttctcacattaattatggagcacgagatttgcaaaaacatccctgttataagtatgatatccaagataaatgttttagctgctatggaattttccagctttgttaataatacctcaatgatgtcttcccaagattcaattagcacagtatacaaatgcatgttgagaggtgctgctgattatcttgttaagcccattagaaaaaatgaattgaggaacttgtggcaacatgtttggagaagacaatcatcaaccacaggcattaatggtccccaagatgagagtgttgcacaacagaaggttgaagccactgcagaaaataatgctgctagtaatcgttcaagtggtgatgctgcttgcattcagagaaatatggaattaattgagaaaggaagtgatgcacagttatttgaagacatttgtagcaaagacaaagaacaacaccatcaaagctcttgtacgaagcctgactgtgaagctgagagtggccctgtcgataacatcgataacatccaggaattttctccgctgaaatgtggggaagcgtatccaagtggaacagagacacaacaggttgaaacaagcattcgcttaggccagacattaatgatgcatgccagtcatgctggaggattaaatgtgagcatctgcaaaaatggtgaggcaagcacaactgatgctgatccagagcattttgggaatggcatcagtggtgaggctcatgacaatcactatgttcaaatgaactcttccaaggaagccattgacttcattggagcatttcatactcatccaatctgcaccctgaaaaattccacagttaattgcacgggcaagtttgacctttctcctcaattggatctttctctgagaagatctcgtcccagcagctttgagaatgaactcactgaagaaaggcacaccctgatgcattctaatgcttcagctttcaagcggtatactaacaggcaattgcaaatctcgacgcctgcagtgttaattaacttctctgatcaacaaagacaacagatagcaaattgtgaaaaaaacatctcacgcatcgctactggctgcaactcagatagttcaacacctagtatgcaaagatgtatcgtgtctccaactacagtccaatcaaaagaacctgaacttgcaacctcacactcccagccagggcattctctcccaattcctgtaaagggtgtaaggttcaatgatctatgcacaacctatggttctgtatttccttcagtgtttcgtgcccagtcaggttcaccagcaatgccaagtccaaattcagttatgctccttgaaccaaactttcaagtcaatgcattttatcagtcaaatatgaaagagagtagttcagagcagctttatgaacctggtggtccaaatggaaacaccacccaaaaccacattgtgtacacacaggagcacaaatcagaaaatgcagaagatcaaggacatatctctcctaccactgatcaaagtgtttcaagtagtttctgcaatggaaatgcaagccatcttaacagcattggttatggaagcaactgtggaagtagcagcaatgttgatcaagttaacactgtctgggcagcttcagagggcaagcataaagacctcacaagcaatgcaaactctcatcgatctatccaaagagaagcagctctaaacaaattccgcttgaaaaggaaagagagatgctatgagaagaaggttcgatatgagagcagaaagaaactagcagagcagcgtcccagagtgaaaggacaatttgtgcgtcaagtgcatcctgatcctcttgttgcagaaaaagattgcaaagaatatgatcattcacatatttctgacacactggagaggagagcatga

SEQ ID NO: 58727 - DNA, 339 bp, Glycine max
  Peptide Sequence Number=SeqID_175505
atggcccccatgttttcttccatcttgctcaattgcccttcgaagcttaagctcactattgcttccccacaaagctcctcgaaacttgtttcagccccattcttccttttgggccctctttgtttctcgttccaatacttcggcggtggccacactgatgtctctcagtttgtcgcactctttccggaccttgatggccgtcatcttgaacttttccttgactgcttgtgccctagttccacttttagggcttgtacctcctcactctcctcaggggtttcagcctcttcctcacttgaggtctttagcttcgggagccaatccaacccttgcgtctga

SEQ ID NO: 58728 - DNA, 480 bp, Glycine max
  Peptide Sequence Number=SeqID_175506
atggagagtccgatcattgctattttggccgatgcctatgacactttcgatcgaagatgcgaaaagagtggcgcaaggattgtttgttgcacaccagctctttatgtgtggctagtcttgcacttctttcgtcatgaaggtagacccgtttgtcccatacaaggtcaccgcttgtgcgccgagaaagggaaggaaaactgggagcaactcttggctagtgtggtagggggatccattaattggttcccccaatggaaggaaggaagagccacggttttatcctcatgtgaaggattctcaaacgtccccttgatgggaacaagggcttgtatcaattataatcccgtccttgccattagacaacttggctaccccatgagaggagcaccgtcggaggaaagcatcacacctttcatcgcacggggtttcagggacccaatgggaggatacttcaaggagtccgcaaggcatggggcatag

SEQ ID NO: 58729 - DNA, 504 bp, Glycine max
  misc_feature (18)..(18): n is a, c, g, or t
  Peptide Sequence Number=SeqID_175507
atgcacaaagaaattganatctacgtggatgatatgatcgccaagtctaaaaccgaggaggagcatctcgtcaacttgcggaaactattcaaaagacattataagtactggctaagattgaatcctgccaagtgtacttttggggtcaagtccagaaaactgctcggctttatcataagccagaaaggaatagaggtggaccccgacaaggtgaaggccatccttgagatgcccgagccacgcactgagaaacaagtccaaggtttcttgggatgcctgaattatatagcgagattcatattgcagctaaccactaccttgcttgtgccacccgtgccccgaagacccctcattctatacatgaatgtgttggatgagtcgatgggatgtatgctggggcaacatgacgagtctgggaagaaagaaagggtcgtctacaacaactactctttgcttgaaaggacatgttgtgccttggtgtgggcaacccatcgtctaaggtag

SEQ ID NO: 58730 - DNA, 801 bp, Glycine max
  Peptide Sequence Number=SeqID_175508
gcaaagtttgatatcgcagaagctacgaaggttaagacgaaggttatgtcaacagtagcaacgagatggcggcaatttaagtccacattgactagcaaatttgtgtttgctaagagtgaaggtcaacaaatgcaggatgttgtgacaaaatatggactagatcctgaagcgtggaaacaatttgaagaaactcggctcacacataactgggaggactccttagaagagcaggtaacgcaaggttcgtttgtaccccatggtcggcaagacatactgaacactgccattgggcgacctgaccatgggggtcgcattcgggcagcaggctcaggtgtgactattactcagtactacggaagggcatcaaggacatgcagcagctcgtccacatccatcagccaacaacaactagatgaagttgttgcaaggcttagggaagacatgactggtcagattagggaagaattgaggactcagctagaagaggaaaataaaatgagcttggaaataatgaccaatgcattgaaagaggctattaaaaaagagttgtcaaataaaggatccccagagtcgctccaaattcagttggacatacaacaattaggtgcgcgtgtcagcactaagggaagtaatgttgttatcaatgtccagccttcacaagaacatcatgctgatgccataccattgatgggactgtatgtgcagcgtaaggatggtacactaaggttggtggccatggggaaaataatggagggggattcaatcatacacacagtggcatatgcagatgatgttgtcagg

SEQ ID NO: 58731 - DNA, 180 bp, Glycine max
  Peptide Sequence Number=SeqID_175509
cgagcattcgctaagcgcgacactcagtggctaagcgcgaggaagaatccagaagaagatgagctggcagtttcactgagcacaacgctccaggtcatcaagcgcaccgcttcagctcattcactaagccaaaatccacttatgcgcgctaagcgattcagatttgtgctaagagcatga

SEQ ID NO: 58732 - DNA, 639 bp, Glycine max
  Peptide Sequence Number=SeqID_175510
gtcgactctagaggatcccacagaggactacacgtcctcgccatcagagggatagacgtccttgccttcagagggctgcacgtcctcaccttcagaggactacatgccctcaccttaagaggactgcacgtcctcgccttcagagggctacatgtcctcaccttcagaggactacacgtcctcccctttagcgggctacacatcctcgcctttttagggctacacgccctcaccttcagcggattacacgtcctcgccttcagagggctacacgccctcgccttcagaggactacatagaactcaaggtcctccgcccttaatgcttaatcgaggcccgcactcccggttaagggctagtagtttccttttatcagttcctgggccaccccttgatcctggaggagggccaattgtgcgagcacaaccagaggaggaggctatcgcgcaaccactatgcataccggggcaagatttcacccgtgccgctgcaaagagacgagtgcggatcatgcacaccaacataaccactcttacacagatatggatgacgttgctacttagcaacattctgcccagtgaccacaatgccgatctccccctgcggaagtatcagttggtctgtgctgtcatgacatag

SEQ ID NO: 58733 - DNA, 174 bp, Glycine max
  Peptide Sequence Number=SeqID_175511
atggaagaaagagaacggaagatcttcagaccagataaattttcggcaagattgccattcaaggtcattctcgactggcgatatcccaccccacatgaacaaaaaggaagagaccgaaacacccagcttcctctccaaaaacactaccctcgagaaaatcctattgatccgtga

SEQ ID NO: 58734 - DNA, 240 bp, Glycine max
  Peptide Sequence Number=SeqID_175512
atgactttacaagctcagggttcagttcaatcaatcaaaaacaagctcaacatgggtgcaagggattcatcattcatgaacaagagattcatgcaaaaatcggtactcaatgctagtcgttctctcacagttaaagatcacacactcaccgggttgtgtgatgtgatcctgactaggagcggatcacttgatacaggctacagagatttggatgatgtcacttccagtgaaggaagataa

SEQ ID NO: 58735 - DNA, 408 bp, Glycine max
  Peptide Sequence Number=SeqID_175513
atgcaatctcagggacttgcagtgcctcctgagcctctggttggtccctcaggtcctcgagtgagcacaaaggggagttgtgttgatccctcaggaaacgatcctcaaacgggtgactctgacaggtgcggcttgtacatagaagcagatcctgcccgcctggttgccatggggagagtttatgagggatccactgttgttcataacactcctttgttaactggccaagtaaaggtgagtgtggaggaggttacagatgcagatgctccaattcctgtacccactgatgaggtttccttagtggggcaggcacttcacaccttccttgcttggccgacacatctggtcaagtctttatcacagcagatacttattgcccttactatatgtttcttctttttaaattaa

SEQ ID NO: 58736 - DNA, 1065 bp, Glycine max
  Peptide Sequence Number=SeqID_175514
ggacggcgcacgttgcagcacccacggcggccgaagctgttgcccgcggcaccggctcccgaagtgccggctgccgtgacacctcctgcgacacctgtggtggacgcgcagccggcgccggccgcaggcccgacgcctgtgcccgttgcacccgcaacggtggcgcctgtcgctgcgccgcctgccgtcgtcgagccagccgtcccggcggtagctcccgcgccacccgccttggccatcgtgccgttgcagcccgagcaggccaccgagcgcgcgcttggcgcccgttgcccggtggatctggccgggcggctggcgacccagggcgagctgctgatcggcgcctgccagggcaggatgccggcgcatctggccgcgctgctggtcgcgctgccccagcaggacatccacctgccgcgcagctggcgcgagcgtgaggtgcagcagaaggcgtggttcaaggcggtgccgggctacggccagcgcccggacttcatcgtgcggatgggcgacatctgggtgcgctcgctggaagggcgcgacgccgacagcacgttctatctggtgtcagcaccgttcacctgcagcgaccaggtcgccaaccgcgatgagtacggcgcggagccggtccgcgtgccagcgggtgattgccgcgaggcctacgtggcccagcgtgtgtaccaggtccgcggggacgcggcgccgagggatgtgaccgccgatgccatgccggccatgcccacggtcacggaggccgatcgtgcgcgtcagctgtcgcgtaagggacggatcatcctggaccatatcaagttgcagtacggcccggccatgcgctggttcgtacagtacccggagtctgcgcagaagggcggtccgcgcgcctacggtgactggaaccgcgagcacatcgcgttcgtggtctggactggggatcgcttcgagctgcgtgagaaggtcgcgcgggcgcagtggccctgtgacccggtagcgccgggcgatcgcgcctgtggtggcttcccggattccagaccagatctgttcgtaaccgccggtgcgtcggcgccg

SEQ ID NO: 58737 - DNA, 261 bp, Glycine max
  Peptide Sequence Number=SeqID_175515
atggtcttagaaaggagttttagaccttgtcttagttacagggttattatgccaatgatgaatgacccaactgatattgaattgtatcgattgcaaggttttgattccaatcttgttgatggtcctttgttgggcagaaaagcagaaataaggtggaatggtgagagcaagaaattcgtgagtggaaaagagatggaaatgaaggagaaagtggtgtctcaaggtgataaaaacaaatatacccatactccatgttcttaa

SEQ ID NO: 58738 - DNA, 211 bp, Glycine max
  Peptide Sequence Number=SeqID_175516
taagataattgaagcgactggctcggagctgcagaggctgagagctgatgtgaagaagctgcaaatccaaaactggaaccttgctcagtccaatacccacatgttagcggagcttaacatggggagggaaaggattaaaacgctgcagcatgaaattttgtggagggctgctttgattaaaggaaagacagtggacgtgcaggaagagtga

SEQ ID NO: 58739 - DNA, 402 bp, Glycine max
  Peptide Sequence Number=SeqID_175517
atggctgagaagacgaagaaaaaactggaggaagttgctcaatccggaagcactgaggccgtgattgactctccatctcccattagacaccacgtgaagtggaagatggcccgcaccaagaaaactgggcagatgacatctgaggcaacaaaggaaattgctgagaagattgcgtcacagggttcctttgtcccccatggacgtgaggatgtcctcactgctgccattgggcgaccgaaacaccctggtcatgtgcgtgttggtggagccggtgtgaccatcaagcaatactttggatcggctccccggacctcccgcacttcatcctccatggctccagaagaactagagcagctgactcaacaaatcaaggaccagctagaggagtcaatcacagaaaaa

SEQ ID NO: 58740 - DNA, 497 bp, Glycine max
  Peptide Sequence Number=SeqID_175518
atgaacatgcataaggagagtcctcttatcaaactccacagtttcgaccaaggccatgcatggctggctctattgcaccttctcattcacgtctcacccgcagtaaccggtcaaccggtaaccccgccggtgcaacccgacagcaacaaatccatggtcacaatcatggccattttggccatcatgtttctcatcttagtcttcctctccatttactcccgcaagtgctacgaccggcaggccccgacacgtggcatcctcgaccgcgcggaccccaccggcgcagccggtaacccgtcgcaagctgaatccaatggcctcaaccaagccacaatagaaacgttcccaagtttcctctacggcgacgtgaagggtctgaaaatcggaaaagacacgcttgcatgcgcggtttgcttgaacgagttcgaagacgacgagaccctccgcatgatccccaaatgctgccacgtgtaccaccgctattgcattgatgagtg

SEQ ID NO: 58741 - DNA, 447 bp, Glycine max
  Peptide Sequence Number=SeqID_175519
atgggctggggagtccaatacgacaacgtcaacctctcctttgaggcgtttgtgggccccaactccacgcgtccactcggcaatgccaccctcgagggcttctaccagggccgctggagggagggcctcaagcacgggtccttcctcgcttcagccaccactggtaaactcaccaccgtgctgtcattttggcgagttgattttgccacggcggtgaagtacaagaaggggaagtacagggtctggtacacacgggaccgtttgcagggaggggcaaatttggaaattgacgattcccagttgatggtaaactggaaaccggtcaggctcggtgactccccggtcgccataatcgcttctggctcacgcaagcactgtgaactaagcaattcggcgcattgtgttcttggcttgtcgctctccttggtggtgattttgtttgtataa

SEQ ID NO: 58742 - DNA, 564 bp, Glycine max
  Peptide Sequence Number=SeqID_175520
atggcgaccggggagtcaccgagcctgaccggtttccagtttaccatcaactgggaatcgtcaatttccaaatttgcccctccctgcaaacggtcccgtgtgtaccagaccctcgaggaaggacccgtgcttgaggccctccctccagcggccctggtagaagccctcgagggtggcattgccgagtggacgcgtggagttggggcccacaaacgcctcaaaggagaggttgacgttgtcgtattggactccccagcccatgttgcggttcaccagcttgagggtaaagaagcagagagtcggccacagagacgtaatcacgacgactatggttattataaagatgcaacagcagcacgcgacggaggaactagacgccgccatctacgtatggtggccggaatatgcgagagacgacgcaaaaagacgctcacagtcacggtggttcttgagattaaaggaaagagactctcaaaatggcaaaagaaattgataaaggaaagaggcatcaagcagcatgcgatggaagagggaagtaaaagagccgtgaaaatgagagatatg

SEQ ID NO: 58743 - DNA, 510 bp, Glycine max
  Peptide Sequence Number=SeqID_175521
atgacatcattcttctccttcttctctaaagtgttcaagaaattttccctcgctttcaagatcaaaacctttgaattcttctctgaggaagaaaacaacgcttcccctctcctcgacgacatcaacggtttctccctcctcaactccaccatcagaataccctcctccttcgcctccaccgctgctgccacagatcacccctcctcttcctcctcctccttggaatcccaggagcccaaaacaccgcccctgttgccactaatcgaagctcagatcatacaaacgattgcaatctcgagcctcacaattttcccttcaggtttagtcgccaatgcaattcatcctaatgttgattatgccaggaaagggcacaaccaatacacgtggtgtcgtcaatggcgaccttcaggtgaggacctagaggtcgaagcggcagaggaaggtgcagaggtttgtgacagtgcggtcgacatggagaaggagaagaatgacctcataattactttttaa

SEQ ID NO: 58744 - DNA, 109 bp, Glycine max
  Peptide Sequence Number=SeqID_175522
atgaagtgccataatgtgagagccaccgagaagtcgaaaaataggaatctcacaaacggtatcaaagcatacctcactcctagtacggtgtggttcaaggacgaaccag

SEQ ID NO: 58745 - DNA, 201 bp, Glycine max
  Peptide Sequence Number=SeqID_175523
atgtctctatctctagaatattttccattggatttaatgatgaaatatattcaattccagggagcagttgcgctcagctcaccatttgggcttagcgtgcatccaacgctaagtgcagcttcagtgcgcttagctcgacagaagaatctagtagagcatcaagatcaaggccgcgcgctaagcgcaagatccgctcgctaa

SEQ ID NO: 58746 - DNA, 2355 bp, Glycine max
  Peptide Sequence Number=SeqID_175524
atgatcaggaaacaactccaagaagatttgtgggcagctgcacaatcccatgaatctttaataaggcagaaggcgagatctaaatggattaaagaaggtgactgtaattcccgctattttcatttgttggtcaatgcaagccgcagaagtaactctctgaacggagtgtggattgatggagagtgggctgaagatccggtgagagtaaaagaggcagctagatcttttttcttccatcggtttcaagaaactgatcaaaacagaccccgcttagatggtattccttttcagaccattggacaccaccaaaatgacatgctatcggggaaatttcaggaggaagagataaaggatgcagtgtggggatgcgggagtgacaaaagcccaggcccagatggaatcaattttaaatttataaagcaattttggcatgtaatcaagcctgatgtcctgcggttcttggacgaattccatgccaatggaattttccctaggggaggtaatgcctccttcatagtcctaatcccaaaggtgaagaacccacaagccctggatgaatacagacctatatcactcattgggtgtatgtacaaaatagtggccaaaattttggccaacagactgaagaagatcatgtcatgtataatagatgaaaggcaatcagcattcatagagggtagacatttgctacaaagtgcactgatagcaaatgaagtgattgaagaggctaacagaactcagaaaccttgcattgtgttcaaagtggactatgagaaggcgtatgattcagtctcctgggattttttactctatatgcttagaaggctcggtttttgctcaaaatggatacagtggatagaagggtgcttgaaatctgcatctatttcaatactggtgaatggcagtccctcacatgagttcattccacagagagggcttaggcaaggagatccattagcacccttcctctttaatgtcgttgctgaggcctccttggagaatgttaaggcaatcaaagcaattctgaggacttttgagctggtttctggactcaaaattaacttcgcgaaaagttgtttcggtgcatttggaatgacagatagatggaagactgaagcagccagttgtttgaattgtagtttgctggccatcccatttgtttacctaggcatacccataggggcaaaccctagaaggtgtcacatgtggaatcctatccttgaaaagattcctaagaaagtgacggagaaggtagtgtctatacaacaaagattcctatggggaggtggcacagatcaaaacaagattgcgtggattaaatgggagacattatgtctcccaaaagacaaagggggactaggaatcaaggacttaaacacattcaacatcgcactgttaggtaaatgggggtggaacttattccagcatgaaggtcaactgtgggctaggggtgtggagatgcacaatagcattgagtggaggcctggacgtggagatagaatcaaattttgggaggataactggatagatggagaggaatcacttgcagcaaaatatcctagactgtacctaatctcgtgccaacaaaaccatcttattcagcacatgggaggcaataaggaagcagattgggagtggaacttttcatggagaaggccattgtttgacaacgagattccaatggctgttgattttttacaacatattgaaagcaaacctattcagatacacagaagagacgagtgggtgtggacagcagattcaagtgggcaatacatggcgaaaagtgcttacaagatgatgaggggaggtgacatagatgggacacaggatagggcttttgaggagctatggaagctgaaggtaccaatcagatatgcagtgtttgcttggcggttgcttagagacaggttgccaaccaaatcaaatctacttaggagacaagtagagatcgttaacaggacctgtccattctgcagaagcgcggaggaggaagcaagacacttattttttcattgcagcaaaatcatccctatttggtgggaatccttgtcttgggtgaacaatgtgggagttttcccgcaagatcccagacaacatttcctccaacatggatcgatagcagctgatggattaaggattaatcggtggaaatgttggtggttggctgtcacttggactatttggaagaaaaggaatgacatacttttctccaatgactctttcgacaacagcaaaatgatggatgaggcagctttactcatgtggacatggctcagaaatttggagaaggattttgcaactcattttaaccagtggtctagtaacctcagagaaggatttatgtatcagtag

SEQ ID NO: 58747 - DNA, 267 bp, Glycine max
  Peptide Sequence Number=SeqID_175525
atggtaccttttctaattgaggtactgaatgtggggatggtggctcaggcagaggccgtagaggtgccaattccttattcagctggtccacctagaacctccaacacttgggttaatcccaattctaagtcaacaggctcaggtcataatcagcccagtgccatgctcacaaacttagcctctcatgggactgctccagctggctccacttggataccagattttggaggtagttttcatgttactggtgattctcaaaaacattaa

SEQ ID NO: 58748 - DNA, 161 bp, Glycine max
  Peptide Sequence Number=SeqID_175526
atggagggagataaaggaatcgcacgaagacagtacaaatggaggcttcaatcccttctccgtctctctgacatttgggaattctatcagaacaatcggaggaaaaacttgaggaatctcagggaatcgctacaaatgtcgttatcgctgtcagaagacac

SEQ ID NO: 58749 - DNA, 246 bp, Glycine max
  Peptide Sequence Number=SeqID_175527
atggctgagagtttgacatcaaacatttttgctgggtttttggctacagtaacaacgacagtgctaaaggtgacagcgttttgcgcatgcaagggttgcaataataggattcacaagacggtgttgaagaataaaggctacagtgacaacggtggtgctgaaggtgacaacgctttgcccatcgatagtgacaacggtggtactgaaggtgatgacgctttgttcattcaagggttgcaacaatag

SEQ ID NO: 58750 - DNA, 780 bp, Glycine max
  Peptide Sequence Number=SeqID_175528
atggacaaccaacgcactcctcttcttagttgggcttactactgccacggcaagtcagtggaggagctgaagcagtctctgatgtacacaacccttgagctggaacaaacaagagcaggtgtccaagaagagctaaggaaaagagacgatcagcttctcaccctaaaggagcttctgaacaaagtgataagggaaagagatgaagctcaagagaaatgccagagactactagtgttggagaaaatggtttttcatcagcagcaccaaacagcacctgcttctggagtttccagcattgaggatgagccaagaagaggaggaattaataatgattcctccaataatggcctctcttcatctgattgtgaagaaagcattgtttcttctccacttatggagcatttgccgccacaaccgcatcatcatgcgggtccttcttctcagctgcagcaacagttgccagaatcaatgattgagttaatttcacaagataaaccgttgccagaaaagggtaagcttttgcaagcagtgatgaaagctggtcctttgcttcagacactgcttcttgcaggaccacttcctcaatggagacaccctccaccccctcttgagtcctttgagattccacctgtcaccattccttcaccaccaccacaacaacaacttcatcaagattccttcatcacctccaactgtgggagagtaagtaggaaaagggttttctttgagggcactgattctcccacacagaacaagttccaaaggattgtactccactga

SEQ ID NO: 58751 - DNA, 682 bp, Glycine max
  Peptide Sequence Number=SeqID_175529
gagggagcttgaagaagagttgggtataacccttcctaaggatgcatttgaattgatatttgttttcctccaagagtgtgtcataaatgatggaaaatacataaataatgaatataatgatgtgtatctggtaacaacacttgatccaatacctctggaagcctttgtacttcagcttgttttacatgtgctagaactcagtatgaaggaaactgaggtttctgctgttaaatatatctcttatgaagagtataaaaggttactggccaaagaagattcaggctatgtcccttatgatgttaatggacaatatggtcaactctttgatataattgaaaagagggagaggcacgtgcttagatgttggtttgacaaggtgaagagtggccattacaagtatggatatttctctccaaatataccaaaaacagcaaagaccaaacgtgtacacaaaattcagacattgtcatcttctgaatccttttatgggcaaaccaaatattcatccaacaaaccaactgttatagaatttaggtgggaaagagaaagaaacagaaaaacagagaaagaaagagggaaagagagaagaaacagaatagagaggatagaaggaaagagaagagaaacagagaggtcaaggaaatgtgcactgcaccctgtgattatcattcagtctgtctaa

SEQ ID NO: 58752 - DNA, 3666 bp, Glycine max
  Peptide Sequence Number=SeqID_175530
atgtcagtcatggggaatctatcccgtgcaaaacttttacaggtggcaagagcggtagagagggagacggtgcgtgatgggtcgggttttgccagatctagcaaaccgggtcaagggtcaagcagatttgggtcggttgggcccaataagggaggagcctcagattgggtattagtaaaggggggtaaggaagcagtaaccaagccaactgggcctgggccacgtaatgaaagattgggtcagggagacagacgaagtgggccacgagatcggggcttcacccacctttcttacaatgaaattatggaaagaaggaggaagaatcaatgtttcaaatgtgcgggcccttttagttcgatacaccaatgccctgataagcatttgaggttgctgattaccgacgatggcggaggagaggagagcgagttgttggccgtggaggtagaggaaggagaagaggagattgaaggggagatgagcttgatgagtttccaccaactcagtcaagcgcaacaaattaagccacagtcaatcaagttgaagggtaccatccatgaggtaccagtagtgattttaattgatagtggtgcgacccacaattttatttcacaacaattagccaagaaaatgaatttggtcaccacgaacacatcacctctaaacatcaggtgggtcactttacatggggtggatggtaatatgaagggcatggagactttacagagtattattagcaagccaaaaagaagtcaggaggtatgggggagagaggttggtagtaaggtagatggtggatcctttcatgccttagaggtggagcaatcaaggaaattggaacacttgttgaatttgtgtgcagatgtgtttcaagagcctaaagggttgccacctaaaaggaagaaagaacacgtgattaccttgaaggaaggggaagggccagtcaatgtgagaccatatagatatcctcatcatcacaaaaatgaaattgagagacaagttaaggagatgttggagataggaattatacgaccgagcaccagttcgttttctagccctgtcatacttgtcaagaagaaagatggatcatggagaatgtgtatagattatagagccttgaacaaagctactataccggataagttcccaataccggtgatagaggaattgttggatgagttacatggagctaagtttttctccaagctggacctaaaatctggttaccaccaggtaaggatcaaggaggaagacatacacaagacagcttttcgtacccacgagggccattacgagttcatgactcatttacaacacttagaggaagtgttgagacttttacaaacacatggcttggtggctaataaaaagaagtgtctatttggtcaaatgtcagtagaatatttgggccatttgatttctggagaaggagtagctgtggaccccagcaaggtaataagtgtgacaaattggcccaccccaaagaatgtgaagggagtgaaagggttcttagggctcacaggctattacagaaagttcataaaggattatgggaaaatagtcaaacctttgactgaactcaccaagaaggatgcttttgtatggagtgaagaagcacagctggccatgaataaactcaaaatttgtcttacctctgccccggtgctagctttaccagattttgacaaagactttgtgattgagtgtgatgcctcaagacatggaattggagctatccttatgcaagaaaagcgacccatagcttacttcagtaaggctttgggagttaggaaccttactaagtcagcctacgagaaggagttaatggcagtggtacttgccatacagcactggaggccctacttgttgggaagaaaatttattgtctctacggatcagaagagcttgaaacaattgctccaacaaagggtggttactgctgaacaacaaaactggtcggctaaactattgggctatgattttgagatagtttacaagccgggaaatcttaacagaggagcagatgcactttcaagggtgaatgaggaaggtggactatgtcagatacacactagaattcaatgggaagaggaagagatagtgaaaagagaggcagcaacagatcctcaacttcagcagataataaaagatttgcaaattgatgaaacatccaggcctgggtacgaatttagacagggagtattattgtatgaagggaggttggtgctgtcaaaacattcaacattaattcctagaatgttagaggaatttcataccactcctcaaggtgggcactccgggttttatagaacatacaggaggttggctgctaacttgtattggataggaatgaagaataccatccaagattttgtgaagggatgtgatgtgtgtcagcgacagaaatacatggccagttcaccaggagggttacttcaacccttgccaattccagaccgtatttgggaggatttatccatggatttcataactgggttgcctaagtctaaaggttatgaggcaatcttagtggtggtcgataggttatctaaatatgctcattttgttcccttaaagcatccgtacacagcaagagttattgcagaggtgtttgtcaaggaggtggtgagattacatggaatccctctatcaattgtgagtgatagagatcccatatttatgagcaatttttggcaagagttgttcaagcttcaggggactaaattgaaggttagtactgcttaccacccagagacagatgggcagacggaggtggtaaatcgttgcttagaaacatatctgagatgtttcattgctgatcaaccaaagacatggagtatgtggatggcttgggcagagtattggttcaatactagctttaatgttagcacaggtaaaactccttatgaagtagtatatggcagggtcccacctactcttacacgttgggtacaaggggagataagggtagaagcggtccaaagggagttactcgatcgtgatgaggcaataaagcagcttcgggaacagttgttgaaagcacaagacagaatgaaacagctggcagacagaaaaaggtgtgataggagcttcgaggaaggggagtgggtatttgttaaattaagggctcaccggcagcaatctgtggttagtaggattcatgccaagctagcagctaggtattttgggccctatcccatcatagctcgtgtgggggcagtagcctatagactcaaattacctgatgggtctcgggtccacccggtgtttcatgtatctttattaaaaaaggcagtgggtaattaccatgaagaggacgaattgcccgagttggagggagaaggaggtgtgttgattgaacctgaagaagtacttgctagcaggattgtacaagtgcaaggtgaaaaagtgaatcaggtactcataaggtggaaaggacagatggtagatgaagctacttgggaagacaagattgctatgagaagtcaattccctaatttctgccttgaggacaaggcagtactttctggagggagtattgatagaccccgtacacaagaggaggagccaagtgaagccttagcccatcaccatcccactgtgggccctaaggtgtggtacgtttattctagaagaaagaagaatgttgccaatacaaatgacagttag

SEQ ID NO: 58753 - DNA, 864 bp, Glycine max
  Peptide Sequence Number=SeqID_175531
atgaagaatttgacagggcttacagattcagacaaagaggctctagtttttgttgtcaaggctgcaaatgttatggatgaaattttttatctgcaggcatggtacagtaatccatctcttagagattggttgaaggagcatgctgatacatcagagtttaataagttgaaatggtcatattatcagattaacaagagcccgtggtctagccttgatgaagacgaggcatttttgtcgactgcagattcagcaataaggttgctttctaaagcaactaggatagtgaaagattggaagggtttggaatacagagcagcatttcccttgcttaaacctgctggcgctaatttctaccctccagacatggacaaaatggtaccattatgtcaagcatatgctatattgtttgcaaatttgaaaaatgataaagctattatcttgcaggagtttgaattatggaaggacagtctagaaaagcatgaacagaaggaagcaacaggctttttcagtgttattaaaaggcacagtgaatttattttagattctcatctgtctgataacaaaacaggttctcatgatctctatatagttccttactccgaagagtacaagtctcttcttgcaaaagcctctgatttattgcataaagctggagacattagcgactcaccgggtttgaagaggctgctacatagcaaggctgatgctttcctttcaaatgattattatgactcagatatagcctggatggaattggactctaagttagatgtcactattggtccgtatgaaacttatgaggataaactttttggatataaggtaagtcttaacaatgaggctttgtacagcttatacaattaa

SEQ ID NO: 58754 - DNA, 519 bp, Glycine max
  Peptide Sequence Number=SeqID_175532
atggacgaacgaatcgctgcgttagaaggagaaatcaccggaattaaggcctccttgtcgacgttggagcaaggtcaagcaactctcatagccatgtttgagaggagcttaggcaagaagaaggaaggtgacgtcgtgttgatcgaaggaacccaggagtctggatcgggaaaggaaacgaatctccaaacaggagcgtcgaaggcgggcccgagtaacgacgaggcgttattggagtttcgacaagccgttaaaaaagtcgagctacccatgttcgacggtggagatccgacgggatggatttctcgcgcagaggtttatttccgggtacaaagaacgaggtcagatgtgaaggtttgtctagctcaactgtgtatggaaggagcgaccatacatttcttcaactcgttaatcaacgatgaggaagaactgacatgggagcaattgaaagaggcgttacttgagagatatggaggacacggtgacggggatatctatgagcagttgacggagttatga

SEQ ID NO: 58755 - DNA, 120 bp, Glycine max
  Peptide Sequence Number=SeqID_175533
atggacacaaatacactagggtatagtggatggagaggagcaaaggactcacctttgcaaccaccaatttcaggggaagctcatggagcatccacgaaggatattcaagtgaatcagtaa

SEQ ID NO: 58756 - DNA, 213 bp, Glycine max
  Peptide Sequence Number=SeqID_175534
atgacgatgacaaagggggaaggagaatccgtggcatcatgtcacgaggaggttcaaagggggaaagaaaagatgtgtgggttgcgggaaggagatgagtcgtcacagggaaaggtatgggtcacggagggagctgtcgctagagggaagggcattgcaaggaagggggtgcatcgtggaggcagccgtcgcgcggaaggagggaggtgttga

SEQ ID NO: 58757 - DNA, 939 bp, Glycine max
  Peptide Sequence Number=SeqID_175535
atggacacaatggattttcaacaagagactctcgtgcacattaatgactttgttgaagatcccaacttagatcagttcatcaatttgattcgttgggagcataaagatgctatctgtaacttcaattctgagcttatcaatgaagcattcattgataactcattcctgtcacaccctgcaatcccatttgatcagtgcaatggtaattctgtgaatgtttatgatccaattagctctacacatagctccttctcttgttttgatggggaagccaaggaagaagaaggaggaggagaagaagaagataacatgggggatacttctgctgctacaacaacaagaactaaaagtcttaataataagccaataccaaaaactgataggtccaagactttggcttctgagaggaggagaagagaacgaatgaaggagaagctttatacattgcggtctttggttcccaacataactaagatggataaggcttctatcattggagatgctgtttcatatatgcatgaacttcaagcacaagccagcatgctgaaggctgaggttgaaggacttgaaacatcctcattgaactccaaaaattaccaaggattgattgaaaaccccatgagggttcaattgatcaccaacaagaagataatccagatggacatgtttcaagtggatgaaaaagggtttcatgtgaaaataatgtgcaataaaggagaaggtgtggctgcctcattgtacaagtctctcgagtctctgacaggcttcaatgttcagaattcaaacttgaccacaatttctgatcgcagttttctacttacattttcattgaatgcgaaaggccctgagccagaaattaacctgcccaacttgaagttatgggtgactgaagcttttgtgaaacaaggctttgaattcataccttttttttatgcttga

SEQ ID NO: 58758 - DNA, 651 bp, Glycine max
  Peptide Sequence Number=SeqID_175536
atgactacggctattgatctgttaattgattttcatgctcaggttcagcagtactgtataaactgtggaatatgcatgggcaaatttcaaagaatcaataccactgcgatgaatgtggcatttgcagaatttgattactcatcttctctattcaattgcttttacagaactggaggcaaggataattttttccactgcaaccgatgtggatgttgctactcaaaggtaatggaaaaggggcaccgttgtgtagaaggagcaatgcatcacaattgccctgtttgctttgagtatctttttgatacagtaagagaaatcagtgtcttaccttgcgcgcatactatacatttagactgtgtaaaggaaatggaaaaacatcagaggtactcatgtcccgtttgctcaaaatccatctgtgacatgtcaagtgtgtgggagaagcttgacgaattgattgcctcaactccaatgcctgaaacctacaaaaacaagatggtgtggatactttgcaatgattgtggagtaaactctcatgtacaattccatattgtggcccataagtgcttaagttgcaactcatacaacacaagacagatacaaggagtacctgccacatcaagctcttctagggtaactgaaatggtgagatga

SEQ ID NO: 58759 - DNA, 678 bp, Glycine max
  Peptide Sequence Number=SeqID_175537
atggcggccaacgctgtcgtttcaccgtcgccgttccgacctcagccctttctccggtcatccttctccggcgtctccgtcaagctcactccccaatccataacgctttcacgctccaagcccctcaccgtcttcgccgccaccaagaaggccgtcgccgtcctcaaggggacctccgccgtcgaaggcgtcgccactctcatccaagaagacgatggcccgacgacagtttctgttcgcatcactggccttactccggggcttcatggttttcacctacatgagtatggtgatacgacaaatgggtgtatttctacgggagcacattttaatcctaataaattgacacatggtgctcctgaggatgaagtccgtcatgcgggtgacctgggaaacatagttgctaatgcagagggggttgcagaggctacaattgtggataatcagctaatcaggctgtattgtatggcatcaaacatgcagataccactctctggccccaattcagtagttggaagagccttggtggtccatgagcttgaggatgaccttggaaagggtgggcatgaactcagtttgacaactggaaatgctggtggaagattagcatgtgaaatggtgactagagatctagaatatctttgtatatttgctttcagacctatgacaacgatataa

SEQ ID NO: 58760 - DNA, 1947 bp, Glycine max
  Peptide Sequence Number=SeqID_175538
atgtctcctgcttccaaatctaagtctaaagacaaaaaggctggcaaggaagctcaaaagtcttctgccaagtcttcaggatctggtaatgccgtggctggtgtaccagctagtgcatacaatcctttatcgggaacattccatactttggagatgtcaccaacatctacttcccaagtacattctaatggtcgttttcggaacatagatgagacggatgaacatcctgcaggctcagtggtagctggtgtggagtatgattctgtttctaacaatggtagttggtctggtgattcagaggaccataaagataaagcttctaatcctcctgctcgactagaagcagtaccaggagctgataatgacaaacgagagaaaatccgacagaagaatgaaaagaagcatcaacgacagaaggaaaggcgggcacaagagttgcatgatcgctgcactggatatattatgtcaaggaaacttgaggcacttgctcaacagcttgtggcaatggggttttctcatgagcgtgcaactgtagcattgatactgaatgaaggaagggtggaggaatcagtagcatggctgtttgaaggtggtgaagaagcagataatcataaagatacaaatataggtgggggtaatttgaaaattgatatatcagaagaacttgctcgaattgcagatctagaaatcaggtacaattgctcaaaacaggaggttgaaagagcagttgttgcttgtgagggtgatcttgataaggctgctgagtctttgagagaattgaagctggatcgaccatctggtccaccaaagccagaggaaattggtgatctttcttcccttagcagtaagcagtcaggagctgtgaatcagaatgctaggccacagacaaaacccatactttctccaaatcaacccaaaaaagatgaaaaggattttaactatgcaaagcaagcagttattctaggaggatctatggaatccagcaacagacttgtgcagcctcttaagagaatcttacccaagcccgaatgggcaaagcctcaacaagctgctgtaccagctgacaagaggtggccaggtgcaggatctaatccttcggtttcatattcattggcttcaccattgcaagtgtcacccacatctgctaagacagaagcttcttatatggctgcaggaggtgattataagagccttcaacctggatcagctagggagccagtaattgtgatgcagcgacctcaaactgtaaatgcaaagcagattccagctgccagcatgagttcatctcctcccggagtggctgccagttggtatccaactaatagtattgaagtcatgaggtccaatggctttatatctcatcctcctagtactagaagcctcagttcaaactatttcagttctaatcaactgtaccaccaacttcaatgtcaaccgcctcagcagtttgtggctggcaacagcagttcagtagatctcctagcaactaatcaagggaatagcttatggaataaaacagctgcatctccaagtcttgctgccgcttcttctcttggactcttttccaggctaggatcggcagctacatcaggggcaacttctccagtagactggagcactggtgggacaatgcaatttgattataccaacatagactggtccttggatagaggtttatctcccccacggtctaatgcattattgtttgggctttctccttttacaaagagtagtagtactctatatggctcaaatgcttctgggacggttgctcagacgacagttagatcattaccctctaatggtagcatggttcctttgcctggattgcaaaatggtgtagtatcgtctgctgaaacatcaggttctcgggattggagttctccatttgaagggaaagacctttttagtttaccaagacagtttgtttcttctccttctctgtag

SEQ ID NO: 58761 - DNA, 210 bp, Glycine max
  Peptide Sequence Number=SeqID_175539
atgttaagcttcccaatttgtttgaaaagcggaagcaccattgttggagttggttctcctgatcctccacaatttgtttatgatgatgacgaatacaaagatgtgttcttatcagatgcctattttctcactcgagaggaaaatcagtggtaccaagagcctacttcaagtccttctgcctcaccttcagttgtttctgagtctgtttga

SEQ ID NO: 58762 - DNA, 420 bp, Glycine max
  Peptide Sequence Number=SeqID_175540
atggaatctaatagtgttaggactgagtccaagcaacaaactgtagcaggaaagggtttgggtttgcagctttatcatagttactgggctactgccagtgtaaaaggagaaagctcatttggaggtatactcaagttcctaacaagttggtccgacctgccatcaccaatcgcaatggaaaatcgggttggagcattggagaaagctgtcagtgagcaaggacaacaactggcggaattcaagacagatatgaactacatcaaagatttgctgttacagatgaaaaacaagaagtcattatctgatgaggaggacaatcctgtgaataaaaatgagaaatcggcggaagaagaggagattggagaatctgaggaagaagaaaattttcctcttcatccttgggtcatgacggttgaatga

SEQ ID NO: 58763 - DNA, 1137 bp, Glycine max
  Peptide Sequence Number=SeqID_175541
ggaatctccatcaaacttcttgtgctcacaccacaacaaaatggtgttgtgaaacggaaaaatcgtcacctagttgaaacagctcgtacttcttactgcatgtcacttgatcaatgcatgccctcgtccatcctcaacaatcagatcacgtactctatttggtacccacaacagaacctctactctgttcttcttcgtgtctttggttgtacctattttgttcatgatcttttcctaggtaaagataaactctctttgctaagtctcttaagtgtatttttcttggttactctcacctacaaaaaggatgtcgttgctcttgtccgaaacttcaacagtatcttgtttatgctaatgtcatctactttgagtctactccactcttctctgagagcgttgccacaacatccaccggtgattcagtataccaattccctagcatcatctcttgctccaaccaaccctccaacaacgccttctacacctgaacttcccattgccctatgcaaaggtgaagaaatggctgatttggcgatgttggatgaaatggctactttacagactagtggcacatgggagttggttcatttgcctccagaaaagactagtgttggttgtcactgggtgtgtacaatgaagtttgcaccggaaggttgtattgatcggttcaaagcccgattggtggctaagggctatgctcaaatctttggccttgactatgggtataccctttcccctgtgaccaagattactactgtccatttgtttcttgctatggctgttattcgtcattggccacatcaccaattggatattaaaaatgccttcctacatggggagctacaagaagaggtctacatggatcagtccctaggttttattgcttctagtggatctcatctagtttgtcatcttcgacgctcgttttatggtctaaagcagtttccccatgcttggtttggctgtttcagctcaaccctaattcagtttggtatgacccgctgtgaagctggccactctgttttcttccttcattcttcatttggcttgtgcatttacttggtggtctatgtcaatgatactgtcattactggtgatgactctgatggtatctgccgactcaaatctcacctttaa

SEQ ID NO: 58764 - DNA, 357 bp, Glycine max
  Peptide Sequence Number=SeqID_175542
atgatgaaaagcacgaaaaatgttcgatttatggcgttagagcataaaatgttgatgctacctttcgaagtttctttgccttcttttgagcgaagaccgaaaagcgtacatttttgttggggaattgagtatgtaaaaggcatatggcaagtgatagagctcagagtaccacgcccaggagaagactcagcaacctgtgtatctcaacgattacgtccgcatatgaagcatgtggatgtgcattttcgtaattgtattaacattaatggggcacgcattctgttaggatatgtcagtatatgtcgcgtgatatttcgtgcttgtaatagtatagcagaaggttctagtactgaatga

SEQ ID NO: 58765 - DNA, 2265 bp, Glycine max
  Peptide Sequence Number=SeqID_175543
atgacggtgaaagacaggtttccaatgcccaccattgatgagttactcgacgaacttggtttcgcttcttggttttctaagctggacctccgacagggcttccatcaaatctccatggctgcagctaacgtcgccaaaaccgcctttcgcacccaccaaggtcactatgaatacaaggtgatgttgtttggcttatgtaacgctccatccacctttcaggcgaccatgaatgagctcttgaaacctttccttcatcgctttgtaaccatcttctttgacgacattctggtgtacaacgcttccttggaagactatgtctcccacctctgccaggtattcgactgtttatctcatgctcagttcttcctcaaggaatctaagtgcgtcttcgcccaacaacaactggcctttctcggtcatatcatctcggcccgcggtgtcgcccctgatccttcaaagattgatgttatggttcaatggtccgtccccacgaacacccactccttgcgtggattcctcggtttgactggtttctactacaagttcatcaaagctttcgagtccctcaaaagcgcaatgacccaagctcctgttctctctcttccagacttctccattccattcattctggaaacggatgcctccggctccgccatcggcgccgtcttgcaacaacgaggtcatccattggccttcttcagtaaggcactatgcctacgcatgcagcgagcctctacatacgtccgcaaattacatgcaatcacgaccgcggtccacaagtggcgccagtacctccatggccattcctttacgatccttactgatcatcgaagctggaaggatctcatgaccccggaacagcagacttatctcgccaagctattaggttataattataatatccagtacaagtcaggcaaatccaacgttgttgtagatgcgctatctaaggtgcctcagcccgaagcgagccagtactggtttttatccatgccccacttcatcttcctcgacacgctacaaaaacacttcaccaccagttcataccctgagtttgcacttcacgacgacttgttattcttcaacaataggatttggatggaactagataatcccttcgtggatacgttgctcgaagaattccattctacacctatcggcggccacctcgggtttgccaagaccctacatcgcgtgcaagccagcttccattgggccaccttgagccgtgaccctctgcccatccctagctctccctggcaagacctctcattagattttatcactggcttgcctccttctcggggatacacgaccatcctcgtcgtggttgatcgttttaccaaaggtgcccatttcgaggctcttcccgaccgctataccacccacaatgtggcattccttttcctcgatgtcgtcgccaagcaccacggcttcccttgcagtctcatttcagaccgtgaccccatctttgtaggccacttctggtgcgatctattccatctcagcggcaccaaactgcgtatgagcactttgtaccatccccaaacggatgggcagaccgaggtgttgaatagaaccttggagcagtacttgcggtgctttgtgcatgacaccccttctcagtggtcacagttcctctccctcactgaatggtgctacaacaccgttgttcattccgctaccagtgtcaccccgtacgaagccacatatggcaaaccaccacctttactgaaatcccaacaaaccatgaaagaccaggctgatcgcaagcgccgtgacgtttcctactcagtcggcgattgggtgtacgtcaaattacaacctttccgccagctttctctcgcccgcacgacatttagcaagctttctaaactcgcctatcgcctggctcttccggcacactccaaaatccacaatgtctttcactgttctctgcttaaacctcatcacggtcctgttcacgcaaacattgcacctctaccaccacaagctactgacaaccacccactcgttgaaccgttgagcgttcttgataccaaatgggatactaccacgtcaccaccatccttgttggctttggtgcagtggaacagtctcacgtcggaggagacatcatgggaacgctgggaagacttatgttccacctaccaccttgacgacaaggtggttttgccagtggagggtattgatagagctcagagtaccagacccaggagagagactcaacaacccgtgtatctcaacgattacgttcgcatatga

SEQ ID NO: 58766 - DNA, 1021 bp, Glycine max
  Peptide Sequence Number=SeqID_175544
atgccaactcccatccttcttcttgaccaagaagactggggaggagaaaaggttgttgctcagctgtataagacccaaagagagcatctcatgcacctgcttctcgatttctgccttttgaaaatgggggtagcgatggatatggtgggtgattggccgaggtgggggaagcgatgtgggttgttggaacaagtggatatattgttggagaagatatgtgagggcggggtattgaggcagatgcataatgtgttggcatcatgtggcggagttggagcgaggacacgtcagatggtatcgtcggggcatcagcacgaaggagaacggggtgaccctggtattggaattgcatggcaggacatggagatcaacgtggaactcatgaccctggagagatataagggtgtgagaacagagttggtcgcatgggagagaggtgccgttgccgatggtgacttgcaatgggttggtcaggatggtggggagttgaaggtatttagccacccgcaactgaatgaaattatgcgtacttcctccgttaatgagcacggtggggaaggttgggtgagagcggggttggcaggttgggtgtttgggtcggggtcgtcttcctctgagatgagtaggaagaaacgtgccttgcatttatgtgagggggcccatttctcatcgcaattgttgcacagaacgagctcacgtttgcgagtcatctcctccggggtgaggcggcataagtggttgcggatggaaggggtgggtttcggcaaaggtgagggcaacggaggtggtgaggggttggggaaggtgggtgacaagggcggaaagaatgtcgcctgtcatcaagtttgtcttcctgcaacttggcgagggaaatggcctgaggaagagaaattggctggaatgcctgaacctcctagtgtggaggaggcagaggttgtaggggtggtggttagggctggtgttggatttgcaggagttggagttgctcctggatggcgtccaaacggagggacatgtcgtg

SEQ ID NO: 58767 - DNA, 180 bp, Glycine max
  Peptide Sequence Number=SeqID_175545
atggtggtggttggagggatttctgattggagagtggaggttgagattgctaaaagttttaagggcatcaaactatggaaggagcaccaagtgtgcaaccttgcttttatacttgacaactacacattttggttccctcaagtatttgcaaattttgagcaagctttcatttactactag

SEQ ID NO: 58768 - DNA, 453 bp, Glycine max
  Peptide Sequence Number=SeqID_175546
atggctattcgtggcctttggctacctactcctctacgcctttgcatctctgcagacattcgatacacaggacatgtacctgaagcggatcgcgaactgaactcgagacggcggacatgtcgatcaagcaaacggatgaaattgacatggagaaggaaatcgggaggcaaaaatgatgagtcctcgagcgaactactatgtctacttgggggtccccaccccgcaaaacgtccctcgtttgacattgtatctggaatgatgcaagttttagatatcggcacggggttgtcgatatcagtcactcgctgcgctctcttgcaaatcaggattcgagccgagccgacgtccgattacttttattcgaagaggaccaccgattatcactactatggtcgggaaaggcggtttgtatcaaacggatgggttgggatatatgcgactgtcggtttataa

SEQ ID NO: 58769 - DNA, 2067 bp, Glycine max
  Peptide Sequence Number=SeqID_175547
atgccaactatttgtgataaagttgatgcatatttgatagggaaaactgttagggttgatagaaacacttatgacctaggaaagggagaagtatgcgagggttgccctgataaagataaagccaatacatggcaaggaacacatggtgttgaacagagaggggacaatgtagaaggtgcgtcacatcgaatggaagatgttgatggtgtcacagaaaccaagagaagtaatgaggagaataaagttggtaatgagacaacaaatagagttgtagtagcgggatctggattggttcacgtggaaaatgctaaaggagataaatcaaaagaagaatcagcagatggaagaagtttgaatgaatatcattctcctcatactgaagttctaggagatgggaataaagataacttcaatcagggatcttttgatatggaagttgttaaggagaccccctttgcagaagggaaatatgttgatgcgaataagcctgacattttggctattttggaaggacaagggttttcagaagacacagctgataacgtgactggtagttgcatgattggaggagattttaatgatatcatctgtagtgcagagaagaaaggaggaacagttgtgtcgaaaaggaaatgtcagatcttcaggaacaggattaatagagcaaaactcattgaccttggtgctgttgggccaaacttcacttgtagaggaccaaaatttaatggttttcaaagagtgtttgggaggcttggtagggctttgagcaatgactcgtggaggttgctctttcctaatacagtggttaaagtcttgcctagattggaattcttttattaccatccctttcttatagctcttcacggttgcactctgcttggagcccttccttctcctgatgatataaagcatgctctgtttgatatgaagccttggaaagctccgaggcctgacaggtttcttgcagactgtggttgtggcataagaactctttcacagtttgaggcatctaagggggaagaatggatactttgtggtcaaggtaaagcttatgattgtacgaaatggacaaacatgaaccgtgttcttgaagaaaacggaaagcgatctcccatgtttgctcctaataaagggttgcacaaaggtgatttgctattaccttacctctttgttttaggtatgaacaaactctcccacattatcttgaaagcagtggaagcttggaaacctttttgtatgggaagaaagggccccctcatctcgcacttcatgtttgcggatgacttattattgtgtggtcaggcttctactaagcatatgaaatgtactttggacactatgcatttgtttggcgagatgttaggccagcaaattagccaagagaaaactaggatattcttttcaaagaatgtcagtgatagtagtagaagacagttggtccaaatgagtggcttttctgaagttacttccttggggaattacctgggtattcccttgttaggggagtctcctcgccaatctgattttaatcgtcttgctttgcctatctactctatggtgacaaataaaattccatggggaattatcaacaatattaagaaggatgagagatcttttatttgggaagatcaagtgggaagaaagaaaatgcatgctataggttggaacttgatggctcggcctaaagcttatggaggggttcctaaagggaaatatgcgagacaagatttctctgcaaatgttttggtagccaagccacatgattctcccatttggaaagttgtagctgagatttggcctcatcttgtggaaggtgagctatgggccattggagatggtaggctggtggatgtttgggaagacagatggctcaacaatgggcagatgttctctcaagagattattgagcttatcacatcgatcttacccccttctaataaggttggtcttgatagaaggctttggccgggaaatagacaaggagaattcatagtggctagtgcttatcaaaggcttatagggaataatttccctgctctttcagaagcatggaaatcaatttggtag

SEQ ID NO: 58770 - DNA, 243 bp, Glycine max
  Peptide Sequence Number=SeqID_175548
atgactggtcagtttttaaaactatgcccgaagatagtaaaccaagagataatagctaaaggagacaaattgagtctcaaacaatgccacaaaaacgaccttgaaagaactgagatgcaaaatattctttattcatcagtagtaagaagtctgatttacgctaaggtttgtactcatcctgacatagcatttgttgtaggagttacagacagatacttgagtgatcctaggatgcagcactga

SEQ ID NO: 58771 - DNA, 483 bp, Glycine max
  Peptide Sequence Number=SeqID_175549
atgagtgaaatagaggaggtgcaagagcatatgaaggctgacatgaaggccatgaaagaccaaatggccgccatgatggaggccttgttgagcatgaagaagataatgagggtcaatgtggttgcagttatcgctaccagtgccgccgctgaggctgtccccatgttgtgcaaagcaagaactctttcccatcttactggggcagccgtcacctgggatctagcagctcaagtagcgccctcaatgatggaaagggagatgataacaatgatagtagacacattaccggtgttctactatgagaagatggtgggttacaaaccttcaagctttgccgatttagtttttgtcggtgaaaggattgaaatgggtctgagaagaggcaaatttgagtatcctgctttgatgaatgggaagcctagggaaaatggagagaacaagaaggagggaggaacccatgttgtgactgtcgttcctacatga

SEQ ID NO: 58772 - DNA, 126 bp, Glycine max
  Peptide Sequence Number=SeqID_175550
atgggtcagatccagtactccgagaagtacttcgatgacacttacgaatatagacatgtggttcttcctcctgaagtcgcaaaactgcttcccaagaatcgtcttctctccgaaaatctgacctaa

SEQ ID NO: 58773 - DNA, 372 bp, Glycine max
  Peptide Sequence Number=SeqID_175551
atgcaaatgcaatctgtttgtgatgaaggtggggtaaaaaaggtagatggtgatgcggggggtgcttcaattttaggttgcaacgtgaaacatcagaggaggttaacccaatcaataatgaaaaaagttaaagatggtgttggtaaggaagttgagggttattttgtggtcgttgcttcaactataaggaaaatgtctaaggattttataggaaacaagtttcttagcaatctgaaagaccttttatcttctaggattcttgagggactatgtgcgaattatgttttcaacaagggaaaaattgaaagggttttgggagtgatttttggtagtggagttttgtgttattgtaaagtctgtaaaaagattatg

SEQ ID NO: 58774 - DNA, 540 bp, Glycine max
  Peptide Sequence Number=SeqID_175552
atggcaagttgttttccttctacatcggagaatggtgaggatgatagaggtctagatgaatgtgaggcggtagagaagcatggcgaagaggatgaaggttgtttaccaaaaagggaagatgaaaattcaaaaaattacacaatggattttaaccatcaaataagaggaggctctgctaggttggtagatgggtctgctgatctccctgatgttgcagcagaggatattgctttcgagaagtctaaggaggagtgtatggttgtgattgtaagacacaaagaccaagaagatgaggctacaattgaaaagagaaagaagttgattaagtctgtggagaaggatgttggtaagagtcgaatgggagaaagccacattgagatagagaacgaaaaagacaatgcacaaagctacgaaggtgatggtcaatcaatggtgggccagacatgtcatgcattgggttgtgatggttttcaaacacactttgaaataggccaacatattgaggaaaataaagaactagaaattataagttgtaagtag

SEQ ID NO: 58775 - DNA, 455 bp, Glycine max
  Peptide Sequence Number=SeqID_175553
gtatatcatgaattcaattattacagtgttgtatttcaacggaagagtatatgaagacaatgatggtgtaatatttgaaggcagtaaaaaggccattcagattaaacgcggaattagtttcaatgctttgaaaaaaaaattggagataagatttttagtttcaggaaaatatgttgcgttgcaaatttgtgatgacgaagatgttgaaactatgatcgaaagttttcaacaacaacaacaaatgtcagttctagaattgtacgtagaaaaggatgttgctggtggttcgatgtttcatgctgcaaattctgttacgtcatgtggacgtaatgtatctcatcatgaatcggaactgccaagaaatataagtaatttacatgatgatgaagatgatgatgatgatgattaccttgcatctaactcatacgttgaagagtcttttgatgaagatgata

SEQ ID NO: 58776 - DNA, 201 bp, Glycine max
  Peptide Sequence Number=SeqID_175554
atggagttcttggagcttaagcagggaaacatgattgtggctgaatatgcagccaagtttgaggagctggtgagactctcgagacaggtgacctattataggagtataggtccaatgaagaacaaaaagaatggacctcaacatcggggaaaactgtactcgacccctcctaagaaatatggtaaccaccccaacaattag

SEQ ID NO: 58777 - DNA, 330 bp, Glycine max
  Peptide Sequence Number=SeqID_175555
atgcctcaccctatagtggctgaatgcacacaagtcatgacagtggatgaagggtctcatgttcgagccttaactgtctaccaagctagcttgggcggtgaatttgacatagatccgcgatatgacaccttcaacagatgcctgaaacccattgaagatcttgcgcagttgcaacttagacctaaattggggccaaacaagtatcatagaagaaaaggaagacaagagaaaagtggcataaagctgtcaaagaaaaagttgacaagctactccacgcaaacttcatcagagaggttaggttatgtacctagctcgccaatgtcgtcatga

SEQ ID NO: 58778 - DNA, 126 bp, Glycine max
  Peptide Sequence Number=SeqID_175556
atggcacatatacatgttataagcacgggaaaatgcgtagtttggtcacatacccttaggatttccaatcccgcagcaagaattatgcaacaaattgagccaaaaagtgtgccatacaagctttaa

SEQ ID NO: 58779 - DNA, 269 bp, Glycine max
  Peptide Sequence Number=SeqID_175557
atggcatatgaaagcatgagactttaccctccaatgcaattcaattccaagttttgcttagaagatgatgtgttgccttatgggacttttgtgaagaaaggaaaatattttttaaccggtggcatctatgtgtttggatcatactcagaagcaatcaaatcttcacaaggttatgaccaaagcacactaaactttttaaggttttgcaaggaccttggttcaaattttggcaccccggttggtctcttggtagatgttatccctccatg

SEQ ID NO: 58780 - DNA, 240 bp, Glycine max
  Peptide Sequence Number=SeqID_175558
atggcatttttaggagaaactagcagtcagatgattgtcaactcaaggttgggtttcatttttccaaatggatcgattattcacaatgatactggggtttacttccaaacttcgactccggaaaaaatccaaaagaaatttcaaattccttcaacatgtaccatcgatgaactgaaggatttaataaagcaagttgcacctaaagggattccccctcttggaagtcacgaatcacaaacg

SEQ ID NO: 58781 - DNA, 1065 bp, Glycine max
  Peptide Sequence Number=SeqID_175559
atgaaagccttcccctctctagagtctcctgatgttggaagttgtaacctttttcagtcctttttgaacaactgtctaaattcagtggttgaattgactgcggacaaaggagatatttttcttgaagggttactagtcaatggttggctttcaaaattagcttttctgtgtggtcatgtagaaaagccagtagccgtttgggccttcaacacaatgttatattcatcaaaagaagagctccacaattcttccagcgaattttggtgtgcaattctctcttctgaaaaggaggttgatcaagcactggtcaaaattgattggtttcctgaatatatggatttaagaagagctcttgacagttatgggtttctctttaaattttcatccagtgccgagcctaataatttagattctgacattgaaggacctcctcaaaacattagagcttggatcagatttgtctctgcttgttgtctgataaggagtaaaaaggctatcttctccactgtagaagctgaagagatagttgaaattattatttgtctgttcctagatcgccaatttcagggtttgttggtgcttttgaatgactgcatggaagtgattgtcaattactttacagaccaggaatggtgctcaagttgtgagaacgtagcaaaattcattgcttgcagagtctcaaaggatttgaattgcatccggactattgaatgtatttcagaagctagctctcgttgcaagcaacttaggagtgctgttgcatatcaaacactgctttcttgttttgatggagtctacagtggagaagagatcctcagatcacttacagaaattaatttcaaagacaacagttgtgatttctacaggatgtatattaacttagttttgaccgagaattgggttttgtccaactcattaattgaagacaatcctgtaatctatgagatgttctctctttatcttcgacattgttctaccttgatttcagccacaaacctacgatcatatgcatcaaaggttcgtcatagggcttcatatcttctgcacttctccatctacaaatag

SEQ ID NO: 58782 - DNA, 126 bp, Glycine max
  Peptide Sequence Number=SeqID_175560
atggtgtttcaggaatcccctaccaatgaaacagagttgacatcatcctcagcttatgatgaagagccagtgactaatggtgacgggaaaatactaacaaatgccccaatgacactggttaaataa

SEQ ID NO: 58783 - DNA, 872 bp, Glycine max
  Peptide Sequence Number=SeqID_175561
gcatccgtcaccgtgcccgtgatgtcctgcgcgatcgatgcgaaccacgtctggtagaccggcaggcccgaacgtcgggtgaagatgaggctgagggagatgagcggcgtgctgggctcgaaccaggccgaggacccactggtgtcgatcgcgccggcgttgccggtgagggtgagcgtggcgggatcccacgtcggcacgtcgtcggcggttccggtgcacgagggcttcccggccacaccgggtgcgcagtagttgaacaggtcctgcaggccgagctctgccgcggtcagcacgtgcccgtctgcggcgacggcgtggatgcggacggagtcggcgtcgatgtcgcccaccgcgaaggcccagcccgatgtcggcgtcggcgccgcgaaggagtacgtcgtggtggaggggctggtcgcgttgtccgctcgagggcgcaggttcaggtagggctggtctcggctcgaaccgtacttggcaccgatgctcgtgccctccgagagccaggtcgacgcgccgctgatcactccgacctgaccggcgcgcgagtcgctggtgacggtcgccgtgatcgcaggttgcgcagccacctgcacggtcgtggtgaacgcaccccccgtgccggtgagcggctgccaggtggcccaggaggccaccgtggcggcagatgccgggagcgccccggccaggaccgcgatgaggacgatggctccgatgacgctcccacgacgacgcacacgcatgcggtcaggctaccgatataccgctcgtgcgggaagggcggatcaggcctcgaggtagttctgctccaaccacaggatggcatcggcgagagtcgtgaacgacccatcgaccctgtccgtgttcga

SEQ ID NO: 58784 - DNA, 495 bp, Glycine max
  Peptide Sequence Number=SeqID_175562
atggctcccgaagaactcgagcagctgactcaacaaatcagggaccagctggaggagtccatcacagaaaaagtgactcggcagctgatgttatccttcagccagatgcagtcccaactgcaatcacagatccaatcacaaggacttgcactacctctggagcctgaggttggtccctcagctgcttgtgtcagcacaaaagggagttgtgttgatcgctcaccgaccgatctagacatgggtgactcagacaaattcgggttgtatattgaagaaaatccttcttgcctggttgctctaggaagagtttatgagggatccacagtggttcacaacatccctttgttgcatggccaagtaaaggttggtgctgaggaggttaaagatgcagaggctctcgttcctgtacccactgacaaggttattttagtggggcagacaattaacaccttccttgcttggccaacacatctcgtgaagcgtttatcagaacag

SEQ ID NO: 58785 - DNA, 207 bp, Glycine max
  Peptide Sequence Number=SeqID_175563
atggctaccattgcgttatcaagtagatatgggagcaagttagcatatgacaccggaatttggggtgaatcctacaggcttttcgctgcaaaattcatttcttggttggtgttttttttggaatggcagtcacagcatgggtttctccctcatcctcaccctctttatttgccccagttttctcattcgtctaagcaggatgattaa

SEQ ID NO: 58786 - DNA, 138 bp, Glycine max
  Peptide Sequence Number=SeqID_175564
atggaggaaacgtggaggaggctttggctgcgcagcagctctgatttcgtattggtaatcgattacaggaccaataagcctactggtaatcgattacaggatgttgtaatcgattacaggctgcctgttcatgtgtaa

SEQ ID NO: 58787 - DNA, 585 bp, Glycine max
  Peptide Sequence Number=SeqID_175565
atggagaacaacggtggtttgtggtggctaatcgtggctgtgggtgatggagaaagtgcttgggacgttagaaatgactttggaagaaagaaaggagaagaaatggcgtttttcctaagctacacgaaagcaaaggctgaaacgctcaaagatatatatcagggtgttacagctgtctcttctacgctaagcacaagattggtgctaagccaaatatcacttactcgcgctaagcgcgagaatggcactaagtgcgactttgagtggcatcttcaatcaccgtttctccttttctattccgctgccattgatcttcaagaagcaaaagacttcattgatgaagaagatccaaggcctacaagctctacatggagccacattaatggtattatattgatggacaaaacttttggcttcgatactacgattgaggaagcacaaagagaaataaattctgcatacgttgaggcacatagtgcatatcatggaattggtattatggaattgatgggtcgtgatagaggattcatagcaatgcatgcttccttagctagtggacagattgacatatgtctgattcctaag

SEQ ID NO: 58788 - DNA, 363 bp, Glycine max
  Peptide Sequence Number=SeqID_175566
atgatgattcaaattgggttggacctgaatcaggagggagaggccctaacggactcttcggagtgtaggccttgggggtcaccgggtttgagtgctcctttaagcctatgcggatcccatatggttggagcattctcgcaaaacatcgtgaccctgactggtctccctatgatcttacttagtgagagtgacctgacaaacccatggtgtgctaggaatgtgataactcacttcctgtgtgtagtagtgttggatcctgtgatgatcttgaacttgtgttcgggagagcagatgaataggtggatgactatgaagaacctcatgctagaggatacaggaacacaacgttctgataggatgtga

SEQ ID NO: 58789 - DNA, 312 bp, Glycine max
  Peptide Sequence Number=SeqID_175567
atggagagggagatgataacaatgatagtcgacatgttattggtgttctactatgagaagatggtgggctacacgccttcaagctttgccgatttagtttttgccggtgaaaggatcgaaatgggtctgagaagaggcaaagttgattatcctgctttgatgaataggaagcctggggaaaatggagagaataagaaggagggaggaacccatgttgtgacttccattcctacatggccaaatttcccaccagttcaacaataccaatactcagttaatatcaacccttctcattacccaccaccatattag

SEQ ID NO: 58790 - DNA, 244 bp, Glycine max
  Peptide Sequence Number=SeqID_175568
tgtagtttacaaaagcaaaggtgaaacgaaagatattgagctggtagaggaggaacagacatggattggtgttgatccttctagtgagacctccaataaatctgagaattataaggaggaagcactgaagaaaacacaaaagcataaaccaaagagggtggagagtgtcaacgctgatgcagaagcctttgctgatgactggaaaattctaattgctctatgcattgtgaagctgaagcagtag

SEQ ID NO: 58791 - DNA, 252 bp, Glycine max
  Peptide Sequence Number=SeqID_175569
atggaaagagctaaaggtttactatttagtgacaactcccaaaagtggtcgaacataacattcaaagggactaccaacgacaacgtatcatcaaagacaaaaactctagatgaggcttcactatcatcaagcgagtcggagacccaggatgaccacagatcaacctccgcttcctgtgtctccacggacccaggtgtagatgcaattggctttgatgttttgatgatgatcatgatgatgtgttgcaattga

SEQ ID NO: 58792 - DNA, 360 bp, Glycine max
  Peptide Sequence Number=SeqID_175570
atggagagggagatgataatcatgataatagacacgttaccggtgttctactatgagaagatggtggcttacatgccttcaagctttgtcgatttagtgttcgttggtgaaaggattgaagtgggtctgagaagatgcaaatttgattatcctactttaatgaatagaaagcctggagcaaatggagagaataagaaggaaggaggaacccatgttgtgactgtcgggggtgtaaatagcaacctggccccattgaccttccagattcttcctccagaaggcggttgcttctggaggaagcaacctggctcgcctgggcgagctgggtggcaagctcctcccctattttgctataaatag

SEQ ID NO: 58793 - DNA, 438 bp, Glycine max
  Peptide Sequence Number=SeqID_175571
atgaactatgagtcctacagtgaagtgcttgatttccttgataattactttgcggggagagtgagggatccgtattacttgcataagcttaagaaaataattgaggattcaaggtatgaaaggaatgtcccgatcaggtctattcaccaaacttttattgattacacagaagagttcaatgactactctgtacaagatagagcaattgataatattgaagctgttataaaaaatgagcgcaaagaagatttgcgggcttttattaatgatcttgaaaatttaaaagtggaagttattaatgatgaagtaaagagtaatatcttaagaggctttgcccgtcgttatgcagacatgtataacgactaccttaatccaattactaatgttttggatagaatggaaaaagcagtcgatagttatttagaaaaagaaatatag

SEQ ID NO: 58794 - DNA, 1471 bp, Glycine max
  Peptide Sequence Number=SeqID_175572
gccgctacctgcagatcgagccgcagtcaccgaccctccgcgaccacatctggtggggttccggatcacgcgcgaccgccgaggagaccggacgcaagggcctcaacatgatgagctcgacgctggtcacggaggcgaccggccagccgttccacgaactgcagcgcgagcagatcgagctgttccgctcggcctacaaggcagctgggcacacgggccgcccccgtgtgtcggtgagccgcagcgtgttcccgctcgtctccgacatggaccgcgcgtacttcggcctccggagcgaggagaacgcggatcagatcggcgtgatcgacggcttccgctccacgttcggcaagacgtatgccgcagagcccgacgtcctcatcgcgcagctgaagcaggatgaggccgtgatggccgccgacaccctgctgctcacgatcccgaaccagctgggcccggagtacaacctgcatgtgctggaggcgccgggcggggatccgcggacgccgatcggaccgggagctgcgtgcccgacgcccggacccgtgtcggagcgcctcggtagactgagtgcttcgcggttccagccgagggagaacatgtcgagccttgccgtaccgcctttcgctgacgcgactgctgcacacctggcggcacccggcactcgagttcacgggagcgccaccacgttcgcggacaacatgaagttgcccgtgcaccggtggtatcgctacagcgcgggctactccagcgagtgggcgacgtcgctcgcccgccactggggttcacgacgcgtgctcgaccccttcggcggctcgggcacgaccatcctcgcggcgcaggagctcggcgtcgagtccgtcggtgtcgaggttcatcccatggtcgctcgcatcgcccgggccaaactgcggtggacggaggatccgaacgaactccgcgcccgtctcgccgaggtgctttcggcggctgcggtcggcaagcccggtggaggtgccgggttccccgctggtcgagaagtgctttcccgatacggaagcgctgaccgacctgctgcgcatccgcgacgaggtgctcgcccagcagggccgagacggcgtcgaagagctgctctggctcgcgttcgtctcgatcatccgcgcctgctcgcccgcaggcacggcccagtggcagtacgtgcttccgaacaagaccaagagccgcgtggccgagccgttctccgcgttccaggccgcgggggagcgtttcgcgtcggacatggagcagcgccgctcgctcctcggagcccgtccggcgaccgcgatggtcttcacggcggacgcgcgcacgttggagccggtgtcggacggatgggccgacgcggtcatcacctccccgccgtacgcgaacaactacgactatgccgacacgctccgtctcgagcagatcgtcctgggcgacatcgagggatggaaggacctccgtccgctcc

SEQ ID NO: 58795 - DNA, 602 bp, Glycine max
  Peptide Sequence Number=SeqID_175573
atggatcaacggcgtgctggatggcagctaccgtctgcagcgcatcggcactgccgcctgaggccgggagataacatgacgcaacgcaagggcatcatcctggccggcggttccggcacccggctgtatccgatcaccaagggcgtcagcaagcagctgttgccggtgtacgacaagccgatgatctactacccgctcagcgtgctgatgctggcgggcatccgcgaagtgttgatcatcaatactccgcacgaacaggcgctgttccagcagctgctgggcgacggttcgcaatggggcatggacatccagtacgcggtgcagccgagtccggatggcctggcccaggcctacctgatcggccgcgacttcgtcgccggcaagccgagctgcctggtgctgggcgacaacatcttccacggccacggcctgcgcgaggtgctcaagcgtgcagacgaacgcgtgcacggctcgaccgtgttcggctactgggtgaatgatccggagcgctacggcgtggccgagttcgaccagagcggcaaggtgatcgatctggtggagaagccggagaaaccgcgctccaactatgcggtgaccggcct

SEQ ID NO: 58796 - DNA, 204 bp, Glycine max
  Peptide Sequence Number=SeqID_175574
gttaaagatgcagatgctctcgttcctgtacccactgacgaggctattttagtgggacaggcacttaacaccttccttgcttggccgacacatctcataaagcgtttatcagaacatggagttgtgtctccagcaaaacctgcagataggccggatcctgaggtcgatgatcccctatatctgatgacattgaccatcgcataa

SEQ ID NO: 58797 - DNA, 603 bp, Glycine max
  Peptide Sequence Number=SeqID_175575
atgcccagcagctcggacaggcgctggccgaccttggccagcgaatcggcctcggtcagcacgccctctttcgggcggcccaggtgcgaggtgaccatcaccgcggcgccggcgtccagcgccaggcggatgccgggcaccgaggcgcggatgcgggtgtcttcggaaatgcggccggcgtcatcgaacggcacgttcagatcggcgcggatgaacacgcgcttgccggacagggcgccggccttggccagcgcggacagggtattgaccttggacatatgctttgcgtctcctagagttggcgaacgaaggggacgaacccgctttccgccgtggcggaaaacctgttcgtccccttcgatccgacagcgatgcttacttggccgacatcagcgcgacggtggtgtcgagcatgcggttcgagaagccccactcgttgtcgtaccaggacgaaaccttgaccaggcggcccgagaccttggtcagcgacgcgtcaacggtgctggaggccgggttgtggttgtagtccaccgagaccaggggttcggtgttgtagtccaggatgcccttgagctcgccttccgaggcggccttcaggatgcc

SEQ ID NO: 58798 - DNA, 392 bp, Glycine max
  Peptide Sequence Number=SeqID_175576
atgggagttgctgaaaagattctgggcaaggagaataagatggatgaagtccagaagatgatcttctgtggtacaagtaatattagactcatctaccatggagacatgtcctgtgctatcattggttactcaagttctgactatgctgtagatttggatgcaaggagacatgaaatacttatacccacagtggctttatccattatagatgtagagtacatggttctggcagatgcaataaaggaagaaatcttgttgaaagccaaggatcaagtccacttcatctattttgagaagatggttgaatatgttcatgaaacctactccaaggatcaagttgatatgagagagaatctagctaatatgttcatgaaacctactctaagaagcaa

SEQ ID NO: 58799 - DNA, 381 bp, Glycine max
  Peptide Sequence Number=SeqID_175577
atggagattgttgattgttggatgatgaacaatagagataaggaggatgacagttgtcgtctagtcaaggtgtgcattcacaattggcaattgtcttgtgagttggaaggatactttagcccacagttgccttgtccactacagaggctgaatacatggctctacaaaagtagcaaatcaagaccgttgggaataaaactatgttacttcgagttcagaattgtccttgaaccaatgtggagattgttggaagtaggagttgacgacattgaaagaggtgattggatgacattgtcgatatcgtctagtctcaccctctgtgatgaaatctatcttttgttcaatggtgcgtctagtctagtctacctatacattgtctag

SEQ ID NO: 58800 - DNA, 813 bp, Glycine max
  Peptide Sequence Number=SeqID_175578
atgaagttaaaggtattaacaaaaaatgcagcgaaaataattgtttgcgaaaataatttccatggtagaacaactactattgtttcattttctaacgatccggatgcgaatcaaaattatgggccttttaccccgggttttattaaaatcgcatataatgatctttcagctctggaagaagtattaaacaatgaagcagaaaatattgccgcatttttagttgaacccattcagggtgaagccggagtgtatgttccggatgagggctttcttaaaggagcttctgagctgtgtaaaaaacataatgttctttttattgcggacgaagtacagacaggtattgcaagaaccgggaaactgattgcctgttaccatgaaaatgtgcagccagatatcctgattttagggaaagcactttccggaggaatgtatcctcacggttcaacatttggaggaaatccaatagcctgtgcagtagccgtagcagctttagatgttgtagcagatgagaacttatctgaaagagccgaacaattaggacagcttttcagaaatgagatccaaaaattaattgaaaaatctgaccttattactaaagtacgaggtaaaggattgttaaatgcgattctaatcaatgatactcctgacagttctacagcgtggaacctgtgtttgaaattaaaagaaaacggactgcttgccaagcctactcatggaaatatcatcagattagcaccacctttggtcattacagaggagcagttacttgattgtatagaaatcattaaaaaaacgattctcgagtttaaataa

SEQ ID NO: 58801 - DNA, 180 bp, Glycine max
  Peptide Sequence Number=SeqID_175579
atggggtcttttatcgcgggaacccaatctggatatctggggcgaaacgaatttgggtgtcaaggtgtcggtctcgggccgaacttccacatcattccacaaggcacgcgtgacaatgatgatttgaaaacaacgtgcaaaattagtcatggctacagccaggacgacgttcctaaataa

SEQ ID NO: 58802 - DNA, 321 bp, Glycine max
  Peptide Sequence Number=SeqID_175580
atggttatccgcacctttcgtcaaccaggggcaaacgagtccgttgacgcgcagagactaacgtcgtcttctgcaccttttgtcatccagggacagcgagtcaggtggcaagcggagataccttatggtcgtctacacctttcgtcaaccaaggcgaacgagttcggcggtatcaggatgatgttggtttttactctcgtcgtccggagacattcaagcccgacgatgcacgagattcttctttgctgggcggggacgatcaagtttgatagcgtgtggaaacatcatggttatcccattttatcgctttcaagacactaa

SEQ ID NO: 58803 - DNA, 490 bp, Glycine max
  Peptide Sequence Number=SeqID_175581
actcgatggtggaggacgcatcaatagcgccaggcaatcaattcatgggtctccgactaagattgagaatggagaattggcaaacagcgctaggcaatcaattcgcgtggctccagactcgatggcaatcaattcgtggggctccagactcgatggtggaggacgcatgaacagcgctaggcaatcaattcatggactcaatggtggaggacgcatgaacagcgccaggaaatcaattcatgggtctccgaataagattgagaatggagaatttgcaaacaacgctaggcaatcaattgacggggctccagactcgatggcaatcaattcgcgtggctccatactcgatggtggaggatgcatgaatagcgctaggcaatcaattcatgggtctccgaataagattgagaaaggagaattggcgaacagcgcaagcactcaattctcgacgctccagactcgatggtggaagacgcatgaacagcgctag

SEQ ID NO: 58804 - DNA, 276 bp, Glycine max
  Peptide Sequence Number=SeqID_175582
atggggcatgccacattgtccccatactcttgcaatttatgtccaaacatgcgctcaccaagtgctcggaaatggccccgaggaaacttgcctcaaagagatccaggaaagataaaacggccgaaggaactagttccgctcccgagtatgacagtcaccgctttaggagcgttgaacaccagcagcgcttcgaggccatcaagggatggtcatttctccaggagtgacgcgtccagctcagggacgatgagtataccgatttccaggaggagatag

SEQ ID NO: 58805 - DNA, 435 bp, Glycine max
  Peptide Sequence Number=SeqID_175583
atgcggatcaacttgatctgtgggaagcatgcgaatcaaccttttcttcttgcggatcaacgtgatccgcaagttcaacacaacataaacacaacctacggatcatctaccctatttgcggatcacctagaagagcagcacctcgcggcagaatggaagaagaagcgcactcgaaggagggagaagcagcagcttgcgcggaagaagaacaaccacctcgtgctagagaagcaaatgggctcgcggaagaatgaggaaggaggaagaaagaagttgaagaggctcgcagaagaaagaaggagaagaagaaaggctcgcagaaaaggaagaagaatgaaggagaagaggctcgcggaaaaggaagaagaaagggtcgttgggtgcactgctttttttttaaaaaataacaagggcatttgtgacttttcacaataa

SEQ ID NO: 58806 - DNA, 156 bp, Glycine max
  Peptide Sequence Number=SeqID_175584
atgactgattcatattggatgcatagaattagagtaggtaggttctgtgcttttgatccccctccatctctcgtatttggattgagggttcttgagttaaaggagcaaggtgttagtaaggaacaagcaatggctatggcagatgtagtaacgtga

SEQ ID NO: 58807 - DNA, 144 bp, Glycine max
  Peptide Sequence Number=SeqID_175585
atgtcagtgaaaaacctcgttagacatctaagagtacatgacaagacagatgacacactgggagaccagtcagggtcacgctgttttgcgagaatgcttcaatcatgtgggatcgacacatgcttaaaagagcactcaaactga

SEQ ID NO: 58808 - DNA, 405 bp, Glycine max
  Peptide Sequence Number=SeqID_175586
gatcatcttcacatgtacttcaatgcccctgcagtagagccttcctcatcaacccgaccaaacgagcttgagttcacaactgagccaggattacctaacaaagaacttggtccctttagtgagaatgaaggcaaagttcttcacaatcaaccctatgaggaagattataagaaagatgctcggcttgtttcactaatcacaaccacaacactccatatgaaaatttttgaagaaacctattttcaagattttgaatacaggcatagcttggatcatgaagaagtccaacatccggtgggaactctcttcgaagggatgcatctcttgacaaaacaagacgtacaaaatgctttgcaacagtatcatggggagcaacatgaagacttagccttgaagcttgaagaa

SEQ ID NO: 58809 - DNA, 363 bp, Glycine max
  Peptide Sequence Number=SeqID_175587
atggcttcctcaccgatctcctccccagtagttaccatcattaaccgtgtcggtgtcagcatggttgcccctttcactggcctcaaatccatggctggcatccctaccaggaagaccaacagtgacattacctccattgctaccaatggtggaagagtgtggcctccagttggcaagaagaagtttgggactttttcctacctgccagaccttgatgatgcccaattggctaaggaagtgttaaaggagcttcaagaggctaagactacataccccaactccttcattcgtatcatcggattcgacaacattcgccaagtgcagtgcataagcttcatcgcctacaagcccccagacttctaa

SEQ ID NO: 58810 - DNA, 285 bp, Glycine max
  Peptide Sequence Number=SeqID_175588
atggcgcagtcagctgatggcaaagtgtttaagattgttccatgtcaccatctggagcatagcaccagcaactccctgagcatacgggccttaagccatgacttgactggttcagatagatcatattttcaaaagttgttcatgtcattgcatgcaatgtttgctttcacccaaaggggtggctttgatcaaattgacaaggatgattccaacctacctctggatacagctcctattaagcatgtcacgcagactaagacccgtcaaaagattaagaaggactaa

SEQ ID NO: 58811 - DNA, 207 bp, Glycine max
  Peptide Sequence Number=SeqID_175589
atgtcagtgaaaaacctcgttgagagcctaggtgtacatgacaagacagaccatacactgggagaccagtcaaggtcatgttgctttgcgagaatgtttcaaccatgtgagattggcaaaggcttaaaggagcactcaaactgggtgtacttacccccaaggcctagactccaaagagtatgtcagggcctctccctcctgatttag

SEQ ID NO: 58812 - DNA, 177 bp, Glycine max
  Peptide Sequence Number=SeqID_175590
atgcggagatacccaagtggttatccgtataaacactctttcgctatccgtcagactcaaagtctgggacagcgagtcaggtggcaagcggagataccttatggtcgtccacacctttcgtcaaccaaggcgaatgagttcgacggtatcaggatgatgttggtcgtccgattctga

SEQ ID NO: 58813 - DNA, 252 bp, Glycine max
  Peptide Sequence Number=SeqID_175591
atgaacttaatcattgttatcaaaaggaaagaacacgttttatggtgcccttaccaaacccgtgctagagctagagtaatgggtgaaatagaggaggtacaagagcagatgaaggccgacacagaggccttgaaagagcaaatggtaacaatgatgagcataaaggggataatagaggtcaatgcggctgcaatagtcactaccagcaccattgatgaggtggacctgaccctcccatatggcctcaactaa

SEQ ID NO: 58814 - DNA, 297 bp, Glycine max
  Peptide Sequence Number=SeqID_175592
atgggcgcgggtgatggtggtggttttggggatggtggggtggaggtgagtttgtgtactgcctcctcaaggcattcaagggaagtttggcgcgtgatttacccttctctttttccaactttcattcttagaaactctcgctacccttctttctcaatcttccatgctcgttgccgccaacctctctcattacaccttccatacttgagaatgccgctgcaccccaaatataaagctcacaggcctacccacagttgttccctttgggacgcggtggcaaatgtcaccgcaaaatga

SEQ ID NO: 58815 - DNA, 498 bp, Glycine max
  Peptide Sequence Number=SeqID_175593
atggcggaggaagacattcataagacaactttttggactcaccaaggccattacgaatattgcgtaatgccttttgggctctgtaacgtggcaacaacatttcagacgatcatgaacgaactactcaagccatttctctgcaagttcatcatagtctttttcgatgatatattagtatacaacccttcttgggcccttcatctccaacacttggaagttgtcttctctatgttatcccaagggtcattccatctgcatgagttcaaatgcgtgtttgccaaaaccaaactccaatacttaggccatattgttttggtggagggcgtggcccttgacccatccaaaatcagtgccatgttggaatggcccaaacctaccaacaccactaaccttagggggttccttggcctaacaggtttttataagcgcttcatacgtaggtacgcgaccatggcaacaccactgacgactcttcttcgcaaataccacttcatctag

SEQ ID NO: 58816 - DNA, 687 bp, Glycine max
  Peptide Sequence Number=SeqID_175594
atggcttcaccttggctaagtgagaccctatatcgccaagcgctattcattgcggtcagaattgagggccatggggctgagcgcatgatctgctggctaagaggatattcttgcagtttaaactggattcactgcagcttagcgccactcatgatgtcttcaaggaaaagaaagagtgtcagttcaaggcccactgctcaatacgatacacgaagattccattcctttgaggcctggaccagatatactgacaatgtgttgggaagacacatattagctgagaggaaagtggaaatctatcacacagagctggatgaattcaagggcgagctagagaggcgtaactttcacaagcgcctcaccaacttagctgatagtagcattgacctcgcgttggtgaaggagttcaacgccaacctttacagtcccgagggaccttcacctgaacaagtcagaatccagggccacataataaggattgatgcaggtaggctcaatgcctttctagaaacacctgtggtgcttgctaagggtgaatctttgctcgcctactcaagatattgcaggatgcctactgacattagagaaattgaggctgcactgtgcatacccggccaagggtttattctaaatgctgaaggtcactcggggaatatcctcagaaaagatctaaccacccttgctcag

SEQ ID NO: 58817 - DNA, 222 bp, Glycine max
  Peptide Sequence Number=SeqID_175595
atgcattttccttccttggaagaagcacccgtgagccttcgcgtcgccctcccgccgaaagtgcgacaattctcgctcagtgcaattcctgtcgagttggaattagcactgagcatgacaattctcgctgagcgcaattcctcttgcgttaagcgcaacaattatcgctcaactcaattccatctcgagttagaattacgcttagcgcacttatcgcgctag

SEQ ID NO: 58818 - DNA, 300 bp, Glycine max
  Peptide Sequence Number=SeqID_175596
atgaggaaatcaaacctatgtagttcttcacgaccgtttaaggcgttggaccttaaaacggtttcaaatgacctttcgacagacagagcttggtttcgagaattcgctaagcgcaaccttcagcggctaagcgcgaggaagaatccagaagaagatgagctgtcaagttcgctaagcgcaccgctccaggtcatcaagtgcactgcttcagctcatccgctaagtgaaacaagcgtgctaagccaaaatccacttatgcgcgctaagcgatccagatctgcgctaagcacacgagcatga

SEQ ID NO: 58819 - DNA, 561 bp, Glycine max
  Peptide Sequence Number=SeqID_175597
atgggtggtggtgcatggccgttcttagttggtggagcgatttgtctggttaattccgttaacgaacgagacctcagcctgctaaatagctatgtggaggtaacctccacggccagcttcttagagggactatggccgcttaggccacggaagtttgaggcaataacaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaagtgcgactcccgggggcccggagacggtgtcccgcgggagtcgtcacgacacaacatttacatacaatga

SEQ ID NO: 58820 - DNA, 237 bp, Glycine max
  Peptide Sequence Number=SeqID_175598
atggcacgcagagacaaattatggtcattctgcaccttttgtcatctagcggcggtgatcctgatgacatgcgtagacaaattatggtcatccgtgcctttcgtcaaccgagaggaacgaattcagcagtatcaggatgatgttggtcattcggtgctgatcattttcaaaatttttgcaggtgccgttggcggggatattgactggccgaatggtgttctgctcgaacgaaattag

SEQ ID NO: 58821 - DNA, 285 bp, Glycine max
  Peptide Sequence Number=SeqID_175599
atggaaaggcgcagaatgatcataatttgtctctgcgtgccatcggacacgatcgcctctggatggcaaaaaggattgcctctggatggcgaaaaggtgtgcggaatgaccataatttgtctccgcatgacatcgggcccgccgcctctggatgacaaatggcgcagaatgaccataatttgtctctgtgtgccattggacacgattgtgtctgaatggcaaaaaggtgagcggaataaccataatttgtctccgcatgtcatcaggcccgccgtctctggatga

SEQ ID NO: 58822 - DNA, 427 bp, Glycine max
  Peptide Sequence Number=SeqID_175600
agacggtgagtccgatgacatgtggggataccgtatggttatccgcacctttcgtcaaccagggttaaacgagcccgttgacgtgcagagactaacgtcgtattctgcacctttcgtcaaccaggggggaagcgagcccgttgacacagacagcgagtccgatgacatgcgggggtaccgtatggttatccgcatcttttgtcatccagagatagcgagtccgatgacatgcgggggtaccgggtaccgtatggttatcggcacctttcgtcaaccaggggcaaacgagcccactaacatcgtcttctacaccttttgtcatccagagacagcgagtccgatgacatgcgagggtaccggataccgtatggttatccgcaccttttgtcatccagagacggcgagtccgttgacatgcaggggtacc

SEQ ID NO: 58823 - DNA, 429 bp, Glycine max
  Peptide Sequence Number=SeqID_175601
atgccatcaccattggatgggtactgtagaaatcatagccttatatatagcaagtttgagcagaagcttggcaatctagctgctgaagcacaacagttaccaccgttaaccatgttggtgttggcatggttattccattcacaagccttaaatccatggctggcttcccccaccaggaaaaccaacaatgacattacctccattgctatcaacaatggaagagtgaaatgcatgcatgtgtggcaaccaattggcaagaagtttgagactctttcctacctgcctaaccttgatgatgcacaattggcaaaggaagtagagtaccttcttaggaacggatggattccttgcttggaattcgagttggagcacggtttcgtgtaccgtgagcacaacagatcaccaagatactatgatggacgctactag

SEQ ID NO: 58824 - DNA, 183 bp, Glycine max
  Peptide Sequence Number=SeqID_175602
atgcctgctcttctagttaatgtctgggcattcttagaattgctaatatatattgcctgcttgtgcaaaaagcaaatcatgttgaaaggtggaatgaacagagggagaatgggacttttccaagacctctttgaaatcatattgtggcacttggatatccttatgaggcatgagaagtcttga

SEQ ID NO: 58825 - DNA, 408 bp, Glycine max
  Peptide Sequence Number=SeqID_175603
atgaatgtgttccaccgattgttcacatgtatttctatatttctagacaacaaatataaagttcaattagggagtttaagtgaagtctatgctcaagaagctgatattcatcaaagtaaaatcactcggtttctgcggttgcctcaggtgtttcgattggtcccttttgttttgttagctcctctgcaaagctggggaatgattgtcaactatatcccggaagccatcttttttggtgcttttgttggtgatgatcatcctggatgtactgttattggaagcaataacacaataggatatcacgctgtgattggtgtcaaatgtcaagacatgaaatacaaggggggtgcccttgctcctacgtatcctcaagtgcgatgggaaattcagatcaacatagttctttaa

SEQ ID NO: 58826 - DNA, 1030 bp, Glycine max
  Peptide Sequence Number=SeqID_175604
attgacactggcagtgatgttctctgggttagttgtgggtcctgcaacggttgtcctcagacaagtgggctccaaattcagctcaattactttgaccctgggagttcgtcaacatcttcattgatctcttgtttggaccgaaggtgcaggagtggagtacagacctcggatgcaagctgttccggtcggaacaaccagtgcacttacacatttcagtatggagatggtagtgggacatcaggctattatgtctcagacttgatgcattttgctagtatttttgagggaaccttgacaacaaattcttcagcatctgtagtttttggttgtagcatcctgcagactggggacttaacaaagtctgagagagcagttgatgggatatttggatttggacaacaaggcatgtctgtcatttcgcaactctcgtcgcaaggaatagcaccaagagtgttctcccattgcctgaaaggagataatagtggtggtggtgtattggttcttggtgaaattgtggagccaaacatagtttatagtccacttgttccatcacagcctcattacaatttaaatctgcagagcatctctgttaatggccaaattgtgcggattgccccttcagtttttgctacatcaaacaacagaggtaccattgttgattccggaacaactttggcataccttgccgaagaggcttacaatccttttgtcattgcgattgcagctgttattccacaatctgtacgcagtgttctttccaggggaaatcagtgttacttaataaccacctccagcaatgttgacatttttccgcaagtaagtctgaacttcgctggtggtgcatctctggttttacgaccacaggattaccttatgcagcagaattttatcggtgaggggtcagtgtggtgtattggctttcagaaaatttcgggtcaaagtataactattctaggagacctcgtattaaaagacaaaatttttgtctatgatcttgctggtcaacgcattggatgggctaactatgatt

SEQ ID NO: 58827 - DNA, 504 bp, Glycine max
  Peptide Sequence Number=SeqID_175605
atgccttcagagttatcgactgactcaaccaagacaagcaccagttctgattcatcaacaactacaagcaagattgaatatccaactcacactaatccattaatcctacagttcactgcagtattccacaatgatatggacattatagaagtgcccactttttaccaccaacaatgggcaccagaataccctgagtttgtcaactttagatatgatggaacaatataccaaatcaggctaaggcagcatcggacaaaagtctactttgcgaaagggctaaaagaattcagaaaagatttatcaatttatgaatctgtgatcattaaattcttggcatgcaacaacaaatccatgtttgatctttatttcgttccctcactggaatgccagacttgcggaaggccagaagttatgtcaagacaacatatttgggcacttgaaatcacacaatcaattcttggtgcactaggaccactgagactccctaattgtgccatgacacat

SEQ ID NO: 58828 - DNA, 164 bp, Glycine max
  Peptide Sequence Number=SeqID_175606
ttccgcctgcatattatgcacatttggctgccttcagggctcgctattacatggaaggtgaaacatcagattctggttctgcaagtggaggccggactgctaactttgaggttaaattgccttcggttaaggaaaatgtgaaagatgtgatgttcttctgttga

SEQ ID NO: 58829 - DNA, 717 bp, Glycine max
  Peptide Sequence Number=SeqID_175607
atgaacacaaaacagagtcacgaaggttgcaaaaaccatgaacgattgaagctcaaatgggaatcaactaaggatgtgatgtcgcgaacgagtcgggtcaagacccgtgggcttgccgagtcgaactcggcggcgatgaagtggaagaacacgttttccaggcacaaggagtggcggaggacggagtgcactgcggcgatggagccgcggaggttgacaaaaggggcaacccgccccgtttcggtaatctggcgcctcgatgtagtggaagaatgcgtcgtcgtctgtggttgtcgggaaagagcagattctgaggcaaagcaatggtgggaagaagaagcagagaatgagggaggaaacgacggcgctttggcggaggagaagaatttggaggaatggtcgatggcaaaatcagttcttgttggaaggaaacaaaaggggtgttgttgttgttgggtgctagaaggaaaaaaaatggcattttctctggaaccagggtggaggagagggaagttccagagcgagaaagagagaaagagctggagtttcgagagtaaaaaaaaattatcactgaggttaaaaatcgtaaactatttcacgtgcctatcagacgttgacacgtggccgtcaacgtctgaggataacggtcaacgtccaattgggacgtcccgaaccaacattggagaaatttataaaaatgggagatcaaatttgtga

SEQ ID NO: 58830 - DNA, 1053 bp, Glycine max
  Peptide Sequence Number=SeqID_175608
atggttaatggtggcactgtgcagcattggacttgcctcaacttttctggaaaaacaaaccgaggtttggcagcttcattttgtcaagagttggccaaaatgtgtaataacaagggcatgcgttttaacttggatcctttgctgcccataacatctgttcatagtagtcaagtagagagtgctcttgggaatgtgcataagcaggctattgcaaaactagcaaacgaaggaagactcgaattattgatcataattttgcctgatttgaagggatcctatgggaaaataaagcgtatttgtgaaactgagttagggatagtatctcagtgttgtcttccgaggcatgtttaccagatgaagccacaatatcttgaaaatgtggccctcaagataaatgtgaaggttggtggcagtaacacagtattgaatgatgcatttactagaagaattcctcacgtgtctgacttaccaacaataatcttgggtgcagatgtaacacatccacagccaggggaagattatagtccttctattgctgcagtagttgcatcaatggattggccttatgtaacaaagtacagaggagttgtttctgctcaaactcaccgtgaagaaatcatccaagatctttataatacacatgaagatcctgtgaggggaaagacacattcgggaattatcagggaattacttcgtgctttccgtttatcaactaagactaagccagagaggattatattctacagagatggagtaagtgagggccaattcagccaggttttgctgtacgagatggatgcaatacgacgcgcttgtgcctcactacaagaagactatatgccccgtgttacttttgtggtggtccagaaaagacaccacacaaggttatttcctgcagaacacggaagtcgtgatcagacagataaaagtggaaatatattgccagggactgtcgtggacactcaaatatgccaccctcgggagtttgatttttacctcaacagtcatgctggaatacaagtaatacagtactctaagatggatcaactttag

SEQ ID NO: 58831 - DNA, 147 bp, Glycine max
  Peptide Sequence Number=SeqID_175609
atgtctcgtccacctctaaaaacctcacaatctctcaaaaactccttaaaactcttcaagatgcctcctttggttttatatggaaatcttgtcggtggcccctcgctaagcgccaatctcgtgcttagcctaaaagatgacggatga

SEQ ID NO: 58832 - DNA, 288 bp, Glycine max
  Peptide Sequence Number=SeqID_175610
atgacaacctcgatgacaagtgtcggcccttccacctcctctgttggctcaaccctgacactgtgcaccactgcctcttcctccgatggatgcctctacatcgacaaccagatctgtgagagtgtagggtggaggctttgcgggggtggacttgcaatttgtgagcctgaagtttgtccctattggaagcttcttgatgatgcgttgggtgactatgatggtgttgtcagtgattacattgaactttgccagcaacaccgttgttctagccaccaattgggcccttaa

SEQ ID NO: 58833 - DNA, 510 bp, Glycine max
  Peptide Sequence Number=SeqID_175611
atgtcagcttcagtgcagctcctttacgtgcatttttcgagagggacttcccctagtaactcatcgcataacttatctcaatgtaagaagctaggtccagtcacaacacgaccatcgattctaatgcctagatacagtgcaacatcttcgagtgtgatggtgcactcaccccatggcagggaaatatgttggaacccggtacacgataataatggtataatttgtggttctggttcaggccttgagattcgaaagcacgttaacacgactatgctagtgtcacgcatcgagcttctaattcacgtgaaccatggacccgtgattgattacatatataaacgtaccatatcacccaacactttgcatagttgcatcaaatcaaattgtgagagtaaacagagagagcaagcaatgaggttagagccaatttgtgggtatgtttatatcaatggtgacaagacaaaatcgttactactgaatcaatggagcagaagctgcataatttcctaa

SEQ ID NO: 58834 - DNA, 1716 bp, Glycine max
  Peptide Sequence Number=SeqID_175612
atgtccaggcaaaaagtcatagatgaatgtactcagagaacatcaaaaataagaaggctactagaagggcaattgaaaagcataaaggctaaacctacagattttagcaaggtcaattgtttcaatattttcagaactacattatttttcttagtttttaagattattgatgaccagtgggtgtgggaggctgatattagtggaaggtactcggttaagagtgcttgtagtgtgcttagacaggatgtactagaggaggctccagctgaagcatttaaggaattatggaagctcaaagtcccatctaaagtggctatgtttgcgtggaggttactcattgataggctgccaaccaaagataatttgaggaggaaacaggtagagctgaatgattatttatgtcctttttgcagcagtgtcgaggagagcgcgagtcatctattttttcactgcagcaaagtacttccgctttggtgggaatccttgtcttgggtgaatatggtggttgtcttcccacaacacccaagacagcactttatccagcacatgcatcaatcgtatgaaggcttgatagcgactagatggaaatggtggtggttagcattgacatggtccatttggaagcacagaaatagcattattttctctggcagcaccttcaatgcaaataaaatgatggaggatgcagtgtttttattatggacttggctgagacatttagagaagggttttcaatctcactttaatcaatggtcttcaaatattagagaaggctttcgatttaatggatctattccaaaccggcaaccagttcctgctgggaatgtggctcctgctactgtaaaagtggagccagttcttgtagcctccatggtatctggacctgcttttcctcacaattcgtcagttcctcgtgctactagtactagtcaaggagttccaagcttgcagacgtcttctctatcttctgtttctcaagatattataacaaataatgaaaatgcgcaggatacgaagcctacagtgtcaatgctgccccttcgtccagtgaatcctgctcaagcaaatgtgaacattttgaacaatctctctatagcacggcaggtgatgaactctgctgccttaagtggtggaacctctatgggacttccgtcaatgagtcagactcctgttgccatgcacatgtcaaacatgatatctagtgggatgacatcttctgtacctgcagctcaaaatgtattttcatctggacagtcaggaataacatcaatgactagttctggacctcttactggtcctgcacaggttggacaaaactcaggtctcggttcattaacttcaaacacttctaatttgtcttcaagttcgaacattgggatttcacaaccattgggtaatcttcaaggggctgttagtatgggacaacaggtgtccggtatgagccaaggaaacctttcaggggcccaaatggtgcaaggtggagttaacatgaaccaaaatgtaatgagtggtcttggtcaatcagttgtttcttctgggactggcacgatgattcctactccaggaatgtctcaacctgtacaatcaggtatgcagccacttgtgaacaatgccgcaactaatatgcctttgtcacaacagacatcaggtggtatgcaatcagcacaatccaaatatgtgaaggtctgggagtgtaatgaggtgggcaaatcatga

SEQ ID NO: 58835 - DNA, 171 bp, Glycine max
  Peptide Sequence Number=SeqID_175613
atggaccaccagcagcaaggcgcacaacacccaaggggtgcaaactacccaacagttatgatccacccaaggtcacaaccaaccattatgatccgcctaaggggtgcaaggtcaggagatgcgaatcaagggggcatgacccttgggaacagtcacaatcattcagaatag

SEQ ID NO: 58836 - DNA, 162 bp, Glycine max
  Peptide Sequence Number=SeqID_175614
atgaggcccagcccaacagtggcgctaagcgcgcatcaggcgctaagcgagcaaccaaatgcaggcgctaagcgtgacgttaagcacgaaggagtagaaaccgttacgcgcgctaagcctggctacgcgcccagtgcgcgatccaacagaagcacaggctaa

SEQ ID NO: 58837 - DNA, 222 bp, Glycine max
  Peptide Sequence Number=SeqID_175615
atggaaaagagcggaggcaaacagaataattttgggtcaatgaaagaaagggaatggaaaatcttcagatcagataaattctcggcaaaattgccattctcgactggcgatatcccaccccacatgaacaaagaggaaaagaccgaaacacccgacttcctctccaaaaacacttccctcgagaaaatcctattggtccatgatcatacgtttgatctttga

SEQ ID NO: 58838 - DNA, 210 bp, Glycine max
  Peptide Sequence Number=SeqID_175616
atgtcattgcctagcgctgttcatgtgcctccattatcaagtgcgaagcttctggtgactgggaagcacgttattctgttgttttccagatcggtttcttcgccaaaagaaaaaaaaaagggaagaagtagagatgagagtcgtcatcgcgaaaagggcaggacggacgaaatcagtgtcctatctttgctttcctcttatctccgatga

SEQ ID NO: 58839 - DNA, 810 bp, Glycine max
  Peptide Sequence Number=SeqID_175617
atgaattcaaaaccactcgtctcggtcttccccctaccttgcttcgattcaaacgtccccagaatcaacaatcccgtgaccgaagacgatgttagtgggattcatggcgacatcaccgatcaaaggctcggaatcgatgaaagcgacgcgttctactgtggaataaagttgattttgaagatgaactgttatggtcttcagcagaacgcctttgcagcctgtgaagagatgagaggccctgtgaattttgttgaacagaaggagcctgtcatttgccctaagccgcgccgagttggggttgtatctaacatgcctatgaggcatttgagatggcatttcaatccacaggctgagggttctgactcaaaagctggggcagagctattagagataatgtttaagaaggtttttggactttttgcaattgcaattgtggctgcattggttgcattgaatgtccaaaaatgtgccaaagccgcaactgcaagccttgatttaaaactttgtagagtggagagccatggggaggaattttcaaatcaggtagcttcatctcctccatttttttgtgggtctcctccgggccgagctgcaaatcccttagtccaggatgctcgtttcggagatgaaaagctttgtccgacattattaatttcatcgccctcaggtttactatctccatcatcagcgtcacgcaaaggagggtgtgttaggatgagtttcggacttaaaccggctgcagttagagtagatggatttgattgcctcaacaaggattgccagaattctaggatccctgttgttgcttaa

SEQ ID NO: 58840 - DNA, 507 bp, Glycine max
  Peptide Sequence Number=SeqID_175618
atgtcttgggggagatcacgacgtggaggtaaaactcaagctatcacaactaagcatcattatcgtgttgaattattttatactgttgtggacatgcaacttcaggaacttaaagatcgttttacagaaacaaatactcagttgcttctttgcatggattgtttgaatccaaccagtttattctcttcttttgataaggcaaggctaattgaatttgcaaagttttatccatatgaattctctgcaattaatttagtgatgcttgataatcaacttgagacttacatcattgatatgcgtagcaatgtagaattttcatccttgaaaggaataaaaaatctttctgagaagttggttgaaactgaaagatatattgtttatccattagtttaccttgttttgaagttagcaatgattttgcccgttgccacaataactgtggaaagagtcttttctgccatgaaaattgtgaaaaataggttgcgtaatcggatgagagatgcatga

SEQ ID NO: 58841 - DNA, 351 bp, Glycine max
  Peptide Sequence Number=SeqID_175619
atgattttcactctctcctcctctccaaacgccacccaaactctaacacctccttctccaccactcacgaccaccggtggtcaccacgagctgttgttgcttgtcgctgaacccccacaccaagaggaacgttttaattggagcaaaatccttagaatcctcctcaagaattcggtggagaaaatttcctcaatcctccatttcaaagcttctctaagagccatcaaaatgggttttggcccgtgggccagcccggcccactacgggctaaagctcggcccacttagcccgtgggttaggtgggctcaacccgtgggttggtgggccagcccgtcaacccaccaaatttaa

SEQ ID NO: 58842 - DNA, 186 bp, Glycine max
  Peptide Sequence Number=SeqID_175620
atggagtttttgcaaattgcaatcggtgaaatcaaacgaaaaatgaaaaagaagaagattgcaagttacgggagtcgatttgatgaagaaatgagtaaggtaggaaggtttgaaggtggaggtagcctactggtaatcgattacatgaagactgtaatcgattacaggccatctgttctagtgtaa

SEQ ID NO: 58843 - DNA, 314 bp, Glycine max
  Peptide Sequence Number=SeqID_175621
atgaattgcgttttcgttcatgtgtcctccaccttcgagtttggagctatgcgtagtgattgcttagtgcaattctccattctcaacctttttcggagccccgtgaattgcgttttcgttcatgtgtcctccaccttcgatgaggaccctcttgtgcaatcctccattctccagagtatttcatcgtcaagggcggatcctcttgactggaaaataaaagaagaaggagtagagacgagagtcgtcatcacggaaaaggcaggacggacgaaatcagtgtcttatctttgctttcctcttatctccgataaaag

SEQ ID NO: 58844 - DNA, 1119 bp, Glycine max
  Peptide Sequence Number=SeqID_175622
atgaagaatgacgaccaatttagaatctgtgatcaccagtataaattagtttttaccggagttactgttctcaggcaatccaatttggaggatcttccctttaagaaatataaatttgctgatttcaccaatatcgttgttgggctcttcgaacctaaattgttggttgacattattggtgttgtggatgaggtagtctatcatcatgtgggatcaaagaatacattggttgttttcaaactcaaggatttgagcctttctgatttaggcattcaggttcggttagttttcacagttggtgaccaggggagttcccaagtttcaggttcaagccaattgtcgtcaaaagatgaatttctttcaaaagttgaagcaaagacaatctctgacattaacaacatttctaagttggtttggaatctgatgcctatctttttttgccaagaaattgtttgtgttactgtcagcaccattaatagaattgttatggataaccattcatggtgttatccagcttgcagttactgccacagaaaaactgatgttgagacagtcgcattcacatgtgcatgtggcaaacataatgaccaacctgtgctgaggtatagagtcgaggtgatggtcacccacaaagaacaaagcacaaattttttgatgtgggactataaatgcattgagctgattggacaatcagctaatgaagttaacaagttgaaaattgaagagggtgatattgatttgaatttttctcctctagctcttgataagttgctgggttatgttcttgcatttaaaatcaaagttcaacccaagtttaacaatgttgttgttcttagatactcgaatgacttagatttgatcaatgctgtggtggacatgctgcctgatgccgaggcatgttccaatgttcatgctcctattcttgactccgatgatccttcccaactcgaatctcaatctgtgtctgacacaacagatcatgatccacttctgggtcttccattgaaacctacaaaacggtttacatctgatgattgtgatgatgaaccgaaagcctctcagatttcaccggcccaactttcatctaacaaattagcaagacatgatcaaattgaatga

SEQ ID NO: 58845 - DNA, 156 bp, Glycine max
  Peptide Sequence Number=SeqID_175623
atgctaccgccaaggcttccaccaaaatctttcaagtgccattggcgacaagatagtcggagaatccttgggggtttaaggagtatcacatcggaaaaaatgaagaagaagggagtgaataattatggtgcaatgatgatgataattaacctttaa

SEQ ID NO: 58846 - DNA, 660 bp, Glycine max
  Peptide Sequence Number=SeqID_175624
atgaggagggttgaagaggaaaaacagcgcactatggacacatttaaaggacaaatacaagaagctatcaagttggagttgtcacaaattgcatcacaacattcagccccacttcagccaaatgatatacaagtattagcagcaagggtaagcacgaagggaagttgtgcagcagtagagacaaatgcattagctaaaaaaccctctaagttgaatggtgacaatgtcggcctgcatgtaaccgttgagaactccaacaaattagtggcagtgggcaaacggtgcgacagttttggcaccatccacaacgtgccctatgctgatgatgttgttcgcgtgagtgtggtggaagttattttcggtgatgcggaggttccaatccttacatcagaaataaagtttgtcaaagaagctttaggtagttttgttccatggccaacacatttggtcaaacccatcttgcctgaggaagcagagaaggatgtgagctcaccattgaagactgttgaggaggaaaaggcagatgaggttattgatccattgggagagttggtgaagaacttgttcgacatttaccaaaggcctgttgaggtgtcatgggatggtgctaaatttgggatcaataatgtcaaagatggctacttcatcacacacgctgat

SEQ ID NO: 58847 - DNA, 403 bp, Glycine max
  Peptide Sequence Number=SeqID_175625
atggggatacctggtgttgatagagaattgaagaagattttgaaagctaacatggatgaagttggtgctagaaggcgtgcacgtgaggccttcaagaatattcagcttggaattgatcatatattgtttaagactccatgtgatggaataaaaatggaagagtcatatgagaagaactcaaagggcctagaaatcttctgcaaaagttggcttccgagtgcatctaagccaaaagcagcagtgttttactgtcatggaattgctagaaagctggcatcatctggatatgcagtttttgccatggattatccaggatttggtctctcagaaggactccattgctatattcatagttttgatggacttgttgatgatgtcattgagcattactcaaaaatcaaag

SEQ ID NO: 58848 - DNA, 249 bp, Glycine max
  Peptide Sequence Number=SeqID_175626
atgctgaagataggagattcgactaaatttgtgataaaacaagacatgaagggaagaagacataaatatgggtttaacaacaataaacgtgagaagccagagaagataatgggttctccacctgcctcccctcctcctcctccttctcctccttcggatgcatcggcttcgccgtctgccgtgaagtggacacgcaaagcctcatgtctacgctcattgtctactagacctcttggtgctagagactag

SEQ ID NO: 58849 - DNA, 321 bp, Glycine max
  Peptide Sequence Number=SeqID_175627
atggctatggggtctgagctggagtggtctcttcctctgctgctgctggtgatggtggctcttccatcacaggctcctgggctgtggaggccccaccccctccagaggaagaaggctgagagaggagctggaagtggaatttatgaaggtgctggaggaatcattgggatctctgtggaggaagaggaaggaagtgtagaagaagaaggtgttggtgcctctgattgtgcagtggaaggggcctcagatctcttacctctggccttcttgggtcctctgaaagtgactgttgatcatcaagattccaacagttcttcttaa

SEQ ID NO: 58850 - DNA, 444 bp, Glycine max
  Peptide Sequence Number=SeqID_175628
atgaaaggtcagactagggttttcgttctctaccgaaaccgcaagccaagttggaagattccgcttcggttgaagggttcctctcggtgcgggttttcaatggagaacaatgatagtttgtggtggctaatggtggctgtgggtgatggagaaagttcttggaactttataaatggctttggaagaaagaaagaagaagaaatgacgtttttcctaagctacatgaaagcaaaggctgaacttcgagcacactccggatattgtctcatagatcccaacggtccgatcatggacaattgtcttgtgaagttgcagaccaaatttcgagaagatgcaacggttaacgaaggcggggcagcgtttttatcgaggcatcttcatgtagcttcctcaagaagcttcattaagaggcttccaccagaagcttcctcgtggcttctttga

SEQ ID NO: 58851 - DNA, 201 bp, Glycine max
  Peptide Sequence Number=SeqID_175629
atgctccatccaaaaattgaggtcccaattgctggaacacagagcttccactctcctcaagaaaaggaggtagaatctaaaaccaaagactcagaaaaagggggttatacagatacatctcctgttcttcaagaaggtgagcaatcagaagattccagtgcaaatgaggctcatcagaatgctaaacctaagcctgcatag

SEQ ID NO: 58852 - DNA, 300 bp, Glycine max
  Peptide Sequence Number=SeqID_175630
atgtctgttaattcaagcataagggagaatgtcacgtcaaaccgtctttgttattatcgtagaagagttaccattcgaacaacaaggacgacaaggaataatgagagattgttttatgtttgtccattaccacaacaacatgcagatcgatgtaatttcttttcgtgggttgatgaagacattgatgttggtgcaactaaaataggtagaatagaaccaataccaaactttggtttaagattgagactggagattctgcaaagagaagttaggattttaacatttaggaaaaaaagatga

SEQ ID NO: 58853 - DNA, 297 bp, Glycine max
  Peptide Sequence Number=SeqID_175631
atgggtcatgcaagaataaccttgaagcacatctcaaaggagagatctcacaagacaactttaatgttgagaaagaaaggactaattaagaaaatctttgaattttctaccatgtgtggagttgaagcttgcttgattgtgtatgataatggcaataatggtgatgttgcaccactaacatgtccccgagaccccacagtgaacatgcttgaagttgagatttcccaagtgcataaacagatcaccaacatcaagtatccaacttgggatccaagcatcacaaacatggaagattag

SEQ ID NO: 58854 - DNA, 567 bp, Glycine max
  Peptide Sequence Number=SeqID_175632
atgttgactcttttatataacacgccttactctctcaagctcaatttgaaatcctggcctcactctcttgacctactctcttgtttgccactctctcttgccactacgtcaccactaccgtcacctcagaccaataagcttttgccacatgttgtgtttgtccacaccaaaaagattggtgaaaaaaaggctttaggggttagctctgaaccgccgattttgtgtccgccatgggttttgttcaatgaaggtgtttctgagtgttcacatccaaattatttgatggagaatatagttaaggaaccaagtgttaatttggaagataacttctatgttaatctgagtgatatggagacttttatacatagtgatagtgatagtgatagtgagagtgagagtgagagtgatagtgatagtgatagtgagagtgagagtaaagtttataatgacaataatgatgataaagctggtgaggcagaaaatgttgatgattttcaatttgaattaacaaatttggaagatccgcctctcgttatatccttgatgacgacagtgtggccaaaatga

SEQ ID NO: 58855 - DNA, 846 bp, Glycine max
  Peptide Sequence Number=SeqID_175633
atgacaggggttaccaccgaaactgagggggagcttggagcaaggtttggagatgcagaggagttcaaagttggaccaactcttgtcgtagatgtgggcttggtcgaggcggcagtcgccattgaggacctcgatgacggtgtagttgacgcagttcttgaggtcgaggaggaggtcaaagttgcgaaagccgacgagaggggaatgagggcaaaggaagaatatggagttgggggcggtggtagcaccgaggagaaagtggagagagggaatggtagggagttgattatgttcaaagtaaatttcaagaaggcatatgattcgatagactgggagtatcttatgtctactatggaagggatgggtttcccagtaaagtggacgaagtggatttatgagtgcttagtaacgactttggtctctatgcttctgaatggtagtcataccaaggagtttcaccttggttgtgggttgagatatggatcctttatcacatctcttgttccttatagttgcagaagaactgaatatgtttactcaaatgattcatatgaacgagttttcaggagtgcagttggtaggttacttatgaaatatttggggttacctattggtgttgatcctaggaaaaaaagaacatgggagttggtcgtggaggtaatcaagaagaggctaaggtcttgggctacaaaacaattgtctttgggtggaagagtattggtgatgagaatcctgaaactggccaaatacaggctaaaggcccaagtggagaagggcgaaggcccaagtagagaaggacaaagcccccgagtggagaaggatgaaggtccaagtggagaaggatga

SEQ ID NO: 58856 - DNA, 1110 bp, Glycine max
  Peptide Sequence Number=SeqID_175634
atggagaataggctaggttgggtgttaaatatatatatcactgagaatatgggtcgtgcaagaataaccatgaaatgcatctcgaatgagagatgtcgtttagcaactttaaagcagagaaggaacgtacttatcagaaaaatcgatcaatttactaagatgtgtggagttgaagcctgcttgattgtgtatgataatgatcatgttggaccagtaacttggcctaaagaggctgtattggtacactccatccttcaaaagtatgagtctcagaagaatgagagacctcccaagacctttggtattgaagacttttttgagaataggaagaacatggttgaagctgacatttccaaagtgcataaacagatcagtaacatcaagtatccaacttgggatccaagtttcataaacatggaagagaagcaattgagggctttaattactcaggtgaatgctaagattatggcttgtgatcatgtgttgcaaaacaagcatcaaagtgaagccaacaacatcatgcaaaacatggcttggggaagtgcttcctcctcccatattccaagccaaatcaccccaactcctaacaataatgggagggtgtattttacaaattcaataaatcagtttgatggagctagtaatcatggaatgaacatgcaacaagttgatgcttgctttggttacattccaacaatggcgcaagaaagtgctaatgctacctcctcatatccaagccaactcaattgcttgcaaaacatccctcaaagccaacccatatttgaagatttaaagccacttaatgataagaatgagatggtagattttagtaatcaagttgatgtgccactagattcaactaatcaacttggtttgtttatggactggactaatgatcaatttggtgactttgaggactggattaatcgacctattgattggtctaatcaaccaggttgtggtgatgttatgggttgggacagtcaacctaatgaatctatctttcaaaatgttccagttcaatctcagaatgaggagcaaggaggaggagctttgcatgtcttgccaccaccatcggatggatttcaaagttcaaacagattgctataa

SEQ ID NO: 58857 - DNA, 207 bp, Glycine max
  Peptide Sequence Number=SeqID_175635
atgaaggtaatgcaacaaaaaatcagcggagaagaaggcctcgtcggagggtcatggggtagggtcatcgaagccgaagaagctggagacgagggtcatggggtcgaggttggcattgccagcgacggagaagaaggcctcagcggagggacacagaacgtaatggttcataggctaacttggtactccttgtacgggagatgctag

SEQ ID NO: 58858 - DNA, 408 bp, Glycine max
  Peptide Sequence Number=SeqID_175636
tgggcgtcttccggaattcttccggatgaaccacttcttccggaaagttcccggaagacgttttccggaagtcttccggaagaagtgttctttcggaagacgtttggttacttccggaagaacacttcttccggaaactttccggaaaacgttcttccggaacttccggaagaacccctaacgggtcttccggaagactccgccgtcagcctctgttccccattttttccggcgtcctctcctctcgttttctaccgtcctctcctctcgttttctaccctaaagggagttagggagactaacctcgttcgcggagaagaagaagacgacgttcgcgcttgccttgccggagaagaagaagcagttcgcggagaagaagaagcagttcgcggaaggaatgaggaatga

SEQ ID NO: 58859 - DNA, 240 bp, Glycine max
  Peptide Sequence Number=SeqID_175637
atgtgtgccaaggaagtaggtggtttagtggtgagagatgtgagaagtcttaatttaactcttttagaaaaatggaagtggagggtgatggttgaaaaagggagctcctggtataatgttttagcaggcatctatagggagaaggggcagatttctaggaatgaaaagaaaggcttaagttggcggaagtcgatttgtaagcctgaggttggggtaggggttgaggagttggtggtttag

SEQ ID NO: 58860 - DNA, 519 bp, Glycine max
  Peptide Sequence Number=SeqID_175638
atggaagaaaaggataccaaaactatcaaggtgctaaacccctcaaactcagccccctcacgccattttataagaaaatgggggaggtggttgccgcccagctcgcccaagcgagctgagttgcttccacatgaagcaatcccctttccagaatattctagatgggccctgatgctagtcaagaagcatgatgggtcttggcgtctatgtgtggactatcgggcattaaatgcgataacgattaaagaccgttaccctattcccaccattgaagagctattagataaattgggaggcgcaagctggttctctaaactggaccttttgcaagtttattaccaaattcggatgcatgaacctgatgtcgctaagaatacgtttcgcacccaccatggtcactatcaatttacggtgatgccattcgggttgtgtaatgccccttcttcatttcatgctacgatgaatgatatacagtcggaccctgctggaacatctgctccacctagagaaagcttttaa

SEQ ID NO: 58861 - DNA, 1119 bp, Glycine max
  Peptide Sequence Number=SeqID_175639
atggccacataccccactaaggagaaggttaactttcatccattcccagaaggtcttacggtccttgcagttgatgatgaccacaatgttcttgtattcattaaaagaatgtgtattcaatggaattatcgcgttattgcattctctgatgccccatctgctttgaattttgtgcgggagaaaaaaggttgcaatattgatgtgatactcactgaagttcatatggcaaatatggatggctatgaattccttaagcatgccactaaggaaattaatgttcctattatcatgatgtctcatgataatgctacgactacgagtgctttgatggaagctgttaaacatggggcttgtgatttttggattaagcctttgaatgaaaaccaattcaggatattgtggacgcaagttgctaggaaaatgtggaatgaaaagatgctagcaaaaacagatgattcttctgttcatggtactagagtgatgaatacagaaaagaacagctcaaccccaccaaagaagccccgtttagtgtggcaaggagaattgcaacagcgatttgtcagggctataatgcatcttgggcttgataaggcacaaccaaagaggattcttgaagtgatgaatgttcccggtttgacaaaagagcatgtagctagtcatttgcagatatgcatgaaatatagagttaatttgaagaaatctaataaaatgatcactgcgcatcaagagaatgagatgcaaatgcaattaccaaacaatatagaatccaggggcatggtaggcgcatctagcatttttccctatgcagtccttcatcctgaagaacaatggcctaactattaccatcttgaagaacaacaaggtgtgccatatatagcaaaatatccttctaacatgatcaataatgccaagaattttgctcagccaataatgacagtagatgatgcacctatatgtggagtattgccccagtctaatacagtgacagccaacaatgcattgatgcatccagatatgtatgtagcagcagcagcatcatcagaggcagcaaacagtgatgcattatcaaattcgttcaatgaactttcagccatcttgcatggcaattataatttttag

SEQ ID NO: 58862 - DNA, 542 bp, Glycine max
  Peptide Sequence Number=SeqID_175640
aggcgagagctgagacgattcaatgtcatgactcttatgttcgactatcgtggttatgtgacgtgtatgagatgaagatcgaggtatgtcactggatcgtagcagtgcgagcgtatttgttgcatctgcttggatgtacactctttgctaacaagagtgccacacacgtgcacgtggtattcttggatgcactacgtgacttaacgcagagtgggggttacgcttggggcgttgctgcacttgtgaacatgtatgataatttaaatgatgcgtccaagagcacgacgagacagcttgcaagatatatcactctattacagtgttggatctacgggtattttccatccgttggttccgctgttcctgccaaggattatgatgagaggagagtatggggccccttaacagtcattcatcgaccggagagggttatacgacagtttggctacatccagactattctgccacatcctgttgcgtcttcgctctttgttgaagaaattgatgatagatggatgcagtttggtgagtacattgcactt

SEQ ID NO: 58863 - DNA, 177 bp, Glycine max
  Peptide Sequence Number=SeqID_175641
atggtggtggcaacgacaacatggtggggttgcattggtagtcgtggtggtggcagcaacggtgacgaagtgaatgctaatgctagtaatgtaaaggtgaaggcaatgataagagaccatggcaagtctaccattgttggaaaccaatttttcacctttagatacagtcgcttttaa

SEQ ID NO: 58864 - DNA, 153 bp, Glycine max
  Peptide Sequence Number=SeqID_175642
atggtaccattttcagtgaaaaacctcgtcggacacttaggagtacatgataagacttgtcacacaatgggcttagaggaacactcaaaccgagtatatttatccccaagacctagactccggagagtacatgaaggcctccctcctgattaa

SEQ ID NO: 58865 - DNA, 183 bp, Glycine max
  Peptide Sequence Number=SeqID_175643
atgattgtcaccgcctttgtcagtgtgatcattgctattgtcaccacctccaccgccatcatcattggtggttgtgtggtagtgacaactgatgacaatggtggtggcaacgacaatcatggtgggggttgcaatggtagtcatggtaatggtagcgatgttgacgaaggtgatggtggttga

SEQ ID NO: 58866 - DNA, 213 bp, Glycine max
  Peptide Sequence Number=SeqID_175644
atgattttcaccccctttctctctctcccaaaccctaaacctcctcctccaccacccatgaccactggtgaccaccacgagtcaccaccacttgcctttggacgaccacacaaagaggaacacttcaatcagagcggaatcttcaaagctccactcgaggattcaatagagaacagagtcttcgattctcccttcgcaatttcttcaaggtaa

SEQ ID NO: 58867 - DNA, 390 bp, Glycine max
  Peptide Sequence Number=SeqID_175645
atgaagtttcaaggatcaataaatggattgggagtgcagattctagtagatagtgggagttcagataacttcctccagcctagactagctcaatgcctgaagttacctgtagaaccaattcctaatttgcaggttttggttggaaatggaaatgccttgactgctgaaggattaattcaagacttggaggtgaaaatccatggtcatacactgaagctaccagtttacctacttccagtttgtggtgctgatctagtgcttggggctgcatggttggcaacaattgggcctgatctttctgattatagtactttgacattgaagttttacttgggtaatcaatttatcaccttacatggcgagagaccctccctaccacaacaggcttaa

SEQ ID NO: 58868 - DNA, 591 bp, Glycine max
  Peptide Sequence Number=SeqID_175646
atgatcgagagcgagcatgatcgtgcgttcgcgattgccgatcagctgaagcgcaccatggtcctgcacggcagcgcactggaccagaatctcctgcaggaagccgatattcaggatgccgacctgatggtggcactgaccaatcaggatcaggtcaatatcctgtcgagcatcatggccaaacgcctgggctgcaagtccaacatggccctgctcaatacggtcgcctatcaggatttcacccacatggtggggatcgatgcctacatcaatccgaaagcggtcacgatctcgaaaatcctgcagcatgtgcgccggggccgtattcgcgcggtctatagtgtttatcgcgacatggccgaactgatcgaagccgaggcgctggaaacgtcatcgctcgttggtgcgccgctgcgcgatctcgacttgccggaaggcttgcgaatcggggcgatctatcgcgacgggcaggtgatccgccccaatggcgatgtgcggatcaagcctaaggatcgtgtcgtcattttcgcaacgtctgacgccgtaaagcatgtggagcagatgttccgcgtcagtctggagttcttctga

SEQ ID NO: 58869 - DNA, 720 bp, Glycine max
  Peptide Sequence Number=SeqID_175647
atggcgcaacaggtcgaattcaccgatcccgacatccatcccgaatacatcacctatccgtcaccggaaggaaacggtgaggttcgagcctatctggtgcgaccggccaagctgcagggcaagctgcccgccgtcgtggtcgtgcacgaaaatcgcggactgaacccgtatatcgaagacgtcgcccgccgggtcgcaaaggccggtttcatcgcactcgcgcccgacggtctcacttcggttggtggctatcccggcaatgacgataagggccgcgaattacagcagcaggtcgacccgaccaagctgatgaacgacttctttgcggcggtcgatttcatgatgaaaagcgatctgacgaccggaaaggtcggcattaccggcttctgctatggcggtggtgttgccaatgcggcggcggtcgcctttccggaactcgcagccgctgtgcctttctatggcaggcaggctccggcggatgaagtgccgcgcatcaaggcgcctatcctgttgcactatgccgaactggatacccgcatcaatgagggctggcccgcttatgaggaagcgttgaaaaagaacggcaagacctacgaggcttacatctatccgggcgtcaatcatggcttccacaacgattccacaccgcgctacgacgaagcggcggcgaagctcgcatgggatcggacaatcgaatggttcaagcgctatctggcctga

SEQ ID NO: 58870 - DNA, 129 bp, Glycine max
  Peptide Sequence Number=SeqID_175648
atggccaccccaatgagcactgcttgctacttggataaagataaagccggtcaatcagtagatatcaagaaatatagagatatcaagccaataccaaagaatctcaccttagtgccgtcaaaagaataa

SEQ ID NO: 58871 - DNA, 303 bp, Glycine max
  Peptide Sequence Number=SeqID_175649
atgttcgcaacccatttccgagcattgtcaccgttgggaatttcgatatcccatctgagatatgagaaatacccctctcattgtagcattgtttttcccgcagaaatccaaaactgtctcggtaaaactacgatcccgaaaaaggaatcgcatgatgacagtaccagcggaggtttcaatcttttctccgtttctctgacgttcaagaattctatcggagcagtcggagagaaaacttcaggaatctcagggaacctctatagatgccgctatcgttgtcggaagacacgtgagtccgcttag

SEQ ID NO: 58872 - DNA, 573 bp, Glycine max
  Peptide Sequence Number=SeqID_175650
atgttgtcttcaaacgcagaggattcggtgaggaagaagggcttctacaagtcttgtcctccaccacctccgccaccgccaccaataatgtttcagaaatcagtgttcatgaagccaaggttcaatggttcatccaacgaagcaccttccttcaataaggagttgaagagaagctttacaagtgagagaaccacaccagtgggtaagaaaagtcatgaagaaaataaatccaagcaaggcacattgtttagaaataacaagttcatggggcatgcaagtgtgcctcttgtgtcacagccagctgagaaagaaagccttcttgtggaatctaacgatgatgacgacgacgatgacacagaaatcgaggaccaagacgttgaaggaggaaggaccgttgctcagaacaatgacaggggaaagggtccacctgttattggtggagaaagttcaaaaatagatggtgatgaaggaccagatgtggataagaaggctgatgagttcattgctaagagaattgagtcaatcaagaggagtagaaggagtgcaagaaactcttcaagcttaaggttgtaa

SEQ ID NO: 58873 - DNA, 390 bp, Glycine max
  Peptide Sequence Number=SeqID_175651
atgaagctaacggacctcaatgaaaaagcccccatcacagactgccatgcagacgcgagtcagtggtttaacacccatggggaaatttcgggcaatacagaaaaaggaatagagggggagcacgaaaaagcattgcctcttgaggtgttgaggagtaatagcaaagcccaacagcttgagaaatcaattgtggacttcaacccaacctctaaaactgacccttcgccttcattacacgaggactctatagagctgcaatgtgccctttttaaggaaatgggcttgacttatggggaagatgataacaaggttaaggggctgttgctggatatggagaataagtataatatgatggcagcagagaagggaattaaaattcaacaattatga

SEQ ID NO: 58874 - DNA, 222 bp, Glycine max
  Peptide Sequence Number=SeqID_175652
gacggtgggttttgaggttttcaagatgaattgggggttgctgacgtggcagagagttgagactttgggcgagcgagtgctgtttgtaggtgggaattcttcgctttcgttctgtgcgtctgattttgttgggtgttctgcggattgcatctatttcaccgacgattattcggagtccaatgacgacgatgcgtgtgggaagcatgatttgggcgtatttag

SEQ ID NO: 58875 - DNA, 168 bp, Glycine max
  Peptide Sequence Number=SeqID_175653
atgatcatggcagcagtggtagtgacaactgatgacaatggtggtggcaacgacaatcatggtgggggttgcaatggtagtcatggtggtggtagcgacgttgacaaagttaacatcggcttcggaaaaaccgatgttagtatgccgttgttaacatcggttttgtaa

SEQ ID NO: 58876 - DNA, 417 bp, Glycine max
  Peptide Sequence Number=SeqID_175654
atgccacttcaccccaactacaaccaaattaacaagaagcatatgctcaactcgcactccccacttatgaagctaacagaccttaatgaaaaagcccccatcacagactgccatgcagacacatgtggcccaactctttctgccacaaaagtttatgtgagaagaaaggaggtgttgaggagtaatagcaaagcccagcagtttaagaaatcaattgtggacttcaacccagcctctaaaactgaccctctgccttcgttacatgaggactctatagagctgcaatgtgcccttttgaaggaaatgggcttgacttatggggaagatgataacaaggttaaggggctgttgctggatatggagaataaggataatacgatggcagcagagaagggaattaaaattcaacaattatga

SEQ ID NO: 58877 - DNA, 198 bp, Glycine max
  Peptide Sequence Number=SeqID_175655
atggacatccgacaagaaattcaatgccgcaagcttccaccgttgggatttgcgagacaatattcgtggagggagaaaaaggaatcgcatgaagacagtataagtggaggtttcaatctcttctccgtctctctgacgtttgggaattctatcggagcagtcggaggaataactgaaagaatttcagggaaccactag

SEQ ID NO: 58878 - DNA, 228 bp, Glycine max
  Peptide Sequence Number=SeqID_175656
atggtgcttacatcagcaccgtctttgaaagtaagcattctaagacggtgcttacatcagcaacgtcttagaatgcctactttcaaagacgttgttgaggtaagcaccgtcttagaatgcctactttcaaagacgttggtgagcttcgatgacgtcacattcaacgacgttcgaagaatgtcgttgtatcccctatttgaccgtcgtagaatcgcttttttccagtag

SEQ ID NO: 58879 - DNA, 219 bp, Glycine max
  Peptide Sequence Number=SeqID_175657
atggtggttgtggatgatggagaaaaagcttgggtcattggaaatgaatttggaagaaagaaagaagaagaaatgcgtcgcgaacacttcatatatcttctcgaagatcccaacggtcagatcatggacaagtgtcttgtgaagctgcagaccaaatttcgagaagattcaacgattaacgaaggctgggcagcatttttaccgaggcagctcatgtag

SEQ ID NO: 58880 - DNA, 300 bp, Glycine max
  Peptide Sequence Number=SeqID_175658
atgcctttccttctgactttcctgagcggggaaggagctaacgatccgtgccccctattagctgatcgaggggaaatttcattctcctttcttcatgagaaaaggcaccacccagacaggacggaagctatagtcataacatcgccgaaaacaaccatcgactggcaagatactgcccgggagcagaaagagtcagggggtgaagcctacgctagcatgcctaccgcccccactctctactattggtggctaataggccccttcgcgtatcctgtcttttggttggccagtaaggagtag

SEQ ID NO: 58881 - DNA, 889 bp, Glycine max
  Peptide Sequence Number=SeqID_175659
aggactacacgtcctcgccatcagaggattgcacgtcctcgcctttagagggctacacgccctcgccatcagaacactacacatcctcgccttccgatggctacacgccctcgcctttagaggactacgcgtcctcaccatcagagggctacacaccctcgccttcatagggttggactccctcgccttcataggactagacatgctcgccttctgcaggcaatatgccctcgcctttagaggagtacacgtccttgccatcagagggctacacgccctcgcctttagaggactacacagggctacacgccctaacctttccttgagagggcaacacgccctcgccttcataggactacacgtcctcaccttaagcgggctagacgtcctcaccttcagagcacaacacgtccttaacttcagaggactacacgtcctcacgttaagagggctgcatgccctctcctttagaggactacatgagatcttgcacctcctcgccataagtgggctagacgtcctctccttcagaggactaaacgcccttgccttcagaggactagacgtccttaccttcagaggactacacgtccttgccttcagagtgctgcatgtcgtcgcctttagaggactacatgtcctcttgcacgtcctcgccttcagagggctacacgccctcgccttcagaggagtacacgccctcaccttcataggactacacaccctcgtcatcagaggagtacacgtcctcgccttcagagggctacacgccctcgccttcagaggactacacgtccttgccttcggagggctgcataccctcgcctttagaggactacatgtcctcttgcacgtcctcgtgatcgaggccgtacccgaatcaaattaa

SEQ ID NO: 58882 - DNA, 1077 bp, Glycine max
  Peptide Sequence Number=SeqID_175660
atggagttcaaatatcgtgatggtcaaatccgaaggacaccatcaccattgcggagccctcttccttccaactcctatgtctccaatcgcccattacatgggtgtgactttgcatcaggtggctttcctagcaatgtttcagcgcctagagttttcccaatggtcatgtcgatcaatgtcaacgaagtattccaacgagagttggagaaggagaaaatatggcgagagctagagaaggaaaaaatcaggagagaaatcattgctagtgagatggcttttgcacaacgacgagagttggaagacgaagtgagaaaggaaatggaattagagagaacattcagaatcccgatgcaaagatcagaggggattgcatttcgagaaccaatttcagagtctattaatcagagtcggttgaataacattaccatgtttggtgggctaccattccatttattgtcccaagcttctaagcaaattcacacggataatatccaatttgataacaaagaagcttctaatagcaaggataaagtgattatattgaataagccagatgatcattgtggagaaaagcgcaaagcagtaacacttccaattgatgacaatgagagtctacagaagaaagccaagaaggagtggacttgcgagttgtgtcaaatttctacaacaagtgagaaaggcttgaatgatcatattcaagggaaaaaacataaggctaacaaagaatccactagaactcaaaaaatagggctggattcaagaccagaaagagaaacacttcatccttgtttcacacccgcggacacatgcaatatggaatctgaagaaaagggccaagttgtcccaaagagcaaaggtttaggtgatttggacgatcaaaatgaaacaactactagtaaacaagcacaggaaacaagcgcactatcaaaagggaagaaatttgatttttggtgtgagctttgtcaagttcaaactcaatcagaaattgtcatgcaaagtcatcaaaatggaaaaaaacacttgagaaatatgaagaaattgaatcacaacaatgatggtgttgcaaatcttggataa

SEQ ID NO: 58883 - DNA, 150 bp, Glycine max
  Peptide Sequence Number=SeqID_175661
atggcggcgagggctgaaggagaaagtgttgggaatctcgatgtaaggactggggatgttctcgtttggataagccagatgctaattaatttggtacaagtgatgacacctatggcagttgatgatgacaatgagaattctccattctga

SEQ ID NO: 58884 - DNA, 618 bp, Glycine max
  Peptide Sequence Number=SeqID_175662
atggagcttttggaaaatgggacagcaaaacaaaatgaagtttctgtaaccaagaaggattatatctccaccttgactgaacatatcattcatgaaattctcagtcgactcaccatgccagatgttgctcgaattagttgtctatcaaagacatggaaaaacttctatgtctcctttccttgcctgaatatcgagcagcaatactttgatcatctctcttacgatagcttcaagaattttatgtaccacaaagttagaagcatgagcatcaaagaagaaagtttggttatacacaaattcaagctatgcatgcattataaatatgtaagagaagctaaagaagagattgtaaactgcacaaggctaatatctaagatgagcaccatcaaagagttcgatttccaaatcattcaaggtaatcattttgataatccagattattcttatgaacttcttcatcatatctataacgcaaagatgttaatggtgttgaggttaagtggtttgataatgatacagccatttagggatacaaagttttcccaccttgaaattctaagctgccctatggtaagggaaatagcaattgttaaatgtaatggtttggagcatttgaag

SEQ ID NO: 58885 - DNA, 420 bp, Glycine max
  Peptide Sequence Number=SeqID_175663
atggctctggttgcgggttcagggttcaaggcggtggcaggaggtcaggcggcggtgtcgtgggttggcgcacgcggcggattccgtagtggcgacgaggtgttccggggtttcgactctggctctggttgcgggttgatggttttgactatgagtctaagactccgaccgcgccatcgtcttcgtctacaacagcctccctctgtgtcgtccgccgcacctacaaccaaaacacgcaagatctgtgttttttttttcagatctgagcatttttttccagatctgaccaaaagaagacctccatcgacaaggtggcggtggtggtggtcgcatatcctatctgacggcgttgtggggaaggcgacggcggtggtggtgcgccacggcgacggtgggcatagggggttacggtggctatag

SEQ ID NO: 58886 - DNA, 816 bp, Glycine max
  Peptide Sequence Number=SeqID_175664
atgatgcaatactctgaggaaatcagccagctccaagaatgcatgcttgacattaaccaagtgctttggaccaaaaatatatggatatctctttggtttgataaattcaaggactctgcagaccaaaagttagtcatctacccaaagcacaaaaatttctatcatgctgttgtattggaagactggagttcaatggcagaacttgcactaatgactcagataagtgaagaagcagaaagaataatcattacaactatgagttttgctcatctagttgattacatgtttggggatagtggtaaggatttgtctagtgttttggcattctcgctcactgatgaaagcagtttatatgagctcctaaacaacaagccaaaagtttcatttagggacaagaatggggaagtagtgcaacaaacatttgtttgttcaagggctggtctaagacaagacagaggtttaactactgaaactaggaagcatgaatctagaaatgaagcaaggtgtgagtgtggtgcaatgtgtcatgttcacattgacaatgcaaaccaggatgggggatatcacaaggttggttatttgaaaaaagatgtccataatcaacttgctaggcaaagaagggagcatgcatctgatgttagcggtgccttgaaatatttggcatatttgatgtctaaggacccattgatgtttacattaactgaacctatggttaatgcagccgcaccagtgattattccagatcatgttgttcactatgtactggctgacgaaccaccgaaaaatggtggtcatattgccagattctacctttga

SEQ ID NO: 58887 - DNA, 1537 bp, Glycine max
  Peptide Sequence Number=SeqID_175665
atgaaagagcatggaaatgaagaacctgtttttgaaattggggtggtgattcctaggagagtggttcaggaaaaagatgaatcatgtgactgtgcatacgtccttgtaaaggagtttgagaaggtggggtttgtagttgagagagttattggcattgcagatgagttcatcaaggtggaggaggttgaagcttttgtgaaacagcctgatggttctgttttcagttggtatgagcgttttcagtgctactgtcacttgatatatggaacagtaaacaacagcaagtcggtaaaaacccttaaatttgatggaaaagaaatccattgggaaattggggagaatctgcttctgaaattggaatcattggaaattgttaagcaagtctttcctttgcatgatgaaaagaagagaaagaaacttcttagaagttgggcacttcaatggtgggacttcactagtcagccaatcgatgagatttattcatattatggggcaaagattgcaatttattttgcttttcttggaatgttcacacggtggatgctcttccctgctgcatttgggcttactttgcaattgatagactttgggtcattgaaattagtcgtgcttcctattttcttcatcatggtgatactttgggctataatgttttctcagttctggaaacgtaaaaattcggcacttttagccagatggcctattagttctatagttgcagttgaccaaggatacaagatttcaggcaggaagtccagctcctggcagcccccaatggaactcatgaaagtatttgagactgatagagctaaagagaaggaaatattccagagacatgagtggcttgggcgtcttatgcgattcagaaatgatgctatcattatcttcagcattatatgcctccagttaccatttgagttggcatatgctcatctttatgaagttcttgattctgatataattaaggcgagccctggtgcagcggtaaagttgtgccttggtgacttgttggtcatgggttcgaatccggaaacagcctctttgcatatgcaagggaaaggctgcgtacaacatccctcctccataccttcgcatagcgaagagcctctgggcaatgggtatattaccaagattggtggcaaggtgtctgtcaaacttatcatgaatgaaaacaatgagaacacagaaaaacgggctgatagcttggtctacaaggtgtttggtctgtacttcatgcagacatacattggaatcttttatcatgccttgttgcatcgtaatttttcaactcttcgccaagtgttgattcagcggctccttctttctgaggttgcagagaaagtgttggaaaacctggtggaaaattcattgccttatctcaagtatagctataaaaagtacagggttcgacacaagaagaatgagaaaggagaagcaagagaaaagttccagtttagttctagagtagagaaagaatacctgaagccctcttactctgctagcattggtgaggagcttgaagatgggctatttgatg

SEQ ID NO: 58888 - DNA, 1476 bp, Glycine max
  Peptide Sequence Number=SeqID_175666
atggagcttgtggagagagccaaaggtattgaagtttctacggttgagaaggatcctctgatctccaccatgcctgaacacatcattcatgaaattctcagtcgactttcaatgctagacgttgctcgaaccagttgtctttccaagcaatggaataacttttgtgtctcctttccttgcttgaacattgaccagagtgactttaatcatcttccttttcaccacttcaagaatactatgctccacaaagttatgagcatcaaagaagaagaagaacgtttggttatccacaaatttaggctacgcatgcattttgaatacgtgcaaaatgccacaaaagagattgaagaatgcacaagactagtattgcagacgagcacagtcaaagagttcgatttccaaatcatgcatcattgtctttacgcgactaaaggtaattggtgccaactttttcatcatatttataatgcgaagacgtttgtggtgctaaggttaagtggtttgacattgattcagccctctgatagggatataataaagttttcccacctagaaattctaaggttagaaaatgtatgggtaaaaagagaaaatgtcattgattggttgtttactagttgccctctgataagggaaatatcacttgttagatgtaatggtttgaagcatttgaaggtgtgtggtaatcttggtcacctcaaacagctagaggttgttttttgtcaaatgcttgagagtgttgaaatccaagtgccaagtctagagaagcttgtgttgtccgagattgaaagaagaagaggaactgaattttgtatggctttgagaatagattcggaaactagtgaaaccttaagggagttgacattgtgcaattctaccattggaggcttaaccttcacccgtctattttctagatgctcaaaagttgagtctttggtactggaacggtgcatccgtttttttaagattaagattgcaagtcagaagttgagaaaacttgtcgtgaaaaggtgttacgatcttgttgtgacagacattgaagctaccaatttgacttcattcatgttttgcaattatgtacccaataaagtttatcaagattttgctgttgacaaacaaatccaatattgtgaggagatcagtcagctacaagaatgcttgcttgactttaacaaagtgcttatgagcaaaaacatatggacatatctttggtttgataaatttaactactctgcagaccaaaagatgattatctacccgctgaagaattacaaagggtatgatgttgtggtattggaagactggagttcgatggcagaacttacacttatgacccagataagtgaatcatcgtcaagaacaaccattacaaccatgagttttcttgatctggctagttacgtgtttggggattgtggcaagggcttaaaaggggttttggccatctcaatctctggtaaaagcatgttacatgag

SEQ ID NO: 58889 - DNA, 216 bp, Glycine max
  Peptide Sequence Number=SeqID_175667
atgaaaatttatcagctccaaattttgctcctttctttatttctggaggttccttacctgacctcaattgtagacaattgtcaatggggtatctctgaaaaagcaccaaaggcccaattggaggtggaagctagaatcattggacctttactcggttgcatcggcgtacactctactacaaccactactagaattatgacgttttatgtcggttaa

SEQ ID NO: 58890 - DNA, 372 bp, Glycine max
  Peptide Sequence Number=SeqID_175668
atgattttctactgcacgggttctaaaatgattgtaacaaaatcaatgattggtaccttctcggaattctctgcggccttccccaccgtaatagagaacccaacagcatgccttaaagaggcagagcctgaaccggaaatcccggttttctctttcaaaaccccggttcagaccaaagcaagaagcaagcaaaccagaaacggtcttcgtgtttggccattccgttcaccttccttcaccaattcttcctcaagctccaccacatctttctcttcctctttctcagcttctagccccttactaatttatagccaaagccttcggtggcatgatctttgtcctcgtctactacaccgtcggcatttctggtaa

SEQ ID NO: 58891 - DNA, 495 bp, Glycine max
  Peptide Sequence Number=SeqID_175669
atggccaccgttccagggcagctcgtgtgggagatcgtcaagaaaaacaattccttcttggtcaagcagtttggaaggggcacccagagcgtcgaattcagcagagagagcaacaatctctacaacctcaattcgttcaagtactctgatttggctttatctgagaaacattttatggattggatcaatgtgtttcgatggtttgtggctgaatgtcttattttactgtttatggatcaggctgtgttgttggctacaaccaagacaaagaagcaaaacaagcccgctgcattgctccacaaatctgtgatgaagaaggagttcaggaggatggcaaaagctgttgaaaaccaggtggccaaaaattactacaggcctgatctcaagaaggctgcccttgcaaggttgagtgctgttcacagaagcctcaaagttgccaagtctggtgtcaagaagaggaatagacagggcgtgagagtcgctggtaggaagtga

SEQ ID NO: 58892 - DNA, 246 bp, Glycine max
  Peptide Sequence Number=SeqID_175670
atgtctgtaaagaaatctgagtctctcaatggcagcaatgcggttgccaagcttaagggccagaaaccttcaaaacggaggcatttcgaacgctgtttctcttcagttgaattgactatggagccagggaagcagctgaaggacatggattccaacaagttgaaggctgagatcaagaggtgggctaaggctgttgttgcatatgcacgccaagtcagtggccgttttggaaagtctcaaggctaa

SEQ ID NO: 58893 - DNA, 983 bp, Glycine max
  Peptide Sequence Number=SeqID_175671
atttctcacccatactggtttcttgttcatctggcaagcctcaagttagtccattgggagaacagtcttgtaatgctagtcaatgtgaagctgtgtcattgagaaatgagagcaagaatgaaccaggctgtaccagttcagttgctggtcacagtattgttggccatagagcagacaaaggaatagggaactcggacggaatctatcagggtgcttgtcaaaaagttgattggaatggcatgggtgaaccaaatacttcatacaactgtacttctcaagttaactgcaaacctgttgctgaaggtcaactagaaggacttcgggacttgaacaagcatgtcaaggtgacaacaacggaggcaaagttattgcctgatggatctctcacacctcagagattgcttccttatcgccattcacgcttcactgttaactccagatatcaaacggcagatttccctggaagaaattattgttctgatgcttcattatatgacgttaagctagaagttaaatccagctaccggccacaacatgtgcctttggtttcccttgtgagtaaactgaatggcaaagcctttattggacaccctttggcggttgaggtcatggttgaaggtcattgtgataaaatgttgagtgacattggatgtgacttggaagttggtgatgtctattgtgtagccaagccaaactcggtgactggaagaatacattcgaagaattcaacgcgattttctcctagtaaatcttccaagatgaagaaaaccgggctgttgaataaaaagattcggaagttgtcgtcattgacaggtcacaggcagtcagaagaggaaagaaaggaaaaaaagccagtggtagataagaagggtcctgttattgcttgtattcccctccaagtagtattcagtaggataaatgaagctgtgagcggtcaagcacggtccacgcaccgtgcattaccaacatcatccaacccttga

SEQ ID NO: 58894 - DNA, 354 bp, Glycine max
  Peptide Sequence Number=SeqID_175672
atgaagacacttagatttgaacacagatctctggtggaacatctcaaatacaaatccattgtcgctcttgtcatgggttatgatgagggtggatggtggaggttgggtcgtcggcagttgcacgagcgattatggatgacaagtggtgtggtgggcgctaaggtggtgaggcggcatgcggcaatgctggtaggggttgcaccgaatttgttgaaggcgcaaaggtgcatgtgtttagaggtggagtcagatctggaggtggaggcagcgtgcaacgtcggaggagggtggtggggttggtgcgtgatgtcgatggagtgtggcaagctacatcacctgctaacagaaaaataa

SEQ ID NO: 58895 - DNA, 2158 bp, Glycine max
  Peptide Sequence Number=SeqID_175673
gtgtgggtttggctacgatggtttaagtgacacttacaaggtggtgataatcctttcgaatgttaaactacagagaacagaagtgagagttcacagcgtgggtgatactcgttggagaaagactttaacttgtcatgttttcccgtttatggaacaacttgatggaaagtttgtgggtggcactgttaactggttagcactccatatgtcgagttcttattatcgatgggaagatgttaatgttaatgagattgtgattttttcgtatgatctaaagacccagacatacaaatatttgttgttgcctgatggtctttctgaagtccctcatgttgagcctattctcggggttttgaagggctgcatgtgtctttctcatgagcacaggagaacccattttgttgtttggcaaatgatggactttggagttgaaaaatcttggactcaattgctgaattacttacttggccataagttcactatcttcaccgaccaccgtagcctccatgaccttatgtctcaggtcattcaaactccagaacagcagttttatttggcaaagcttctcgggtttgattacgacatacaatataaagctggctcctccaatattgtcgcagactctctcttgcgcattgatcacaccggacaagcccagtgccttctcctctctgttccccaccacgagttcctcactcaactaaaacaggcccttttcgctagtcctgattttcagacacagaagaaagctattcaggctcacccagaggatcacccccacttcaccatcgccaatgagctcattttcttcaagaatgccatctggattgactctcgcaatccattcattcctgcattattacatgagtaccacgcaacccctctcggagtcctccatccgcgaatgtcgtgtctgccaacaagtcaagcacgtgactccgctgggctccttcaaccaatctcaccccccactggtatctgggaagacctctcgatggatttcatcacccatctcccaagctctcacagcttcacagtcattttggtggtcgtcgataggttctcgaaaggcctccatcttggtgctttgccaactcagttcacggcttttaaagtagctacacttttcctggatatcgtgtgtaagctccacggtttcccttccagcatcatttctgatcgcgatcccgtgtttatcagttccttttggcgcgagttgtttaagcttagtggcaccaccctccgcatgaccaccgcctaccaccctcaatcagatggccaaacggaggtgatgaatcgcagcgtcgagcagtacctgaggtccttcatccacaaacgcccagaggaatggcataagtttcttcccctcgcggaatgggcgtacaatacctcgcaacactccagaactggggtcactccctacgaagttatctacgggaaacccccaccttccgttccgggatacgtcttggggtcctctcgaaatgaggccgttgacacccttctccattcacgagctgagcttcatgaatcccttcgccgcaaactcctcaaagcacaagccgagatgaagcattttgcggacaagaaacgccgcgatgttcagtacgagatcggccagttagtctatgttaagcttagacctcaccgccagctgtccctccgttctcagcgtcatcataaactcatgaagcgatacttcggcccatttcccattctggaacgcattggcagcgttgcttaccgtttgcaactacctgaagggtctcgtatccaccccgtcttccattgttccttactacgccctcatcacagacctcttgacctcccaacctcttcccttccggcggatacttcctccccacaccctatacttgagccactagccatccttgactctcgaatggacttctctgtggaccccccaactcgtttcgttcttgttcaatgggttggtcttcctccggaagactccacgtgggaaaagtgggatgatgtttgccatgctcatcaccttgaggacaaggtgagtttcacagggtcggatgatgttagcagcagcaacacaactaaggaagatagcagccacgatgaaccagtaccacaaagacaaaggagttccacacgtccgaagcatctagaagattacgtgttgtaa

SEQ ID NO: 58896 - DNA, 513 bp, Glycine max
  Peptide Sequence Number=SeqID_175674
atgacttccatagagcaacaacttaatcttgtggtggtcgcacaaccaattaatgctattaaggatgctgatatcctcgaaagactttggaaagacttcgaagaccaactatggaaagccaagacgatagcatcagaacgtctccgacttggtggagattcatcagttgcgcctacattcccaatgatagagacaaacgcatcagataacactgatgaaacctctagaaaaactctacgcaaaaggggaagaaagacaacttccaaggttctcttccaagtgcctttttcttttcaacctcctgaattttgtttgaaggaaaacatcaacctggagatagtattattaaatcgattcaagaatgaatcaagttgggggaaccacgttcccaaattttctgtagaagaaagattaaaaaattgggtcatcgaaaaaagggaacgcatgcaaagcaaggacaaagaaaaacctgacgctaaaatgcaagattatgtaagactggattttcaataa

SEQ ID NO: 58897 - DNA, 720 bp, Glycine max
  Peptide Sequence Number=SeqID_175675
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggcccccctcctcccccccgtgatcagttttgttgcccaggattttgccaactttggcttgcgccccgttggctaagtctgtgcctcggtggtggatcatcatgtcataacatggcaagacacaaggtcacacgcacacacacacacacacactcacgcaggcacaagggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 58898 - DNA, 234 bp, Glycine max
  Peptide Sequence Number=SeqID_175676
atgtcacatcctatcagagcgttgtgtctcaacgtccttcagcacaagggagaccagtcagggtcacgatgttttgcgagaatgctccaaccatatgggatcaacataggcttaaaggagcactcaaacccggtgacccccaaggcctacactccgaagagtccgttagggcctttccctcctgattcaggtccaacccctaaaatcattttagcacacagacactgctcgtga

SEQ ID NO: 58899 - DNA, 1269 bp, Glycine max
  Peptide Sequence Number=SeqID_175677
atgggtagctcaggtgagtcgaacctgaacggaatcgatgcgtcggtgggtgggttggtttgggtccgacggagaaacgggtcgtggtggccgggtcggataatgggtcttcatgaattgtcggagagttgcttggtttctccgagatcgggtactcccgttaagctcttaggtcgtgaagatgcaagcgtggattggtataatcttgaaaaatcaaagcgggtaaaagcttttcgctgtggagagtataatgaatgcattgagaaggcaaaggcatctgctgctaattcaagcaagaaggcagtgaagtatgctcgcagggaagatgctattctccatgctcttgagctagagagtgctcacctggacaaggaatcattaagcttatgctccagattagataaacctggtagtgaacatggaggatcagctggcgaattacccctcatgtctggtgaagacaatgaagatgtggcagatgatttgagtgactctgatgacaattctaatgcagctccagaattgtctcaatctggtatatcttttgaagagcctaatcacaatggtactttaaagatgcaatctgtgcaaggaaggaggagaagaacacctaatgattcagaagatgatggatttgaaggagtcaagcgaatgagaggacttgaggacctaggcattggtgtagtgtcaaagagaaaggtccaaggtactggtgcaactgagatagttcagcacattagtgcttcactcaacaattcaactgcagggaactgtctggcaaatggaacttctgtaaatggtggtaaaggctattcttcaacactgaaaagaaagagatcacaagtggcaaatgctcatgaattattgaaaaggaaaaatcgacaccggcccctgactaaggttttggagagtacagccatggtgtcagttcctgtcatttgtgatcagcttcccagttcaagcggttctccactatgtggggtaactgatggaagaatttcaggattagattctaatggttcaaagaaaacttttccaacgccaacacataattcagatagtactgaggctacttgtgagaacgggacttcattaattggtcatgaccatggtagtgatgatgcttcccaaatcaatcacaaagtcaaggagaatgaggcttctggcttaccagggctagttggcaaagattctcctgatgaactatttgatgttccatttgttggggttttaggggaggagaaacacactctggatttaggtctttag

SEQ ID NO: 58900 - DNA, 315 bp, Glycine max
  Peptide Sequence Number=SeqID_175678
atggaagtttcaatttcaacaccaaacattagacatgacatttggacggacctttctttaatcttccgttccccttgcttgcaggttgtggctggagaacttgaactgaatcatgaatgcagtttgatgcactggtcaccagaggactttgaatctaaattgcaggaagcaatgaagcagacttatcagagagctatgaaagctgcaactgattttggttatcaaaaagaaagccctgaggctctggtacatggagcagtcatctctgcctttctaaccattgctcaagccatgactgatcaaggctctatatag

SEQ ID NO: 58901 - DNA, 306 bp, Glycine max
  Peptide Sequence Number=SeqID_175679
atggcactcacgaagcaactcaagaagaagagcgagtgggacactctcgaggaggccattaaagccaaacttgaagatatcaaatctcacaaggtgacgagttgcagatctgaccttcgcggccttgccctttggtgcgaaaagttgcagagaagagtggcggcgtcgattggaggagcgatgagcgctgaagcagaaactggaacaatggggcgtgggtgtcaagttctaatggtggaggcgagtttagtgatggtgtttttggtgtgtgcaacggaggagaggaagttttggaggcgagtttag

SEQ ID NO: 58902 - DNA, 1308 bp, Glycine max
  Peptide Sequence Number=SeqID_175680
atgggcagggtaaaaagcgattacagaatatggatccttgattccttgggagagtttaagcctcgcaaagtgcccgagagagttcctgttactaatttcttcctcgtttgtactgtgaatagtgctatatctcaggatctggttcttaatcccagacctgaagacgtaaacaattttgttacttttagttcttatttctatccgtacttgatacctaacagtcaagattcagttaacattactatggcaaatttcagctcattgctcttgttctttgccatgtcaaaaacagcaggatcaattcttgaagctacgctaaaaagggatcctcatgaggttgaattcattcaggcagtccaagaagcagttcaagcccttgaaagagtcatagcaaaaaattctcgttatattaacatcatggagcgcttattggaacctgaacgaatgattgtttttcgagtttcatgggtggatgataggggtgagacatgtgtgaatcggggctttagggtacagtttaaccagtcaatgggtccatgtaggggtggtattcgttttcatccatcaatgaatttaagtgttgccaagttccttggttttgaacagactttaaagaatgccttatcaccatataaattaggaggagcagctggtggaagtgattttgatccaaaaggaaaaagtgacaatgagattatgcgattttgccaaagtttcatgagtgaaatgtatcgctacctggggcctgacaaggaccttccgtcagaggaaatgggtgttggtactcgggaaatgggatatctttttggacagtataggcgtctcgcaggtcattttcagggaagttttacagggccaaggatattttggtctggctccagtcttcgacctgaagccactggctatgggctggttttctttgcccagctcatgcttgctgacatgaataaagaacttaaaggattaagatgtgttgtgagtggttctgggaagatcgcaatgcatgtcttggagaagctaattgcttatggtgctcttcccatttcagtatcagattctagaggatatttggttgatgaggatggatttgactacatgaaaatatcatttttgcgagacatcaaagctcaacaaagaagtttacgagactattcaaagacctatgctcggtccaaatattatgatgaagcaaaaccttggagtgaaaggtgtgatgttgcatttgcctgtgcttcacagaatgaaattgatcaatctgatgccattaatttggttaattctggttgccgtatactagtagaaaggtag

SEQ ID NO: 58903 - DNA, 261 bp, Glycine max
  Peptide Sequence Number=SeqID_175681
atgggaaaagaaaatgagatggaaagaggatacgaggaagggtggtctcggaagagagagaaaaaaaaaagtgtgagggagagagaaaagggggacgggtctgacggagtgacggaccttgccataggtattagaagattttggtatgatcatgtatcaacttctttgtatacatgctgtaagcacgttagcattggcgagggcaaggagaattccaaaatacgaggttgggattggtgcatgcagtccaaccttggctaa

SEQ ID NO: 58904 - DNA, 273 bp, Glycine max
  Peptide Sequence Number=SeqID_175682
atgagtggaactggaacattcttctacggttcggtaattcagtcgttgattcaagttcaacaacaacgctaccattatcccctctcatcacctccattcactccaacgacaccgtttctccgtaaaacggaacgctttgcttcgagacaaagcatcagcagcatagcgaagaaccgcttcccgttcccgtcactctttgccgtcgaagaaaacaaagcaacaacaagatttcaacatcgaagagtctctgagcgaattgtcacaattagctga

SEQ ID NO: 58905 - DNA, 921 bp, Glycine max
  Peptide Sequence Number=SeqID_175683
atgtggagttccttttactgctatttaagcgtaagatggcaaaaggagattttcaaagatgtagaacttgacactacccagtctgcttatgtttttaaatgccaattgtatgatttgactggtgtgcctcctgaaagacaaaaaattatggtcaagggtggtcttttgaagggtcaaaagctaatgatgatgggtacagctgatgaagttgtgaagactcctgagaagggaactgtttttgttgaagatcttccagaagaagaacaagtagttgctgttaccacacctcatgctatttataatacggaaaagggacatactgctggtcttttcaacttgggaaacacatgttatatgaattcaacattgcaatgcctccattccgtacctgagttaaagtcagctttgactaattattcacattcaggacgaaacaacgatgtcgatcaatcttctcatttgttgaccattgcaacccgtgacttgttcaacgagcttgataaaagtgtgaagcctgtggcgccaatgcaattttggatggtattgcggaaaaaatatcctcaatttggccagctgcataatggagttttcatgcaacaggatgctgaagaatgttggacacaacttctatacactctctctcagtccctcagatcccttggaattagtgaaaatcccgatgctgtgaaggcactctttggcatagaacttattagcagagacgactcttccattcctttagatggtttccgcaagtcctccacgatcccttattttgaactacacaaaagtacaaataaacgtaaaaagaaaaatacatcaaacaagaacttcccatccgatcattgccttggatctacctatggttccccaccaagctccactcacagattgtcatatggatatccttttggtgtctga

SEQ ID NO: 58906 - DNA, 893 bp, Glycine max
  Peptide Sequence Number=SeqID_175684
tggaaaatgtgccagtacgcgagcttgcaccgctgttgcaccagctcaacgacgcaaccggcatcggtaacgtggttcactttgagccgtccaacgtactgctgttaaccggtaaagcctcagtggtgaaccgcctggtggatctggttcagcgcgtggataaagacggtgttcagcgccgtgaaattgtgccgctgcgctttgcctctgccaaagagctctcagacatgttgaacaacctcaacaacgaagagcagaaagggcagaacgcaccgcagctggccacgaaagtggttgcagatgacgagaccaacagcctggtgatcagcggctcggaagcggcgcgcacccgcacccgctctctgattcatgagctggatcgcgagcagaacaacgaagggaatacccgcgtgttctatctcaaatacgcaagcgccaccaaggtggtgccggtgctgaccgggattggcgaacagctgaaagacaaagcgggcgcgccaaaggcgaaaaccgccgccgcgtccagcgatctgaatattaccgccgacgagtcaaccaactctctggtgatcaccgcgcagcctaacgtgatgaactccctggagaaggtgatcgacaagctcgatatccgccgtccgcaggtgctggtggaagccatcattgcggaagtacaggacggtaacggcatggatctgggcgtgcagtgggccagcaagcacggcggcgtccagttcggatccaccggcctgccaatcgggcaggtcaaaaatggcacgatgaaagggttgtcgtataccggtctggcaaccggcttctttaacggtgattttggtgcgctgatgactgcgctctccaccgggtccaagaacgacattctttctacgccaagcgtg

SEQ ID NO: 58907 - DNA, 560 bp, Glycine max
  Peptide Sequence Number=SeqID_175685
acccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttattaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 58908 - DNA, 363 bp, Glycine max
  Peptide Sequence Number=SeqID_175686
caaaacaaagcatttggagtcatcacagctcgcccaggcaagctgttacttcattctgaagcaaccttgctcgcccaggtgagcagaggctatcctgggcaagccaggggtcagaaaaagtgtaaaaatgaccattttgccctcccttttgagtattttctgcattcttttccaaaacgtcgaaaaaactttcggattgtgcggcaattggtgtcaagcagctcaattcgactagcaagaatcaaaacattagcaaatgaaggtcctcgaatgaaattagggtatgaaagttgccatctttacttatcttttattggaaataaaagggaagtaaagataaggacactaatttcgttcgagtga

SEQ ID NO: 58909 - DNA, 708 bp, Glycine max
  Peptide Sequence Number=SeqID_175687
atggcacgaaaaaccaaagcgcaagcacttgaaacgcggcatcaaattctggatgccgctttagctcacttttctgaacacggtgtggccgcctcctcactggcggatatcgccgcggccgctggcgtcacgcgcggcgctatctactggcattttaaaaataaagccgatctgttacaggagatctggctgcgctgcgacgccgggctcgacgatgtggaacttgagtatcagacaaaataccctggcgatccactttctgtaatgcgttcgatgctgatctatatccttgaagccacagcaaaggatccacaaagacgcgcattaatggagattatcttccataaatgtgagttcgttggcgaaatgtcgacgttaatggcgatgcagcaggggctgctgcaggcatgttatgaccgcatcgaagaggtgctgcgcagctgtatcgaggccgggcagcttccggccagcctcaacacccgccaggcggcgctgctgatgcgcggctacatcagcggcatgatggagagctgcgccacaggtggtcgaggcctttatagatatgctgcgcctgagcccgacgctcgccggcacgcgctaagcggtgcgctcggccgccagcttctgctcgtaatcgcgctggacaatcgccagcgcagccagcaccgtggccgtgggtacctggttttcctccagcagctgaattaa

SEQ ID NO: 58910 - DNA, 1656 bp, Glycine max
  Peptide Sequence Number=SeqID_175688
atggagagggacatgatatcgactttgccgaaaacaatacttcatgacattctgtcaaggatgccagaggaagatgctgttaggacaagtgttttgtccaaatcttgggcggaaacgtggtccacgtatcccatcttgtatttttctgatactatgatcgtggggacgtttccgcggccgtgggaggattttttgaggaaaagaaagaacttcattgatcatgtaaagagaacattgctaaggttccatacccagggcttagcaatcaaacaatttaggcttattatcaattttgaccttcagtacatgtccctggatgtagatcattggttgaagttggctagtgaaagtggtgttcaggtactggaaatttgcctgcctaaaggccatgaacaggatgagaaagctctggacccatgctacatcttgccaacgggtatcattgaagccaaatcactttataagttagtgttgatggggggaatcagagttgatcaagcattcctgagtcattcagtcaagtttttctcattgcgagtattgtcattgtggagtgtacttttggaagatgaacaagcgattgagcatctcatttcttgttgtcctttgattgaagatgtaactttgaagtgttgttctgtattgaacaatggtggcataggaggtctacttgagcccaggacctctaggatgcaatctataagtatgaatgctctgccaaagctcaagaaagttgatgttcaagggataccggagattattatcattgatgctccaagtctagagtatttctgtttttgtcctggtggagatgtgcattcaccttttaagatgaattttgacaagtgcagaaatttgagagtgttatacttatggtcattgaagagcactactatcacagacaagtggtttcttgatctatttactaaatttcccttccttgagtgtttgaaatttgtcaattgcacaatgtctgagacgattaatatttcaagtgctcaactcaaggtcttagagttatcaaattgctccaaattgaaggagctcaacctggatgctccaaatttattgtcatgtggatattgtggtgatggtgcctcaaaacctataatatcttttctgaaaagctctagtcaactggaagtcaatgctcagatcgacattgattttatggatcttcattacttgagggaatgcatccaaaacttcaaacctcaaaatgttttggcttcactatccctatttatccaccagccaattgtcgatgagttgaacttagagatcttgccagtttcatcctctccaccaagcatcaaacatttggacctgcgtgctgttccaaaaaatgaaactttgtatctgcctcttgtcaatagtgtactttccagttgctgccctgcaactatttcgttgagcttgaattcttttttctgcagcagagcattcattgagtttttctacgagatgctaacaggaagaaaagaggatgagtgtttttgcagttctggtcatattaagtgctggtggcatggcttgaaggatgtgaaagtctcaagcactaggaaggctgatgagaatattgattttaagaccatgttagatgccttgccgactttttcccatcatgacaatattatctttaggttagagttgtaa

SEQ ID NO: 58911 - DNA, 1704 bp, Glycine max
  Peptide Sequence Number=SeqID_175689
atggcacttagtttcactgttaatgggagaaggaagagatcaggcatgcttgtagttaagaaaatggaggagggtcaaatagaaaacctgcctgatatagtcctccatgacatcctgtcaaggctgccagagaaagatgctgctaggacaagtgttttgtccaagaagtgggcggaaatatggtctacgtttcccatcttgtcttttactgacactgaaattatagagaagtttccgcactccaggaaggacgatcttgtgggggggaaaaagaagttcattaatcgtgtgaatgaaacgtttctaaggttccgtaacaagggcttagtaatcaaagaatttaagcttagtatcaattgttttgaccttgaggacctctctaaggatattgatcattggatgaagttggctagtgaaagtggtgttggggtactggaactttgcttgcatgatgaatttgaggacgaccaatgctatatcttgccaactggtatcattgaagccgaatcactttataagttagtgttgatggggagaatcggagttgatcaagcattcctaaatcattccgtaaagtttctctcgttgcgagtattgtcgttgtggtttatcttttcgagagatgaacaagtgattgagcatctcatttcttgttgtcctttgattgaagatataactttgcacgtctgttatgcaatgaaccatggtggcttagatggtccacttaagtacgatacctcttggaagcaatctataagcatgcttggtctgccaaagctcaagaaagttgaagttctaggaatacagaaggttgtcattgatgctccaagtctagaggatttccattttagtcctggtgctgtggatgaaccttttgagatgagttttggcaagtgcagaaatttgagaaggttatacttgtcgtcattggatagccttattatcacagacaattggtttcttgatctgtttcctaaatttccattcctcgatagtttgaaattcagcttttgcaaaatgtctgagacgattaatatttcaagtgctcaactcaaggtcttggagttatcaaattgctccaacttgaaggaggtcaacattgatgctccaaatttattgtcatgtgaatatagtggtggtggtgcctcaaaacccattatatcttttctgaacagttctagtaatctggaagtcaaagcttttatcgagattgattttatggaggttggtaacttgagggaaatcatccaaaacttcaaacctcaaaatattttggcgtcgctatccctatttattcagccgccaattgtagatgaattgaacttagatatcttgccagtttcgtccactccaccaagcatcaaacatttgtacctgtgggttgttctggaaaatgaaactttgtttatgcatcttgtcaatagtttactttcctgttgctgccctgtaactatttcgttgtgtggctatactttgagcttcagcagagcattcattgagtttttctatgagacgctaatgggcagaaaagaggaagagtgtttttgcggttatggtcatactaagtgttggtggcatggcttgaaggatgttaaagtctcaagctctaggaaaagcgaagagagtattgattttaagaccctgtttgatgcattgccaacttttttacccggggaaaatattatctttaggttagaatggtaa

SEQ ID NO: 58912 - DNA, 1773 bp, Glycine max
  Peptide Sequence Number=SeqID_175690
atgaacggtggtgatgaggtcgtggcagctccggcgagtccaccgcagccgctggagtggaaattctcgcaggttttcggggaacgtacggcgggggaggaagttcaggaaggtaattgtttggtactacgttgtttgctgtcggatccagttgttgatgtgttcggattagggggaagggaagaagtagtggttttgtattatggatttttcttggttggattggtgttagatcttaatggtgtggagtttggtgagtggcattggagtttggcttcaggggtcgggttggtgttaatgtgtaagtttcctaattatttacccaattttatttcttcagtggatataatttctgctattgaatttgacaagtctggtgatcatcttgctactggtgatcgtggtggtcgagtagttctctttgaacggacagatacaaaagatcattgcggatcaagaagggacttggagaggatggactattctattagtagacatcctgagttccgttataaaacagagtttcagagtcatgagcctgagtttgactatcttaagagtttggaaatagaagagaaaattaacaaaatcaaatggtgccaaacagccaatggtgctttgttccttctatccacaaatgataaaaccatcaaattttggaaggttcaagaaaagaaggtcaagaaagtttcagacatgaatgttgatcctaaattaatgggaaatggctctattgctagttcaagtaattcgggtagctctaaatcatatcttgcaaatggagtatcttcagatggaccatataattatttaaacaacgatttctcatttccaccaggcggtgtaccttcactaagattaccattggtaaccagccatgagaccagtttgatggctcgatgccgtagagtatatgcccatgctcatgattatcatattaattctatttcaaataacagcgatggcgaaactttcatatcagctgatgatttacgaataaatctttggaacctggaaattagcaatcaaagttttaatattgttgatgtaaagcctgcaaatatggaggatctgaccgaggttataacatcagcagaatttcaccctacacattgtaatacattggcatatagcagttcaaagggttcaattcgtcttgttgacttgcggcagtcagcattatgtgattctcatgccaaactatttgaggaacaagaagcccctgggtccagatcatttttcacagagattatcgcttcaatctcagacataaaatttgggaaggatggaagatatatacttagtcgtgattacatgaccttaaagttatgggacatcaatatggattctggtccagttgcaacgttccaggttcatgagtatttaaggccaaagctttgtgatttatatgaaaatgattcaatttttgataagtttgagtgttgtctaagtggtgatggattgcgtgtttcaactggctcttacagcaatctattccgtgtgtttggttgtgttcctggaagtactgaggctacaactttggaagccagtaaaaatccaatgagacgccaagttccaaccccttcaagaccatctagatcattgggaaacagtataacaagagttgtaagacgtggagcagagagcgccggtgttgacgcaaatgggaattcttttgatttcacaacaaagttgctgcacttagcatggcacccaactgagaattcaattgcttgtgctgctgcaaatagcttatacatgtactatgcttga

SEQ ID NO: 58913 - DNA, 978 bp, Glycine max
  Peptide Sequence Number=SeqID_175691
atgtatgaaataaccttctctggaaccggacaatacccagaatattctcgtgttggagaaggttgcaaaaccaagcctagaaccaccgatcttgagatcactacaacacacccaaacagagccttattcttgagaaacaagtttcttcttcaaaacaacatgtctggaaccgtgattgtttttgactttgacaagaccattgtcgatgtcgacagtgacaactgggtcatcgacgaattgggtttcaccgatttgttcaaccagcttcttcccaccatgccttggaactctctcatggacaggatgatgatggagcttcattcaaaaggtaagaccatagaggacattgaagaggttctgcataggattcctttgcacccaagagtaatacccgctattcaagcagctcatgctttcgggtgtgatttgaggattgtgagtgatgcaaacatgtttttcattgagaccattctgaagcacttgggaataagggaatacttctcggagattaacactaacccaggttatgttaacgaagaaggaaggttaaggattttgccttaccatgacttcaacaaagcttcccatggctgcactttgtgtcctccaaatatgtgcaagggtttaatcattgatagaatccaagattcaatttcacaagagggtaacaagaggatgatctatcttggtgatggtagtggtgactattgcccaagcttgaggctaaaagagagagactatatgatgccaaggaagaactttccagcgtgggatttgatatgcaaagaccctttgcttgttaaggctgaaattcatggctggagtgatggagaagagttggagcaagttctgttgcacttaatcgccaaaatttcaatggaggaaaattctcagttcatttcatctgattgcaagctacagactctctctgtctctgctttggagggtttgcctaaagtcctcccagttagaccataa

SEQ ID NO: 58914 - DNA, 372 bp, Glycine max
  Peptide Sequence Number=SeqID_175692
atgagtctagaagaagctcaccactttaggaggccatggataagagcttggaggaagaaggagatgaatgaagggagaggaagagaagagcacgaaattttgtgctctaaaagagctctgaaatctgaagattgcatcaagaacgctttcaacaaaagggtgcactcgcgtaaattcaatgagggagaccttgttttgaagaaggtgtcacatgttcagaaagattttcgagggaaatgggccccaaactatgaaggaccttttgtggtgaagaatgctttctcggatggaacattgatactcacaaacatggacggtgaagagctgccttcacctgtgaattctgatgacgtcaagcgatactatgcatga

SEQ ID NO: 58915 - DNA, 168 bp, Glycine max
  Peptide Sequence Number=SeqID_175693
atggtggagaatgtcttctctagcctctcaaccttaactctttctatttctcccgaagctaagctccctttgcacggctctcttttcaagtttcgtgccaacttcagtgttttaaaggctcttggactcctaagcgagatcattcaccagggatgggctgatagatag

SEQ ID NO: 58916 - DNA, 359 bp, Glycine max
  Peptide Sequence Number=SeqID_175694
agtttatctccgggttccttgttgaaccaattatcagatttaccaaggtaatccttgtggcgtctaccgtgacttatcttccttcactggaagtggcgtctacccggacttatcttccttcaccggaagtggcgtctaccctgacttatcttccttcactggaagtggcatcatccaaaacctccgtagcctgtatcaaacgatccgctcctactcaggttcacatcaatgcgcctgaatcggacattcgtgtgaaaagtttcgaccatttgaatttcttgagagcttccgttgttccatttcgagcatctcgatgtattatgcgcctgaatcgggacctccgtgtgaaagagttatga

SEQ ID NO: 58917 - DNA, 281 bp, Glycine max
  Peptide Sequence Number=SeqID_175695
atggactcgacggtgttctcgctgcattaccggagcctcgctcggtcagattccggtaacattcagactcgccagtttggcctcacttcgccgagctctcaggaaagtttcatggagctcacggaggcgaagaggatttacggcgaagcggtgctcgatgcggagaatgctggcagagactcgaacgacatgagcatcgagggagagcaccaaaagaaacatcgattcgacagagtctctcctgcgtttgaagcaatttttttgcagaaggagcgccaaat

SEQ ID NO: 58918 - DNA, 780 bp, Glycine max
  Peptide Sequence Number=SeqID_175696
atgactgacagatttttcaaaaactaccttaatcttgttgacacagatgccacaatgttctttcattccaatgctgctatcgaatggttaattctgaggattgaattacttcaaaatttgacactcttcactgcagctttgctgcttgttctacttccaaagggatatgtggcccctggccttgttggactttctctgtcttatgctttttcattgacagcaaccgtagtttatctgactcgaatgttttgtaacttatcaaactatgtaatctctgttgaaagaatcaagcaattcattcacataccggcagagcctagtgcaattgtagaggataatagaccaccaccttcttggccttccaagggtagaatagatctccaatctctagagattagatatcggccaaatgctccattagttcttaagggcatctcttgtaggtttgaagaagggagtagagtgggagttgtgggaaggactggaagtggaaaaactacacttataagtgctttgtttcgcttagttgagcctaccagaggtgacattcttattgatggtattaatatctgctcaatagggctaaaagatttgagaacaaagctaagcatcattcctcaagaaccaactcttttcaagggcagcattcgaaagaacttggaccctctatgcctgtactctgatgatgaaatatggaaggctttagagaaatgtcagcttaaggcaacaattagtagtcttccaaatctcttggacacttctggtgtgttaaatctgtga

SEQ ID NO: 58919 - DNA, 487 bp, Glycine max
  Peptide Sequence Number=SeqID_175697
atgcaaagaattgctgagggaaatgtgttccaagaaagcagcaatgcttcaacgttacctcagaattccatgcagttcaacactttgatgttgtctcaagggagtggatcatctcatcaacaccacaaatcatatcaaccttggttttcttcctctggagcagcaataggagcacagagttcagcttggtcacaaccacaatcgtcacatcctagctttgaagtcccaaacaagaaacctactgcggtgaattggatcgagggacgtgggaaattggttgtttgtgaagcaattatcaaagaagaattagtgcagaaggtattgaagaccaacgtgtctgccctggtacagcttaacatgctcaaaaaccttgttggttctgttgtctccgatgctattggtgggtttaatgctcatgctagtaacattgtttctgccatctttatagccactggccaagatccagcccaaaaagttgagagttctt

SEQ ID NO: 58920 - DNA, 714 bp, Glycine max
  Peptide Sequence Number=SeqID_175698
atgaggttggataagaatccagttagcttaaaaggacttattggaattgatagatcaattcaatatctagagtcgatgctacaacatgagtcaagcaacgtccgtgttattggaatttggggtatgggtggaagaaataagaagaatggaataattaccttgaaggaattttttttttctacactactacaagaaaatgtgaaaatgatcacagcaaatggattgccaaattatatcaagagaaagattggtcgcatgaaggttttaattgttctagatgatgtaaatgattcagatctactagaaaaattgttcggaaaccatgattggtttggaccaggtagtagaatcattttaacaactagagacaagcaagtgcttattgctaataaagttcatgttgatgatatataccaagttggggtattgaaccctagtgaagcacttgaacttttcatcttacatgcctttaaccaaaagctttttgatatggagtattataaattatcaaagagagtggtgtgttatgccaaaggtattccattagttcttaaagttttgggtggtcttctttgtggaaaagataaagaagtgtgggaaagtcaactagacaaactcaaaaacatgccaaacacagatgtttacaatgcaatgagattgcctcggtcaaataaccaagaaaatcgtgacggatgtcctgctcctaaagtttaa

SEQ ID NO: 58921 - DNA, 603 bp, Glycine max
  Peptide Sequence Number=SeqID_175699
atggatgagaagagaaggaaaaaactagaggaagctactcaatccggaagcactgaggccgtgattgatcgtccatctcccatcagacaacacaagaagtggaagatgacccgcaccaagaaaaatggattcattggaggagcaggcgtcatagggttcctttgtcccccatggacgccaggatgtcctgactgctgccattggcgactagaacacctaggtcgtgtgcgtgctgttggagctggtgtgacaatcaagcaatactttgaaccggcccaacggacctcctgcacttcatcctccatcgctcccgaagaactaaagcagtcgactcaacaaatcagggaccagctggaggagtcgatcacagaaaaagtgactcggcagctgatgttatccttaagccagatacagtcccagtttcagtcacaaatgcaatcacagggacttgcactgccttcggagcctgaggttggtccttcaactactcgtgtcagcacaaagaggagttattttgatccctcagcaaatgatccagacatgggtgactcagacaaatgtgggttgtacatcgaagaaatcctccccgcctggttgccctag

SEQ ID NO: 58922 - DNA, 297 bp, Glycine max
  Peptide Sequence Number=SeqID_175700
atggttgtcatcatcaaaaagggggagaatgtaaatcatgaagattttgatgatgtcaagaagaatttgcttgacaaaggggagaatgtgaatcatgcatatcttgatgatctcgaaaagaaatcacttgattgtcatcatcaaaaagggggagaatgtgaatccttgtttcaagattcactaaagatcaagccttgtctcaaaacaaagggtttcaaagtcatgcaaggctctggtaatcgattactaggaagtgtaatcgattaccagaagggaagaatgaaaaagagctattga

SEQ ID NO: 58923 - DNA, 972 bp, Glycine max
  Peptide Sequence Number=SeqID_175701
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggggaggaggggcttggtcgtccgtccgcccgggcacacacctagttagcaccaggcaggcaaacgagagagagccgacgaacggggacggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacg

SEQ ID NO: 58924 - DNA, 342 bp, Glycine max
  Peptide Sequence Number=SeqID_175702
atggtgataactttgtatgttaagatgattgaggcaacatgggagatcttatccgtaagagttgaaaatcttcatggccaaagtgtgcttcctaccactgaacttatggtatcaactggatctcctttgtcttcactagaagaacaggaagcttatacacagagctggcttaaggaaatgattggtccttcaatgatgattttccacgatggagatgcagcggaagacaaaggagaagagcttggagaggatgcttcaatggaggaaaagaaagagggagagaaagagagaggggggagcacgaaattgaaggaagaaaaagggagagaagttgaactttga

SEQ ID NO: 58925 - DNA, 363 bp, Glycine max
  Peptide Sequence Number=SeqID_175703
atggcagcgcagttgatctatgatcgtgtggtgatggagtgcctagaggaagtttgggagacccccaaaggcaatgagaggtgccgattccgtggcacaattcaactcactgctacttcattagtacatccggaggaacccgcacgcacacttcagcagcctgtggagtggatactacctacacctactccatatcgactagttgagccggttcaagtgataaagaggatattatgtcagcatctaaggcagactctacaaaggagagtggccctagagggacagcgaatagtgacgactcttcatcatagcagacggctccttagactaggcgtacatacttttgtgggtgggtgtatctag

SEQ ID NO: 58926 - DNA, 492 bp, Glycine max
  Peptide Sequence Number=SeqID_175704
atggcagaaatgggaaagttggatcatctagaggaaaggctcagggccattgaaggagttgaagattatgcctttgctaacctagaagagttgttcctagtacccaatatcatcacccctcccaagttcaaggtgttggactttgacaagtacaaggggactactttccccaagaaccatctaaagatgtattatcggaagatgggggcatacgcaaaagatgaggaattgctgatatattccttccaagaaagtcttactggggtagctgttacctggtacactaacttggaaccttcccgagtccattcttggaaggacctagtggttgcctttgtgaagagacctggcagctcaagtggcacctcaatgacggagaaaaaagtgatgacaatgatagttgacacattaccagtattctactatgaaaagatggtgggttacacaccttcaagcttcgctgatttggtcttcaccgacgaaaggatcaaa

SEQ ID NO: 58927 - DNA, 405 bp, Glycine max
  Peptide Sequence Number=SeqID_175705
atggcccgcatgaaaaaaatcggtcaaatgacgtctgaggtgacaaaggaagttgcagacatgattgattccatggaagagcaggccacactgggaagctttgtcacccatggacagcaccctagtcatgttcgtactactggagccgatgtcacgatcaaaaactactttggacgagcttcaaggggctctcgcacctcttcgtccatggctcctgaaggcctaaagcagttgacacaaaatatcagagatcggctagaggagtcgatcacgcaaaaagtgatgatgcaatcctatcccgcaagggcattgggtaaaagactccaagtagattgggctggagatccaagggtaggccctagggttctcatgagccttagggtagatttcgagcccatgggctaa

SEQ ID NO: 58928 - DNA, 508 bp, Glycine max
  Peptide Sequence Number=SeqID_175706
gtgagggcatgtagccctacaaaggtgaaggcacatgaccctttgacggcgaggacgtgtagtcctctgaagttgaaggtacatgaccctttgaaggcgaggacatgtagtcctctgaaggtgaaggcgaggacttatagtcctctggaggtgagggcgtgcagccctctggtggtgaggacgtgtaatcctctcaaggcgaggacgtgtagtcctctaacggtgagggtgagggcatgcagccctctgatggtgaggacgtgtagtcctctcaaggcgaggacgtgtagtcctctcaaggcgaggacgtgtagtcctctcaaggcgaggacgtgtagtcctctcaaggcgaggacgtgtagtcctctcaacggtgagggacgtgtagtcctctcaaggcgaggacgtgtagtcttctcaacggtgagggtgagggcgtgcagccctctgatggtgaggacatgtagtcctctcaaggcgaggacgtgtagtcctctcaacggtgagg

SEQ ID NO: 58929 - DNA, 700 bp, Glycine max
  Peptide Sequence Number=SeqID_175707
atgacttccttgactcacctcgacctctctggtactggattcatggggaagattccatctcagatttggaatctctccaatttggtgtatcttgacctgacgtatgccgatggaacaattccatctcagattgggaatctctccaatttggtgtatcttggccttggaggtcattctgttgtcgaacctctgtttgctgaaaatgtagaatggctatcaagtatgtggaagcttgaatatcttgatttgagtaatgcaaacctatccaaagcatttcattggctacacactctccaatctcttccttctttgacccacctatatttgtcaggatgcaaactccctgactataatgaaccatccttgctcaacttctcatctctgcaaattctcgatctttcccgtactagttattcccctgccatttcttttgtccccaagtggatattcaaattgaagatacttgtttctcttcaattatggggtaatgaaatccaaggtccgattcctggtggtattcgaaacctcacacttcttcaaaatcttgacttgtctggaaattcattctcatcttctatacctgattgcttatacggtcttcatcgtctcaagttcctgaacctaatggacaacaacttacatggaactatttctgatgccctgggaaatttgacttctcttgttgaacttgatttatcag

SEQ ID NO: 58930 - DNA, 1500 bp, Glycine max
  Peptide Sequence Number=SeqID_175708
atggctctgctggcattgaacatctcagtgtgttgtttccaacagcagcgttcccccactctcttcaaacccaccattaccaaacaaaccctctccctccccaccgcttccgctttctcttcctcttccttaactcaactcagcgtgggccaatatttacccgccaactacggcgattgggttcccaaccccgacccggagcttcgcagaagatgcggcattctgctccatccgacgtcgtttcgcggcccctacggaattggcgatcttggcgacgaggccttccgtttcatcgactggctccaccactcgggttgctccgtttggcaggttcttcccctcgtgccacctggcagaaaggccaacgaagaaggatccccttactctggccaggatgcgaattgtggcaacacgctcttgatctctcttcaaggcctcgtcgaggatgggttgttggaaaaacacgagcttcctcaaccaattgatgcagagcgcgtgaatttttcacttgttgctgatgttaaggatcctttgataactaaggctgcagagaggctcatttcaagtgaaggggaactcaaaacacagcttgagaattttcgtcgggaccctgacatatcaagtgagacactcgtttatggagacagcttagggattttaggattacgtgttatagaagttggaaggaaagaaatactagcatatgtggaagtaataagctggcttgaagatgcagcctattttgctgctattgacgacagtttaaacacaatcagctggtacaattggcctgaacctttaagaaatcgccatcttgtagctctagaagatatttaccaacaaaagcgagattttataaatgtatttattgcccaacagttcttgtttcaaaggcagtggcagaaagttcacagctatgcacagagtaagggaatcagcataatgggagacatgccaatatatgttggttatcatagcgcagatgtttgggcaaataagaaacagtttttactgaacaggaagggctttcctcttttagttagtggtgttcctcctgacgcattcagtgaaaccggccagctctggggcagccccctgtatgattggaaagccatggagaaagatggatactcgtggtgggtacgtcgcatacgacgtgcacaaaatttatttgatgaatttaggattgaccactttagaggatttgcaggatattgggctgttccctctgaagcaaaagtagctatgcttggaaagtggaaggtaggacctggaatatccttatttgataccattttcagagctgttggaaggattaatattatagcagaagacttgggagttatcactgaggatgtagtccaactaagaagatccattggagcacctggaatggctgttctccaatttgggtttggaggtgatgctaataaccctcatttgcctcataatcatgagtgcaatcaagttgtctatacagggactcatgacaatgacaca

SEQ ID NO: 58931 - DNA, 3219 bp, Glycine max
  Peptide Sequence Number=SeqID_175709
atgaattccccacccaacttcttgtccctgttgctgtctcttctcttgctcactatctctactccttcctcctccctcccggagctcagatctctcctcgaattcaagaaaggcataacccgagatccggagaagcttctagactcatgggcccccaccaccgtcgccgactccacctccacgtgtccttcctcctggcagggcgtcttctgcgacgaggagtccggcaacgtcaccggaatcgtcctcgatcgcctcaacctcggcggcgagctcaagttccacactcttctcgacctcaagatgctcaagaacctctcgctctccggcaacgccttcagcggccgcctacccccctcgctagggtcactttcgtcactccagcatttggatctttctcagaacaagttctacggccccatcccggctcggatcaacgacctgtggggcctcaattacctcaatttgtccaacaacaacttcaagggcggtttcccaagcggcctcaacaaccttcagcagcttcgcgttctcgatttgcatgcaaaccaactctgggccgaaattggggacgtgctctccacgctccggaatgtggagcgcgtggatttgagcctcaaccagttcttcggtggactctccctaacggttgagaatgtttccggcttggccaacaccgtgcattttcttaacctgagtcacaacaacttgaacggtcgtttctttacaaactccaccattaccctgtttcgtaatttgcaggttttggacttgagtggtaactccatcactggggagcttccttcttttggttccttgctggcgcttcgcgttctcaggcttcctcggaatcagttgtttggttctttgccggaggagctcttgcagacttcaatgccgttggaagaattggatcttagcttcaatgggtttactgggaagtgttgtattgttagagatgggaaaagttcatgccagaaaacccgggactgctttgatcttagaatagtgttctactgccgaaaaggtcttggctgctcaatcggtgtaatcaactctacaactttaaatattttgaatctttcatccaatagtttatcaggctccttgccaacttctttgagaagatgtacagtcattgacttgagcaggaatatgttatctggtgacatttctgttatacagaactgggaagccccattggaggtcattgttctgagttcaaacaagctgtcaggatccttgccttctattttagaaacctattcaaaattgtctactgttgacttaagtttgaatgaacttaagggatccattccacgaggtttagttgcttcatcgtcagtgacaagactaaatctttctggaaatcaatttacaggaccacttctgcttcaaagttcaggagcaagtgaattactacttatgcctccttatcaaccaatggaatatcttgatgcatctaataactccttagaaggtgtcttaccttctgaaataggtaggatgggtgcgcttagactgctgaatctggcaaggaatgggttttctggacagctgccaaatgaattgaataaacttttttatttggagtacctcgatttgtctaacaacaattttactgggaatattcctgataagctttcatccagcttaactgcatttaacatgtccaataacgatctatctggtcatgttcctgaaaatttgcggcatttctctccttcatcctttcgccctggaaatggaaagctaatgttaccaaatgattctcccgagacttctttggtgcctgataacattccagataagggtagacatcatagttcaaagggtaatataaggatagctattattcttgcctctgtgggtgctgctattatgattgcttttgttttattggcttatcatcgaacacaattaaaagaatttcatggaagaagtgagttcactggtcaaaatactagaagagatgttaagttaggaggactttcgaggtcttccctcttcaagttcaatacaaacgttcaacccccaacatcttcattgagcttttcaaatgaccacctgttgacttccaattcaaggtcactctctgctggacagtcagagtttataactgaaatttctgagcatggcttaactcagggaatggtggctactagttcagcatctttaaatcctaatttgatggataaccctcccacttcatctggaaggaagtcttctcccggttctccattgtcatcttcaccccgttttatagaggcttgtgaaaagccagtaatgttggatgtttactcaccagatcggttggctggggaactgtttttcctggattcttccctagcattcactgcagaggaattatctcgagctccagctgaagttcttggcagaagtagccatggcactttatacaaagcaactctggacagtggtcatatgttgactgtaaaatggttacgggtgggattggtcaaacataaaaaggaatttgctagagaagttaaaaggatcggttctatgaggcatccaaacattgtcccattactagcatactattgggggcctagggaacaagagaggcttcttttagctgaccatatacatggggacaacttggctcttcatctctatgagagcacaccccggaggtactccccattatcattcagccagagaataagagttgctgatgatgttgctcgatgtcttctataccttcatgatcgaggacttccccatggaaatctaaagccaacaaatatagtgttagcaggccctgatttcaatgctcgtcttactgactatggtctgcaccggctgatgacgccagctggaattgcagagcagatactaaatctcggggcacttggataccgtgctccagaactcgctactgcatccaaaccagttccatcctttaaggctgatgtgtatgcacttggtgtggtcctaatggaattgttaacaagaaaaagtgcaggtgacataatatcggggcaatcgggtgctgttgatcttacagattgggttaggctgtgcgagcgagaaggaagggtaagggactgtattgacagagacattgcaggtggggaagaatccaacaaagagatggatgaactgcttgcaatatctctcaggtgtattctccctgtaaatgagaggcctaacatcagacaagtttttgacgatctgtgttcaatatcggtttga

SEQ ID NO: 58932 - DNA, 228 bp, Glycine max
  Peptide Sequence Number=SeqID_175710
atgagactctccaagccagcattgcttctcttcctggttttcatcttcactgttgttcaagggcaagcagttaccaacgaacgagttgtgtgttctaagagttctaccactgtcagaagatcaggtggctgtgaaaaacaaggctttgaatacaaggaaggaaatggtgggttggaagacacagttttggagaatgaagactacatctacaccaacttcttgccttag

SEQ ID NO: 58933 - DNA, 163 bp, Glycine max
  Peptide Sequence Number=SeqID_175711
atgaggcctgctaagtttcttcatgcttactactactgtagggagagatttgatgagatagggaagaagatcaagagggaaagagatgtttcatctcaaatgggaagaagacacatgttaggccctccaggaaccctaaatactatcaccccttgtgcagcat

SEQ ID NO: 58934 - DNA, 333 bp, Glycine max
  Peptide Sequence Number=SeqID_175712
atgggtggtattatagctggccatcttcctctaatagttatgataggtttgcaaattcactatgcagcacttaacatcttcacaagagcagttctgttagacgggttgagtacagtagtctttgtagtgtacgggcacggcatagccactgtctttggcgcctatgagacaataaagagtttattgggattcagaagcttctctttgatgtttgtgactgctcttgttggtggagccttgaccatgacattgatcaaaggacagaagatgttacacattgagctccttccagcttctatgcatctcactagcaatggaggtgaggattattga

SEQ ID NO: 58935 - DNA, 780 bp, Glycine max
  Peptide Sequence Number=SeqID_175713
atggcaataaatatgtgttcttccgataaatcaggcccaggaatgagccctcgcatttcattctcacatgatccgaaaaacacagtcccacttgaagaaggccctgaccaagacacaagctcagactttgttttctgcatcacaaacgcacagaaactctcttcagccgacgagcttttctccaacggcaagatccttcccactcaaatcaacagcagactagtttccattcccaattccaattatgccccacgacaccaccacccccaacaacaacaacgcaagaagatgctaaaagagttcttgtcggaaccagatgaggacgacatcatcgacatcatcatcgaagaagaagaagagatgaggcccagcaattcagttaagcttttctggcgtagcagcagcgtgaactgtgacggcgccacgcgtgggaagagcatgcttcgttcttctctgcagtttctgtcgcgaagttattcaacagggtcagcaccaaacacgccaaaacaccacgccgttaacgttattcccaggcataagctggcgaaacagtcctctgcttcctccttttccttgtcatcctcgtcctccaccagttcaggtgcttattatttctatgattcctgccaaaagaacccttccttgaagaagaatttttccggtaataatggagttcgaattagtccaatcttgaatctgccgcatcacaaggccactaggagcattttcggatttggttcactcttctgtaatggcaagattaagaggaagaagaaatag

SEQ ID NO: 58936 - DNA, 1470 bp, Glycine max
  Peptide Sequence Number=SeqID_175714
atggctccaaccgagttcttcatgtgggggctatgtttgatattggtctttgctcattaccaaggtgcccaaggggaagagtctataccaggtcttggtatcaattggggtgcattagcatcccacactttgaatcctaacgtagtggtgaatatgttgaaggacaacgggatcaagaaggtgaaactttttgatgcagattcttggaccctgagtgctttgtctggtacagacattgaagtcatggtaggaattcctaatgatcaattgagtaaatttgctggaagtagcggagatgctgaagcttgggttagagaaaatctcaccaaacatattcataatcatcatgggagcgtcaacatcagacacgtatctgttggaaatgagccattcatgaaaggttacaagggtgcatatgtgaagaccacattcccagcaatgcaaaatattcaaaaggccatcgacaaggctggtcttggagacacagtgaaggtgacaacggctttgaatgccgatgtttacgagtctgcttcagacaagccatcagatggagattttcggagtgacatttacgatgccataaaacaaatactaagtttgcttcacgaaaggaactcaccatttcttgtcaacatataccctttcctcagtctctaccagaacgacaattttcctgaagaatttgcattctttgatggtcaaggcagaacaattcaagacaaagatgcacaatacagcaatgtctatgatgcaaatttggacacccttgtttggtcattgagaaaagctggctaccctgacttgagaattgtggttggtgaaattggatggccaactgatggcaacaaaaatgctaataactacaatgcaaaaaggttctaccaaggactactcaagaaaatggtacacaagaaaggaactcctcttcgccccggagccatggagatgtatctgttttctcttactgatgagaacttgaagagcattgagcctggcaactttgagcgtcattggggaatttttggctacgacggaaggcctaagtttcccattgatttttctggtcagggacaggacaaatggccagtggcagccaaaggtgttgtttaccaagaacgtcaatggtgtgtcctaagtagtgatgttaagaacttgagtttggtgccaagtgcattggactatgcttgtgctggtgctgattgcacaagcttaggatttggttgttcttgtgataagttagaccttgctggcaatgcttcatttgctttcaaccaatattttcaaacaagggaccaaagtgttgaggcgtgtgatttcaatggaatgggaactattgtgaaacaggatccatcaaagggaagttgcttgttccctatagaaattgagagcagtggtgacatggttagagcaatgcgtgcgattggaagcattttgattggattggcattgtttttcgtaacatttacgtag

SEQ ID NO: 58937 - DNA, 1206 bp, Glycine max
  Peptide Sequence Number=SeqID_175715
atggcttcgacttcaatcactaccttgtccatctactctcactcccaaccaaagttcctcaatctgcttcaacaccccctcattcacacccgcaacaaaagcacatcaattacgtttaagccagcgatagttcgcgccacccttttctctacactcacttgttctcacaccccttccacaccctcttcaaatttaccaccgggaagggctttaaccaagttcctctcagaaaaggtagcatttttcctcattgggtcgtttctcttatcgggttgcttcagcaaaaggcctgcattcgcagaaacagctccttccgtgggttctggagcagtgttggaggagaaaatgaatcccactgaagagaaaaacgaggaagagaaaagtgaggaagaggtggaggaaatgtgggagggcattttggagaaggatccgaaaaacgttgaggctctgaaggtggttttgtatgggaagattaggagagggaaatcgaaggaggctgtgaaggttgtggaggatttgattgctgcggagccgaatgaggtggagtggaggctcttgcttgcactttgttatgagactatggggcagttgagtaaggctaaaagattgttcagggaaatcttgaagaagaggcctcttctagtcagagctcttcatgatttgatcagattagttgaattcttcattccaacagatatgttgcataccttagatttagctttggagggtttggctatggcaatgcacaaaatccatgaaggtcctgctgtatttgaaatgctaaataatgctcaagagttagcttctcgcgaaaacagagttaccgaggagagaaatataagaatcttaattgcgcaaatgcatgttgtccagggtaatttggaggagggcttgaaaagatttcaagaattgattgatcaaaatcgtcgagattttaggccttatatttgccagagcatacatgggagagcagaggttttcaagagactgcaaattatcctgtgtcattatgatttgattggaataatatacagtctcctgggtaaaaatgaggaagcggcacagcagtttgaaacatatcaaactcttgtgcctgaagaatttcctcagagacgattcctcgatgatgttgccatagcagcaaaaagatcatccctggaacagtttaagaaggaattcagagatcaattttcttatcggaaatag

SEQ ID NO: 58938 - DNA, 363 bp, Glycine max
  Peptide Sequence Number=SeqID_175716
atggattactattttggaaaccttaatcctaacccttattaccatcactctgccgtagtgaacatggcatctccctcctccgagttcatgttatctgattatctcgtgttggaagatgctcttgttgttgatcatcatcaagagtcttggtcacaaagcactgaaactgaatcgtcggagaaagcaacctccagcgatgcaagtcatggaaagtgccaaaatagtgggattaagggaaagaatgcagaagtgagtcaaaggataacgtttagaaccagatcgcaacttgaggttatggatgatggatataaatggaggaaatacgggaagaaaacagtgaagagcagtcccaacccacggtaa

SEQ ID NO: 58939 - DNA, 840 bp, Glycine max
  Peptide Sequence Number=SeqID_175717
atggacacctctcggcaaaaacaacccgcatcggttggtgaacttccaattgccaccgtgtcggacgatgacgacgacggaagcgacatggatctcgaacaactcggtaaggcactctttgaagctgggaccctggcttccaacactaagtgcaagaaaccgcgaaaaaaatgccagaacaagctcccttcgtcttctccaaatccaaaaacaacaaccatggttcaaaatgatgtgcctgtggtgccatgcttttatatatatgcacaggaagagcagtcttcgggggatcttagttctgtatgttctagctactcctccctttctattaaggggaatggaagtgacgttgacaatgctgatccttcacaagctgaagaaaccttggaaaaggaacaatatgaatacgataaagctttgaatgctgatagaacgtacctcaagttcaagaaacgattggatgcgtatcccgagcaatgttatagatattcatatggtgggaggccaattttagctgcagctgacaaaatgaaccccggcagctgcgatctctgtggcagaccgaggcaatttgagatgcaactgatgcttccattactatactttcttcaggaagcacttggtgaccaaagaaagattgtgggaaagtgggattggatgacccttattatatatacttgttcagagagttgctgtgaagggattgaacaagcaaagtccaataataaggctccatttgttgagaatttccacaacattttgtcttcatcaataggattaagaagtggaattgaaaaaattgcagcagaatcaacattattaaagagggaggttatttga

SEQ ID NO: 58940 - DNA, 825 bp, Glycine max
  Peptide Sequence Number=SeqID_175718
atggacttggccgcgaagcttcaccgtttagacctcaccggcgtggtcattttggacgcacgaaagccctccgtactccgccaccttccgccacgcatcctcaccaaaacaaacaccaatttaatctacacgaaccggttctcgggcccatcgaggcccaattccgcttcctcttccacgataaccgttgaggacgacatcgagtctctcttctccgagacgaattcggaggaggagaggcgctcgaggaagcaaccgagcagtggcgcgtcggggatttcctctggagtgaagctcgagaacgtggggaaagcctacaagggcgtgacggtgctgaaggacgtgagttgggaggtgaagaaaggggagaaggtgggtttagtcggcgtgaacggtgcggggaagacgacgcagatgaggataatcgcggggctcgaggagccggatttcgggaacgtggtgaaggcaaaggagaacatgagaatcgcgtttctgaaccaggagttcgaggtagcgctgagcaggactgtgagggaggagttcaccagcgcattcaaggaggagatggaggtggcagggaagctggagaaggtgcagaaggcgctcgagggtgctgttaatgatttggagctcatggggaggcttttggatgagttcgatttgcttcagaggagggcgcagaatgtgaaccttgatgaggttgatgccaagattagtaagttgatgcctgagcttggttttgctccggaggattctgatagattggtcgcgtctttcagtggagggtggcagatgaggatgtgtctcggcaagattctacttcag

SEQ ID NO: 58941 - DNA, 480 bp, Glycine max
  Peptide Sequence Number=SeqID_175719
atgaggagcagtgatgcattggtggaggttgatggaacatctgtagctgatatattcaagcacatcggagagccgttttttggtaataagactgaggtattgcgaaggctgtcaatgatgcatagacatattatttctactggtggaggagctgttgaaattagtgtttggttggatgtacctctaaaagccttaggtcagagaataacagctgtaggaactgattctcgcccacttctacattatgaagaaggtgatgcatacacaaagttttaccctttgaaattgacctgcagactagtcttgcgtttgtctgccctttttgaagaaagaagtgaagcatatgctaacgccattgtcaaggtctccttggaaacaaaattgggtcgaagagatgtgtcagatttatctccaactgctattgcaatggaggcactagaacaaatcaaagactttcttatgggtgaagatggttgttaa

SEQ ID NO: 58942 - DNA, 300 bp, Glycine max
  Peptide Sequence Number=SeqID_175720
atggagcaaagtaaggagaaaaatgctccttggttatcagtgccacagtttggggactgggatcagaagggacaagtgccagactactctctagatttctctaaaattcgggaaatgaggaagcaaaacaagacaaatatttcaagggcaagtcttggtaatgaagaggagctcatggcttcttctgccactaacaatacaagcactgtccacagtgatgaccaccagcacccccactaccaccaaaccaactctccaactctactatttgttggtggtattatggaaaatcgggaatag

SEQ ID NO: 58943 - DNA, 365 bp, Glycine max
  Peptide Sequence Number=SeqID_175721
ctcagttggaggtggacaacaggggatggtgggtttatgcggacattgtggatgtggaaaacttgttgtgcaccatcgcccgaccgccacctaagtggtacctggagatatgtcgcgggggtcaggagaccttggggacgtcaggtggggtgctattgcccaaaaccaagcttgaccaatcccgacccaacccgggcatagtcggggactggaacattgtggaggcctctggtaatcgattaccagcctgtgtaatcgattacacagagggatgggtcactggtaatcgattaccaggctgtgtaattcaagttcagcctctggtaatcgattaccaaggctgtgtaatcgattaccagagatga

SEQ ID NO: 58944 - DNA, 462 bp, Glycine max
  Peptide Sequence Number=SeqID_175722
atgatcgacctcgcactgctccgcgaaaatccggagatcgtccgccgttcacaggctgctcgtggcaacgaccagagcaccgtcgacgtcgcgctcgaggccgaccggtcgcgccgagcagcgctcgccgcgttcgaggagttgcgggcggaacagaacgcattcggcaagcaggtggcgaaggcgcccaaggaggagaaggctgcgctggtcgcgcaggccaaagacctcgccgagcgcgtgaagcatgcccagcacgcagcccacgaggcggccgaggccgcggcggccgcgctcgcacggatcgagaacgtcgtgatcgacggggttccggccggcggcgaggccgacttcgtcgagctgcgccgcgtgggcgacgtgcgcgcgttcgacttcgagccgcgcgaccacctggaactcggcgagcttctcggggcgatcgacatggatcgcggggacaag

SEQ ID NO: 58945 - DNA, 579 bp, Glycine max
  Peptide Sequence Number=SeqID_175723
atgggttctcggcccaggaggtggcggcgcgtctcgggatcgagccagcggccgcgcgacagcggatctctcgggcgcgcaaggcgatgcaggcgtaccgcagctccgggatggccgaggactgagggaggccgagcgcgcttcggcctccccgtggccgcgccagccgtgcgtctcgtcgtagacagcgacgtcggccgtggttccggcgagagccacggcggacccgtccgggcccgtcccgctgatcgtccagtccgcgatcgccagaccaacgcccgcgctttcgaacacgtgacgaacagtcatcgtgatcggcaggttcaggccgaggaactgctcgagtgcgccgcggacggcctccgtgcccgtgaccggtgttcccggcgcagggacgaagaccacgtccggggtgttcagtgccatcaggccgtcgaggtcccgggcattgaagcggtcggcgaacgcgaggttcagctggtcgagagaagtcaccggagtgctcatgagttttcctttccgagcgtcgacccgacgccgacgttcatggaggaagacgacgcggcgccggaagtgtga

SEQ ID NO: 58946 - DNA, 381 bp, Glycine max
  Peptide Sequence Number=SeqID_175724
cgtgcggactgccacgcgtctacgggttaaacgtcagcgggacttccgtctcgcagggttgcaccagaatcagcgggcatttcttcaccttacacgcctgcgaataagccagctcgcacacttcgcagatatcgcgcacttccgactcatattcatactccatgaagtagcgaaacgtaccgctgcgcgtgtcgctgcgccagaagcgttgcggttccagtatttcatccagttgcctgaagggaaaatctttgctaacgctggcacatcgggcgccgcaacccgatccgtaacggttgcggcgcagagggaaggctttgaccgtcagcgctggattttcaattcatcatcccagcggtctgccgccgcgtttgcgggatc

SEQ ID NO: 58947 - DNA, 119 bp, Glycine max
  Peptide Sequence Number=SeqID_175725
aaaacaaggagttagagataggagtgttgctaggtgcacccaacattattgctggtgcacccagcaaagctattaaatgccaaaattgcccctacttgtttttcttcttacggatcaag

SEQ ID NO: 58948 - DNA, 834 bp, Glycine max
  Peptide Sequence Number=SeqID_175726
ctacatgtcctcaccttcatagggctgcacgccctcaccttcagaggactacacgtcctcaccttcagagggtcatgtaccttcaccttcagaggactacacatcctcaccttcagagggctacacgccctcgccatcaaaggactgcatgtccttgcctttgtagggctacacgccctcacctttggaggattacacgtcctcaccttcatagggttgcacgccctcaccttcagaggactacaaagggtcataggactacacgtccttaccttcagaggacttcacgtcctcaccttcagaggggtgcatgccctcaccttcagagggctacacaccctcaccattgtagggctacacgccctcaccttcagaggactacacgtcctcaccgtcggagggctacacgccctcgcctttagtgggctacacgccctcgccgttagaggactacacgtcctcgccatcagaggactacacgtcctcgccttcaaaggacttcacgtcctcaccttcagagggctacacgccttcgccttcgtaggactacatgtcctcacctttagaaggctacatgccctcacctttagaggactacacgtccccaccttcaaaggtctacacaccctcatcttcataggactatacgtcctccccttgagaggactacacgtcctcgccttcggagggctacacgccctcgcctttagaggactacatgtcccccttttcagagggcttcacgtcctcgcctttagaaggcgacacgtcctcaccttcggagggctgcacactccttcgcctttagagggctacgcgtccttgctttcatag

SEQ ID NO: 58949 - DNA, 231 bp, Glycine max
  Peptide Sequence Number=SeqID_175727
atggttacttccatgcttcaacttgactcgatgaaccttttcgtaaaagcacgagcttggttcaaccccataacccagggaatggaaattttgatcgccaatacttcaacaatatttcatagggatgaaagactcgagaatacgcatgctacgcatggaaaatgtaattatgagattgagatgcccgaagagacatcctttcttaaccacgcattagaaatgggtttatga

SEQ ID NO: 58950 - DNA, 373 bp, Glycine max
  Peptide Sequence Number=SeqID_175728
gccggatcctgaggtcgatgatccgctatatttgatgacattgaccatcccagagcttttcttgcagcctttccaggttaactgggatgctaccatgtttggagtgtgtcatccaaacttcccgttgtacataaagtacgaagatctctctaaaatcgcacatggtagtcaatgtctcaacatatctgtcatacagttgtggattctctacatgaagagttggatgcagagttcacaacgtgatgtctaccttggagcctacctgaatggaccagacaactaccttaagggaataattaacagtgctttgaaaggacttgatgatactccacagtctaaatccaaggctggtgctaggtggattgttgttaag

SEQ ID NO: 58951 - DNA, 548 bp, Glycine max
  Peptide Sequence Number=SeqID_175729
gactacacgtcctcgccttgagaggactacaggtcctcaccatcagagggctgcacgccctcacctccagaggactacacgtcctcgccttgagagggctacccgccctcgccttggggctacatgccctcacctttagaggactacacatcctcgccttcagaggactgcacgtcctcaccttgagaggactaaacgtcctcgccttgagaggactacatgtcctcaccatcagagggctgcacgccctcacctccagaggactacaggtcctcgccttgagaggactacatgtcctcaccatcagagggctgcacgccctcacctccagaggactacacgtcctcgccttgagagggctactcacacttgccttgggtactagttaccctcaccttcagaggatccacgatgtcggatacaatgtccaggacatcctgcccgaaaatactggaaggcaagataaaagtcaaatgaagaatggaagctgcaggatccacgatgtcggatacgatgtccaggacatcttgcccgaaaatactggacac

SEQ ID NO: 58952 - DNA, 183 bp, Glycine max
  Peptide Sequence Number=SeqID_175730
atgtgtcgtaggcaacgctctaaccttattgtggatgagctgaggctactgtggtgtctcgccctgcgcctgcctgggggcgcagtacttcttgatgaaagcccggttaatgggggccctaatgaccttgttgggggcgacgggcgctccgtagaactgacagaggcccgtaatcagagttag

SEQ ID NO: 58953 - DNA, 336 bp, Glycine max
  Peptide Sequence Number=SeqID_175731
atggaaaaatccgacaagacgaatttcaaagagaagaaagaaaagaaaggatatatcacttgggaagataatgtcataaattattcaagtgattcagagaagaaaaccataagtttgggtatcatgatgaaagactatgaaaatggagaagagcaaagtcgatacattgatagcaatttctccaaacacatggcatgcatcaaacaaacaaaggccacatttctccccaagaaaagtgaatatgtgatatatggagacaacaaacacaggccacttgatcaacaaccccaacaagtaatatcaaatgataccaacaggtcacttgtctttgattga

SEQ ID NO: 58954 - DNA, 376 bp, Glycine max
  misc_feature (318)..(318): n is a, c, g, or t
  Peptide Sequence Number=SeqID_175732
atggaactcatgagattaaatcaacatgaggaaaatgacaagaaaaagaaaggaatcgcacttaaagcttcatcttcaattcaagaaggaagcgataaagaagatttgaatgaaatagaagaagatgatgatttcaatttcttcgtaaagaggttcaataattttttaagaaacaaaggaaaccaaagaagatcaaatttgaaaccaaagaaaaaaggagaagattcatcctgtcttccagagtgttatgaatgtaatcaacgaggacatctgagagttgattgcccaagtttcaagaaaagaatagaaagatctganaagaaaaccttcaatgataagaaagcaaagaaggcttacatcacttgggaagacaatg

SEQ ID NO: 58955 - DNA, 435 bp, Glycine max
  Peptide Sequence Number=SeqID_175733
atgtacccactgaagaggttcagtgcacttaacaccttcgttgcttggccaacacatcttgtcaagcatttatcagaacatggagctatgggattggtgaaacctgcagataggccgaatcatgatgtcgatgatcccctatatctaattacattgaccatccaacaactttttcttaactcgttgcaggttatgagggatcttaccgtgtttggggtgtttaatgacaacttccccttgcatatgattgagacaagtatgcgagcgggagatgctgatgtgtatggattcctcgagccacaatccatacagagatctgggcaatcacaatttgaatcaaaaagttatattaagaagtggatgcagaattcaaagagggatgtgtacctaggagcctacttgaatgggccagacaactacctcgggatcctctag

SEQ ID NO: 58956 - DNA, 243 bp, Glycine max
  Peptide Sequence Number=SeqID_175734
atggcctctaggaagaggaaagcaactgcctcccgacctcgagaaccatacgatactaccagatttatttccgaggtcgcttgggagcgttatgagcagaatgttcactcccggaacatccttccgaagaggaaagttaatatttttgttatggagtatgacgagttccgcaaagagctcgagcgaaggcagtggcacaaggccttgaccagacagcctgatggtcgcatcaatgtggccctg

SEQ ID NO: 58957 - DNA, 261 bp, Glycine max
  Peptide Sequence Number=SeqID_175735
atgatgcctattgtcgcaatctacccttcggcgggagggcgacgcagggctcacgggtgcgtctcccaagaaaggaaaatggacggagtcaccaccaatgtttatttgaggaaaatgtcggaaaaaccggaaacgtgtggtccgcgaactttaattttgaaaggtttgggagttgtttttacgcacggggaaggagagaaaacgtttaaggtgttggaccatttaacgatctcttgtgttttgaaaggagagaaacgttaa

SEQ ID NO: 58958 - DNA, 249 bp, Glycine max
  Peptide Sequence Number=SeqID_175736
ctgttgcctgtggtggttcgtggtgtattgcctgagaaacttagggttgcgataacccgcttgtgttttttctttaatgatatctatagcaaggttattgatccaaaaaaactggatgatttggagaatcaggcagccattatcctatgtgaattagagatgtattttcctccatcgtttttttatgctacctgtatgcttcttataactgttgagagttcatctccacatggtcaatatcaccaatga

SEQ ID NO: 58959 - DNA, 204 bp, Glycine max
  Peptide Sequence Number=SeqID_175737
atgcatattttgttatcttatgaccagagcaggatcgtcttaggcgatggtcaaataccgagccaaatccaaagacagagacaaatcgaggtacttagggacgggcacgagtggaggctaggtccacgatcaacggatcgtcgtaccgcgtccagctccggacaagcgagaagcactgctgggaggcagcctagtatcctttaa

SEQ ID NO: 58960 - DNA, 241 bp, Glycine max
  Peptide Sequence Number=SeqID_175738
gtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccac

SEQ ID NO: 58961 - DNA, 234 bp, Glycine max
  Peptide Sequence Number=SeqID_175739
atgcaagatttagttgcagagaaagggaaacatctactgaggattcagaaagagagcttgagggttttggagagaggattctgggttttgttgcacgggagagtttttagaatggttcataattgtgaaaatcgaaccggtgacctaactagtccgattaagctattggattggaaccaacatcaatttggtttgacccggccaggtttggtcaaaaccagtggcccaaactag

SEQ ID NO: 58962 - DNA, 384 bp, Glycine max
  Peptide Sequence Number=SeqID_175740
atgagttccataaccaaagctcctccttcctctaacgatgatatgtcaactgaggagagtggttggaccacgtactttgatgacttcttcaacaaccatgttgttgataacaacaagtgttccatgtctttatccgatggtatagctagctcctcccttgtctccgatgctgcttctttggtagacaaaaaagtggctcatagcaaacaagttgaggagttttatgtgaatagaaatgtcaagagttcatgtttaaagaaaaggaaggatgcaataacggctttgattgatgactctttggaagatacggcaacttctcctcttaatagtcccaaggttttgtatgtgaatcagaagattgacaaggcaaacagacggaagtag

SEQ ID NO: 58963 - DNA, 432 bp, Glycine max
  Peptide Sequence Number=SeqID_175741
atgggcgcactgagcgcaagaagaaacaacttcttcgctgggctggctggctacgcgctacgcgcgcaaatctctgacttctccttttctagggtttcccatccgctaagcgagtcatttgataaggttctaaccaacatattggctgaattgggtctgcaagatagtgaacatagcagacttgggaattggcatttcagaggcataagtagtggagagaaaagaaggtttaccatagggattgcaatcttaactcaacctcatgtactgcttgtggatgaacaaactactaggttggatagtgcagctgctttgcgatttgataaggttgaattgggtctggaagatagtgcacatagcagacttgggaattggtatttcagaggcataagtagtagagagaaaaaaaaggcttaccaattgagatgttaa

SEQ ID NO: 58964 - DNA, 144 bp, Glycine max
  Peptide Sequence Number=SeqID_175742
atgtcgtacaacaacattgctgacatgaaaggtcaccaaggatggatgaaagtagaagaaaaatatatagaaaaacttggtcaatacattcccataattgaaggtgttctgaggactgcacttgacatgggggttctgtggtaa

SEQ ID NO: 58965 - DNA, 1950 bp, Glycine max
  Peptide Sequence Number=SeqID_175743
atgccaccaaggaagaacactgctttgggagaaccagcagctaaggagcacggagacacgagagtggagtttgtagtaggagaggaagccgctgataatcagacgcggctgctcaatctcatgtcgaccttttcgaagggacttaaggaagagggcgaagggaaatctagtgggaatccgagactgaaaccactcaaacgcgatgatttgctggagtttcatcaattgatgaagaaaatcgaactaccttcattttacggtgatgacccagtagggtggattgtgagggccaaaatctatttcagcgttcaagaaacacgcgaagctgttcatgtgagccttgctcaactctgtatggaaggaggtacgatacacttttttcattctctgttgaataagtatgaaaatttgtcatgggaggatttgaagagggagatgttggagcggtatggtggaaggggagaaggaaatgtttatgatcaattggcatcgttgaagcaatcagggaggattgaaggacgaaatccatgcgagaatgcgaagcctgcacgtcgcgaatcctttgaccaggggatgaatgatgaacgttgctttgcaattgacgtagaaatctctggacaaagcagagtgtggcagggaagaggcgaaatatatggagatggaaataggctagacccaagtggaaaaaatgatgggggggattgtgttttaagtgtggagggtcatttggaccactccaccagtgccccattaaacacctccgggggcttgtacgacattgagtctctgttcgatgaagaagaaggaggaggaacaaccacgaacgatgaagttgtgagaacaaaacagatgagaattttgatgggggatgggcacaaatctgaaatgcaaggcgtatgtcgtgggattaaggtggagtttgatgaaagggaatttgtaattgatgtttttctcttcaaattggaggacatggacgtgatattgggaatgccatggtttaccaccttaggggaaaccttggtggattggaaaaatcaggtgatgaaaatcaaaacagatcaaggagagaggtggttaagaggagtaccccgtgaagattcgttgttggtgtcaatgtttggcctgttggaggaaaaagggggaagtgaagagaatggattgagccaagaacaaagacgtgtcctagatgaggtgttgcagaattttgttgatgtatttgttgaaccaaaggggctgccacctgtgggtcatgtgaggcatagccagagtgtatactccagcccgatcattttggtgaagaagaaaaacaacaaatggcggatatgtgtggattatagagcactaaataaagccaccatacctgacaaatttcctcttccagtgatagaagagctcttggatgagttatatggggccaggttcttctcaaagctagatcttcgttcaggctaccatcaagtaaggatgagagaggaggatattccaaaaacgacttttaggacacatgagggtcactacgaatatctcgtaatgccttttgggcttatgaatgccccttctactttccaagaactcatgaatgaagtctttcgtgctttgctaagacaaggagtattggtgttctttgatgacatacttgtatatagtagaagctgggagaaacatgtgcaattactagaaacggtgttgggggtgctgagggccaacatgttgtttgctaacaaggaaaagtgcacctttgggcaggaaagcattgtgtacttgggccacattatatcaatacaaggagttgcaattgatcctgtcaaggctcaagcaacttttgaggagcttaagaggaagattaccacaacatcggtgttgcaattaccaaattttgatgaagagttttctttggagtgcaatgcatctgggacaggaaaccagtttcttattacagcaaagtgttga

SEQ ID NO: 58966 - DNA, 243 bp, Glycine max
  Peptide Sequence Number=SeqID_175744
atggggaaaagtgtttctaatgtaaagacgtttcttgagaagagggtcgtaacggaaggtgaagcactccgctgtgtcggggtctatcttagtcatgagttttccatcaaagtcgtgacggctgagcgtgtcgatgtcaccgtcagtggattacttggaggaccagaagatttctcgctctggaccgaacctcccttcgcgaatggtcaaccaagtatcaaggtcgagaaagttgctaaatga

SEQ ID NO: 58967 - DNA, 525 bp, Glycine max
  Peptide Sequence Number=SeqID_175745
atggattggttctatttgttcagttttgctcaagctgctgctgcagctcaagctggtgcttctgtcattcaaatttttgttggtcgcataagggattgggcacgtaatcattctggtgacacagagatagaatctgcccagctaagaggagaggatccagggctggcattgtgtagaagtagtattacgtgtgggccaactaatactttggtgtttcctgaaaggttagtgaagattgtgaacgtgaatataaagagtgaggttcagggagacaaatccaatggaaagaaggtagccttgtcggtgataaatagaagagatagtcaaaactatggaattaagatagtaatgtcaatgaagtttgtagcgcctaataggatggtgtgggaggatgaatcaactccttcagatatattaggagcgaacactcaatttcagggagatcaaattttagcaagttcgagtcaaaaggtggaggaaatggagggaattgtgagtatggtagtggagatgtcgccgggttag

SEQ ID NO: 58968 - DNA, 570 bp, Glycine max
  Peptide Sequence Number=SeqID_175746
atggctcataggaatttgggaagtgatgactataaagagcttgttaaggagccagggcggttggtgttagccaattcgatgttaggcaataatagtagaagggtgcacttggtgaactgggatgtgatcactgagcctaaagaaggtggtggcttgcgagtgagagtagcaagaaaccataatattaatatattgggcaaagataagtattttctagatgagaacctattcatggcagaaggtagaaaggggtcgatgacttggaatgcaatcatgaaagtcccatggattgatatctatgatgggttgaaagtgagaactatgtggagtaatagggactggaatttgaactccctatacatagcaatatctgatgagattcatgtcctcattgaaatgcatatgactttcttcaagaagttgaggaggtgggtgatcaggaaaagacctggagttggattttggaagatgaaggttctagctttggttcaatttttcatgtggcaggcaagtgtagttagggttcagaagcctcctttagactcctccaaaatgatatgggaggagtga

SEQ ID NO: 58969 - DNA, 276 bp, Glycine max
  Peptide Sequence Number=SeqID_175747
atggactggagatgcttcttcaagcccaaaactcccgtccaaactccacaaaaacacaatcatcttgcaccacttcttgtagcaattgttgcttgtgttccaaaaaaagttcacattgagggagctggtgaaacaggattcaagatatcatcaattgaaattacggatgctatcaaagctggattggatgaacctattcagccagagcctgagctattagatcataactacatgtttgtacatataccttgtctgaaatttgacatgagtttataa

SEQ ID NO: 58970 - DNA, 528 bp, Glycine max
  Peptide Sequence Number=SeqID_175748
atgagcctatgccttctgcctaggtggggtgcaatggacgcagaagcatatccagaagcatcaaagagtgtgctacaaattttgtgggatgtagttacctatggtcagggtagacagtggggaaaagcaagaatttcagccctggaggcagttgctcaatatgaaagagtagtcaaggaaaaaagagttacaggaagcaagattgaaaaattgatggatgtatttccacagttgtctattttgtctcttgcttctctcaccgttagaagctcctttcagaaccttggcctccttgaatccattgctggtgtccaaaccaacaactcctccattatcgatcttgccctcatccaagcttttcagttgtactcagttgcctgcagcccaatagatgcagccttggtggctactacaggcggtgatgacagaggatttctctggaagattggccaaggggattgggcttttgagcttcaaggtattttgttagtaacaacaaggacaatcagcacacctagcagcacatag

SEQ ID NO: 58971 - DNA, 186 bp, Glycine max
  Peptide Sequence Number=SeqID_175749
atgggacaacttagtgatcaaagggatcccacagaccctaagagaatcaaggtcattcctgattggcccactccaccaagtgttgagggaaggatcccaaagtatgaagaaactcgggatttgaggtcgaatcctttccaaggtggaggggatgatgcaatcctaccccccaagggtattgaatag

SEQ ID NO: 58972 - DNA, 429 bp, Glycine max
  Peptide Sequence Number=SeqID_175750
atgactttgttgttcccggaggaacaaaaggtgcagaagactgtgtcagcccctgcatgctatcaagcgttctgtcttacagatagcaaaagaatgggtgcgaataaccataaggtatctccgcgtatcatgggtatctccgcgtatcatgggtgcagaatgaccaaacttggtctctgcgtgccatcggacacgactgtgtctgaatggcaaaggggtgcggataaccgtaagaatgaccaaacttggtctctgcttgccatcggacccgacgcctctgaatggcaaaagggtgcggataaccgtaaggtatctccgcgtatcatgggtatctccgcgtatcatgggtgcagaatgaccaaacttggtctttgcttgtcatcgggcctgccgcctctggatgacaaaaggggtgcgaataaccataag

SEQ ID NO: 58973 - DNA, 258 bp, Glycine max
  Peptide Sequence Number=SeqID_175751
atggctccgcctcctccaaggaagtgcggaaattcatcatccctcagctgcctctgtctctgtctgaggaatgaccatccctcgatggccttgaaatgtgatcgaggccgtacccgaatcaaattaaacatgaaaatgcaggagaactgccaggaaaccacattacaagtgaacctcaaagagagttgggcttcgtcctcaaaaggaaacaacaccagaaaatctagccttccatggattcaacagaaacgcaattga

SEQ ID NO: 58974 - DNA, 353 bp, Glycine max
  Peptide Sequence Number=SeqID_175752
atgatggagaaggaaatgataacaatgatagtggacacattaccagtgttctactatgagaagatggtgggttacatgccttcatgctttgtaggtttagtgtttgcgggtgacaggatcgaagtaggcctaaaaagtggcaaatttgattacgctgcttcgatgaattctggtgatagaaggcctagggcaaatggagggaataagaaggagggagaaacccatgttctgactgagagatatctgagcttgacgaggaagccatcttgcggagctttggatgatattttgagtgattgtgagaagcttccctactatggagagctaaatcctcagttggttcttcctatggg

SEQ ID NO: 58975 - DNA, 688 bp, Glycine max
  Peptide Sequence Number=SeqID_175753
atgcctcagcaacctatgctattctgtgaggtgtttgatgtctgggttgattatgtttcaaaatgggtggaagccaagcccactagaactaatgatgctaaggttgttgtagactttgtcagatctaatctgttttgcaggtttggagtacctaaagcaatcgttagtgatcaaggaacccattttttcaacaaatcaatgcatgccttgcttaaaaagtacggggttgtacacaaggtatccacaccataccacccccaaaccaatggacaggcagaaatttctaacagggagataaagagaattttagagaagattgtgcagccaagcaggaaagattggagtaccaggctagatgatgctctttgggcacataggacttcctacaaagcacccataggaatgtctccttatcgggttgtgtttggaaaggcatgtcatcttctagttgaaattgagcacaaagcatattgggcagtgaagagttgcaacttctctatggatcaagctggtgaggaaagaaagttgcgactgagtgagttagatgagatccgcctagaagcgtatgagaatgtcaagttctacaaagaacataccaagaagttccatgatagcattataattaagaaggacttcatggttgggcaaaaagtgttattgaataattctaagcttggactcatgagtg

SEQ ID NO: 58976 - DNA, 904 bp, Glycine max
  Peptide Sequence Number=SeqID_175754
ggacgcggcgtggaaaaacgcgcagcagggctatgagaaggtgaaaaagctcgatgcagagaaaaatcatctggtgtggctgacgccagcaccggctaacaacacctggaccattgcggtgcgcggcgatgtcgcgcagcagaataacctgaaatcccttgacgatctcagcacttacctgaaaaaaggcggcacctttaagctggcggcgtcggcggagttcatcgagcgcagcgatgcgctgccggcgtttgagaaagcctacaacttcaagctgggccagtcacagctgctgtcgctggccggcggggacaccgctgttaccatcaaagcggccgcccagcaaacgtccggcgtcaatgcggcgatggcttacggtaccgacggcccggtcgcggcgctcggcctgcaaaccctgagtgacccgaagggcgtacagccgatttacgcgcccgcgccggtgatccgcgccagcgtgctgcaacagtacccgcagattgccgactggctgcagccggtgttcagcaagctggatgagaaaaccctgcagcagctcaacgcgcaaatcgccgttgacggtcaggacgccagccaggtggcgcagcacggtgctgtcacggataaaccgaccgcgccagcagccggtgctgctggtgctgacgctgctgattacgctggcgctgggagcgctaccgctgctgagctatgcggccaaccggctggtctccggacagccgctgatgctttggcaggtaacggcgggctggctgctgctgctgccgctgttatggctatggctgggattgtggtggccgccgggacgcggtgcggcgctggcgcagttgctgggcgcggagctactgttcgccctgctgattggcatcggcggccacgccgccagtga

SEQ ID NO: 58977 - DNA, 372 bp, Glycine max
  misc_feature (228)..(228): n is a, c, g, or t
  Peptide Sequence Number=SeqID_175755
atggaggccattaaagagaaaatggccacaatgatggaggccatgatgagagtgaagaagataatggaagccaatgcggttgcaattgccgctaccagcgttgttgctaaggtgaacccgacgtccccatccgggcattcaattgaattcaatcccccaaacctcagatatggtaggcaaagatttgggaatatgggcggcccccatgatgtgcaaattcaaaaaaancccgagcacgcattcccgccatatggcttgccttcaactatacgccaacccaattggcgtacactcccaataagaatgtcaataactccactcctatacccattgagaccaacaaccccaactgatcatgcacatgtctcttaa

SEQ ID NO: 58978 - DNA, 262 bp, Glycine max
  Peptide Sequence Number=SeqID_175756
atttgatgccgtgatccactttgctggcttgaaagcggttgctgaaagcgttgcgaagccccgtcgctattttgattttaatttggttggcaccatcaacctctacgaatttatggcaaagtataattgcaaaaagatggttttctcatcatctgcaaccgtttatggccaacctgaaaagataccgtgtgaggaggatttcaagttacaagctatgaatccctatggacggaccaagcttgtggtttctaaggtcggataa

SEQ ID NO: 58979 - DNA, 263 bp, Glycine max
  Peptide Sequence Number=SeqID_175757
gatgtttctactctacagcagttggaggattaagatgctatgagaatccaaagaataagattactgcagtacctgccgaggaagagcaaatttggggtgcattcttcaagaacagagaatcagtgatcagtcccaacagtaatataaggttaatgtcagttgagactgcattaggtacaaagggaaaatgtgaggtaatcttagagcttaagaagttagagttgaatatcccttacgtaactaggattgccagttgcaactag

SEQ ID NO: 58980 - DNA, 405 bp, Glycine max
  Peptide Sequence Number=SeqID_175758
atggctaaagcagaggaggtgcaagagaaggtgaaggtcgacatggaggctatgaaagagcaaatggccatgatgatggccatgatgagcaagaggaagataatggaagccaatgcggttacaattgccgctaccagcactgttgctaaggtgaacccgatgtccccatcgggcctcaaccaaatgaatcatccaacctcagctatggtaggcaaagatttgggaagtacgggcggcccctattatgcgcaaagtcaaaacaagcatgccttcccgccatatggcctgcctcccaactatacaccatccaatgtggcatacactcccaatgaggatgtcaataactccactcctatacccattaagagccaacaaccccaaactgatcatgcacatgtctcttaa

SEQ ID NO: 58981 - DNA, 486 bp, Glycine max
  Peptide Sequence Number=SeqID_175759
atgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctacgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 58982 - DNA, 312 bp, Glycine max
  Peptide Sequence Number=SeqID_175760
gcttttagatttaggtgttgaggtgagtcaagttttgctacctggcgatcaagcaagctcacaagtttcagggggaagtcagctatcatcaatggattcgtttctttcaaaggctgaagccaaaactattttagaaatcaatgtcatttctgaggacgctatttgtgttacggtggggactattagcaaaatagtcatggataaccattcatggtgttatccagcctgtgctcaatgtcataggaaaactgacatccaaacaggaccattcacatgtggatgtggcaaggataatgatcagcctgttctaag

SEQ ID NO: 58983 - DNA, 150 bp, Glycine max
  Peptide Sequence Number=SeqID_175761
atggccggcggctggcgcccaaccgtacgcccgccgcgcctcggcggtaatgcccgcatgggcgtatttgccacccgctcgacctttcgccccaatcctatcggcatgtcgctggttgagctcaaatgcatccgctgcgagcagcaacag

SEQ ID NO: 58984 - DNA, 225 bp, Glycine max
  Peptide Sequence Number=SeqID_175762
atgatgaatgtgttgagtgttgcaatcctcttttgtaaaatcagtcatgcacccaacatcttcatgattcatgtcatagggactcataggaataatcaacgtgaaaatacaaaaaaaggtgtccagggaaggagcccaaagtatgaagaacctcaggatttgaggtcaaatcctttccaaggtggaggggatgatgcaatcctaccccctaagggtattggatag

SEQ ID NO: 58985 - DNA, 580 bp, Glycine max
  Peptide Sequence Number=SeqID_175763
atggcattaagatttccaaggtttagtcaaggcttagctcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaa

SEQ ID NO: 58986 - DNA, 828 bp, Glycine max
  Peptide Sequence Number=SeqID_175764
atggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagatttcttgggatcctgcaagagctactcgttcttttttctctga

SEQ ID NO: 58987 - DNA, 288 bp, Glycine max
  misc_feature (150)..(150): n is a, c, g, or t
  misc_feature (275)..(275): n is a, c, g, or t
  Peptide Sequence Number=SeqID_175765
atggcattagcgcgtgatttttgtagggaaacaacccatggggcaatttggtttagaataggtagcaagatacctttggcaatttgcgctttgggtatgaatagcgaagtacttgaatgtattagaaataccagaatgtgcacgtatgcnatttttgatagccaaagtgctttgagtatgcatgggtttgtatgccatttttgttttaagggtagcatttcttggaatggctccgaggaagcttgcctcaaagaggtccaggaaggacaaggcgngcgaaggaactag

SEQ ID NO: 58988 - DNA, 238 bp, Glycine max
  Peptide Sequence Number=SeqID_175766
gttgttaaaatggcaaacacttgaccagacacttgtgagcagagagaaacaccagctttgtaaggatatgcaaagagaccagtcaaaggatcaaggaattgaagtcatggagagtgttggaatgcttggaacttacttgagaaaatttttgcttaagaatggaataattttatttgcttggggacaagcaaaatataaaaattggaggtgtaacaagcacaaagggcagaaaaattga

SEQ ID NO: 58989 - DNA, 567 bp, Glycine max
  Peptide Sequence Number=SeqID_175767
atgctggtggacttgctgatggtgtctccagagtctgctagggctgagacagtccagtgtcgcgaaccgtacgtacgcctgcaatgggtacatgatatatatcagcgccgatgccaggcaggtcattggacagctgcggcttgcgcatatcttcgtcacctactgggttgcactctgtttgctaacaagagtgcaaccaatgtccatgttgtctacttggaggcccttcgtgacctcagtatgacagagaggtacgcctggggagtggctcctttggttcatatgtacgaccagctgaacgatgtggattgcgacgaagaagaccgtgaagagaattcgcacgccgtcgtacagggagcgcctggatcgactccggattctggatgtctgttggatcccttatggggagcatcgggaggttcgggacttccacgtcagatcatgctattccggtctcttgcgctgagggtctgttgctgtttattatcgaccagagagggtcgtgcggcagtttggctacacgcagaccattcctgctcctcctatcgattcatgggtctcgtatga

SEQ ID NO: 58990 - DNA, 1524 bp, Glycine max
  Peptide Sequence Number=SeqID_175768
gttcaaaacaaggctgtcacacgcttgtgcaaagagcgagtgattgtcacagtgaatggactttaccctggaccaaggatagatgtccgagaaggggacgctgtggttgttcacctctttagtgcatgggcagatggtcctgaatatataacccaatgcaatattcgtcctcaaaatagttatacctataaattcaatgttatacaacaagaaggtacattgtggtggcatgctcactcaggagttttacgtgccacggttcatggtgctttcatcattcaccctcgttcgggtgattggtatgacggtaatattgtggatatttatcagcaagtactccttctcggggatgtaaggccatctgctgcctacaccatcaatggtttgcctggtgatctctacaattgctctagaaatcagatgttcaagctaaaggtaaagccagggaagacctacttgctaagaatgatcaacgctgcattcaataacaaccttttcgtcaagatagccaaccacagcttcacagttgttgccatggacgcttcctacatcgaaccctatgtgaccgacatcatcaccatcgcccctggccaaactgctgacgtgctcttcaaagccgaccaacccataggctcatattacatggcagcctctccttacgttgtgggccagccagaagccctattcgacaccacgacaactcgcggcattgtcgcttacgaaggctacacgacatcattaaaagactcgaagcccattgtgccactacttccacccttcaacgccacaccaattgctcacaaattttttagcaacatcacgagcttggtgggggccccacattgggccccggtcccacttgaggtggaccagcacatgttcatcaccattaacattaacctagaaaggtgtcccaagaatggcacgtgtcaaggtgtatttggacagaaattctccgcaagcatgaacaatgaatcatttgtgcaccccgttggaaaagggtactctatgttggaagcatcgttttataatgtgagtggtgtgtatactactgatttccctgacaagcctccaatcatatttgatttcacaaaccctaaaattgctttggatacgaagtatttgtttacgccgccaaaatcgaacaaggtgaagaaactcaagttcaattcgaccgtggaggttgtgtttcaaaatacacaaattatgaatgcgcaaagccaccccatgcaccttcatgggtttagtttccatgttttggctcaagattttgggaatttcaattacaccaaagataaatacaagtttaatttggtgaatccaatatttcgcaacacgattgctgtgccagctggaggatgggctgttataagattcaaagctaacaatccagggatgtggtttgtgcattgccatgtggatgatcatcagttatggggactagacatggttttcgaggttgagaatggaccaactccttcaacttctctccctccaccacctgctgatctacctaaatgttag

SEQ ID NO: 58991 - DNA, 543 bp, Glycine max
  Peptide Sequence Number=SeqID_175769
atggcttacatagagatgagtcattgtatttctcctgtcaagacaaattcagagaaggtaagtaagagggatcatgttagaagcaggttgaactttgatgctgctgatgtgcctgggagattggacaatccattgcccaatgagatttctacatctgagtctgaaaaggaattggacatatttgacattgagtttcctaactttgatgccttagggacggacttctccttcacagaaatgttaaatgatctagacttttcttgtgaaggcatggatttttcttgccatccaacaccaagtccttcaatggataacgcttcaggctcatctcatgaatgcaatggtaatcatgctacgcctgaattatcaactgtggcagaagttctatgtgagaaagacatgaaaatactaggccctgattgtatgactgcaatgaaatctgtcacaaaaaacataacagttataagccctgttaaactttcaatggaagaggcaagggaaagactagacatgctgggatttaaattttttcaagaatcttaa

SEQ ID NO: 58992 - DNA, 171 bp, Glycine max
  Peptide Sequence Number=SeqID_175770
atggacaattattcaatgcttaatattattgaaaacgacgttcaggcgaccgggaagcagcaaagaaataccatagtcatttcactcagactcaaattattgaaattagaatggtgccatcggaacatcagtaccagaccaaggattaacttggtgacaaaaatctcttaa

SEQ ID NO: 58993 - DNA, 195 bp, Glycine max
  Peptide Sequence Number=SeqID_175771
atggagagtggtgcgcactcccctcggtgccactggcaggctatgcgagactgccatagggacagtggtgatgcgatggcggcagaggcgctgctagaggcatggtggcgcaaacaaaataagaataaagaagaaacagtgaatgagaggatatctagtgacccctctcacttctcttccggtgtggccaaatga

SEQ ID NO: 58994 - DNA, 796 bp, Glycine max
  Peptide Sequence Number=SeqID_175772
atggcggggaagcaatccaaagccagaaagccagaggtgttcgggaagggcaaggtcacccctactcagatcgctttcatcgtcgacagatacctctgcgacaacaacttctcctccactcgctccaccttcagaaacgaagcttcttctctcatctcccattcacccattcatgaggcaccaaagactttgttgactttgggggagatgttggatgagtatatctgcttgaaggagcagaaagtgatgttgaatcaggaacgggctgcagtagaacaagagaagaaccgggttcagatgctgttgcaaggcatgcataatgtaatgactgcttacaatgctagtggaaacctccctgcacccgcatctgctgcaaaatctgcagttgtaacggttcctcaaccgacatttggttacaaatctcaaccaggtaatcctacttctgtgcaaatcaaatcgaatgcaccgccattgcctcaatctagcaattcaaatgttgagggtggaaacttctcaacaccaacgctgaatgtctgtgacagaaagagaaaggatactaaagctgtggatgctccttcagctgctaaaaaaccccgtggtagatcatccagtaggaaaattgttgttcaaggtcaaaatgctctgcaacaatctgataaagctgtcaataatacaatggtagctcagccttctaccattcaatcttcatcagagaaatgcatacccagggagtcacaggttcagggatacaatgttgctaaatgtttattcaaccggtctacaacttctgttccaa

SEQ ID NO: 58995 - DNA, 378 bp, Glycine max
  Peptide Sequence Number=SeqID_175773
atgggcgacggagtcggcatgggtgacgaagttggcgtgggcagcggagtcggcaagggtgattggttgtgttgcattggtacggggcatggaggcacagttagcttagaaggcaaagtcgacggtgaggcagttttagaagaagggcttccaatgtggattcaaggcggagttgagctgcaacaagtttggcaatggcggcctcgaggcggtccacgcccgctggagaaggttcgacatccgccattcgaggtgggtgctaaaatggaagggacaaaggggatggatgctacagaaatggttgctggtgggtggctgtgtggaaaggatggcgtgggaaggggtgattcggtaggtggtgtgggttgcagtggctag

SEQ ID NO: 58996 - DNA, 264 bp, Glycine max
  Peptide Sequence Number=SeqID_175774
atggttgctgaagttcattcaataatcacccaagtcctctgcttctcatcaatgtcttttgagatggacctaatagcaaaactacattacccatatattgtggagtacaaagatgcttgggtggagaaggaaaagactgatgactacatatgcattataactggctattgtgaaggaggagacatgctttgctgctggctcttggtgataggaagggtattaaccggtttggtaacttctctgctccacttgatgaagcattaa

SEQ ID NO: 58997 - DNA, 495 bp, Glycine max
  Peptide Sequence Number=SeqID_175775
atgacctccataaacacattaactcataaatactcctccctgtttcagcctctcaccactctacccccgtctcacccaaccaaccacaccatcacccttctacccaactcatctccggttaatgtgagaccatattgctacccttattaccagaaaaaagaaattgaatctcaagttgcttctatgttgcaacatggcctcattcaacttggcaccaaccccttttcttctacagtgctactcgtgaagaagcgcgatgtctcttggcgattctgcgtcgactatcgcacattaaatgccatcacgatcaaagatgactttccgattcctacggtagataagttacttgatgaattcgggggcgcaaaatggttctcttacgtggccaattctctctcaaacttccttagtcatttggtgtcggagaatggagttgaaccgatgctagagaaattaaagtgcaagctattcgacaatggccacaaccacgaataa

SEQ ID NO: 58998 - DNA, 1020 bp, Glycine max
  Peptide Sequence Number=SeqID_175776
atgagctcattaaagacattggatctttctgacaatcaattgtttggagaaatacctgagggcatatttggagttctgtaccaatccaagggatatacttacataggaacatacaaggctgaacattctccttttgaaagtcaatcgctttactggcgctataccaaaggagttgtgccaattgatagatttaagcatactacacctttctcatcacaatttttctggtgcatattcaattgcttaggtaaagtgccttttgagattaagtaccctgatttattcttggaaatattgtctggccggattttggtagatcacaaatattgcatgccttttgacacaccaatattaccaaatgtggaagagaaagcaaatttcacttcaaagaatagaaccaacacttacacggggagaatccttgcttacatgtctggagttgacttgtcaagcaataaactattgaggaatatcccatctgagcttggaaacatgagaagaattcgatcattaaacttgtcacatgatgatttgacagggcaaattccgactacattctccaatttggtacacggaaagagtttgaatctttcatttaacaagttgagtggccaaattcctccacaattgagtgtgttatcctcccttgatgtattcattgtagcgcacaataacttatctggtgcaacacctgaaagaaaaggacaattttcaacatttgaagaaagcagctacaagggtaatcaattcctttgtggacctccactaccaaaaagttgcaatcctctacctcttattttaccaaatgatgaaggtagtgatagtttggtggacatgtttgttttctatgtgagctttgttgtgtcatacatatcagctttgttggtaaccgcagcagctttatatattaatccttactggaggcaagcatgggtttactacatagaattgatgaacctgaattgctactactttatcatggataatttgtgtaagttatttaaaaatgaaaatatgtaa

SEQ ID NO: 58999 - DNA, 351 bp, Glycine max
  Peptide Sequence Number=SeqID_175777
atggtgaagttgcgtcctcatcgtcaggtattagacatagggtcctcgtattcaaaattagctaagcactattatggaccattccaagttgaggatagaatgggaaatgttgcttataaattgaagctgccaacacagtcttgcatacatcttgtgttccattgttcaatccttaaactgtattttcaagctacttcaggaggagtgaaggcaacttaccaccttaaggacaaggtgttgcttggtgggctccggaatgatacaacagatactgggggtctggaagaagcaagagctacaaggtccaaaaggaaaagtgtaccaccagcttacttgaaggattatgcgtag

SEQ ID NO: 59000 - DNA, 207 bp, Glycine max
  Peptide Sequence Number=SeqID_175778
atgggtgccaagtacctcgaagcggtcaagcaaaggttgcatgccatcaacaatggtccccggacgaaatttagctatctacttggccaattgttccacctggacctcaagggtgtgtcctccactgtccttgttgattatgtggaccgtgctggaagcctaaaaatcctccttgagtatacccttgtcgctgttgatttcccataa

SEQ ID NO: 59001 - DNA, 1017 bp, Glycine max
  Peptide Sequence Number=SeqID_175779
atggattatgaacctccatttttagagttctacaagcccctccttctacaaggctcgcacagtgttgatgttggcatcagtggcagtggcataattagaaatgacaaatcggagtggcgtgagcttcctctgattgatcttggccagttaagtctcggccacgtcgagagggaggattgcatgagagaaatctgtgaagccgccagaacgtggggttttttccaggttgtgaatcatggggtttcacaagagcttctgcagagtttgcggcatgagcaagttgaagtgttccgcaccccttttgcaagaaagtccagagagagtttcttgaacttaccagctgccagaagttacaggtggggcaacccatctgccacaaacttgaggcaaatttcatggtcagaagccttccacatgtttcttccagatatagctagaatggaccagcaccaaagcctgagatcaactattgaagcttttgcatcagtagtttcccccctggcagaaagcttagtgcaaattctagttcagaaactgaacatcaaattcagctacttccgagagaattgttcagcaaacactagctttcttcgcctgaacagatatccaccatgtccaatattccattcaagggtgtttggcctcttacctcacactgactctagtttcctcactatagtgaaccaggaccagattggggggttgcaaataatgaaagatggaaattggtttggtgtcaaacctaacccccaagctctggttgttaatattggtgatttactccaggcactgagcaatgacatttacataagtgctaagcaccgggttgtggcagctgaaaaggtggagaggttctctgtggcatatttctataacccttcgaaagatgcattgatagagagccacatcatgccaccaatgtacaggaagtttacttttggagagtacagaaggcagatagagaaagatgttaaggaaacaggtgataaagtggggctctctaggtttctcttgtag

SEQ ID NO: 59002 - DNA, 1612 bp, Glycine max
  Peptide Sequence Number=SeqID_175780
tggccctccacctcctccacctcctagcaatggccctagagctcctccaccaccaccacttagaggcaagcctggccctagaccttcaccacctcctagagttggtggaggtcctccaagaacaacacccccttttggttcaaaggttgctaagactcaggaagaagttggagtcaattctgaaggtgaagttaatgctactaataaagctaagctaaagccttttttctgggataaggttcaagctaactcagatcaaacaatggtctggaatcaactcaaagcaggatcattccagtttaatgaagaaatgatggagacgcttttttgctataatactacgcctgtggaaaaaagcaaagggcaacaaaagaaagaggcttcctccccgtcagcttcacctcaatatatacagatcattaactcaaagaaatcacaaaatttatctattttattaaaagcattgaatgtgacaatagaagaagtttctgaggcacttcttgaaggaaatgagctccccacagaattccttcaaaccttattgaagatggcaccaacatcagaggaagaacttaagcttagacttttcaatggtaatttagcccaacttgggcctgcagataggttcctaaaagccctagttgacattccatttgcttttaaacgaatggaagcactactttacatgggtattcttcaagaagaactcactggtactcgagaatcttttgcaattttagaggttgcttgcaaaacgctgagaagcagtagattgttcctcaagcttcttgaagccgttctcaaaaccggcaaccgtatgaacgatggaacgttccgtggcggcgcacaagcattcaaactcgacacactgctgaaactatctgatgtaaaaggagtagatggcaagaccactctcctacacttcgtagttcaagagataatgcgaaccgagggcataagagctgcacgcatggcaaaagagaaccacagtttctctagtataaaatcggaggaccttcttgaagacatttcttatgaatcagaagaccaataccgcgaacttggtcttcaagtggtttcacgtttgagcagtgaactcgagaatgtgaagaaagcagcagctttagatgctgatggattaataggaacaacttctagactaggccatggactcataaaaacaagagattttgtaaacaaagacctaagtaacatagatgatgacaaaggctttcatgagacagtgaagagttttgtggagaaagctgaggctgatgtcacgagtttactagaagaagagaagaaaatcatggccctagtcaagaacactggtgattactttcatggggactcagggaaggatgaagggttgaggttgtttgtaatagtacgtgatttcttagtaatgttggataaggtgtgcaaggagattcaaaatggaccaaagaagcctgtagccaaaaatgtgaagagagaagcttctaatcattctagaaagtcgtcttcctccgaaattcatcctcttcctcctgatattcgtcagagaatttttccagcagtagtggctaatagaaggatggatggctttagttcagatgatgagagtccttaa

SEQ ID NO: 59003 - DNA, 435 bp, Glycine max
  Peptide Sequence Number=SeqID_175781
atgagttctcatggtcattctcattatgacatgctggcacaagccgctgaaatggtgaacaaagagttaggtttcttcaccaacgagtctgtggaggaaaatgactacatagacgacgtggaacaaaataagagactgaggaataggtacaggaagagggtgaggaagatgtgcaagaagggtcaactcttggagccacgtgagcgagaggcatttgatgcgggcaacaagatatggggtagccgaagtggaggcaagcgtgaacaacatcaacatcaacatcacaggcttttaggagaaactcgtgacaatgatatacgggagaaagagaaggaagaagaagaggatcccgaaaaagatcctaaagaggatcaagaggatcctcctcacgatccaaatgaggaggatgaccctttggctcggttccattgttga

SEQ ID NO: 59004 - DNA, 798 bp, Glycine max
  misc_feature (16)..(16): n is a, c, g, or t
  Peptide Sequence Number=SeqID_175782
gcgggcgattgcttgntcggcgtcggcctcgctgcccacttcgatcgtgcccttccagaccggcttgatgccttcgatcttcgcaccggaactcagcaggcgcgggccgaacagggtgcccttggcgatctcgccacgccactgcagcacctgctcgggcagatcgccggaacagtcacgcaccgtggtgatgccatgcgcgatgtacagcggcagcagtgccttgttctcttcgatcagcgccgggccaccaccgaagtgcacgtgcatgtcccacagccccgggatcaggtatttgcccttggcatcgatctggcgggtcgcgctccactggctgcgcagctgcgcgtccgggccgacagcgacgatgtcctcgccgcggatcaccacgctctgaccagccagggtactggcgtgctcgacgtcgaccacggtggcattgcggatcagcaggtcggcgcgctcggcagcagatgccgacagcggtgccaccacaaggaggatggcaagggacaacggacgggaacggaacatggacagcatcctggtgggcacgcccagcgtgcgggtggaaggggttgcggctcagcgcaccgcgccgtgctggcgcagcagggattcaattccggtatagccgcgctggcgcgcgtgcgccagcggcgtcacgccgtcgccgtcggccagctccgggtcggcaccggcctccagcagcagctgcacgatctgcacgtggcgcgcgccgccatcgccgagcaggatcgcttccagcagcgcggtccagtgcagccggttgacatg

SEQ ID NO: 59005 - DNA, 760 bp, Glycine max
  Peptide Sequence Number=SeqID_175783
atggcaattcaacaatatatgggtaatgtcagcattgaagagaagaaaactcaagaagaattcattagccaactatttgatccaacatctggactattaactgaggacacggcagaggtactatggatcacttgctgggaagattttattcatttaaagaaagaagttggagatcttgacttatgcctcccaaaggaatcatacagaaaaaccaatgaaattagttcagaaattggttcaatagccagagaaaacatccaaaaattgattagttcatgttatcctcacttaaaggaaaatgttcttcattgtttgagaaaaaataattttccattcaatgctctcaaggaagagggtgactccaagatttggcatgtcacttacatgggatcactttcttctagaagatatttgggtcaagtttttccccagcacgtatcagaaatatcaatcaaggaagatgaatcacctaaaaagaacaagcctaaggaaaaagactctaataaaaaagacaaaaagaagtcgaagtcttctggctcaaaggataaaaacaaaaacacatctatggctataactataatagtgacaattttagttgcagcattgctctttttatgttgtgggagtggtcgagttagaccaaatgatgagaggccccttctcagcatgagcatgaatgactactcagttggttcttcttccaataataatccataccaaaattccatgaaagaggagaaaattgggtttcaatcatcaa

SEQ ID NO: 59006 - DNA, 132 bp, Glycine max
  Peptide Sequence Number=SeqID_175784
atgaacttgggacaaaagtatgagcctccctatgactacttcaagttctgcactatgtcttgcaaggctagcacaggagaagcacaagatgaatcactactaaaaaaacagctttctacatcgcccaattaa

SEQ ID NO: 59007 - DNA, 219 bp, Glycine max
  Peptide Sequence Number=SeqID_175785
atgtcttctgcactagggtggtcatacctcacatcggttactgcctctatttatgagatattatcacctaaatatttcataacttttgtggttctggacctgatttggtactacagttatgctgcacctatgttataccaaccagatatgcacaatgaattgaggaaactactagccaagcaagatctcagtaaattacgattatctccagttccttag

SEQ ID NO: 59008 - DNA, 201 bp, Glycine max
  Peptide Sequence Number=SeqID_175786
atggcaaaaatagaatgcttgggtgaggttgctttgtgtcaaaaccgatcacagaaacaacgaatccaccacatccattgtgttccacatcgaccaatgccatgcatcaccacaaaatctaagcccgaggcaccaccacaaaagccgaacatgacgcaccaacacgaaaccattgttcggcatgatcttttaggatgttaa

SEQ ID NO: 59009 - DNA, 249 bp, Glycine max
  Peptide Sequence Number=SeqID_175787
atgacgacatgtgatgaatttaaaacgtactgtgctcctccaccaagaaccattgttgcaccaccacctgtccctaatggttctgctccatctgctgttaaaacccgcatatggaacaaatccaataccgccgaaggatgcaaatatggtgacgagtgccattttgcccatggcggatgtcgggtttacttcattaagtgttcaaccaattcccacaatggatttttcaccaccgtgaaaggggaataa

SEQ ID NO: 59010 - DNA, 540 bp, Glycine max
  Peptide Sequence Number=SeqID_175788
atgaatgagttatgccaaaaggtggctaagcatatgcagatggaagagttggtcaagcttcgccatcagacgtgggtggaacaagttggtgagaggaaaaatgctaataaagaagggaagaaaaggaaccgagactcgtccaaggaaagaggttccccacgaccaacacgaaaataccccctaacccctctgacactcggaggaaggcaacaatcacaaatgagggcactaggctacacaataaagaagagttacaatcataccctcagacaagtaaaggagaaagcaatgctggcaaaagagatgtctgactttcaaaaccagaaacattttctgctgaaggcagagagccagggaatacgattgaaagaatgcctaaaaagtatataccagccaacctatgtagcattaagtgcttcaatattgatgaaagtaggcatgaaggacatcaagaaagataaggggagagaaaggttcttgtcttctgagaaacctgataaaagggaggagctacagaataattgctactttacaaaataa

SEQ ID NO: 59011 - DNA, 330 bp, Glycine max
  Peptide Sequence Number=SeqID_175789
atggaggcgcctctgttattatcggagaagagaactggatcgattgaagaagagagtggaaaatggagctcgtatcagtatgtgggtggaaccggttctgtgaggccaacttcttcattggctggaactgaggtgagtgtggatgaaattcgatctgctgctgctgcttctggttactatcccccttcccttcatggagccttggttggttcacctgagcctgatcctacaggtacaaatgcggctgaagcagccacaattgtggtcgcaaagactccaaaacaaaaccttgatgcttcggccgaaattctagccatggaccgtttttaa

SEQ ID NO: 59012 - DNA, 222 bp, Glycine max
  Peptide Sequence Number=SeqID_175790
atggttagctatgacccatgcattcatgcatcagtaggtggaaagcgcaaaccagcaaaccttagaccagcactgtaccttctagaagatgcactgataacctcgaaaccagcttatcttctccttcttccttctggaggtgctaaccctcgaaattcaggaaaaagcacaacaggtaacatcattcctccggatagcaaaggtagggatttgcccaagtaa

SEQ ID NO: 59013 - DNA, 153 bp, Glycine max
  Peptide Sequence Number=SeqID_175791
atgggtgacgactatctaggagtttctcctcatggagacgcgctagacctgcggcctggaccaaaagacaaaacaactaagcagaaagggcgacggaagaccaatggtgcgattggcaagctcttcaaactccgacagatagtatgtcattga

SEQ ID NO: 59014 - DNA, 300 bp, Glycine max
  Peptide Sequence Number=SeqID_175792
atggaggtaacaacgttcacagtgacaatgcacagggtggatgtggtgatgttcgagaacaaaaagtttggaaccatgggtaaaggtggtgacattcacaacgacaacatttgcaatgatgatgtttgtgacaacagcgaggcagagtgtgaagattggaggaaggatctagaggaagggtgcaacattaggattgagaagttaaggcaaatgatggatgtcatggttgtggaaaagcatgttggtggctttgttctacccacatctgttcaattacttgtccctgatccctcaggatga

SEQ ID NO: 59015 - DNA, 228 bp, Glycine max
  Peptide Sequence Number=SeqID_175793
atgcctgacccaaatgctaagcaaggacaacatgcagctgcacatatctccaagtttgaggcatgttactgtgtttccaagcaaagggttcaaggagtttatcaaagtgaaggttgcatcgaggcgtgtctcgtaccggatgctcttctattcgctcttgttcttcacttttcttctccgctctttggcattcctcgaacaaatcgtcaaaacttcaccgacctttga

SEQ ID NO: 59016 - DNA, 639 bp, Glycine max
  Peptide Sequence Number=SeqID_175794
atggcttccactgtgttctcatatccttctcttcaccttaacatctatccacagaaaacatcatcaaatcgatcagagttttccattcacatccaacccaaaaagcacttttccattagatgcacatctttggactcaactcctgaggctgactttccaactccagacccttcctcaagcacagtgaacagtgcagagtcctttcccattgagaagagaaggaggtcagagatagtgaggaagagaaggggagagaaacttgtgcagccagagccaccaaactttgaaataggttggaagaggaccaaggagattaacctagagaggccaatagggcatgtcatagctgattttttggagaagttggagaccctcatggggaaggagtttggatccacagaactgctggctaaggttggggagattgtggctgagagggcaagagaggaggctgagattctcatggatgaaggaaaagttgaagagagaatggtaactgagctctttagagtgttgaagctgatggagatggatttggctatggttaaggctgctgtgaaggaggagactttgggtgagaggcttgagctggccaaggcaaggtgcaggcaagccatacttgttgcttattccttttga

SEQ ID NO: 59017 - DNA, 147 bp, Glycine max
  Peptide Sequence Number=SeqID_175795
atgtcacagttgatgtcgatgtgttttttggaaggtagggttggttgcgatgaagtttccgcacagcttgcccaatatgaattcgagaagtaccctgattgcggcttgatgatgaaagatggttggacaacgtatgaattggcttaa

SEQ ID NO: 59018 - DNA, 369 bp, Glycine max
  Peptide Sequence Number=SeqID_175796
atgactgaagataagggtgttgtatttttttggactatggttggtttgaagaaggattacagagtcaccaatcgcctccaagagggaaaacgtcctctatacgccatcgttttcaacgtccttgactctcgctaccttgacgttttcgccactgttgggggcaacagggttactgtttatcaatgccttaaagaaggggttattgcagttttgcaatcttatgtggatgaggataaggatgagtctttttacactgtgggttgggcatgcaatgttaatgggaccccacttgttgtgactggaggacttaatggggtaattcgagtcattgatgctggcagtgagaagatacacagtgtattttggtaa

SEQ ID NO: 59019 - DNA, 3669 bp, Glycine max
  Peptide Sequence Number=SeqID_175797
atggagtcaatactgggtcgggctctggagtacactctcaagtactggctcaagtccttctcccgcgaacagttcaagctccaaggccgcaccgttcacctctccaatttagatatcgatggagacgccttgcattccagcgtcggattgccgccggcgctcaacgtcgccaccgccaaagtcggcaagctagagattacagttgagtctctcacacgcaatgtgcaaacggagccaatcgtggtgcatattgatagactcgatctggttctcgaggagaattctgattctgatgaatctcttagttcgaactgctccacgccgtcggctgcctccgccaagggaagtggttatggtttcgctgataagtccattatcgagcggaatagagggataggatgcagtgaaaggttggatcattgcaatgctgttcggtctaatatgattctttcttttaggattgcagatggcatgactatacaaattcaaacagttaatcttttacttgaaactcgtggtggttctcgtcgccaagcgggagcaacatgggctccacctatggcatctatcaccatacgcaaccttttgttgtatactacaaatgaaaactggcagaaactggaatggcaatctttgtctattgatctcttacctcatcccgacatgttcacagaggctgcatttggccactctcaaggggaatcaaactttagggatgatgatggcgcaaagcgtgtattctttggaggagagcgttttatagaaggagtatcaggagaagcatatatcacaattcagagaactgagttgaatagtccacttgggcttgaggttcaattgcacatcaatgaagctgtttgccctgcagtaagcgaaccaggattacgtgcacttctccgctttatgacaggagtatatgtttgtctaaacaggggtgatcttgattccaagattcatcagcgatccactgaagcagctgggcgttctcttgtctcaattgtcgtagatcatatatttctttgtattaaagatactgaattccagcttgagcttttgatgcagtccctctgcttttctcgggccagtctctctgaaggagataatgataataacttgaccagaattacaattggtggcttatttttaagggacaccttctgtagccctccatgtatcttagtgcaaccatcaatgcaagttgtcacaagagatgctttccatgtgccagaatttgccagaagcttttgccctccaatatatcctttgcaagaacaggagtggcaattgatcgagggaacccctctaatatgcctccatgctcttaagatcatgccttctccacttccaccatcctttgcttctgaaactgttattgactgtcagcctcttgtggaagaatcatgcctgaggatatcctctttattagctgatggaattgttgtcaatcctggtgacattttaccagatttctcagtgaaatcttttattttcaatctaaaaggactggatcttacagttccttttgacaagaccaaattggatatttccaaaagtgacatggacaatacagtccagacctcctttgctggagcaaggcttcatattgaaagcctttgttttttaaattcaccctcactgaaactaagaattctgaacctggagaaggatcctgcttgcttcagtctttgggaaggtcaaccaattgatgctagccaggagaaatggactgctagagcatcccagcttactttatctctggaagcatgtactgacagaactggatgtcaaaattcccttaaacagacatcaggattgtggagatgtgttgatctgaaagatgcttgcattgaagtagctatggcaactgctgatggcagtccattgttacaagttccccctccggggggtattgttagggttggagttgcttgcgaacagtatctgtccaacacttctgttgaacaattgtttttcgtcctggatctatatggttattttgggagagttagtgaaaagatagcaaaggccgtaaaaaggaaacaattggaggacattagggacaaatcttttagtggaaagctgatggacaaggttcctagtgatgctgctgtgagtttatcagtgaaaaacctccaacttcgatttctggagtcatcttctgtgaatattgaggggatgcctttagtgcaatttgttggagatgatctgtttactagtgccactcacagaacccttggtggggctattattgtttcatcttttttacgttgggggagtgttgtgataggttgtgtagatgatgaggggcacttgccgtgtgaaaatggctcattcttgagttctaaggaaaatgctctctcattgagtgataatggatatcctcaactaagaactgttttctgggtgcataagaacgagaaacatctattgaatggaaatgcttattcagtcccttttctggacataagcatggagcatgtcataccattatatgaacaagacttggagtctcatagtttgaatgtctcagcttctgtatctggtgttcgtcttgctggaggaatgaactatgctgaagccctcctgcatagatttggaatacttgggcctgatggagctcctgggacgggtctttgtaaagggttggaaaacttacaaaaaggaccattgtcaaaactttttaaggcaactcctctcattgttgataattcagaagatgttggaagtatgagagaagggaaagaaatcagttttcctcaattgaagaagcctgatgatgtggatgtaactatagaattgagagactggttatttgcccttgaagatgcacaagagacagctgaaagatggtggttctcaagccatgtagatgaaggcagagaagagaggagttggcatgcatctttccatggtttgcgagtaaatgcaaaaagtagcccaacggatgttccaggtggaaaaggacaattgcgaagaataaaacaacatccagtagaattgattacagttggaattcaaggtctgcaaatcttgaagccacatttgcaaaaagacattccttcatcaacgctaattgcaaatgggggtaaaggattcaccaacacagttggaggaattggtgttgaagttcgcttgatattaggtggggagaatgtcgatgatgaaatggtcaattgggaagtggaaaacctaaaattctctgttaaacaaccgattgaggcagttgtaaccaaggatgaggttcagcacctcacttttctgtgcaaatctgaaattgactcaattggccggataactgctggaattatacggttgctgaagttagaaggttctgttggtcagtctgtaatagaccaactcggccacctaggaagtgaaggcattgataagattttctcttctgaaaagtacagtagagacggaagtgttggtagtagaggactttctccattgccaaatctcatcataaatgaggaatcacacaaaacttcagaacaaacattgactttgcttgaggaagcacttacggattcacaggctaaacttaatgatttaatcagtgatattggtacttcagagtcttcctctcaacaccttaccatcgtccaactcagtcaaaatatagagactatgcacgacttgttgatgcaattacggaatcaaatttga

SEQ ID NO: 59020 - DNA, 1470 bp, Glycine max
  Peptide Sequence Number=SeqID_175798
atggcggggaagcaatccaaagccagaaagccggaggtgttcgggaagggcaaggtcacccctactcagatcgctttcatcgtcgaccgatacctctgcgacaacaacttctcttccactcgatccaccttcagaaacgaagcctcttccctcatctcccattcacccattcatgaggcaccaaagactttgttgacattgggggagatgctggatgagtatatctgcttgaaggagcagaaagtgatgttggatcaggaacgggctgttgtagaacaagagaagaaccgggttcagatgctgttgcaaggcatgcataatgtaatgactgcttacaatgctagtggaaatctccctgcaccagcacctgctgttaaatctgcagttgtagcagttcctaaaccaacacttggttacaaatctcaaccaggcaatcctacttctgtgcaaaataaatcaaatgcaccgccattgcctcaatctagcaattcaaacgctgagggtggaaacttctcaacaccaacactgaatgtatctgacagaaagagaaaggaaactaaagctgtggatgttccttcagctgctaaaaaacctcgtggtagatcatccagtaggaaaattgtcagccatggtcaaaatgctccgcaacaatctgataaagctgtcaataatacaatggtagctcagccttctgccattcaatcttcatcagagaactgcatacccagggagtcacaggttcagggatccaatgttgctaaatgtttattcaaccagtctacaacttctgttccaagtaattcaccggttccgaagacacctcctagaacaaaatcttctcacagtgacacacatatatcccctgctgagatttcttcggttgcaacttgcaaccgtgcagttacacccagtcgttgcactgtaatttcaaccaagagagttatggtcagccctgcaaaacagatggcttacatagagatgagtcgttgtatttctcctgtcaagacaaattcaagtaagagggatcatgttaggagcaggttgaactttgatgctgccgatgtgcctgggagtttggacaatccattgcccaatgagatttctacatctgagtctgaaaaggaattggacatatttgacattgattttcctaactttgatgccttagggatggacttctccttcacagaaatgttaaatgatctagacttttcttgtgaaggcatagatttttcttgccatccaacatcaagtccttcaatggacaatgcttcaggctcgtctcatgaatgcaatggtgatcatgctacacctgaattatcaactgtggcagaagttatatgtgagaaagatatgaaagtactaggccctgaatgtatgactgcgatgaaatttgtcacaaagagcataactgttataagccctgagaaaaaccgccagcagtttgtggatccggaaaattgtacataa

SEQ ID NO: 59021 - DNA, 207 bp, Glycine max
  Peptide Sequence Number=SeqID_175799
atgagcacatcgttctcccacactcgaaaccttggacttggtgaggaagtcatgaaagaaggttcttccacagttgaaaataacaacagcggaagaaccttcttccgtggattcctgcggaagaagttcttccgcgagatcacatggaagaaggttattccgttgttgttattttcaactgcggaagaacattcttctgtaagttaa

SEQ ID NO: 59022 - DNA, 546 bp, Glycine max
  Peptide Sequence Number=SeqID_175800
atggttgaagtagtacctgctaggataactctagcaaatcgtatcacttatgatggtttgcgagtcttttctagtattgccaaatcaaggaccaacaactgcaccgtggaagccaagccaactttgatcactcttcttggtcaacatgcatttgccgacttggcccatgaagatccatacaaccactttgccattttctatgatttatggggagaggtaaaaactttcttgatgaattgtcccaatcacgttattgatgagattgatcaattatacatcttcattgggggtgtaaaggggaaaacaaaggtgatgtttgatgctgcaactggtggaagaataatcaagaacaagacactagaagaggcaataaagcttattgaaaatatggcatccaatgactttgaagctcaacatgatagaggtccaacctcctgcagaggagtaatggagttgaattctcaagatgctattatggctcaagtaaaggcacttaaggtgcaaatgtcgaatcttcctcaaccactgatcaaagttttttcttag

SEQ ID NO: 59023 - DNA, 252 bp, Glycine max
  Peptide Sequence Number=SeqID_175801
atggaagtgctatttagggttcgtggtttcatcttcctgctcttcatttgcaatgagaagaaagaaccgagaggcacatcgatggcccctggtgaacttctcatcatagttgaaacagagccaaggtatacagaacaaccaatggctatagtggacaagcgtgtgaagcgtttatgttctaagaatattatgtctgtgaaggtggctttgagtggaccagctggagtaggagccagaaattgctatgcatga

SEQ ID NO: 59024 - DNA, 270 bp, Glycine max
  Peptide Sequence Number=SeqID_175802
atgaatgcctgggcatttacaagtgatgaatctagtggtttggatagcaacattcgtggcagctacctcggtatgattgaaaagattccacaccttctagagcttggtatcaatgcagtagagttgctgcctgtctttgagtttgatgagttggaattccagaggcgtccaaatcccagagatcacatggttattttggatgttgtctaccatcatactaatgaggctgatgatgcctttccttactacttcatttcgtggcatagataa

SEQ ID NO: 59025 - DNA, 201 bp, Glycine max
  Peptide Sequence Number=SeqID_175803
atgaagtttatgaagctgggttccaagcttgatgctcttcaagcagatggaaactctatccggtccacaaagctgttgatgcatgcaagaatgttcttagaggactgcatagcaacaaaattactgagagggagttggacaaggacaaccaatgtagaaatctggcattctaagacgggtttggagaccaaccagtcataa

SEQ ID NO: 59026 - DNA, 378 bp, Glycine max
  Peptide Sequence Number=SeqID_175804
atgttgtctgagcatcttgcaatcatgcaattaggggttagtctcccacaacctatcaattgtgatttttgtggaggagaacatttcaatgatagttgtcatctttactccatggaaaattcttggtgggagcaagagttacacctttacaatcaatatgaagaagaaagtctctctaatattgagaatgtgttgatgcaattcatgaaagcttctcaagctagattcaaagccaatcaaaactcaattcaaaatctagagattcaggggggagaaactaccaaaattgatgatgctgcagatgttgatgtaggaccttctgatgttgtagagcctggggataatgaggaatacattactgaagtcttagttgcctag

SEQ ID NO: 59027 - DNA, 354 bp, Glycine max
  Peptide Sequence Number=SeqID_175805
atggctagcggcacagcgtgccccgcaggtgaagcggggtggccagaatggctagcgggtagggcaagtaccgcagatctatttcagaagcttggaatccaagacatggatgcttttaaggaacaaactgtggatgtcaacaagaaggaggtagtggacttgctaaagttttcattaatctcaaggaccccaatgacaaacttcattttaaaaaaggaacaataccctgataaaattaccccaaatcaataccagtttgaacttagagaagaaccatctgatgtgggtcggcaaatggttgcaaaggtccatttaagaaaatcaaacggcaaggttgtgtctgctaaagcatag

SEQ ID NO: 59028 - DNA, 315 bp, Glycine max
  Peptide Sequence Number=SeqID_175806
atgtcacgaaaccttatggattatgcaatcgtcccctctttggcttccggaatgttacggaactttacggattgcgcattaacacttcctttcaactcccgacatgtcacagaatttcacggattgcctaacgattgttgccaagtacctcgaagtggtcaagcgaaggtcgcattccacgaaaaagatggtccccggacgaaattagggttgcaggatgtaccatctgtgggggagctcatgaatttggacgttgtatccctattgaagaacaacccactcatgaagtcaattacatgggaaatcagcccataa

SEQ ID NO: 59029 - DNA, 264 bp, Glycine max
  Peptide Sequence Number=SeqID_175807
atggaggcaacggaagcatcaagagactttgatgacaaaagtgaaatcaaaagggtttgggatcattttgttactaggaagcttataaatgaacctgtaaataacaagcaagaatcaatgaaaaagtttcaaatttccttactcaattatgctttttccttcatttctggaggtgctggccctcgtaagctagcttctatctttgagaacctaacatttggtgctcttgttgtcttcatgtcagaccctcaccagcctcgatga

SEQ ID NO: 59030 - DNA, 286 bp, Glycine max
  Peptide Sequence Number=SeqID_175808
aggaacaaaaggggtggcggagcgcgtggccgcggcaactgacgaacatccgagagcttctcttcctgcagcctcgctagtccgacagcttggactagagtcaggggctggtgagcctgcacctctcgacgaatctccggggcacttgtggggtcttcgtactgtgacggagcaaaacgggtttgcaaggcctataggaatcctggccaggagtgccatggtactcaaagagcagagggcgggtgatggtggtttggtggtggttgtgcagtggaagatggagtga

SEQ ID NO: 59031 - DNA, 690 bp, Glycine max
  Peptide Sequence Number=SeqID_175809
atggcttcagactctcaaaaaactgatggttatgtcttctctatctctggaacaccaacaatcacttcagaaaaattgaatggaaaaaattatttagcatggtcagcctctgttgaactttggtttcttggccaagaagacaaacgcgagcagtggaagaaacttgattatcagctttgtgctctcttgtggcagtctgttgagccagctatattgacaaatttcagagccttcaaaacttgttattctttctggaaaaaggcacaaagtgtttttgctaatgacattcaacaattgtatgatgttgctaaaaaattagccactcttaaacaaactaatcatgacatggttgcctatgttttgaaagcccaatctgcagtggaggaattaaaattatcattggaagccaataaacttgaagacataaagacgaaacttaataatctatatatggtgttggtactacgtgggatgcatccagattttgatcatattcgtgaccaagtcttaactagccaagaagttccttctctagagaatttaattactcggctccttcgagtcccctcaccaaaaataggaggaaattcagttgacaatattgaaacttctgtcatggtatctaatcgagggggacaaggtggtcgtggaaaccaaggaggacgagctggaagaggaggtcgtccttaa

SEQ ID NO: 59032 - DNA, 1367 bp, Glycine max
  Peptide Sequence Number=SeqID_175810
atggcgctgccgcgccgcctcgacgatggccatttccagacggtgggcgatgcccttgcggcggtgatcgggatgcacgaaaacgccggccagccacggggtgagatcctggcgctgatgatcgtcgctgggccacaggctggccatgcccaccgggcgatcgccatcgatcatcatcaatgtcaggtgatcgtcgctcggccggctgcattgggcgaagcgcagctgggtgcgctccagcgttccgccgcgctgattgcaagtgctaatgagagtgattatcatgcgcacactattccccgtgtcggttcaatcatgcgcaattccctcattttactgctgctttccctgtgctttggcgtgttttccgctcaggcgaagacggtgaccgatatcacaggccgccaggtcgtggtgccggacaacccgcagcgcatcgtggtgggggagagccgcatgctgtatacgctggcgctgctggagccgggcaacccggcgcagcgcatcgtcggctggccggcggatctggcgcggttcgacgcgcaaagctggcagctctatacgcagaagttcccgcagatcgccgcgatccccattatcagcggcaataatttccgccaggtcaacatcgaaagcctgctgcagctgaagccggatctggtgatcctggcgcgctacgcgcgtgaagacggcgacaacgatctgctggtttccgcgctgaacaaggccggcgtggcggtgatctacgtcgatctgcgcatcgatttgctgaacaacaccgtgccgagcgtgcggctgctgggcgaagtgctcaatcgccagccgcgcgccgagcagttcatcgcgttttatcagcagcatatggtggtgatccggcaacggctggcgggctatcaggggccgaagcccaaagtgatgctgcacctgcatctggggcggcgcgacacctgctgcactaccgccgcgcacggcaatctcggcgatctgctgaccttcgccggcggcgacaacatcgccaacgccagcgtcaaaggggtgtatggcgagctgaacccggaaaccattctgagcgccaatcccgacgtttacctcgccaccggcatggccggcccgcagggcaaacggctgtccgatctgcgcctcgggccgcaggtcagccaacaggacgccgccgatagcttccgccggctgatcgccaaacagccaatgctggccagcctgcaggcggtgaaaaaccatcgcgcctggagcgtctggcacaatttttacctcagcccgtaccacgtggtgctggtcgagatgttcgccaaagcgttttacccggatctgttcgccgacattaacccgcagcagaccttccaacagct

SEQ ID NO: 59033 - DNA, 348 bp, Glycine max
  Peptide Sequence Number=SeqID_175811
atgactctcggcaacggatatctcggctcttgcatcgatgaagaacgtagcgaaatgcgatacttggccgagggcacgcctgcctgggtgtcacacatcgtttccccaacgcaaacatgtaacaatgttgctgcgcgggggtgtatgctgacctcccgcgagcacccgcctcgtggttggttgaaatctgggttcatgggccgacttcgccgtgataaaaatgggtggatgagcccacgctcgagaccaatcacgtgcgagccggtcagttctggacccatcgacgacccttttgcgtgcacgcacgctcccaacgagacctcaggtcagggcggggctacccgctga

SEQ ID NO: 59034 - DNA, 754 bp, Glycine max
  Peptide Sequence Number=SeqID_175812
ccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgtctcgttgggagcgtgcgtgcacgcaaaagggtcgtcgatgggtccagaactgaccggctcgcacgtgattggtctcgagcgtgggctcatccacccatttttatcacggcgaagtcggcccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 59035 - DNA, 165 bp, Glycine max
  Peptide Sequence Number=SeqID_175813
atgatgaaacaagtgcagacaccaggatctcagaaggagacagttcagatgatagatgaattgaaatgtgttattcaattcactgataagttatgtgttgtgcaagaccgtatttcgagggcgctgattggagcaggtgaacaaagggatggtgataactgctaa

SEQ ID NO: 59036 - DNA, 247 bp, Glycine max
  Peptide Sequence Number=SeqID_175814
atggcatttttaggagaatctagcagtcagacgattgtcaagtcaaggttgggtttcatttttccaaatggatcgattattcacaattattctagggtttgctctcaaacttcgactccggcgcccattcgagtgccaaacagttgtgattttgcaagcctaaaaatcagaatacacaatacccttcagctatccgacaaacaatttttggatgaaattcacttccggaagccattcacccatacag

SEQ ID NO: 59037 - DNA, 719 bp, Glycine max
  Peptide Sequence Number=SeqID_175815
atgcacacgaatcatctgttgcttgcccgctctttgtgtatggttggtctcgcacctattccaacaagacataaggcatccatgtcgcttccgaagccatcgctcgaaggaaaggagggagttctcttctcatgtggggactacccaaacatcccgttgataggaacgaggggttgcattaactacaatggtgcacttgctataagacaaatagggtaccccatgaggggagcaccgaaggaagaaagcctctctcctttccttgtgagatatttcggcgcgcaaagtttcaagattatacaaagagtccataaggcgtgggaaaacccgttaaggaaagataaagaacttaggggcattcgtaatggcatcattggtggttatcatgaatggctgaaaaacttcgaagctccggaagaggatgaagaagtccgagctctaaaaaccgaactaggaaaagtgagacttgccaaagaaaaattcaagttggtcgctacagacatccagaaagagtgtgccgggttacgagaagaaaatgcagctaccgcaagagcccttgaacaagaaaccaagagggctcacaaggaagagcatggccgtgacaaatttcgtggagctttgtggggcagcaacagtgagctcaagcttcgaagggaagagagagaccaatcacgagcacatagcatggtcttgaaagaggagttagccacttgctcaag

SEQ ID NO: 59038 - DNA, 131 bp, Glycine max
  Peptide Sequence Number=SeqID_175816
atgatacaagcattctctgaagaactcgctaagcgcgcctaccctgctaagcgagttcatcttttgaggatgaatactcatcctcttgttgagatgcctgtggctaagcgaggcggaatcgctaagcccag

SEQ ID NO: 59039 - DNA, 588 bp, Glycine max
  Peptide Sequence Number=SeqID_175817
cgcttcggcctggtcgtgcgtcaccatcacggtggtggtgccgatctgcttctggatgctgcgcagctcgaactgcatgtcctcgcgcagcttggcgtccaggttcgacagcggttcgtccagcagcagcaccggcggccggatcaccagcgcgcgcgccagcgccacccgctggcgctgcccgcccgacagttcacgcggaaagcggtcggcatgcttgtccagcttcaccagcgccagcgcctcgcgcacccgcgcctggcgctcggcgcgctcgaccttgcgcatcttcaggccaaatgcgacgttgtccgccaccgtcaggtgcggaaacagcgcatagctctggaacacgatgcccagcccgcgcgtgttcggcttggcatgggtgatgtcgcggccatcgagcgtgatgctgccgcgcgtcacatcggcaaagcccgcgatcatctgcagcgtggtggtcttgccgcagcccgagggtcccagcaaggacacgaattcccctttctcgaccgccaggttcaggtccgagaccacccgcaggtcgccgtagttcttggagacgttgtccagccgcagaaatga

SEQ ID NO: 59040 - DNA, 147 bp, Glycine max
  Peptide Sequence Number=SeqID_175818
atgggtcggcgttcgcttactcgaacccactcaaggatactaggttgccttgcagcggcgctttccgtttgtccagagctaggcaaggggcgacgatctatcggtcgtgaccctagcctctacttgtgtccgtccctaagtacctga

SEQ ID NO: 59041 - DNA, 459 bp, Glycine max
  Peptide Sequence Number=SeqID_175819
cgtgactcaaaagtcagtatgacagatcttgtgagcgcggaagatgacgcttttcgtcttacagataacaaaaaggtttatacggatgaccactcgagtatctccgccagtcagcgtgactcaaaagtcagtatgacagatcttgtgagcgcggaagatgaccaaaaaagaatttatacggataaccactcgggtatttccgcccgtcagcgtgactcaaaagtcagtatgacagattttgtgagcgcggaagatgacgcttttcatcttacagatagcaaaaaggtttatacggataaccactcgggtatctccgtccgtcagcgtgactcaaaagtcagtatgatagatcttgtgagcgcggaagatgacgcttttcgtcttacagatagcaaaaaggtttatacggataaccactcgggtatctccgcatgtcatgtgactcctgtgtcagcatga

SEQ ID NO: 59042 - DNA, 915 bp, Glycine max
  Peptide Sequence Number=SeqID_175820
atgtcctcgccttcagaaggctacacgccctcaccttcagaggagtacacgtcctcgccttcagagggctacgtgccctggccttcagaggagtacacgtcctccccttcagagggctacatgtcctcccctttagaggacaacttgtcctcgccttcaaagggctacacgccctcgccttcaaagggctacacgcccttaccttcagaggactacacgtcctcaccttcaaaggactgcacgtctttgccttctgagggctatacgcccttgccttccgagggctacacgtcctcaccatcagaggactacacgtcctcacctttagacggctacacaccctcgccttcagaggactacacatccttaccttcagaggactacatgtcctcaccttcagaggattacacgtcgtcgcctttggaggactacacgtcctcaccttcaaaggactacacgccctcgccttcagagggcttgacgtcgtcgccttcagagggcttgacgtcgtcgccttttgaggactgcacgtcctcgccttcagagggctacacgacttcgccttcagaggactacacgtcctcaccttcagaggactacacatcctcgcctaaagagtgttgcacgcccttgtctttagagggcttcatgtcgtctcctttagaggactgcacatcctcgcctttagaggacttcacgtcttcgccttcagagggctacacaccctcgcctttagaggattgcatgtcctcaccttcaaaggtctacacgccctcgccctatagggctacacgccctcacttttataaggctatacgggccagtagtttccttttatcagttcctaggccaccccctgatcctggaggagggccaactgtgcgagcacaattagaggaggaggctatcgcgtag

SEQ ID NO: 59043 - DNA, 192 bp, Glycine max
  Peptide Sequence Number=SeqID_175821
atgttttcttccgagggcaaggatggacattctcaccctgggtcaaggtttatggggttcagggataaaggggatgtcccacattatttccatgacacatatacaacaatgatgatttggaaattttatgcaaaactggtcatgcacgcacccatgtggacactcaagcatcaagtttttatggtcatgtga

SEQ ID NO: 59044 - DNA, 918 bp, Glycine max
  misc_feature (812)..(812): n is a, c, g, or t
  Peptide Sequence Number=SeqID_175822
atgctctggctggagcattttttacagcactggtcaggcagtttcgtgctggtctcgcatgacagacagctgctggatgccgtcaccaacggcagctggatcatgcgcgataaaacgctgcactactttgcccttccctgcacggcggcacgcaaggcgctggaagccagggatgaaagcgacgcgcagcgccacaaagcggagcaaaaggagatcgaccgcgtgaccgccagcgcgaagcggctggcgacctggggcaaggtgtacgacaacgaagacctggcccgcaaagctaaacagatggaaaaacaggtcgaacgcctgaaagagagccagacctcgctcacggcgggtagcccgtggacgttaagcctgcgcggtgacgcgctgcgggcagaccgtctgctggagatggaaaacctcagcgtcccgcctgcgccagggctaccgccgctgtttaacatcgaaacggcacggctgaaaagcggcgatcgcgtggcgattgtcgggcgtaacggctgcggtaaatcgtcgttaatgaagctaatctggcgacattttaccgatgaaccgacggactgcgggctgaaaatccatccgcgcgtctcgccgggctattacgatcagacgctgaaccagctgccggatgacgccacgctgcttgatgcgctggagcctttcgcgcccgacccgcaaaaccggaagatggcgcttatcagcgccgggttcccgtggtcccgtcacgggcagaaagtcagcacgctcagcggcggcgagcgttcacgcctgctgtttgtgggcctgacgctcgnccgctatagcctgctgatgctcgatgagccaaccaaccatctggacatggaaggcaaagaggcgctggcagaaacgctgcagcagtttgaaggtggtgtgctggtg

SEQ ID NO: 59045 - DNA, 324 bp, Glycine max
  Peptide Sequence Number=SeqID_175823
atgttgggggctagcatgccttatttgcctaagatgtatgattttagatttttctctatcaatttggcctgccagaccctaactaaagggggattagcctttcattgtcatgagagacttttacactttagggggttgatgtggatggaagaagatggatggatagaggaggaaaagaggataatggacatagaaagagggtttcccaagttggagatactcaggcttaggatgtattcattagagaactctaagtcttcgggcgtggtgttatctcggtgtatgggttatggccttcccttctacttcctaatctttttatag

SEQ ID NO: 59046 - DNA, 201 bp, Glycine max
  Peptide Sequence Number=SeqID_175824
atgggtctccggataagatttgttggcaggaccgaatggtccaccgggttttttctacctggaaaggcaagcatgctttttgcaaagcttttaaatgaacattcaggggaaacatcgggtcaaactgaaactgggaataaatcactcatagtgtataaaaactctcacaggaaagtgttttaccctaatcccaaaccataa

SEQ ID NO: 59047 - DNA, 294 bp, Glycine max
  Peptide Sequence Number=SeqID_175825
atgccaatctccccctgtagatggatcgcgcccacaagacacccagtgaacctagagaagtccaacagggccctggggttgccagctctggttatgggtctctgtagtcgtacagggtgcccgtcccccccaacgaggtcatgctatcgtgacatagggatcgcgcccacaagacacccagtggacccgaagaagtccaacagggtcttggagttgccaagctctaattacgggcctctgtcagttctacagagtgcctgtcgcccccggcaaggtcatcaggccccctactaa

SEQ ID NO: 59048 - DNA, 162 bp, Glycine max
  Peptide Sequence Number=SeqID_175826
atgactcatgcaaaatgggaatgtgataaaggacaaatgcaggaacgatatgttcattatgatgctgaagagatgtttatgcggtgcatgatgcgcaaaagcgcaacagggggggtgcgggggagtacgacaatatccataaataagcaaaggcgtatatga

SEQ ID NO: 59049 - DNA, 306 bp, Glycine max
  Peptide Sequence Number=SeqID_175827
atgaagaggaaaagcctgaagtcttcaatactccagaatatccctacttggccattgttggctatgttggagggaaaagataaagatatgggtgatgcctgtttcgaagaagaagaggtggagcaggaaatagcattattagcctcaaccatggtactacagtctcttttggaaaaagaacctggctataggagagatttcttagctcgtgatgaagagcttgatgattcaaaagacagttgtgttgaacaggtggtttttgtagaattggaaaaactgagaccagcagaaaagcccaaagcataa

SEQ ID NO: 59050 - DNA, 660 bp, Glycine max
  Peptide Sequence Number=SeqID_175828
atgccatatcctgagggtgcaaatcttgcattgtgtctagagaatagcttgatattatctgaacttaattacaacaatgatgaggctagatcagaattcgaaaatctttttctatctatgacagacgaacaaaaacaaatttatcacaaaattatggaagctgtcaacaacaatgaaggtcgcatgttttttctatatggatatggaggtacaggaaaaacatacatatggagaacattagcaaattcactgaaggcaaaaaatcaaattgtgattatggttgcttctagcggcatagcttctctgttattgccaggaggcaggactgctcattccaaatttaagatacctgtgccaatttttgaagactcaacatgcaacatacttcaaggaagtcaactagcagaattgttaaatcagacaaatctgataatttgggatgaagcacccatggcacacaaattttgcttccaagcacttgatcaatgtttaagagacattattaaagaaaaaaaatcgaatcaaatttttggaggcaaagttattgtatttggtggagatttccgacaaattctgtcagtcattccaagaggaagtcgttcagacattataaatgctacaatcaattcatcatatttgtggccttcctgtgaagtctaa

SEQ ID NO: 59051 - DNA, 153 bp, Glycine max
  Peptide Sequence Number=SeqID_175829
atgctacaatgcgagggatatttctcttatcttagacatgatatcgaaattcccaatggtgagagtgctcggaaatgggttgcaaacatgctgtttaaatttcacgacgatccaacggtgaatgagtccgagatcgtactttttctaagacag

SEQ ID NO: 59052 - DNA, 712 bp, Glycine max
  Peptide Sequence Number=SeqID_175830
atgcccagcgctcgccggtgtcgttactcggtagcgggcttggcacggggcttgagcctaaagctcacgcctagccgattgatcgcgttcattgccgcgatggtgagcgtaagatcgacaagcgtcacttcctcagaccatgccaacgcggcgcgctcttgctccgagaacagtgcgcgcatccattcagttgagaaacgcgcaagaacaccaggtggatcaattttgagggcaacgatgtgccggtggtcacaaagtgatggagctgtccaaccgctttggcaccctcgggagagaccacaaaccatcggtccactcaaaggtagggacgccgagcagggacggttcgtgacagctgatagcgtgcgccagaataggcgcttggctgagcactggtgtgcggtggggctctacccgggcctgccgccgcgcgaggccgtggaccccctgaccgacagcacgctcatcgcgccggccacgcctctgccgggcctacccccgacccgcgagcagcagcaacaggcccggcgcctggctgaggctggggcgaaggagatcgagcggatcaaggcagcgctggagccgcgcaagccgccggcggagacgaaaccccgagcgagggacatccgcagcaaggcgcggttgagggcggggctgcagcagatgcgcggcgggtctttggtgccggtgaaaggactcgaaccttcatggg

SEQ ID NO: 59053 - DNA, 246 bp, Glycine max
  Peptide Sequence Number=SeqID_175831
atggataaagttgatatctttgtccctcatcctctcacaaacgcatgtttgcttattcaactttcaccagaatgtgggtgtaagccattggtctgtttgctcaagcaacctgcgctcctaagtgttgacttccaagaccgttcaatcagagattactcatcttgcacgttggtggggagaagtgagttatcaagaatagagtgttggacaaatggcctcagttaccttaggaaaaaggggggttga

SEQ ID NO: 59054 - DNA, 333 bp, Glycine max
  Peptide Sequence Number=SeqID_175832
atggtaaacacgcagtctgacctcagacgcgagatccctttcgaaggctccaatcctcttgtagtagccatgccagatactgatactttccaacaactccaaaaccacattgcgaagatgaagcgacgccatgaggaggagcttagaaagctaaaggctgaccacaatcagttggaggctcgttttagaagcccccaggacgacgagcactctgttcatacattgcccaagcgcactcatggggaatcatacccccggcgcacaattaacacacaagatgatccaagtgatggaagcttgcttgtggagcttctatggaggctggatctttga

SEQ ID NO: 59055 - DNA, 582 bp, Glycine max
  Peptide Sequence Number=SeqID_175833
atggcatataggaggccataccagcatataagttgtttccatgtgaacttctctacctcattggtcactttggcaatggtcccagtatgttcattccctatatggcaaaaggccaaggggagctcacaaattgtggagattgtcaggaggggtgcgtggaatgtctacaaactcttggcattgtctatatctcttggtgagcaatgtttccttggtctggtatctgttggcaacctacccctggacaagctgcgagctttgaagttgagtttgagggctctctatagtgacattgtcatgacctttgaggatgattcctgcctcacttcccttcacattggacgcgtcgtcaacatagaggctccaccagtcggggtggtttcgtcattcctggagaattctgccaggaagtattccatgaactgtgtcttcatggggacacgggttcatcttgactaccacttgatgactctgaaagtagggtctaagatgtcgagccgagcacttctcggcgtcatgcagtatgcggctggtgaagtagatagggagttgatgcttcccttcctcttgtacaagggttga

SEQ ID NO: 59056 - DNA, 723 bp, Glycine max
  Peptide Sequence Number=SeqID_175834
atgggcatggacaaatggtctccagtccgagccctgactgtttaccaggtaagcctagacaacaaattcgatgtagatctgcgtgacgaaccttttgaaagaggcccaaaacctattgaagagctcatcaagctacaactcggacccaaacccaggaatgcgcacatgttcgcttcacagccatctgacatgccaggaatccaccccagcgttaactaccagaagttcgccattttccccaaggccaaacctgtatcccagaaggagagaaagatgggagaagaacgacacaaagttgttagagaagaaatggacaaactcctcaatgccaacttcatcaaagaagctagccagactaaggaaattatattctatgcgccggtcatggtccaaaagtgggttgtgacaaacatcgtgaaggtaaaaaagaccaacgacaaatggcgaaggtgcaccgactatactgatctaaacagggcgtgccccaaggatgcataccctttgcccaacatcgacagactagttgatggagtgtctgggttacaagtactaagttttctggacgcttactcaagatacaaccagatcaggatgcacgctccagacgaggagaaaatgacattcatcattgaagatgccaacttttgctatagggtcatgccctttggcctaaaaaatgtaggtgctacataccagagattgatggaccatattttcaagtag

SEQ ID NO: 59057 - DNA, 741 bp, Glycine max
  Peptide Sequence Number=SeqID_175835
atggctctgagctcgttgagtgttttcctgacaatcaaagaaaatggtcatgaggtcgacatagcctctagtctctacttgctcccctacgaagctgaggagtggaccgtcatgaggcgggttcctgttcttatggaggttgtcgaccgcgtcttggctggtctcactcttgcttggtggttgtctagccccttaacaaactgggctaggcagtttgatgggtacctccaagttgaaggcctcctcctggattgtagtgtgattggtcgtcagggcttgttccttttattcaacttgcctgacctcgttcttgaacctggacatttctttcatctggatgtagcctttggttcgttcacgcaactagtccatgctactagggacagtaattctccaaacctatccatgaatttgtatagagattcatcatctgcttgtcacagactggccagtgtggcagatgttacgatgagactagctagttgcatattgcgcattgaagcgctcaacaagggtgtcaaagctgttgatggaccttggagagagtccaccatactaggtcaggaaagcatccaggtgttcatctggatcggtggtctatcataccgctccaagttgagtggtttccaacccagagacttggtgatgcaatcctaccccacaagggtattggatagaagactccaagaggattgggctagagctgctaaagaaggccttggggttctcatgaatcccatg

SEQ ID NO: 59058 - DNA, 207 bp, Glycine max
  Peptide Sequence Number=SeqID_175836
atgcctcgtattcatgacgcgatcctgtattacaacggcaaatggaacatgccaccgcagaacaaatttgttggttgcgcgttcacaggaaaaaatcctaagaaatttcaaattccttcaacatgtaccatcgatgaactgaagaatttaatcaagcaagttgcacctaaagggatcccccctcttggaattcacgaatcacaaacg

SEQ ID NO: 59059 - DNA, 240 bp, Glycine max
  Peptide Sequence Number=SeqID_175837
atggccaacaccaagaaaactggccaaatgacgtctgaggaagcaaaggaaattactgacaagattgatgatgtactgactgctgccattgagcgaccagaacaccctagtcgtgtacgtgctactggagccggtatcatgatcaaacaatactttggaccagctccaaggacctcccgcacttctttgtccatggctctcaaagacctagagcagctgacgcaaaagattagggactag

SEQ ID NO: 59060 - DNA, 243 bp, Glycine max
  Peptide Sequence Number=SeqID_175838
atgaacatgatcatgatgagtgttgggatattcgataagggaaagggaggcacaattggttggtttggaaaggatgaagtaggggtgggagaagacaatgttaggggagacatcgttggtggttgggtccacatcgagggtggggattgtgggagttcgcaatggctagtggagtccatgacgggaggtcgattagtaaagacacatatcttccttgtgctttcgacaaaagtggaaccttaa

SEQ ID NO: 59061 - DNA, 207 bp, Glycine max
  Peptide Sequence Number=SeqID_175839
atgcgtctaccagggaaggagagtctgctgatgggatcccccataaccataaatgagatcttggatgttagcatttcgtttctaaatgaccatttagaggaaacactgggttcgacaaaaatagaagaaaatcactcaaagtgtatcaatctcgcacagtgcggggcgaaaaaaaaagtcgctagcgcacgggattttggttggtaa

SEQ ID NO: 59062 - DNA, 288 bp, Glycine max
  Peptide Sequence Number=SeqID_175840
atgtctaagctcccttctaggtttgttgttaaacatgtcctgtgggaacaaaataaagttgttgatgttatgaccaagggtgcacttggtgcagtgtccttgttggttttgtttgagagtcctcctatgtttgttgcgtcttcaattgttcttgatgtaagtattggtggaagggaagttctcatcaaatatgttcttcaagctattcctacttattgtatgagtatttttcaaatccctcaacctcttggggatgaactgaaaaagatgatgaattctgattggtag

SEQ ID NO: 59063 - DNA, 1580 bp, Glycine max
  Peptide Sequence Number=SeqID_175841
atgacgttcctcagtatcaccttcttaacactattcttccttcttctctttctctccatagagctccaagcgtacaccccagaagacaacttcaccatcagttgtggcaccaccgggatagtcttcgacggccaaaggacatggacgggggacgcagacacaaagtacttatctggtggtcaaggcagcaccgttttaacccaagcagcaacacaagatccttctgtcaatcaagttccctacaccacagcacggttatccccttctcagttcaattactccttccccgtttctgcgggccccaaattcgttcgcctcttcttctaccctgctgattacccttcctttccccgcactcatgcctctttctccgttcaatctaacggattcaccttcttaaaaggtttcaacgcctctctaaacgctgacgcggaatccaccaaaaccatcttcagggaatatgtggtcaacgtcaacgacggtgacattctcatcctcagcttcactccctcgcaacctaactcctacgctttcatcaatggaatcgaggtactttccatgccaagtgatttgtattacacgtcagcaactgactcaataggattcaagttcttgggaagtaccacgctgtacagcgtagaaaccagatttgcgctgcaggcggagtatagaatcaaaatgggagggcaagaaatatcaccactaaacgacaccggtttgttcaggaaatggaccggtgacgaagaagattatttaatcaaacaaaatccagagaataatgatcttccagctatcacggatggtaagatgaacataaccgtgaatcctgattacgtggcacccaaggaactctacagagcagggcgtagcatgggcacaaacgccactctgaacaaaatcagcaacctgacttgggagttcccggttgattctggcttcacttacgttctcaggctccacttttgcgagcttgaccccgatattaataaagatggtaacagggtgttcttcatttacatagcgagccagttggctgagaaccacgctgatgttatgcaatggagccacaatcagaaaggtctcgctgtgcagagaaactatgccattttaattccgaacgataatactcagaaaaaggttaatctctcgcttcagatgcatccttatgcaactaatgatgaaacgacatacagcgacgcgttcttgaacggtctcgagatcttcaaaatcagtgaggctgggtcaaacaaccttgccggacctaacccggacccggttcagactccacacaacaacatacccgccccaaagggaaaccgcagcagcaaaagcggaacgtcgataatcggcatcgtggcaggtgtggtatccggcgtcgttttgatctcactcatcatccttttcctcatcgtcttcttccgacgcaagacaatcactacgcccaaggactacaacaagtccaagtcctccgcgacctccaagtggggcccactctccttcacaacgaccaagtcaaccaccaccacgaagtcctccctcccctccgatctatgccgccacttctccctcccggagatcaa

SEQ ID NO: 59064 - DNA, 375 bp, Glycine max
  Peptide Sequence Number=SeqID_175842
atgaatagtagcggcgccaagaggagcggtcccccgaagcaccagaacaagtacgcatggaaacccaacgctggtcgcaaaatcaacgaaactgtccgtaacacaacaaatcttacttcattccgatcaaaccgactaataatcattaataaaagcagcattttgaatactattgatgtttttgttattaacatgcacaggaagttggaggaagattcaggcccctctctgagatcactggggtgtgctctcgttgcaaggatcaaatcgaatggaaacgccgttatggcaaatacaagcctcttcttcaacccgccaaatgccagagatgttccaagcgtgctgttcgccaagcttaccataacctgtgtcctg

SEQ ID NO: 59065 - DNA, 1152 bp, Glycine max
  Peptide Sequence Number=SeqID_175843
atgatgaaaccttcctcttatttctattaccttttgctggtaactgcaggaagagctttggaagacttgagagcttctctctttaatcaattccgttcctctgaaggtgcaaagcgtcaacagcagcgcatatgtggtccagctattgcactttccttcaattttctggttgcagttggtattattttcatgaacaaaatggtgcttcaaactgttcagttcaaattccctatacttcttacactaattcactacgtagtgagctggttcttaatggcaatactaaaagcattttcttttcttccggctgctccttcctcaaaatcaactcgattgtctactttatttactcttggatttgttatgtctctatccactggctttgctaatgtcagcttgaagtataatagcattggtttctatcagatggcaaagattgcagtgacaccatcaatagttttggcagaatttgtattgtatagaaagaaagtttctttcgcaaaggtttcgatgcttaccagaaattttaaaactttacaggcattagcattaacagtggtatctattggtgttgctgtggcaactgtgactgatcttcagttccatgtatttggtgcttgtgtagcattggcttggattgttcccagtgctgtaaacaaaatcttgtggtctagactgcagcagcaagagaactggactgctttgtcgctaatgtggaaaaccacacctattactttgattttcctggctgctatgttaccctgcctagaccctccaggtgttctctccttcgattggaactttagcaatagtatggtgatttttgcatcagctattcttggattcttgcttcagtggtctggtgctttagcactaggagctacatctgccatctcccacgtcgtcctggggcagtttaagacctgtgtcctccttctaggaaactattatctctttggatccaatcctggcaaaatcagtatctgtggtgcattcacagctattgctggtatgtctgtttacacttacctcaatatgaggcaacaatcaaacaagccatctcctcgacaggcttctgttttgccaaaatctaaacttggcaaagaaaatggcagcacccatgatggacattacggggccgaatctgtctaa

SEQ ID NO: 59066 - DNA, 639 bp, Glycine max
  Peptide Sequence Number=SeqID_175844
atgaaacaacaactctctgattatggaatctttcttgaccatatacctattaggtgtgataatataagtgcaatcaatctctccaaaaatccagttcaacactctagaaccaagcatatagaaattaggcatcattttctaagagatcatgttctaaagggagattgtgtgttagagtttgttgatacaaagaatcagcttgctggtgttggtgtagtaacttcatttggttaccgtaaggatcgtgatggacaatggctgaagaaggatgcgctacctctgcaagacaagtgtactccttctcctcctcctcagcggaatgattccacagctcttatgaatgaagttctttcagaattacggggcctccgcacctatgttggtgaacgattcgattcgattccttggatggtcgctttgatggcatggatacccacatcacccagcttgaagaggatgtgggaattaaattgtcatcatcaaaaagggggagattgtagaagccaagactttgactttgatgttttgatgatgccatatgatcatgatgttttgatgccatatgaaaatgcgcttctgaaattaagatcaagacaaaaatccaagagattcaagatacatcatcaagaagatctctag

SEQ ID NO: 59067 - DNA, 366 bp, Glycine max
  Peptide Sequence Number=SeqID_175845
atgcatgttgctgataattcttctttctacttttgctatcagatgaacaaagacaaatctaaaagttcaaatagcgccccaactgatactaaaggtaacaaagttggacaattatttccaaatgcgtcacttgaagactatgccaaactgaatagagttaatgtgggtcatgacgatggtgaaatatgtgatgatagtgagggtgaagtttgtgaagatgaagatgataacagtgacaatgaagattgtgatgaagatggaaacagtgacgatgaagacggtgacagtgagaatgaagattgtgatgagaatgacgacaaaaatgatgaaaacactcctgatcatactagtgccaaccatgaatga

SEQ ID NO: 59068 - DNA, 423 bp, Glycine max
  Peptide Sequence Number=SeqID_175846
atgatcaaaggaaaagacatttacgaagttgtggcagcacttgtgcctctctacgtggctttgatcttaggctatggctccgtccattggtggaagatattcaccccagaacagtgcaatgacataaaccgttttgtaggtgccaagcttttcatttcaaatcaattccctaagactgcagatgcaatttcaaccctaagggttgattcaaacgttggctctctcaatggtagagagccattgcaaactgatgcagaaattgcagaagatggacaacttcatgtgatagtgaggaacatgtcacgttccacgtcgatggtttcaccaaggacatcaaatcttaccggggttgagatattttcggtgacttcttctagagaagtaccaagccaaagagcttcaagttttattgtcacaaattaa

SEQ ID NO: 59069 - DNA, 207 bp, Glycine max
  Peptide Sequence Number=SeqID_175847
atggcgtggacctcacggcgtgttgaattggaacgagtgtttgagattgatggcacgccttgttgcgtgatgaatggtgatgagtttgtggcggcttttcctgttgttgatgatgccaatgaagcttatgatccacttgatccaaatggaaatatcacaatcaaatgggatattataagctggacacctgatggctatgttgtttga

SEQ ID NO: 59070 - DNA, 729 bp, Glycine max
  Peptide Sequence Number=SeqID_175848
atgaatgttcagctagataaaaagaagttctttgtcgtgggagcaggactctttacgggtgttacagtggcactctacccggtatctgttgtgaagactaggctgcaggttgcctcaaaggatactttggagagaagtgtgttttctgttgtgaaagggttgcttaaaacggatggcatccctggtttgtataaagggtttggtacagttatcactggcgcaattcctaccagaatcatattcctcactgccttggagacgacaaaggtggcttccttcaggatggtggagccatttagactatctgaaactaatcaggctgccatagcaaatggaattgcaggcatggcatcatcatttttggcacaatctctgtttgttccaattgatgtggttagccaaaagttgatggtgcaaggatactcaggccatgcccaatatagtgggggtttggatgttgctcgtaaggtgttaaggtctgatggcatcaggggattatatagaggatttggtctatctgtcatgacttatgtaccatctaatgctgtatggtgggcaagttacggttcaagtcaacgctacttatggagattcttgggagataacaatgaggaagatgctcctagtctaccaaagattatttttgctcaggctactggagggatcattgctggtgctactgcatcctgcattacaaccccattggatactatcaagacacggttacag

SEQ ID NO: 59071 - DNA, 642 bp, Glycine max
  Peptide Sequence Number=SeqID_175849
atgtcttcagatctcagtgattataaaatcatcaaggaaggagaagctgagattcttatgcacgcaaagaatgaagtcttctacaacaaaactcaggtcaataacagggatatatcaatcgctgtcttgagaacatttatatcgaaacggaagcaagagcatgaggcatatttgtccaaaagaacaaaaggggcacaaaaggcatctgaaaatggtgattcttctgaattggttaaggaggaagtacctgacacaactgcacaagaatatcataaatctaatggggaatgcgaagtagaggaagagatatctccagaagaacgatgcagcaccgtggaagaaggttcagttaaggtcactgaagaatgcagcaccgcagaagggcacaccaatctttcagaaggaaaaggaaagagggaactgaagcccccaagagttcttgaggccttgtctgcttctgggctaaggtctctcagatatgctcgtgaagtagaaggaattggtcaggttattgctgtggacaatgataaaggtgcttcacagcttctgttgaagcttgtagaaggaacatcaaattcaatggttcagttgcagcttcaaaagtggagtctcatcttgatgatgctcgtgtatatatgctaa

SEQ ID NO: 59072 - DNA, 1209 bp, Glycine max
  Peptide Sequence Number=SeqID_175850
atgtctaagaaacaattgaatggacaggctgttgttacaatgtacaacttccaacaatatcgtcatatctcagcgcctgggtggtcattaggatggacatgggcaaagaaggaggtaatatggagcatgatgggagggcagaccactgaacaaggggattgttcaaaatataaggcaaacatcccacattgctgtaaaaagaaccctatagttgttgatttacttcccggaacaccttacaaccaacaaatttcaaactgctgcaaaggtggtgtactcagctcgtgggcacaggaccaatccaaggcggttgcagcatttcaagtcagtgtaggtagtgccagtaccactaacaaaactgtcaaagtgccaaaagatttcacactgaaagcgccaggacccggttacacgtgtgggccggcaacaattgtgaaaccaactcaatttttacaaccagacaaaaggagagtgacccaagcactcatgacatggaatgtgacatgcacatattcacaatttcttgctcagagaacacccagttgctgtgtctcgctctcatctttctataacaatacagttgtaccctgcactacatgtgcatgtggctgccagggcaactcatctcaatcaggagaatgtgtagatccagattcaccacatttgcaatcagttgtttccaacgctggacctggaaagagtagtatcacacctttggttcgatgcactcgtcatatgtgcccaatccgagttcactggcatgttaagcttaactacaaggagtactggcgtgtgaaggtcactgttactaattttaattacgggatgaattattctgattggaacttggttgttcaacatccaaactttgacaatctgacccaacttttcagtttcaactacaaagcaataactccctacgggtcaataacaatgctttggggacttaagttctacaatgattttctcatgcaagctggccctcttggtaatgtacaatcagagctactattcagaaaggataaatcaaccttcacttttgacaagggttgggccttccctcggagagtctatttcaatggcgacgtttgtgtgatgtcgccacctgatgcttatccatggttacctaatgcgggttccaggcaagtggtttccctgcttgctttggtgatgtcctctttggtagccttggtattatatgcagatacttaa

SEQ ID NO: 59073 - DNA, 1219 bp, Glycine max
  Peptide Sequence Number=SeqID_175851
ctgggcggcgcgcgcgtggcgctggtgtgcgtgttgatcgaggcggccggccagtggctgatctggatgggcccgacgccggcgtgggcctttgccggtgcgctgttgagcggcgcgggctattcactggcgttcccggcattcggcgtggaggcggtgcgtcgcgtgccgccggccagccgtggcgcggccatgggggcgtatgtggcgttcctggacgtggcgctgggcatcgccagtcccgcggccggctggttggccgggatgcggggctatggggcggtctatgcgctgggcggcgcgtgcgcgctgggcgccgtgttcgtggcgatggcgctgcggggccggaccgtggcggccatttccagcacttcgtcatcgaccggctgggcctggccgtcgcgcagttgctgcaggtggtcggccagttcggcgatggtcagggcgaccaggccgtgctgggcggcatagcgctccagcgcggcgccgcgcatcatggtgccgtcggcgttcatcagttcgcacagcacgccggccggacgcaggccggccagcgtggccaggtcgaccgagccttcggtgtggccgcggcgggtcagcacgccgccgggctgggcccgcagcgggaagacgtggccggggctgaagatgtcgtcggcctgggcggtgggcgagatggcggcgcggatggtggtgacgcgatccacggccgacacgccggtgctgacgccttcgcgcgcttcgatcgagacggtgaaggcggtggcgaagcggctctggttgcgctggaccatgggggccaggtcgagacggtcgagggtttcgccgggcaggcacaggcagacgatgccgctgccgtcgcggatcagctgggccatgacgggcacggtcagcttgtcggcggcgacgatgaggtcggcttcgttttcgcggtcgaagtcatccatgaggatgacggggcggcccaggcgcaggtgatgcagggcgcgttgcaggcgcgcggcgaagggctgggcggccaggctggggaggggggactgcggggtaagggtaacggggcgtgtgacggcacatcttctctcatccggactgtgaccgtcggccctggcatctcaccagatctgctgaccccggtgtccgtaaaggacgccgggcgctcgcgggctcgccaagttgcttggcataccgccggtggggaatttcgccccgccctgaagac

SEQ ID NO: 59074 - DNA, 1356 bp, Glycine max
  Peptide Sequence Number=SeqID_175852
atgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagtaaaacaatctattccttgataagaaaaataaaaaacgtgaatggtgattggattgatgataaaatagaatcctgggtcttgaacagtaattcgattgatgataaagaaagagaattcttggttcagttttctaccttaacgacagaaaaaaggattgatcaaattctattgagtctgactcatagtcatcatttatcaaagaataactctggttatcaaatgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcag

SEQ ID NO: 59075 - DNA, 486 bp, Glycine max
  Peptide Sequence Number=SeqID_175853
atggcgcagcagagactgatccggccggtagcgcagcgccaggcgcatctcgctgacgccgcgcgtcggagtcggccacatcggcggcgtgccgtacagctgggccagcccttcatcatatgtaaagcgcggcgtgcccagctcacgctggggtacgcgctttacgcccagcatccgctcttcgcgcaccacggaaaacagcggcagacgcgcgccgctgtggacattgagcagctggttaaccagcgaggtgataaaggcggttttgccgctgcggctcaggccggtgacggcgaggcgcagatgacgatccacgccacgcaacggttccagggcggccgccagcaacaggcgcagcggacggcgcgccaccgatttcactgcccagccggccaggccgccgggcgcataagttactgcactgatgatgatgaattttcccgccgacttcaacgcaggcgttgcgcgccggcgcagggacagtaa

SEQ ID NO: 59076 - DNA, 1014 bp, Glycine max
  Peptide Sequence Number=SeqID_175854
atggttaaacgcataaacaggctctgttgggtaaacatctctagtcatgctaatcggtataagcggtatatcgttcccgtgttatctgttcagatggatttttatcttcgtgtgtttgttcgcatatatacttctgccagtgctatgaaaaacactcccctaaagctttcatatgtttatcagtgcaccggttgtgattctttccacctacagcccattgggaggaccatttccaagaatactagcgtcagatatttgcctggctttggtcctgttgttcctcaagaatgcagtgattgtgggaaaaaattcaacatgggtggccctatatggtctgctcctatccatgaccaagaatgggtggctgctattctggctgatgtaaaatatatgaaagacagatatccagcttatgatcgcatttcagctgtgttgactacaatatcagaggaattgcctgatgttcccctctttttgagtctgcacaacctctgtgcaaccctcaaatgcacttctccgtcagcaattattttccgttctgcggtgatcaatgcaggctatcgtatatctggaactcatgttaatccattggggcttaaatcagatgcacccatggatgttatttgggatattatgcgttgttgggtaaaaaatcatccagtgaagcctcagccagcagatcaaccaggaagtattatacttgcaaaggaacctgctcttcagatttgtggtgggagagtcagaagggatagaaagagggtgaaaaattgtattgatagggctaattttgctcgagctgtagcatctcttagtaaggcacaagcaaagaaggttgctcgatttcttccaaatcctgaaagacactggggtccaaaactaagggctggacgtcaaattactagcaaacatgtctctcttttgggtcctgacgctattaatggagctctcaatcaggaagacgatgaagaacctaaaagtaagaagtcaaggactgaagatagtgtcacatcttag

SEQ ID NO: 59077 - DNA, 261 bp, Glycine max
  Peptide Sequence Number=SeqID_175855
atgggtgccaaatacttcgaagtggtcaaacgagggtcgcatcccaacaacggatggtccctggacgaaattaggacgcagaatgaccatattttgtctctgcgtgttgttggacacaatcgagcctgggcggcaagccacagaatgaccataatttgtctctgggtgccaccggacacgatcgcctctggatggcgaaaaggtgcgcggaatgaccataatttgtctcagcccacctctcgacttactgtccccaaatga

SEQ ID NO: 59078 - DNA, 465 bp, Glycine max
  Peptide Sequence Number=SeqID_175856
atggcatcagctatgccaagctcaatggcacatttcaccaatgctaattccacaaacccaaatgcgtactaccagatttccaattgtgcttctgcttcttccttctcctatgttgctttttctatttttgcttcttccttctttttctttactattttcttatttgcattctttttaccccttagcagaaaccttatcatcatgcctaaagtgctaaaaagacctccattccacatcaacatcatccaagatgacatcaacactgtcgctagtgacatcattggcaatgacgttgacaccagaggagatctccaaccccttcatcagaatggagcgtacctagacaaggacagtgggaatgagaccaaggaaggaaaaatgggggccaagcaagatagagcggagaacccaaccttcattggaaaacctcactcaatctcgcaacaacccaaagaaaagaaatga

SEQ ID NO: 59079 - DNA, 318 bp, Glycine max
  Peptide Sequence Number=SeqID_175857
atggtggaaagcaaaggaaggttggtggttggtggttggtggttggtggttggtggttggtggaagggaaatagcagactcaagacttgtacctgcaacacaatcagagtgaattacagaggaaatctctacacaaatactacatacaacagtagagttatcactgacatagttgaaagaaccaagataaaaatcagaaagatgtctcacagcctaaaaaatgttgaaatgcatgatctcatcaccaatctccatggaaagagtttctgcatgcacatcaatcttggtcctagttgtcatcaagaatggtctccctag

SEQ ID NO: 59080 - DNA, 276 bp, Glycine max
  Peptide Sequence Number=SeqID_175858
atgcaaatcgcaggagggaatggcgatttcgtcgtcgacgcgacagctggcaccggtgtcgccatcttcaatggcgtgttgcaccaagcttggactcgccagtttgattggcgagttgaggggtttgcagttcctaggtgcaggctatttccaacgctgcagtctgcaacctgcaatgggcagttcctaggtgcagggtgtcgccagctccaatggcgttttggttggacaaaatcgccagcacgagcagcgatttgccttgcttggggtttttaa

SEQ ID NO: 59081 - DNA, 219 bp, Glycine max
  Peptide Sequence Number=SeqID_175859
atggctgcatgtagttgttggaggccacccttgtcactgaatagccatggaaaagaaaattggctttcacgaggccccacacattccaattattatgtcttcaactatggtcaaagtgtaacataccaagagatgaggaaaaagagagttaaggtttgtgaagaaatgctgggggtagtagtggcgtggagggtgaatctgatgaagaagagtttgtga

SEQ ID NO: 59082 - DNA, 534 bp, Glycine max
  Peptide Sequence Number=SeqID_175860
atggcggttttgtcttcgagctctcacacatcccttccaaacctttccaaatttcccttccacagattcagtttccatccccaccacctaaatttacctccttggccctcaaaaccaatgccaaagagtcccttatcgctctcaacaacttgcaaaggccgcaacgtgttcagtgaagagttcaacggaagcgtggcggaagaggagagttacaactcaatggacaataagcaattcgatatagccttccttcatcacctgggaatccggtttgttcttgttccggggacccatgtccaaattgacaatcttttgcttgagagagggagacagcctaagtatgttggtccatataggataactgatgacgagtctctggcagcggcaatggaagcagctgggagaataagattgatgattgaagcaaagctttctcctggaccctccatttacaatagccgtcgacatggtggcaatagccgtttgcatgaagttggtgtcagtgttgcaagtgggaacttttgttggttttga

SEQ ID NO: 59083 - DNA, 2859 bp, Glycine max
  Peptide Sequence Number=SeqID_175861
atgaacgaagcttcaatcaataacacagaaagctacctataccttcatccaagcgagaacccggccatagctcttgtttccccagtattagactcaaccaattaccattcatggagtaggtccatggttactgtgctgagtgccaagaacaaggtggaattcatagacggaagcacacctgaactgttaaagatagatagaacctatggagcttggcgtcggtgcaaaaatatggtcgtatcgtggatagttcactcggtggccacctccatactgcagagtatactctggatggacaaagctgaggagattttgcgagatttgaagtcacggtattcgcagggagatcttctgcgaatccccgacctccagcaagaggcatcaacgatgaaacaaggttcactttcagtcgcggagtacttcactcgtctgcgtgtaatctgggacgagattgagaatttcagacctgattcggtctgctcgtgcaacatcaggtgctcatgcactgctttcaccattatcgcacaacgcaagcttgaagatagagccatgcaattcttacgaggtttgaacgaacagtacactaacattcgttctcacgtacttctcatggatcctatacctgccatatccaaaaaaatttcttatgtagctcagcaagaaagacaattgctagggcacgcaagaccaaacatcaactttgagcccaaggacatctccataaacgcgacgaggaccacttgtgatttctgtgggcgcattggtcatgtagaaagtgcttgttataagaagcatgggatgcctacaagttatgatggaagaaacaagaataacaatggaagaaagacgtgtacccactgcggcaagattgggcacacagtagatgtttgttaccggaaacatggatacccgccgggatacaaaccgtatagtggaagaaccaccgtaaacaatgtgatgataatggaagataaagctacaaatgatcaagctcagcaacacgagtcacaagaggttgttcacttctcccctaagcagtacaaggcattacttgccttaatccagcagccaccggcaggaagcacggcgcagtctaaacaagttgcattagtctcctcgtgcactgttaacacaccattgaacccaggtaattcactctctacccaagcacatcgcacctcctggatcctagattcgggagcaacggatcacgtcacctgttctttgcataatctccattcctacacacaaatcagcccgatcacggtaaagcttccaaacggtaatctcgttcatgctactcacataggaaccgtacatctttcatccaatttaaccttacataacgtgctctacatacccactttcacattcaatcttatttcaatatcaaaactcgtatcttctaataattatgaattaatcttttcttccacatcgtgcgtgttgcaggaagcgaaaaatcatatgaagattggtatagttgaagcaaagcatggcctctaccatttgataccaaaccagataactaccaaagccatatactctaccatcactcatcctagatgcaacatcatccccatagacctatggcattttagaatgggacacccatcaaatgaaaggctacaatgtatgaaaaactattatcctcttttgagaaatgataaaaaaattgtctgcaacacgtgtcactatgcaaagcataagaaaatctctttttcatctagcagctcgcatgcatctcattcctttgatttactgcatatggatgtatggggtccatgttcaaagctatccatgcatggtcataaatactttctaactattgtagacgatcactcgagattcacgtggatacatcttatgaaatctaaagcgaaaacgcgacatacaatcatcaacttcattgctttcattgagagacaatataacgacaaagttaaaactataagaagtgataatggcatagagtttctaatgcatgaatattatgcatcaaaggggatcttacaccaaaccacgtgtgtcgaaaccccagagcaaaacggtatcgtagaacgcaaacatcaacatctgctcaacgttacacgagcactcctctttcaggcaaacttaccacctactttttggtgttatgctttgccgcatgctgcatatctaattaactgcattcccacaccattcttacataacatttcaccttacgaaaaattgcataaacatccctgtgatatatctaatctccgtgtcttcggatgtttgtgttatatcaacacaatcaaagcaaattggcaaaaatttgatcccagggcacacccatgcattttcattggtttcaaaactcatacaaaaggatatcttgtgtatgatttgcattctcacgatgttgcagtatctagaaatgttactttttacgaatatcattttccatacttgcctaaaacccaacatttaaacttagataactcaaccccatctccatctccgagacccttttccggcaaagaccttgacctaccagaagaaagtcactcatcacaacccataataccaatacattcctgtgatgaacattcaaccaaacaagacccttcacacctttggcgttcaacacgatcaagacattccccgacataccttcaagattaccacaaagttcttgcttcatctacaccaaaagcttcagtgattgttcgctacccactaagctcagtgctttcatactcacatctctcacctgcccataggaacttcgtgatgaccatctcatcagccacagaaccttcatcatatgccgaagcctctcgccatgactgctgcattaaggcaatgaaggccgagttacaagctttgtag

SEQ ID NO: 59084 - DNA, 726 bp, Glycine max
  Peptide Sequence Number=SeqID_175862
atggacatgttagtttctattcccttgttctgttgttgcggggttgtcaaaggagttgattttgggtcaactggggaggttaaaaaagtagatatttctcgcatgcgtgaaaggcttgatggcgactgtattgttattttaagcaacttgggctactctagctctggagaagtattagattgcaagtatgctttagagtctctgatgattaccttttacaacttgaaagcctcaatatcttatgtcattcatattctcaatctagggggtcagccaggggccaatggtgaggttgttgccatcacctatgaagttgcgacagcctgtgccttggctgtacgagctgacaagcttatatgcattacagatggtccaatactggatgaaagtggacaccttattcgtttcttgactcttcaagaggcagacatgttaattcgtaagcggcttgagcaaagtgaaacaactgctaactatgtgaaagctgttgctgaagaaagtttcaaatctcttaaaaattttaatggggcagtccattcttcacagaatggaaaaccattttcagaatgtcataattcaacctttcataatggtgttggttttgacaatgggaatggcctatctgaggagcagggttttgctattggaggtcaagagtcactatgtcgaacaaatggttacctgtcagaactggctgctgcagcctttgtttgtagagtgagttga

SEQ ID NO: 59085 - DNA, 1335 bp, Glycine max
  Peptide Sequence Number=SeqID_175863
atggaggggttagactacctcgacacattctctccggtggcaaaactcactaccgttcgtgttcttctcgcattggctgcgcaaaatcaatggcacttgcgacaattggatgtcaacaatgcgttcctccatggagagcttgaagaagaagtgtatatgcaaattccacctggacttgcagttgaaaacccgaagcttgtttgtcgtcttcaacggtccctctacgggcttaaacaggctagccgacaatggttcacaaagttatctagtttcttagtctctcatgggtttcaacaatctaactcaggccactctctcttcttaaaactcactaagtcagtcactaccatactcttggtgtacgtagatgatatcatactcacggggaaaattatactggaaatacaagatatcaccaccctcctggatcaggaattcaaaataaaagaccttggcgacttgaagttctttctgggactcgagattgcccgcaccactgatggaattcatttatgccaacgaaagtatgccttagacattttatctgattcaggtatgctaggttgcaagccacactcgacacccatggattattccatgaagttacagatgaactcaggcaactctctttccgacgagtcctcatcctcctatcgaagactaataggaaaactcatatacctgaccaacactcacccagatattgcgtacgctgttcaacaactcagccaatacatgtcggctcctaccaacattcatcttcaagctgcttttcgcatattgagatacctcaagggttcaccaggatccgggctgttcttcacagcaaccgggactccccaactccgagctttcagtgattcggattgggcggggtgtaaagattctcgaaaatccactacagggttccttgtctatctgggttcttcactcatttcgtggcagtcaaagaaacagtccaccgtctcccgcagctcctccgaagccgagtatcgagctctcgcatctactgcttgtgagctgcaatggttaacgtatattctccaagacattggtgtagcatttattcagccagccaccttatattgtgacaaccaatctgcaattcagatagcaacaaatcccgttttccatgaacgcactaagcatatcgagatcgattgccatattatccgccacaaagtcattgcgggtctcgtaaagctccttccggtctcatcttccatgcaactcgcggacatattcaccaaagctttaccaccagccacctttcagcccctttgtaacaagctgggaatgatgaatatccattcccagcttgaggggggctcttag

SEQ ID NO: 59086 - DNA, 333 bp, Glycine max
  Peptide Sequence Number=SeqID_175864
atggtccatgacatcttcgtcaaggtgaaactggaagtaacagggacatcagcatccctaaatgtgtttggcagtagacgaagcagtgatgtaacacgatcttttgccccattttttttcaagatggttacttccatacttcaacttgactcgatgaaccttttcgtaaaagcacgagcttggttcaaccccataacccaggaaatggcaattttgatcgccaatacttcatcaacaattcatagggatgaaagactcgggaatatgcatgcaatgtatggaaaatgtaattatgagattgagatgcccgaagaaacatcctttcttagttaa

SEQ ID NO: 59087 - DNA, 792 bp, Glycine max
  Peptide Sequence Number=SeqID_175865
atggagaccttggatcagatgcttgtgtcaagctggtacaatgttcattccttggtgcccccatcctatgtacaattaccggaaaacaggcctagcaaggtggttagttctttgcataaggcaatacccgtgattgattttggaggacatgatcgtgttgataccacaaaacagattttggaagcctccgaggaatatggctttttccaggtgatcaaccatggagtttccaaggatttaatggacgaaacactgaacatttttaaagaattccatgccatggctcccaaagagaaagtcaatgaatgctctaaggacccaaatggaagctgcaagctttatacaagtagtgagaattacaagaaagatgcgattcattattggaaggactcactaacacatccttgtcctccttctggggaatacatggagtattggcctcaaaaaccatccaaataccgggagattgttggaaaatacacaagagaattgaagaaactagcgcttaaaattttggagctgctttgtgaaggattagggcttaacctagggtatttctgtggtggactaagtgaaaatccatcagtgttggttcatcactaccctccttgccctgacccaagtttaacattgggcttagctaagcacagggaccctactattatcaccattttgcttcaagataaggaggtgcagggacttcaagtcctcaaggatggagaatggattggagttgagcccattcccaacgcttttgtggttaacatcggtctactcttgcagagattataa

SEQ ID NO: 59088 - DNA, 492 bp, Glycine max
  Peptide Sequence Number=SeqID_175866
atgttgaagttgtacttcaacaaagagcaaattgagaaggcaacggtaactttgcatggagtgaaggtgcagcaacaagactcttcttcttccaaaaaaaagaactattggaataaaggagtaattaaagatattaaagggggtacaaaaaccaaaattgtgaaaagtgacgcaagtggcacgagcatgcccatcactagcacacctatgcggaattcactggagaatggtcataaaatgatcatgcatcatctgatctcatcaaccattcttgacactggtgggtatgatggtaaaatttctacacttgatcttgttctactatggggtttgctgactccttactcccacccggatgaccagattggcactaccacatttcttattcgacgcctccaagtacttgctaatagttccagcattgtcattgtgcaaggaggtctcattatctctattgcgaggttttatgatgatcaccactttctagactag

SEQ ID NO: 59089 - DNA, 291 bp, Glycine max
  Peptide Sequence Number=SeqID_175867
atgtttggggtcccacgagctgtgattagtaatggtggttctcatttcattgagaggcaaattgaatttatattgaagaattatggagtcactcacactacaccttaccatcctcagacaagcgggcaacttgagcacaaggatttgttggtagtgaagcttctcaattatgacttgaaagcagctggtgagaggtggaagcttgatttgaatgaattagatgaaaatatcttgaatgcatatgaaaatgccagaatttacaaggagcagaccaagagatggcataactga

SEQ ID NO: 59090 - DNA, 141 bp, Glycine max
  Peptide Sequence Number=SeqID_175868
atgagacagaagagtgaagtagctggtctcggagtgggtgccgtgctcctctgtgccaccgttgctgccaccaaagtcgatgctttcttctcttcttctcagcgcagggccttgcaaacaccggtatctttaggaggttag

SEQ ID NO: 59091 - DNA, 354 bp, Glycine max
  Peptide Sequence Number=SeqID_175869
atggcggcactattcaagttcttggctgtgaagtggatgatcatactagaggatcatttcgcaaaagggatcatcaacccatttgagtacatgcttcataaaggtggaaaaattcatattacccacaagacatctcatcctttcagtaagaagaacatcaagaagttggctaaacgtcaaagtttggtgttggttaaagcagagttttatccacatctttacccaggttacaaaatcaagagaggtgatggtcttaaatgtgacgagagtttccccgttggagagtgcagtactttcatgttccagagttattttgatcttttttgttacaaaataagaaaaccgtgttattga

SEQ ID NO: 59092 - DNA, 648 bp, Glycine max
  Peptide Sequence Number=SeqID_175870
atgcaagagacgttgatgcaatacatcactaagaatgatcaacagatgaagcttatgactaaagctaatcctaaggaggaagtgaatgttgtgagtactaagagtggaaggcctatggcaaagtttaaaaagaagaagaagaaaccactccaccaccagaaaaaaaaggctcttactgaagagagccaagaggtgcacatcaatatccctttcactgagacaattgctcaaattccaaagaagttgtcacctaagcttaaagttcctgggagtttttcagtcccttatactattagcagcttgcaaatagatagagctttatgtgatctgggtgcaagcattaattcgatgccttattctgtttataagttggggatgatgaagagattccaattattttgggaaggcccttcctctatacatgaggagctttgtttgatgccagcaagggaaactaatttggaggctagccaccaacaagatgaagacaattgtggccaagccttgtccaactatggggaaggaaggtcctctgaaaaggaacatcattctaaaggatcacctgtgaagcccggatacgtgaaaaaaggaaaagtatcggtgtcgtacccgtatccgacaccgatactccacggatacgtatcctag

SEQ ID NO: 59093 - DNA, 135 bp, Glycine max
  Peptide Sequence Number=SeqID_175871
atggtgagtcacgacaagctacgagtgcgccgccgcggacggtgggagctgagtgatgatgcaaactcaggaagggagacctcagtgactgaggaaggtcttcagaggtggaccgatgttgttactgtgtcgtaa

SEQ ID NO: 59094 - DNA, 168 bp, Glycine max
  Peptide Sequence Number=SeqID_175872
atggcaagttatatgacacttctcatggcgtttgagtatctaccaaccattccttgttgtgaaaatgcaaagaagtatgatcgcaagtatctgtttgcggcagggtggaagccactaagggatattggcatggcttattcaactagggaggcattggatcgattgtaa

SEQ ID NO: 59095 - DNA, 111 bp, Glycine max
  Peptide Sequence Number=SeqID_175873
atgaagggaagtagtcaaagccaagggagtcatggtcaactcatatggatcgtggcaaagttaggacgtctcaagcttcaagttcaggattccgataatggccgtggttga

SEQ ID NO: 59096 - DNA, 480 bp, Glycine max
  Peptide Sequence Number=SeqID_175874
atgtggtcatatttaccgaagaagtttttgaggcagttcaggagggagaggcaccatgtagtcttctatgtattccaccataaccacaaccttagccttaaccacaacctggtggtggtcaaataccagattatgtaccaagtgttgtttactcatgataaattccaaatgatgtcaacatccatgcagagattgagagttgtacctaaaggcataaataatcatcatgtcatacaacaacttttgttgatggcacatgaaggtctagtatctagatgcagttcaacaggggagcaccaaagcaagaaacctaatagaagtagcaaaagtggccacaaaggtagttggtcatcttctgatgcaatcctccctaggaagggaccaatcactagaaccatgagcaagaggctccaagaagattgggctagagctgctgaagaaggccctagggttctcatgaaccttagggtagatttctga

SEQ ID NO: 59097 - DNA, 210 bp, Glycine max
  Peptide Sequence Number=SeqID_175875
atgcaaagttggctcgacaataccaataataagcaacaaagcctaagggatatcctaagggatttgacactacttcagtcctataaggaccagatacctgggcatgtatggatcgatgagcccaaagcagagccaaagatggttagccatggtggtaatgttatgccttaccttacccagccaatggtgaaggggcagtttagggcttaa

SEQ ID NO: 59098 - DNA, 216 bp, Glycine max
  Peptide Sequence Number=SeqID_175876
atgggctcgaaatctaccctaaggctcatgagaaccctagggcctttccttggatctctagcccaatctacttggagtcttctagccaatgcccttgcggggccattttattttgagaggttggtgaagggaaatgatccagatccaaagccaaatccctccattgaggaacctcctgaattagagttaaagcctcctcccttcaatctcaaatag

SEQ ID NO: 59099 - DNA, 1194 bp, Glycine max
  Peptide Sequence Number=SeqID_175877
atgtcctccttcatttttgacttcgccattggcatgggtggtagagacttcaggggtttgattcaacaacccttgctagacctggaggtgatatccattgacggttcctcctcagaggatactctccatggtgcttctgatagtgatttttgttccttagagagattaagggtttcgcgtcgtactggtggaggcacttcttgcctccacgggagggtgcaacctttcgttgcttccatggttgggcaacctgtctgccatagcattgggtcacaatcgtccatccccactattgctgactatgaatgggtgagggatgacgttctaatgtataagttatctatcacctctgcggcgagtgttactgctctacaacgccaagtgtctgttcaaggtcttgggtctcattctccccttgatcacattctaatgaagttgaccggtaagattggttgggtctccttgaacagcaaatctaagaagctatttgagtttgactcaaatgtcttttgccacttaaaggaccatttcttcaaggttctagttactgaagtcatggttgatgactcaccactgatgttcaacaaggatagggagcccgacttctctttctactggttcaagtcatttgatgaggatctattgacccttatggagaaggtcgacaaagctatattagagcatctgttggcctcactaaatgcacgagcctttttttctctcccctcgacgagcaatcctttcgctgccatgggcggtatcatgggtgacttcgcttggaagtcccttgtgaagcaggtcgaaccagttggcaagattgtgacaccatctgttgttgcctttattgctggagaagggggtcaacctgctgtcgtggttgcccctattattggtattgctaaggtcacccttggtgttccttcctctgttttggctaataggaagcaagataatgacactgggatgccaggccatctgcctctggcttcatcggctgttgtggctcttgctcttgatgttgttgttgttgttgcccctgctcttccatctcttcctactatgcttgttcaagaggtcactcttgctactgttgaagttagtgcaccagatgctttagctggtcctgttgtggctcctttgtccaccatcgttgcacccttgttgagtgtcggtgtggtgaccatgagtgctcct

SEQ ID NO: 59100 - DNA, 420 bp, Glycine max
  Peptide Sequence Number=SeqID_175878
atggcgtctgtgccatatacccttagacatatcgagtctagtgtgcatggccttaaggatgactttgttggttgcctctgcttgaccgttggtctagggatgttcaacagaggttacgaggtgaacttctcaacctcgttcactatgatttctcgtagtggtcttgcctcaatccacttgattgtcaagaggagtatgcagaatgtctgcgaattcctggcacctctttgtgaagtcgagggcgtctgccctgagtgtcggccaatagtagctggtgcgtaccactttggttgcaagggaacttcctcctgtatgaaggatacaaattcctttgtgaagttctctcatgacatagtctgcctattggctattcaagcatttgagcatttgaatagctcaccatcaaggatgacgcagtag

SEQ ID NO: 59101 - DNA, 342 bp, Glycine max
  Peptide Sequence Number=SeqID_175879
agaattcaagggactaaccgcctaggaattctttgtcctaacacattggagggtacatcctttgtggcacaagtagagggtacatctacttgggttgttatactgagaacaagaaagggtacatctcttgtagatcagttcaactggagagtacatccacttggttgttcaaagagaacaagggagggtacatcccttatggatctttggcttgtaaaggattttacaaggttgaaagaaatctcaagaaccgttggttgcttggggactggatgtaggcacgagttgttgccgaaccagtataaatcttgtgattgtcttcttcttccttacactttttaa

SEQ ID NO: 59102 - DNA, 189 bp, Glycine max
  Peptide Sequence Number=SeqID_175880
atggtcttgactaaaggtggtcatgaggttgacatagcctttggtctctactttttctcctacaaagccaaggagtgggccggagtgaggctggacgggttgataccctttaagtctctatcaatgaaagtgataggagggagacttcatggggatggtaggtcgacacagttgatgtcgatgtcctag

SEQ ID NO: 59103 - DNA, 186 bp, Glycine max
  Peptide Sequence Number=SeqID_175881
atggagacatcctgctcaaagataccgacattaccacaaatacaacttgaagagatcacacagctgttagtctctttggggcccaaacggtgtctgggaaacacatgtattgtggagatcgagtatagacaaagcaagatgagtcacatgcgtacttataggctcacgtataaggtgaaagtatag

SEQ ID NO: 59104 - DNA, 891 bp, Glycine max
  Peptide Sequence Number=SeqID_175882
atgatgaacaatgcccgccttctggttggcattcagggcgtcggcgttgccgaagcggcttaccagcaggcgctcagctatgccaaggagcgcaaacagggccgcgccatcggcgctgatccgaagcaaggcatgaccccgatcatcgagcatcccgatgtgagccgcatgttgctcaccatgaaggcgctgacgcagattgcccgctccatcacttattcctgcgcccatgccatcgacatgagccatgcgacggatggcgcagaccagcagttctggtcagaccgcgcggggctgctgacgccgctcgccaagagttttgccaccgatgcaggtgtggatgtcgcttcgctgggcgtccagattcatggcggcatgggcttcatcgaagagacgggcgcagcacagttgctgcgcgatgcccgcatcaccccgatctatgaaggcaccaacgggatccaggccatcgaccttgtggtgcgcaagctgccgcttgggcaaggtgaacacatcaagggctttcttgaagaattgcaggcagatgccgacaaggccagtgcatccaatcgcccggaactaggcgaaaccggcgcgcgtctctccaaggcgatcgcacaagcccgcgaagccaccgaatggttgcaaaaggccgtggcggatggtcagctcgaggcagcccttgccggagctacgccttaccagcgcctcttgtcgctcgtttcaggcggtgcctatctggcgcgtgcggcgcttgccggtgacgacagcggacgtgcggtcctgagccgcttcttcgcggaaaacatgctcgccgaagtttcctccctgaaggataccgtcataaccggcgccgccagccttgccgccgccaaatctgcgctggaggcgtaa

SEQ ID NO: 59105 - DNA, 428 bp, Glycine max
  Peptide Sequence Number=SeqID_175883
tgtggagactcgaggcttagcgcgatgttgggaaactgttgatgcagcaccgtacagtttccctccgatgccagaacgacaacatggaatgtattacacaccgccggcattcacccaagaatcgtcgcagatgctgccgatgtattcatacccacatgattttcaaccagggtatagtttggcaggcatatttgggtcctctcctccttcaacgggaactccttcatttacccaaagtggtgaactatcaaccccaaatgccccacttggtggtccgtggaatgtacctgaagatatacccgacatggacgacttattaggagttgatttacgtcatgatttctctgtcgaggctgaccaagtggatgaaagggcgaatcgtagaagaagaaatcctgatagggcagctagaaattgggatcggccat

SEQ ID NO: 59106 - DNA, 246 bp, Glycine max
  Peptide Sequence Number=SeqID_175884
atggcgaagcggtgcgcggctgcacgttacgcagcgccgagggcttacgcgtggtcagccagagcgcggtgctgcaggcggcacagcaggaggggatggaccgcatcctcaatcgccacgaactctactgcacggtgtgtgaacacaacaccgggcgactgcacgttgcataacaccgtcgcggatatgcacattccgattcagtattactccctaccagcgcaaaaccggatagcaaagaccaca

SEQ ID NO: 59107 - DNA, 1601 bp, Glycine max
  Peptide Sequence Number=SeqID_175885
cgggcggcattatcggtccgctgatgctgtatgaagtgctgatcgcttttttcctcgaatcggcgctgaccggcgtgatgctgtttggcatcgatcgggtgaaacccggcgtgcatttcgccattacctgtctggtggcgctcggcgcgattttcagcgctttctggatcctcgccgctaactcctggatgcaaacgccgcgcggttttacgctcaatgacgccggccagttcacgccggatagtgcctggagtttgatttccgcgccctcgtttggctggcggctggcgcacatgctgctggcctcatggatcagcgtggcgtttttgctgggtggcgtcgcagcgtggcgcctgctgcgtaatgctggcgaggccgccagccggctgatgctgcgcagcgcgctgacggtgtcgctgtgcatcctgccgctgcagatagtggtgggcgatttgcacggcgaaaacacccgtgactatcagcccgccaaactggcggcgatcgagggcagctggcagccgcctgcgccaggggagggcgagccgctgcggctgtttgcgctgcccgatcagacgcagcagcggaaccacgccgagctggcgatcccggctatcgtcgcggcgcgtgctgcgtctgctggcgctgatgtcaccggctggctttgttgcgctgctggcgggctgggtggtgacggaggttggccggcagccgtggacggtatacggcatgctgcgtaccgccgacagcctggcgccaatgtccctcggcagcagcgtcgccattttcgtgtcggtggtggtgatttacgcactgagttttgcctttggtctgggttatctgctgcgccacctggcggcaccgctgccggatccgcaggcgacggcggtagcggaaaccatacagacgccagcctgaggaggcggcgtggggattctgctgtacagtttcgaccagccacaagagcggcagtggatggtgcacagcctgctgccgcttctgctgttacaaacgctgaaggtgccgctgtttctcttcctgctggcgctgtttttgcgcgggctggcgctggcgtatcgcggtcagcctggcgagaccgggcgacgctggctggaccggctgctgatggtcagctcgctgctggcggcgtttctgccaggctggatgagcggattgatgctggtttcgcgtccgcccagcgggattccggtggtagagcgggcgcgggcgctggccatgctgtggtgggtggtgatgctggcctgctttattgccgtgctgctgctggagccggcgctgtggcagcagagctggcagtgctgcccgggaaaagtgttgctgagcctgttgcctgcgctgtggctgctgcagttgctcacgctgtggcgggaagcgatggtggcgttattgatgatcacgttggtacagacgggcgtggtggtcgcggcgctggcgtgcgggctttatccgtggttgctgccgtggcagctggagatgcaccagcaggcctcctcgccggtgacgcaggggtttgtggtgacggggttattgattgtgttgccgctgacgctgctgtaccacagctgggcgttctgggtgtttaa

SEQ ID NO: 59108 - DNA, 1923 bp, Glycine max
  Peptide Sequence Number=SeqID_175886
atgctggcaccgatcaccaacagcagcagtgaaaacagcgccaacgccaacctgcttaaccgcctgcacagtcgctcggtatacgccaaagacagcatttcgctcaccgacgactggattgcggtgctgggcggacgctatcagcactatgaacagcgcgcgtcaaagggcttcaatccggtggtgcaaacgctggacagcgagggcaacaagttcctgccgcaggccgggctgatttacaaactgacgccggatgtctcactgtacagcagcgtgagcaaatccttcacgccgtcgactgacgtcgacgatgacggcaacgtcggcaaaccagaacagggcaccacatgggaagtgggcagcaagtggcagatttcgccccggctgtttgccagcgtagcgctgtaccgtatcgacgaacgtgatatgtcgcttaatatcaacggcaccacgcgcgccatcaataaagcgcgttcgagcggcgctgaatttgagctcaatggggaagtgctgccgggctgggatctgagcgccaactacagctatgataaggccgaaatcgtcgacgatggcgtcaacccggcgaacaagggcaaccgcctgcagaacgcaccgcgtcacgccggggcactttacctgagccataatctgacgctgaacggcattcccggtgacttccgcgtcggcggcggtgcgcgctacgttggctcacgcgccggcgatccggagaacagctttacgctgccggattatgtggtcgccgacagctttatcgcctggaataatcagctgtttggcgagaaaacccagctgaagcttaacctgaataacctgccagcgttgaattctgatcgagcgaaaaagtcactgacgtggcgtgcctggctggctgccctcctgctgctggcgttcagcaccagcgcgctggccagggtgatcaccgatattgacggcaatcgggtggagattcccgatagtccgcagcgcatcgtactgggtgagagccgcatgctctatacgctggcgctgctggcgccggatgacccgttccgccacatcgtcggctggccgcgcgatctgcaaaagtatgacagccagacgtggaacagttttgcgcagcggtttccgcagatgctgaacatcccgacgctcggatcgggcggccctcaggcgatcaatccggagcagattctcgccctgcggccggacgtggtcattctgcccagcctggcgcgctacgatgatgccgatctgaggctggtcagcatcctgaatgctgcgcatattccggtagtgaagatcgatctgcgcgtacatctgttaaagaacacccggcgcagcgtagagatttttggtgaggtgctgaatcagcaggcgcgcgcggcggcgttcaaccgtttttacagcgcccatctgcaggtgattgaggaacggctggcgcgctatcacggaccgaaacccacggtgctgttgcagttgcatctgggacggcgcaacgagtgctgcgtgacggcgattaactggcatgaggagcaggtgatcgcagcccagcctgagtattactttgccaccggctttggcgataacgccagcgcaggcctgctgcgcctcgggccggacgtcgcgcccgacgcggtgctaagcagtttccgccagctcaccgcgcagcagaacggtttgcgtgagctgaaggcgattcgcaacggccatgcagcggcaatctggatgaatttttatctcagcccgtggcatattgcggtgaccgagttcatggcaaaaacgctgtatccgcagctgttcgccgacatcgatccgcagcagacgctggaaaccctgttccgtgatttcctgccgatcccctatcgcggcacgctgtttatgcgcattccggcggtggattcatccacccagcacaagccatag

SEQ ID NO: 59109 - DNA, 2611 bp, Glycine max
  Peptide Sequence Number=SeqID_175887
atgtcactgcctgccctggacgccgcgccgcgctggtcacagcccgtcggtcacctgccgcaatttaaccatgcttacgccacggtcgcgggcgtgcggctgcactacgtcagcggcggcaatgtgcagggaccagtgctggtactgctggcgggctttccgcagagctggtttgcctggcgtaaggtgatggcgcagctggcggcagactatttcatcattgcgccggatctgcccggccagggcgattccgacaagcctgccagcggttatgacaccacctcgctggcgcacagcgtgcagggattgttgcagcagttgggtgttgagcattactacctggccgcgcatgacgtgggtgcctgggttgcctggccgctggcgatgttgcacggtgatgccattatcaagctggcgctgctggatgccggcattcccggcgtgacgctgccggatgcgctgcctgcgacgccggacaaagcctggaaaacctggcactttgcttttcacctgttgccggatctgccggaagcgctgatcgccggtcgtgaagcgctctatctgcagtggtttttgcagcgcaaggcagccagcccgatggtgtttggtgacgaagagatggcggaatatgtgcggctgctgcagcaaaacggcgcgctgcgcgccggcatggcggcgtatcgtgaggtcagcacctcagcggagcagaatcgtcagttgttgcaaacccggggcaaactggcgatcccgctgctggcggtgagcgccgatcagggctcaattgccgatatggcacagccgctgcgcacttttgcggccgacgtcagcgggattcgcctcgcgcactgtggtcactttatcccggatgagcaaccgcaggcgctggccgacgcgttacgtcagttttttgggagggctgtgatgaagaacctgaccgtcatcggtcgcccgcgcgagttcgagctggaagaggccgcccgcagcgccatgcacgttttctgggatcgcggctatgaagcggcgtcgctaccggatttgatcgccggaaccggtttatcgcgcggcagtctctacaaggcgttcggcgataaaaaagggctgctgctggccgcgctggatatctacatgaccgaaggtctgaaagccacctcggatattctggcgcagcccggcgcggttaaaacggcgattcgcgcctcgctgctgcgttatgccgcgctctccagcggtgagaaagggcggcgcggttgtctggtggtgtcgctcaccaccgagatggccgcgcatgatgaacagattgctgaacgcacggggcgcatgttccggcgtttacagcagctgtatgcggcaacactggtgcgcggtcagctgagcggagaactgcccgagcgtgatgagcaggtgctggcccgcttactggtttgccagattgaagggatgcgcatcctcggtaaaaccggggcaacggaagcagaaatgaacgccgtagtggactgcacgatgcgtgttgtgatgtccgatccgcacgcgttaaatcccgagccacgccgctgggcgatgtttatcgtcctgctgacaggcgcatttttacccccgcttgacttctttattgtcaatgtggcgctgccctcgattcagagcgatttggccacgtccggctcggcggagcaatttgtcatctcgtcctatgccgggttttatgccgtcacgctgatcaccgggggtcgcctcggcgatctgtttggccgcgggcgcatgttcttcgttggcctgaccggttttgcggcggcttctgcgctgtgtggctttgcctggtcaccgggtgcgctgatcgctggccgcgtgctgcagggcatcactgcagcgattatggcaccgcaggcgctggcctcgattcaggcgattttcccggaggcggagaaatcgcgcgcgctgagcctgtacggcgcggtatttggtctggcctcggtgatcggtcaggcgctgggcggcatcctgatctcactcaacctgttcaatagcggctggcgcgccattttcctggtcaatctgccggtggcgctgctggtggtgttgtttggcatcccgttgattaaagagacgcgagctcagcacgcgcgcaagctggattttggcggaatgggactgtcgatgatgacgctgggtctgctgatcgtgccgctgattgaagggcgggaagcgggctggccgctgtgggcgtggctatcgctgctgctggtgccgcgtgccggggctggggctgtccctgctgctggcgctgctgttctactcgattggcgtattcttcctgctgttctcgatctatttacagggcgcgctgcatcagggcgtactgagcgccgggctgatctttctgccctttggtgcggtggtcggcctgctgggcctggtgtggctgatggccagcacgccggttgggatgtcaccagcggcgctgccgctggctctgggactgtttgtggtggggtttggccaggggctggcgctgccgacgctgatgcacatcgtcaccggacgcgtggcacccgcctgggccgggatgattgccggtatcgccagctccacgttgcaactgagcacggcgctgagc

SEQ ID NO: 59110 - DNA, 1709 bp, Glycine max
  Peptide Sequence Number=SeqID_175888
gtgtgtttatcgctgccgaaattgcgccagtaatcctgattctgcttttcagcaatcaggcggaaagcaaaaccgttgccgagcgggccggtgacgtccagcgtgccggcgccgccgccctcgctggctgcgcgaccgctgactttggtgtgccaggtgtattgcggctttttgctcacaatattgatcacgccaccgggattctggataccgtacagcagcgaagccgagcccttcagtacctcgacacgttcggtggtggcgtcgaaattcaacccctggctgctgcgcacgccatcacgatagatggaaccatccgagttgctgccaaagccgcggcgtacaaagccatcttcggtacctgccagcgtattgccttcgcttacgccgctgacaaagcgcagcgcgtcggcgaggctggcggcctgataatcctccagctgctgttgcgtcaccacgctcaccgattgggcttcattgaggcgcgacaccggcgttttactggcgaccgaactgctggtggcgctatagccgtcgtcactgttttgctgctgcgccgtcacggtgagggtgctgttttgttcagcggcaaggctgtcagtactgctgagtgccgttacgccgtaaatagcggcaaggatagccggatggcacagacattcgcggcccggcattgttatgccatcagtcagcagaaaaaggcggctgagatccaggcgagaagggagtggacagcggtagcggcgcaaattttcactacaagccggcctgccgacgcggttcacaacgatgcgatattactaacaggcaacataatggcggcaaataacattaaaaatcgggtggatgtattcggtgaacgctaccgtgcgcgcgtcacgacattatcggccagcctgcaaacggtggcgcgatatatccacgaacatcgtgaggctatattagacgcgactgcattggatatcgcccaggccactcaaacctctgacgccaccgtggtgcgcaccgtgcaggcgctgggctttgccggtttgcgcgatctgaaaaccacgctggccgcgtggtttggcccggcgcaaaactcggaagagaagatgagcgcgaccatcagcgaactgtcgtgtgacatcaactccggcatcgattttgtgctgggcggccatcagcgcgcctgcgaagtactggctgaaccggttaaccgtcaggcggtggcggctgcggtgacactgttgctggaagcgcgtcaggtggcgctgtttggcatcaacgcttccggcattctggcggagtacagcgcgcgactgttccggcgcatcggcctgccggcggtgacgcttaaccgtgccgggattgcgctggcagaacagctgattacgctacagcgcggcgatgtactgatcatgatggcacagaaatcggcgcaccgtgagggcatgacgacgctgaaagaggcgcagcggctgggtatgccggtgattctgctgacccacgcgctggattcggcgtttgcgcagcaggcggatgtagtaattaacgtgccgcgcggcggtgaaaatggtcgcatgccgctgcacggtacggtgctggtgtgcctcgaaatgctgattctggcggtggcctccgccagttcggcacgcacggttaaaaccatgaaacgcattcaggatctcaatcgatcgctgaaacccacgtcgaagaaggcgggataa

SEQ ID NO: 59111 - DNA, 3719 bp, Glycine max
  Peptide Sequence Number=SeqID_175889
gcgcggcccggttcgttataggtcgatgccccggcattttcgcgataaacgcgcttgtcaaacaggttgttgataccggcgttggcgctcaggtttttagtgatgtcgtagttgaggttcagtccgacaatggaatacgggctgatttcacgctgcgacagaccacggctggcctcgaggctggtttccgcatactgacgtggcttctgccggccgtattgcgtccagttgatgttggcgctgagcgcctcggtcgcctgccactccagctgcgagttgatggtgaattccgggatcaccgtcagcgggttgccggtttttttgctctccgagcggaacatataggtggcattggtgcgccactccagcgtgtcggcgatcagtgggatgctcagattgccttccagcccttcgacgatcgccttgccgccgttttcccagcgcagcaggttatacgagccggtgatgcccgcgacatagccctgattactgaactcgatgcccacttctttattcacgctgatctcgggatcgaggtctttgctgcccagcaggatatagccctcagtggactgatacaggttgggcgctttaaaggcgcgcgcaattccggctttcagcgtgaagtaatcaccgaggccctgcgacaggttgaggctcgggctccagttagcgccaaactgatcgtgatagtcgaagcgcaggccgggaatcacttcggtggagtcggtggcggcgatgttgtcttcgaaatagagcgagctgatggtggcgctgtttttactgtcacgctgcgaaccgtcgctggaaacgccgccgaaatcgacgcccggtgcgctggtggcctgtaccgatgccggatcgttaagctcatcgcgattccactcagcacccagcgtaacggtttgatcgaccagcagctgcagcgggaaattgatctcgccgccggcgcgatagctctccagccggcttgtagcgtacgtatcgctgttgatcatcccttcggtgctgccgccggagccttctttcaggcgggtgttattggttttctcatagctaaagttgagcttagaggtgccccagtcccagatgccgttgtgcaccactccatagttctggcgatacaggcggttggtttcgctgccgtacagcgcttccaccagtccgttggcgctggcattgctgttgctgttttgcgtgtcgccggcataaatattgccctggcgactgtagccatagctgaaatcgacaatctgcgtcggggtgattttccacgacagcacgccattaatgtctttgttacgcatcccttcgcgtccggcggcgtaagcgccattttgcgcggtattgatgtcgaaggcgtcggcatccgttttgttcaggttgccgtacagccgcatggtgagtgcctcaccggccagcggaccgctgaggttgaagtttgcgcggcgggtggcgccttccttgtcatcttctggctggttggtgaacagcgacagcgagccgtgccagtcattggtcgggcgtttggtaatgatgttgaccacaccgccggcggcaccggagccataacgggcagcggccggaccgcgtatcacctcaatgcgttccaccatttccgctggtacccagttggtgaccggcacgccatcgatcagcaccaaagtgttttccgggcccatgccgcgaatgtcgatctggcggttgttaccgcggctgccgctggcgccgttaccggtgaggttaacgccgggcattttgcggatgatgtccgcgaggtcgttaacgggcggactttttttgatgtcttcagcggtaatggtggaaactcccggctgctgcttcagctcctgctctgccgtcacaatcatcgactcatcgtcggccagcttctccgtgggttcagcggcaaacaccgagggcaacatagatgcttagacgggaacgttatggctaacaagcaaatcattcagcatggcagcataagcaggatgacaatcctttgcgccgcgcggctttacgcgacatgggcaaagggaaaaatacatcgctacctcgacgccttttccctgccgggaaacattttaaatatcaggagaaaggttccagtgaaattcgcaaaaggtatcacccttttcgcactcgctctcagtgcgcacaccgcgtttgccgccgaacaatccgtcccaaccgacagctcactgcatgtacaggctgatgccgcgctgaaaagcctggtgcccgccgacgtggcgaagcgtggctatattgtggcaggaaccaaccccaacacgccgcccactaccttctataaagaagacaacaaaacgctggccggtcgtgaaattgacatcatgaacgcggtcggtgagcgtctcggcattcaggtgcagtggcgtgataccggcggcttcgacaacatcattccgggactgaaaaccggtcgctacgatgtggccttgtccaacatcaacgccacgccggcgcgcgccaaaattatcgacttcgtgagttactacgacgccagccgtctcggcattatttcgcggaaagacgccaacgtcgcgccgttcaaaaccctcgacgaggtgtgcggtaaagaagtcggcgccggttccggcaccacccaggtgacccgtctggaagaggccagcaaagcctgtgaagcggccggaaaaaaaccgattaaagtgtcagtgttcccggatcgcccggcgggtgttcaggccgtggtcagcgggcgtgtgccgatgttcctcggtccgtacgaaggcctgctgtggcaggtgaaagtgatcaaaccgctgaccatgagcggcgaaatcaccgtacatgatgcgccggtatcggtcgccttcccgaaagattccgcgcttgaacctgccgtacaggcagcgctgaactcgctgattaaagatggcagctaccagaagatcctggataactggggcatcggctttggcgcgtgcgctggtggtgctgttgtgcgtggtggcgatggcgcattcgatgatcaacaatccgcgcttcgaatggggcgtgattgcggaaaacttcaccggcgagtcgatcctgcagggcgtgctgatgacgctgcagctgaccgcgatttcggtggtgctgggcttcgcctttggcacggtgctggcgctgatgcgcctgtcatccaacccggtgctggtcggcgtcagctggttctatacctggtttttccgcggcgtgccgatgctggtacagctgttcctgtggtacaacatcgcggcgctgtacccgaccatttcgctgtcgctgccggcgcggcggtaatcgcgctggtaatgcatcagtctgcctatgcggctgagatcgtgcgcgccgggattcagagcgttggcaacggccagctggaagccgcccgtgcgctgggttaccgtccggcgcagattttccgtcataccgtactgccgcaggcgatgcgcgccatcatgccgccagccggtaacgaaatcatcggccagctgaaaaccacggcggtggtatcggtgatctccctgcaggatgtgctgttttcggcgcagatcatctatcagcgcacctatgaagtgatcccgctgctgctggtggcgacgctgtgttctacgtcgagcgctactttggccgtggcgtcacgcgccgtgaaaagcgcagtttacttaagtcgctgcccggtttctctgcgcctaaagccgaaaggagcgtaa

SEQ ID NO: 59112 - DNA, 1398 bp, Glycine max
  Peptide Sequence Number=SeqID_175890
atggccgagcgcgtaataccgagcaggctttcggcggcggaaaagctgccgcactcgctgacggttttgaaaacgcgcagcagtctgaggtcgaagtcggtcacctgggccagcgttttctttttcattcaggcgcactggatgccgttcactgctaaccgctattttcagcaggatccccgttttattgtcgccgcgcacggccactggctgaccgatggcgacggccgccagattttcgatagtctgtccggtttatggacctgcggcgcgggccacacgcgccgtgaaatccagcaggcggtcgcgcagcaactcggtacgctggattactcgccgggctttcagtatggccatccgctgtcgtttcagctggccgagcgcatcgccagcctgatgcccggccatctcaaccacgtgttctttaccggttcggggtcggagtcggcggatactgcggtgaaaatggcgcgcgcctggtggcgggccaaaggccagcccaataaaacccggctgattggtcgcgcgcgcggctatcacggcgtgaacattggcggcaccagccttggaggaatcggcggcaaccgtaaggcctttggtcagctgctggaggttgatcacctgccgcatacgctgcagccagagctggcgttcacccccggccagcctgccacggggggcgaggcgctggcggatgagatgctgaagctgattgaactgcatgatgcttcgactattgccgcgctgattgttgaaccgctgtccggttccgccggcgcgattattccgccgcacggctacctgcagcgcctgcgtgagatctgtacgcagcacgatattttgctgatttttgacgaggtgatcaccggctttggccgcatgggacgctggagcggcgcggagtattttggcgtcacaccggatctgctcaacttcgccaaacagattaccaacggtgccattccgctgggcggtgtggtggccagcagcgaaatctatcacacctttatgtctcagccgctgccgcagcacgcggttgagtttgcgcacggctacacctattcggcgcatccggtggcctgcgcggccgcgctggcgacgctggacgtgctggaaaacgaggcgctgattagccagtcggccgaactggcaccgcattttgaacgtgcgctgcacgggctgcgcgattgtccgcaggtggtggatatccgcaactgcgggctggtcggtgccattcagctggcatcccgtgaaggtgacgcgaccgtgcggccgttgaagcgggcatggcgctgtggaaagccggcttttacgtccgctttggcggcgatacgctgcagttcggcccgatgtttgatacccagccggccgaactggaccggctgtttgatgcggtag

SEQ ID NO: 59113 - DNA, 837 bp, Glycine max
  Peptide Sequence Number=SeqID_175891
atggaattcttttctgctgaaagttttgattgcattcaagcatttcagaacttaggtctcatacctttcatgtcattacaattgcctgtttatcctgaattggttaaagctttttattgtaaccttgaaattcaggaaagaactttgatttctgaggtttttgggataaaaatggtcattgaccaatcccttttccataacttaacccaattgtccagtgatggtgtaccatttgaaggtacaatgaatgacgattggaaatttgatttctctgcacatgatgcccgccagttggtttgcaccaaccatgcggatatgactggacgtcttcttgccggttcattggcttttgaaagccgcatccttcattatctcattgtgcgtattttgcttccaagatcttccaaccttgcccaggtttctgaggaagatcttgttatcatgtgggcctttcatactgggcgtcaacttgactgggcacacttagtcagatatcgcatgcataaggcattgcgattaaatgctccatttccatatccacaccttgtcactctctttctttgccattttcaaattcctcttgattttgaaccttatgttccaatcaagagatcctttttaattggtgctgctgtgattgcctctttggttaccgcaaagagcatgatggctcttgggtcaaaaaggacttttgttggtgacaagtttgatgccatggaattgcaagttgacatgcggtttgatgccatggaatcaagaatcaccaaggttgaagaagatgtctccttcatccgtacttgctttgatccaccaccaccacctccatcatcctcttag

SEQ ID NO: 59114 - DNA, 1065 bp, Glycine max
  Peptide Sequence Number=SeqID_175892
atgctgactcaacctgctgataaatatcgcccgtggcctgtcatcaatctggcggatcgccagtggccgtcacgccatatcacccgcacgccacgctggctctcaaccgatttgcgcgatggcaatcaggcgctggctacgccgatggacagcgcgcgcaaattagcattctggcaactgctgctgcgctgcggctttaaagagattgaagtggcgtttcccgccgcctcgcaaaccgattttgactttgtgcgcctgctgattgaacagcagcacatccctcacgacgtcactattcaggtattaactcaggcgcgcggcgatttaatcgatcgcacctttgcagcgctgcgtgatgcgccgcaggcgattatccatctgtataacgccaccgcaccgctgttccgtgaacgcgtatttcgtcagagcaaagctgagatcgtcgagctggcctgcgccgccgcgcggcaaatccgcgcacgctgtgcggcgcagcccgccacgcgctggacctttcagtactcgccggaaactttctgctttaccgagccggaattcgcgctggaaatctgtgaagcggtcgccgccatctggcagccgggaccgcagcggccgatgatcatcaacctgcccgccacggtggaagtcaatacgcctaacgtgtatgccgaccagatcgagtatttctgtcgccacttcagccagcgctcgcaggtggccatcagcgtccatccgcataacgatcgcggcaccggcatcgcctgcgccgagctggcgctgctggccggcgccgatcgcgttgaaggctgtctgtttggtaacggcgagcgcaccggcaacgtcgatctggtgacgctggcgctgaatctctatacccagggcgtgacgcctgagctggactttagcgatatgcgcgaggtgctggaagtggtgacgcgctgtaaccagctgccggtccatccgcgccatccttacgccggcgaactggtgtttaccgccttctccggctcgcatcaggatgccattcgcaaaggctttgccgaacgcagcgcgcgtaatgaagtg

SEQ ID NO: 59115 - DNA, 669 bp, Glycine max
  Peptide Sequence Number=SeqID_175893
atggtgcttgttgaatttggagggaccaaggcacaacttgaggtagcaaaagccagatatacaggagttgtttcagatttaatagctgtgaaagaggagctagaaacattgcacaaagaatacgcttccttagtgactgatagagatgtagctattaagaaagctgaagaggttgttactacatcaaaggaagtagagaaattcattggagactacacatgctgcacatttggaagcagaggaaaaaagaataggaacattcatggcaagagatcaagattctctgaattgggagaaataaagacacacactgacatacaagaagcagtggcatcagctggaaaggaacttgaggaagtaaatcttaacatagagaaagcaactgttgagattaatatcttgaaggtagctgctacatcattaaaattggaacttgaacaacaaaaagcaactcttgcctccattaggcaaagagaaggaatggcctccgttgtagtggcatctttggaagctgaattggaaaataccagatcagaaataggtttagttcagatgaaggagaaagatgctaaagagaaaatgatcgagcttcccaagaaactacaactaacaactgaagagactaatcaagccaacctgcttgctcaagcagctcgggaagagctatag

SEQ ID NO: 59116 - DNA, 330 bp, Glycine max
  Peptide Sequence Number=SeqID_175894
atggataaatttgacatctttgtcaatcatcctcttgtaattacatctttgcttccactggaatctgagtgcaagccattggtttgtttgcgcaagcgacctgcgctcctgagtttggacttccaagaccgttcaatcagaaattactcgtgctacatatttggtgagggtgccgtaaaacgacgatttcttccttgctacaaggtcataacaaaagacaaggttgatacctcaaagccctacactggggcaatgaggggcactgtgcataagcctcgagcgaacctaggggaagatcaaaagttctcacccgtcgatgtttttaaatga

SEQ ID NO: 59117 - DNA, 213 bp, Glycine max
  Peptide Sequence Number=SeqID_175895
atgagtaagataagaaggtttgaaggtttgggaattgaggaacgtcacaagggggaagaggttgcgcaggggtttctgaaaatgtgggggaggcagcctactggtaatcaattacatgaagattgtaatcgattacaggccatccgttctagtgtaatcgattacagtattcatgtaatcgattaccagaacaaaacaatagccttttcctaa

SEQ ID NO: 59118 - DNA, 177 bp, Glycine max
  Peptide Sequence Number=SeqID_175896
atggctattttaagttttgctaaaaacaagttcccaaaatttttgtctctctcaaatactgccacaccaagtgctcctgtcgctaattcccagacgctaatcactgttcacagcaaaacaccaactgaatcagtcgctaaacagtcgctaaaaatagtcgctaaacaggggacgtga

SEQ ID NO: 59119 - DNA, 405 bp, Glycine max
  Peptide Sequence Number=SeqID_175897
atggaggtagtgaagggagtggtaatcaagttattggatgcaagtattatctatcctatttctaataacccttgggccttggtaagtcatgttcaacttgtccttaaaaagggggacactattgttatggagaatgagaaacaagaattgattgctattaggaaaaccatcaggaatgctgaacacaagggaagggttgtccctgtgtggttcagactttgtaaagggtttttacaaagggagtggaaaatctcaagtgggttgcttgagtactggacgtccaacaagggatacaaggttggttttgaattgggaaatgtgaaagtttatggtaagggaatgcatttttttgggcacaaggtgttagagataggggggcaacatggtgaacaacctaaaggctaa

SEQ ID NO: 59120 - DNA, 699 bp, Glycine max
  Peptide Sequence Number=SeqID_175898
atgcccatcgtgtttatcacctacagcctggcctatctcgatcgcgccaacttcagcttcgcctctgccgccggcatcaatgaagatctcggcatcaccaaaggcatgtcctcgctgctgggcgcgctgtttttcctcggttatttcttcttccaaattcccggcgccatctacgccgaacgccgcagcgtcaaaaaattgatcttctggtgcctgatcctgtggggcggctgcgcctcgctgaccggcgtggtgagcaatattccgatgctggccgccatccgctttatcctcggcgtggtggaagcggcggtgatgccggcgatgctgatctacatcagcaactggttcaccaaatcggagcggtcacgcgccaataccttcctgatcctcggcaacccggtgacggtgctgtggatgtcggtggtgtccggctacctgatccacgccttcggctggcgcgaaatgttcatcatcgaaggcattccggcggttatctgggcgttctgctggtgggtgctggcgaaagacaaaccggcgcaggccggctggttgagtgccgatgagaaacaggcgctgcagcagcagctggacgaagagcagaaaggcatcaaggccgtgcgcaactacggcgaagccttccgttcgcgcaacgtgatcctgctgtgcgtgcagtacttcgcctggaagcatcggcgt

SEQ ID NO: 59121 - DNA, 114 bp, Glycine max
  Peptide Sequence Number=SeqID_175899
atgaagcctttacaaggaaccactcagacgttggcacgtggcagtcaacgtctgaggggggccaaatccgaaattggagataaactgggagaccaaaagtgcaattttgcctaa

SEQ ID NO: 59122 - DNA, 3084 bp, Glycine max
  Peptide Sequence Number=SeqID_175900
atgtctaaaaaggttttgacatcaatgaaggatgaaaatccagatttgcagaagcaaattgggtgcatcagtgggttttttcagctgtttgaccgccacagtttcctcacgggccaaagcaatagcagccacaatcagaacataccaactaataaaggtggaatcagcaaccgtatcaaagaggtgaataatacaactcataaggcaacggcaaaaaatgtgaagctcacaagagagaatcaacaattctccacagaatcatcaggaacttcagtgacttcatcatctcgttcatctagcatgtcgtccctcgagtttaatagaacaattcagatagagccaccatcaatcagtcaaatgaaaattccagaaaacactaattcagaagcagcaatgaagcaaggcaaccaaggccaccaaccccttgatttctatgatattgtcaaagactcaatgcatagagatgttcatggattgtcagtaaaaactgtagctaaagaggaaaggaagggtcgtatcttgaaatacatggactctcccaggcctttggagccctcaaaatctgtcaatacaggagttacggttgcttgggattcaccaagactctcctacgatgggagggacacacaagatacattcaaatctgctacaaagcccaaggaactcccaaggctttccttggacagcagacaaggatctatcaaaagtttcaatgaaggaacaaaatctcgcatccttttgaagggttcacagaaagggtatggtagttccagaacaatgcagctgcaggaaccagaaacttctagaagaccgtccggcgttgtagcaaagttaatgggactagaagccttcccagactgcacagaaactagtgatactccatcacagatgtctagctgcaccaccaacaaaaatgagacaattgcaggacctagcacaaatgatgagtacaagcaacaccaaagtgcagcatcatcccagggaacaatcaaggggtctagcttgcttcagtttaggagggatgcttcaatcctgaatgtgacaccgtattcacggttttctctagaaccaattccatggaggcaacctgaagcaagccaaggttctcaattacaggattccaaaagaagtgaatcttcagcaaaagcatcaaacctgaccatctctgtatatggggaaattgaaaagaggatagcagatctagagttcaaaaattctggaaaagatctcagggcccttaaacagattcttgatgcaatgcagagatataaagaatcattggatattccaagagatcaggtgtctaattctctatctgacaataggagtagcagcagtctcagtgaaagctcaatagttaaaagcccaagaatacggcagaaggacccaacattcaccgtggttgagatgtcaaattcaacccagggtagtaagtcaccaattttcatcatgaaaccagcaaaagctgcaagaaaaaccaatagtcctgcttccacagaaatgtcatttcagggtaaatcaagcctgggcaagtttagctctgcaaactgcgcaaatggaataatgggtggcaagcttgacgggcaaacagcaaagggtattggcccagcaatcagacatgccaaggattccatcagccaacccttgcactcagtggataagagtaataagatgagaacttctaaattgatgcaatcctcaaaagttcgtcaagtaatcaatggagaaaatgccaccaactccagcaatacagcagaggccaagagcccaagactacaaaagaagtttggtttggagaggcgttcccgaccaactagcccatcatcagatttgagcagtaacagaagacaacacaataggcaatcaggggaattgtcttcctcaagtacaacacccagacaaaaattcagtgagatcagcaatcaaaggagggattttaggcatgaagttgtcgtagaagtcattcacactgttcattctgataggatcaatggtaactccactcagctaaagggcatgaaccaaaataatgcagcagaagagttgagcaaggaaagctttatggctgagaaaacaattacagcagaacaaccaagtcctgtgtctgttcttgatgcttctttctacagagaagaaccaccttctccagttaaaaagaaatcagacatgtcaaaagatttagatgatgctctgaacacttatgatagtagtgaggagaactcagaaaatcttcagctttcatcaagcactgcaaaagccaagttcggcagtgaaatcagtgatactgacttgagaactcaaaagttggtcagaattctccaacaaattgactacaatgatgagagattcaccaatttcagagatgataaagatcctaaccataaatatatatcagaaatactgttagcatcggggctgctcagcagtcaaagctctagccaggtttttcattcatcaagttacccgataaacccaaatttgttccttgcactggagcaaatcaagacaaacatgacgtgtttcaatattgaatgcaacgccaagaagattgctgcactgaatagtcctgagcaaatacaaagaaagctaatatttgatgttgttaatgacattctagctcagaaaataatactggaaagttttactctgtggtgccaaccaaatcagccagcaggtagaaaactaagaggacagctgcttttggatgagctttgcacagaaattgataagttacaacataaaaatacaaatgccaacctgaatgatgaggatgagaatttgacaagtctcctgtgggaagagttgatgcactgtcccacaatttacacaaacagttacagtgaaataccaaatgtcgtgttggatattgaacggttgatcttcaaagatttgataactgaagttgtgagaagtggactagctaaccattctgtgtatgctgaagaaatacatgcagaaatgcagataaatgtatatatcaatgacatgatctctttaagttcaactacaggctcagctcctccagaggtgcttaatgcctcaattcttgatttattccttccttctattgaatacttctggtaa

SEQ ID NO: 59123 - DNA, 416 bp, Glycine max
  Peptide Sequence Number=SeqID_175901
gcgaagcgcatgcgcagttacgctatctctttgtaaagaggcacgttttgcatttcatcatccataatttcgcgcgccacgcgaatacacttgccgcactgcttgccgataggcaccagctggcgcagttgctgaatcgatttgggttgataacggcggacaacttcacgcagggttcggtcgcttacggcattacacagacagacgcgtgccggtcaatgcaaagcaaaaaaaaagagcaccgaagtgctctttttcatgctgcggtggcaaccgaagttaccaccgttattaacgcaattaagcgagaacttcagcaacaacgcccgcgccaacggtacggccgccttcgcggattgcgaaacgcagaccctggtccatcgcgattgggtggatcagctcaacggtcattttga

SEQ ID NO: 59124 - DNA, 276 bp, Glycine max
  Peptide Sequence Number=SeqID_175902
atgggagaaagaaaaaggaaaagaaaagaaggaaagaaagctcctgatcaaggatcgaaagaaaacagaagaaatgtgcagagaggtctttggaccggacaatatctgaacaatacagaattgtcaccaaatgaaacaaaaaagaaaggaaaccacgacctaaaatggtcttctccctttaattaccaaccaaaatcccgaaataatttgcaaagtcaagtcatgacatatctatggttcggaattaggatgaaacacttacctgtgcaagattga

SEQ ID NO: 59125 - DNA, 221 bp, Glycine max
  Peptide Sequence Number=SeqID_175903
gacaggaccttggccttcttgcatagacttgggcttgctttgatgatgggtaggcttgtcgtgcttttgcccccctatctaatcaaggggctttcatcgaggctggaagaccaagatgcgaattacatgcttatcaaatcaaaaatggaatcattttcaggtcatccacatttgaattccttggaaaagaaggctaactgcttgttggctgggagcgagcg

SEQ ID NO: 59126 - DNA, 737 bp, Glycine max
  misc_feature (711)..(711): n is a, c, g, or t
  Peptide Sequence Number=SeqID_175904
atgaagcttatgctgggcagtattcccgatgaaaacaataccattgaaatttttagtcagaaattacctgaactttatcctgatgggtttcaaaggatcggaagccttatagacagccctgccttttatgatcatttgtccggctgggataatcttactattctttccaaattaagaaacctccctgattctgagtgtgaaagagttttgaatctggtagatctctgggacagcaggaaaatgaaaatgaagaaatattcattagggatgaagcaaaggcttgcaatcgctatgacacttcttggtaatcccgaacttctgatcctcgacgagccggtgaatggtcttgatcctaacgggatgttagagatcagagaactattgcttaaactcaacaaagaacagggtattacgatattcatttcaagtcatttgttgcaggaagtggaaaaaatggtcacccaccttgctattatatcgcatggagccatcaaattttccggaagtgttgaagagcttaacacgcattaccgccataaccatatgaggataggacttaataatgcacctcaatttttacaacatattcctgaatattatgcccctcagataattgatgatcatactttagaaattaccgtgcaatccagggaagacatcatcagacttaccaagaaactggttgtaaatgaagcagagatttttgaaatncaaaatagtgcgggattggaagattg

SEQ ID NO: 59127 - DNA, 501 bp, Glycine max
  Peptide Sequence Number=SeqID_175905
atgccacctaccaagcactatttagacctagataagtctaacagggccctgggatttccagcattgatcacaggtctctaccagtcattcgaggttcccgtcacacctagtaaggtgattcgaccgccgatcacccgggccttcattgagaagtattgcacacctagacaggctcagggtgacgcaccgcaggccctagatgcactgccaccacctcatcaggctgatccagctgggtcatttggcatggagcagtatctacaacacttggttcgccagcaggcggctaaccacaaggggcaggtgcagagccagggtttcattccttttgcgtgccctactccagatcagttcagggcagaggtcgcatggcccggagattggcctgaggcccaggcaggggaggcgcccgcagaggatcccaacgatgcagaggaggccggcatggatgaggagatgtcggatttactcggtttcttgggagggagtggagccacatga

SEQ ID NO: 59128 - DNA, 165 bp, Glycine max
  Peptide Sequence Number=SeqID_175906
atggatttcgaaatctgccaaattgtgcagcaaaaagctgtcaaatttgtgcaacagaatttttcaacatgtgcggaaaatgcttgtgcattgttggttatgggaaagcttggaggggttgatagggacccggtgatgagaggaacgaggatacgggttacgtag

SEQ ID NO: 59129 - DNA, 447 bp, Glycine max
  Peptide Sequence Number=SeqID_175907
atgaactctcttgaaattcttcacctctccagtaacaaactgcaaggcgagattccatctttctttggtaacatgtgcgcattgcagaggttagacctctcaaataacaagttgaacggggaattttctagcttcttccgaaattcttcatggtgcaacagacacatatttaagagcttggatttatcttataaccggttgactggcatgttacctaaaagcattggattgctatcagaattggaggatcttaacttggctgggaattctttggagggtgacgtcactgaatcccatctttctaatttttccaaattagaatacttggacctatcagggaactcgttgtctctgaaatttgtcccgagttgggttcctccattccaattagaatatttgagaatcaggggtattaaactccgaatgttgtcattaccttgtttctaa

SEQ ID NO: 59130 - DNA, 642 bp, Glycine max
  Peptide Sequence Number=SeqID_175908
atgggatcgagtcaagcgccttcgcttaaaaagaggttgtatcaagtcaaggtcaagagcctaggaatcaccagtctaaaagagttagggcagttgatgggtcagctccagcgacaagcctttcgcaaagcttatagtaaaatctgggacctagccatggcagagatctccacagaggccattgcctccctcgcccaatattatgatcggccgttgaggtgcttcacctttggggacttccagttatcacccatggtggaagagtttgaagagatcctgggatgccctctagggggaaggaaaccatacctcttctcaggattctatccctctttagctagaatttctaagatagcaaaagcaagaatcttggcaggtagaggcgaatgggccccattcatagacatcctcacgcttttgatcttcagaggagtcctctttccaaatgtggatgggttggtggacctagcggtaatcgacacttttcttgcctttcatgaccgcaaggaaagcccggttgtcgctatcctagccgatctatatgacaccttcgaccgaagatgtgaaaagagtagtacaaggattgtttgctgtactccggccctctacgtatggttggtttcacaccttttccgccaagag

SEQ ID NO: 59131 - DNA, 843 bp, Glycine max
  Peptide Sequence Number=SeqID_175909
atggatacaaagtttgcacgaaggactgagcgcattggtagaacaacatgctcttattggagagctggaaaatgtaacagaaatccatgcagatttgtgcacatagagacaccatctccacctgctgcttgtggttatggcaatactgcatatagctacggaaaaatcccccattcctcctctgagaataccccgaaatatggttcaaagaaagtattgcttagagataatggagatagaggagatgcaataagggttgctaaggctttcaagaaatcatcaccaaggatatgtaaatactggatcaacaacaattgtgtacatggtgaacaatgcatgtatctgtattcatggtttcgtggtgatgggttttccacagtaacgaaacttcaagaacataagaaggttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagaatttactcttgatggacccaaaggccgagtccgtgccatgactgttggcaacaatacactctttgctggtgcagaggatggtgtcatttttgcttggagaggaagctctaaagccgattctccttttgaactggttgcgtctctcactggccacactaaagcagtggtttgtctggcggttggatgcaagatgctgtactccgggtccatggaccaaagcataaag

SEQ ID NO: 59132 - DNA, 363 bp, Glycine max
  Peptide Sequence Number=SeqID_175910
atgacattcttgggagagacaagcagtcagacagttgtgaactccacattaggttttatttttccaaatggatccattgttcacaacgacaatggtgtttccttccaagcttccactccagttcccattcgagtacctaacgggtgtgattttcaaacgttaaaaaccagaatacacaatacctttaagctaatcgacaagcaatttttggatgaaatttactaccggcagcctttcacgtatgcaggaaaaaatcccaaaaacattgacattcccaccggatgtaccatggatgaactgaaggatttgatcaaacaagttgtgcctcgtgggattcccccttatggtgttgatgaaacataa

SEQ ID NO: 59133 - DNA, 231 bp, Glycine max
  Peptide Sequence Number=SeqID_175911
atgaaaaagaaggaggaactggtgtgggtgggtttccagaggttccttggcggcggtagccagcagtggtggtggtggaggaagacccttttcgcttcttcgatgactatgccatttgaagatgttgtagctgattttgatcgattggggaaggttttgtgccgtcacacgaaacgggagaataagggttctatgaaaatgcagatatttatagacagggaagccttgtaa

SEQ ID NO: 59134 - DNA, 792 bp, Glycine max
  Peptide Sequence Number=SeqID_175912
acatcagcgctggcaagtgtagcggtcacgctgcgcgtaaccaccacacccgccgcgcttaatgcgccgctacagggcgcgtcccattcgccattcaggctgagcaactgttgggaagggcgatcggtgcgcgcctcttcgatattacgccagcaggcgaaagagggatgtgctgcatggcgattaagtcggggcgaattggagctccaccgcggtggcggccgctctagaactagtggatcccccgggctgcaggaattcgatccgctattaagccgtggcgcgaatttatcgggcggtcaaattcaacgcttatccttagcgcgtgctttactacacaatgccgagctttatatttttgatgaagcgaccagtaatattgatgtagaaagcgaagaaattattttgcagttcattcagcaatttaaacaacaaaaaaccattgtgatgatttctcaccgcttggccaatgccgtgaatgcagactgcattaacgtgcttgaacaaggcaaattgattgagcaaggcacacataaagacctcatggcaaaacaaggtgcgtatgctgaaatgttccaacaacaaaaagatttagaacaaattagagaggtggcaaatgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 59135 - DNA, 1228 bp, Glycine max
  Peptide Sequence Number=SeqID_175913
atgtccctccgtctcccgaccccggcctggcgcctggccaccctgccgctgttgctggcgctgggcgcctgcgccttcgcccccgatagcaagccgccggcgatggcgcagccggcgcaatacggcgtcgaagcgctgcccgccgccggcgcgccggcacagggcgtggcgcagcgctatgcgcgcgaaggccgtccggtgcctgaatggtggaaacgctttggttcggacgcgctcaacgccatggtggaggaaggcctggccaacagccccgacctggccgcggccgagcgcaatctggccggcgcgcgcgagcagttgcgcggacaggtcaattcgtcgctgctgccctcggtggatgccggcgccgacgtttcgcgcaagcgcgcgctgaccatgccgaacctgccgcaacccacggcgctctacaacgtcttcaccggccaggtccaggccaagtacgacctcgacctgttcggcgcggcgcgcttcgagaacgtgtcgcgcgcggcccaggtggaacagcaggcctatcagctcgaatcggcgcgccgttccctggccggcaacatcgtcaccggcgccatcacctcggcgtcgctggccgagcgggtggcgttgaccgaaaagcaggtggtgctggcgcgccaggtggcgcgcgacacccagcgccggtacgaactgggctcggcctcgcagaacgacgcgctgcaggccgaccaggacgccgccacgctggaagcctcgctgccgggcctgcgcgcgcaatggcaggccacgcgccacgcgctggcggtgctgatgggccgcagccccgaccaggcgccgcccgacctggccttcgccatgatcgccgtgcccgaggaggtgccggtgctggtgccgtccgaactgctggcggcgcggcccgacatccacgtcgccgaggccgtgctgcgcgcggcggcagccgacgtcggcgtggccacggcgcagttgttccccagcctgtcgctgtcggcatcgatgggcaagggcggcttcagctggcccacggcgctgtcgggcgcggggtcgatctgggcaatcggcgcgtcgctgacgcagccgatcttccacggcggcgcgctgctggccgaacgcagcgccgccaaggagcgctatgaggcggcggtgctgcaatacaagcagaccgtgctgaccgccttccgcgacgtggccgacaccctggcgcaactggaggcggacg

SEQ ID NO: 59136 - DNA, 426 bp, Glycine max
  Peptide Sequence Number=SeqID_175914
atggtagtgcttgacatgacatggaacatggcattcatagtggtctgggcggtgatgctcgcctacactgtcaaggacaaccctaacatgccgatccactggtggatctacaactaccacaagaggaacgacgctcacagggacaaggaatttgctaccaacctccaatatgacgatgtcaacgatagcgacaaggacgatgttggaacctctgagagttcctcttcctctagaaaaacaagaaggttattgtcacccagcagtatgtccacctcatgcagccatacaagaattgcgtgtaactgtccgtgtgctacctcctcaagattgtatgttgatgtgatccttactatgagtggatttcttgatacaggtcatagagtttggatgacgctacttccagggagggaagataagtcagggtag

SEQ ID NO: 59137 - DNA, 444 bp, Glycine max
  Peptide Sequence Number=SeqID_175915
atggctcaattgatttctgatgtcatctattgtttgcggggatcgcgcccacaagacacccagtggacccgaagaagtccaacagggccctggggtttccagctctggttacgggcctctgaattgcacccacaaagacacccagtggacccggagaagtccaacagggcccaggggtttccagctctggttacgggcctctgtagtcctacagggtgcctgttccccccggcaaggtcacgtcatcatgacatagggatcgcgcctgcaagacacctagtggacccgaagaaagtgcctgtcacctccaacaagggcattaggccccctactaatcgagctttcatcaagaagtactgcgtccccaggcagacgcagggcgaaacaccacagcagcctgggatggccggcagcaggcaacagacgcaccgccatcacctctag

SEQ ID NO: 59138 - DNA, 155 bp, Glycine max
  Peptide Sequence Number=SeqID_175916
tctctaccgaaagatgttgacatctccggaaaaggtgtagatgaccacattggtctctgcttgtcaattggacttggggtcttcgaatggcgaggtacagataatagtaaggtgtctccgcatgctactggactcttgggtcatgatagcaaaag

SEQ ID NO: 59139 - DNA, 825 bp, Glycine max
  Peptide Sequence Number=SeqID_175917
atgcggggcctcacgctttcctccgcattgatcttccttctgatgacgggaagcgcgctggcgcaggtcgattccagcggcaatggcaacacggttccgcaattgcagaaccccgccgatgagaccatcgaaatcggcctttcgaccgaaaccatcgccatcacatcgaatttcggcggcaccgatctcacaatattcggcgccctcgacaatgccgatcccacgatccagcgacagggccgttacgacatcatcgtggtgctgcaaggcccgtcccgcgatctggtcgtgcgcaagaaggaccgttatctcggcgtttgggtgaatgcggtttcagagaccttcatgggggtcccgctctcatactcgctggcatccacccgcaatttgcaggacattaccgacgagaaaacctatcgccagctttccgtgggcgtgcgcaatttctatctcgtgccggaagaccctgccagtctgtcgggcaatattccgagatttggcaatgaactgcgcgagatgaaaatccgccagggcctctatacgcagcgcatcggtggcgtggagttcatttcgcgcacgctgttccgcgccacgctgaacctccccgccaacgtgccggtgggtcgccacaaggcccgggcgcttctgtttcgcaacggcgttttcctgcgggaagccaatgccagcctcgaaatcgtcaaggcgggtttcgagcagagcatctacaacgcggcccatcagaacagctttctctacggcctgtttgccgttttccttgccgtcttcaccggatggttcgggcgcattctgttccgtcgggattaa

SEQ ID NO: 59140 - DNA, 255 bp, Glycine max
  Peptide Sequence Number=SeqID_175918
atgcgctggggcatggggcatggcggcataataagcagtcgccgccgcattggtcgcgccaaattgggtaaatgccgtctgccagtctcagtcgctatgttttgggcagcaccaaataaaattccaatattttgccaaaaatttattcgcgtctttcatccttcttgttcgccgcaaacaggccaaatggcgagcgctttcagctgccacataaatcgcgatgctacgcttcgtgcccaggcgcaagtcaactag

SEQ ID NO: 59141 - DNA, 891 bp, Glycine max
  Peptide Sequence Number=SeqID_175919
gctggccaacaaagtaaagttgttgctgttgctgctgctgctgctgctgcggctgaggctgctctgcaagagcaaagtggagcaaggacaactattgctgcagcaacaacaaaaacttcgaaaaaaacatgcaaaaaagagcgagaggaaaacggttacatgcctgtccactgcacaagcacgcacatacaccaacagcaacaacagcagaagaacaacaatgctaccttcatttgtgtcctgattatgacaactcaaggaaaatgttgtggcaggctttggggcgaatggcaggcaccgaaatctcagtggagtcgctttcatgtagccatcagtaaaagctctctcatacacacatgcacacatgctcacacagcggaggcgcaactgcaggacatgtacgtgtacgtgcatagcaagaaaagttccgtggctgtggttgtggctgcacattccccgcacatttcaaacgcgacgccacgcaacggtgatgtgggacacatcccgtaccgggcaatgcaacaaccccaacgttatataccgtctgtatctgatctatatggcacggacgagatagaactgctgctggacgagatacgtgaactggagctggagccggtctgctgtcagctggacgatgagcaagactttgaaatagctggcagcagggccggtgagctctcgctgtccctagaatcgcccctcggcacgtgcacctcctgggactcgcacgccaactataaacagcgcaacggccatacaccgctgccatggggcgtcgccctacactgtgatccgcaacacttgaaatcgcctacagggattgtgcgcatactactggtgttgaattgcgttcaagaatgtgtcaccttccttccggttatgacatag

SEQ ID NO: 59142 - DNA, 258 bp, Glycine max
  Peptide Sequence Number=SeqID_175920
atggagaaactcaaggatttaatcaaacaagttacacctacaggggttccccctaatggaattcacggatcacaattggttagacgattattctttcgacaaccaggtcattctaagtattccgaaaatttgattgaatatgacataacagaattgaaaaatgatgaagacgtgctaaaagtgttagcacaatccaactattggaaacgattctgcacaatagaaattttggctatttttagcaaaccagtaatctaa

SEQ ID NO: 59143 - DNA, 261 bp, Glycine max
  Peptide Sequence Number=SeqID_175921
atggcctcatccaactttccatttccagaggaaattctatcaataggctcttatgttcaatgggcacatgagattcaattgtcctatcttcaaaagaataatgaaaaatctgacaagaggaatttcaaagagaagaaagaaaggaaaggatacatcacttgggaagataatgtcataaatgcttcaagtgattctgagaataaaatcataagtctgggtatcatgatgaaagactatgaaaatggagaagagcaaagttga

SEQ ID NO: 59144 - DNA, 315 bp, Glycine max
  Peptide Sequence Number=SeqID_175922
ggtgatcaaattcatgctatttgtaaatcggaccacctcaagtcttggaaagctgatttgaaagagaattgcacttatgttatgcataatttcaaagttgttaagaatgatggtcaatttagagtgtgcgaacatgagtacaagttattttttattggagtgacggttgttagagaagctaatttgcatgaactgccttttaaggaatttagatttgttgaatttgcaaatgttgttgctggcaattttgtgtctggcctgttggttggtggtctttcggcatgtttcatcgaaaaataccagggttgtttttag

SEQ ID NO: 59145 - DNA, 258 bp, Glycine max
  Peptide Sequence Number=SeqID_175923
atgggggaggaggtgcttgtttataactccctcctcgatctgtttcataggaatctccaatcaagttggggtaatccatttgagttaaacaaggtattcccttatggagaactagagctaaaaaagtcaaatggccacaccttcaaaagaaatgcttacctggtcaaggcatacaaggaaggactgcaacaagcaaaaactcaatgtagtgctggtcacaatcgttatcaacttcaacacaaggcaatgatcagttaa

SEQ ID NO: 59146 - DNA, 246 bp, Glycine max
  Peptide Sequence Number=SeqID_175924
atggttgatccaagccttgatcattttgatctaaggtgtggtcaaatccacctaagtcatgatcaagttcaccatggcttggatgaatttgatcaaagctatggtgattctcatccaagccttggtcattccaccacagcttggatcctccctcatggctggggaaggcacatccaaaggttgtggaaggcgtccaagaacaacatgacccactccagagtgttggatcaagtggcctcagaataa

SEQ ID NO: 59147 - DNA, 523 bp, Glycine max
  Peptide Sequence Number=SeqID_175925
atggagaaagcgataaaaaacaaagttgctaaagcggtggtacctgcaatagatgttatgtttcaagctttaagatctgagcaagataaggaacctgaacaggaagctgtgttagaggttgtgggtcctggcccttctgaagaatctgggaatgatgctaccaaatggtctgaacggaaggaggctgttgttgatctaacaaagcttgcatcaactaaaagaatttctcctggcgatttctctgaagtttgtcggaccttaaaaaaggttgatcagagtttgggtgagaatatgatgaactacaagcatttaccacctgctggtgaaattcttaggcttttgttctatgtcttggcttcgcctattgctgccctgctctattacttcatctttgccctattccaccctcctgacgaagaacttgttgcttactaccttaaaagacagattaatggccgaaagattgagttggagatcatatctgaagttgatctctataagtgtgaaccgtgggacttgccag

SEQ ID NO: 59148 - DNA, 249 bp, Glycine max
  Peptide Sequence Number=SeqID_175926
atgttagtcccacatgatcacaccactgagatttgggagtgtggccacatggatgtgaatatcggcactggcaaagtgaagtggttggcatatgacaaggtcgcgtacaagctcctaggtgtctttgtgcaacttgacttcttggatatggggtgtgccgacgataaaatcttcctcttcgaaataccttgtaggatcgttcgattctacgcaccagggaaccctctctgtgttgaatcggcattgtga

SEQ ID NO: 59149 - DNA, 3222 bp, Glycine max
  Peptide Sequence Number=SeqID_175927
atgaacaaatcaacaccaaatatagagagttacctctatctccatccaagcgagaatccagtagtagctctcgtatcaccagttttagattcaagcaactatcactcatggagcaggtccatggtcacagcactaagcgccaagaacaaagtagagtttataaatgggaacgcaccagaacctctgagaactgatagaacttacagtgcgtggagtcgctgcaataatatggtagtgtcgtggatagtgcattcagtatcggtcgcgatcaggcagagcatcttgtggatgaacagagctgaagaaatatggaatgacctgaagtcacgatatgcgcaaggagacctcttgagaatctctgatcttcaacaagaagcttcttcaatgaaacaaggaaccctttccgtcacggagtacttcactaagcttcgtatcatatgggatgaaattgagaacttcagacctgaccccacttgttcttgcaccatcaagtgtacatgctcagtccttaccatcattgctcaacagaaattagaagaccgagccatgcaattcctacgaagattaaacgagcagtacagcaatgtgagatcccacgtgttgctcatggaacccatgcccaccataccaaagatcttctcctatgtagcccaacaagaacgaaagctatcaggtatcaattccttttcaaatctcagtcttgaatcaaaagaaaatatttccattaatgtcgtgaaggttacctgtgaattctgcggacgaattggtcacaccgaaagtgtttgttacaagaaacatggggtacccacaagctatgaaggaagaagaaaaacctacaatagaaacgggaaaatgtgtacccattgtgggaaaataggacacaccattgatgtgtgttataagaagcacggctaccccccaggatacaagtttggcaacagcaaagtagtaaataacatcatggaaggaaaagctgcgagtgatcaaatgcaacgacaagagtctcatgatttggttcgtttttcacctgagcagtatcaagctttgctcgccttaatacaacagccatcttcaggaagctcaatccctacccaaccccaggttgcatccatatcctcatgctccactaacacctcaccaggtatgattctttctctcaaaaccacagactctacctcttggatattagatttaggagccactgaccacgtctcatcttctttggccaactttcactcatatcatcaagttaatcccattatggttaagttaccaaatggacacgaagttcatgctacccactcaggaacagtacacctcacctcttccattatattgaacgatgttctatacataccttcttttagctttaatctcatatccatatccaaacttatttccacaaacaactatgaattaatcttctcctctaatacttgtgttttgcaggataccaacaccaaagcaaagattggtacaattgaagtgagtcatgggctttaccagttcaccataaaaccatcacactcacgaaccatatgctccaccattatccacccaaaatgtaatgtcatccctatagatttatggcattttcatatgggtcatccctctatagaaagactgcaagtcatgcaaccttattacccttctttgcataataacaataagaattttgtatgtaatacgtgtcactatgcaaagcataaacgatcatctttttcatcaagcacttcacatgcattaagcattttttatctcatacatatagatatatggggaccctgttcaaaagtttctatgcatgggcatcgttattttttaaccattgtggacgatcattctcgctttacatgggtttatctaatgaaaacaaaagctgagactcgagaactcattatcaccttcgttacatatgttcaaacgcaatttaataaaaccattaaaatcatacgtagtgataatggtgctgagtttcttatgaatgatttttatgctcaaaggggaatcatacatcaaactacttgtatagagacccctgagcaaaacggcatcgttgaacgaaagcaccaacacctcttgcatgttactcgatctctattatttcaagcaaatcttcctcttaatttttggtgttttgcattacttcatgcaacatatttgattaactgcatccctactcctttcctccataacaaatccccctatgaacagctatatacacgcccctgtgatatcttgaacctttgggtttttggttgcctatgctacataagcactctcaaatctcacagacaaaagctcgaccatcgtgcccacccatgcatttttataggattcaaaccaaacaccaaagggtacttagtatatgatctccattcccatagcataaccacatcccgtaacgttgtcttctatgaagatcactttcctctcttccctgatactctagaatcatcccccacttctacttctatatcacacctccagttctccaataatcccgacagccttgaacaccccactccacccaatgacaatctctcttccccacatataccttccccttctctacgacattccacgagactaaaaaaggcacccacttatctccaagattatcaccatgcactcacttcacaagctaataccaatatgcatggagttaggtatcctctacactctgttctatcctactccaggctttcaccttcccataaacacttcgtgatgtcaatctcggtacacactgaacccaaatcttataatgaggcttcccaatttggttgttggattaaggctatgcaagcagaaatacaagctctgcaacagaatcaaacatggacccttacaccactaccaccacacaagacaactatcgggtgtcgttgggtttataagatcaaatataaagcagatggtactgttgaacgatacaaggagcatctcgtagccaaaggatacacacaactcgaaggattggattttcttgatacattttctcccgtggctaagctcaccactgtgagaatgcttcttgctcttgctgcccttcacaattggcatctccggcaactcgacgtcaataacgcatttcttcacggcgaccttgacgaagaggtatacatgactcttcccccaggtctccatgtgcatgatcgcaatctagtttgccgccttcaacgttcattatatggtttgaaacaagctagccgtcaatga

SEQ ID NO: 59150 - DNA, 201 bp, Glycine max
  Peptide Sequence Number=SeqID_175928
atgatgacgggtgagatccacgacaacaacgatggaggagatccaatcacgacggtgagatccaatcacgacaatgatagaggagttccaatcacgatgacgatgatggatgagaatcagtcacgaaggagacaagagagatccaatcataatgacgatggaagacatctaatcacaacgacaatgatggaggagatctga

SEQ ID NO: 59151 - DNA, 265 bp, Glycine max
  Peptide Sequence Number=SeqID_175929
tgagatacaagggagatagtgatgataataatgaagttgatcgaattggattagttgtaatcgagattggccaaaagctaaccattaagagtattctgaggtacctcagtggaactatcactcatggtctgctattgcaaccagctcacatggatgctaaaatttctctccaatactcaatgatggggtggtttcttgatcaaggtgctgaggttttggataaagatcatgaaaagcacagggagacagcagtttgggactacac

SEQ ID NO: 59152 - DNA, 306 bp, Glycine max
  Peptide Sequence Number=SeqID_175930
atgaccaagtggttttatgggataatgggagcaacaacatggtgtaaggaagttttttctatgagggttttggctggcagtggcggttatgcagttgatcttttcataaaagttgtcattgctgaatttacttgcattctggcactaggagggtccatagtggggataattgctggagctatcaaaggccataccagaggagctggttttcttgatggagcttgcaaaggagctgtcacaggggccattgcagcactagaattgctaaatattgctgcttatgatgagccactgtctaaggtgtaa

SEQ ID NO: 59153 - DNA, 300 bp, Glycine max
  Peptide Sequence Number=SeqID_175931
atggcttcaagtgcaaccgaggaacaaatttctctgaaagttttggttgacgaaaagaaaaatagagttgtgtatgccgaagcagggaaggactttgtggatattctgctaagcttcttatttcttaaacttgcccttggcacgattgctagggttgtgggtaaggaattaaacatgaacaagagaaaaaagcatttttggacaaacacgtgtaaagaaatgctgcttcagtcaaggaactcaacggaaagctattgccaaaacctaaagctcaacattgatgacacggaaattgtataa

SEQ ID NO: 59154 - DNA, 381 bp, Glycine max
  Peptide Sequence Number=SeqID_175932
gggattgactgtgtgaaaatggatttaagtattaaaattctccctgccaccaatgatgtacatggaggagtcattgtggacttaaaggagcctatggactctaaagattttgctactttgcttagatcttcacttttacattggaagcaacagggaaaagatggtgtttggatcaagctacctattgagcttgttaatcttgctgaaattgcagttaaggaacttaccagcgagaggaagaaaagccatggagagggagtgatagctcgtgacgctgctgagagggaaagagagagagcttgtgatggaattggagaaggttgctgtgttatgctcgaagggagaattatgtatgagatgaaggtggtttatacttgctga

SEQ ID NO: 59155 - DNA, 381 bp, Glycine max
  Peptide Sequence Number=SeqID_175933
atgaatatcaccactactcttagctctctttataagtgtagaaaggccctcagtgcaaataataaaaaggcaaggctaaggccatcaggtccaggggatttatttgagtccatttggaaaaggacaattttaaattcatcaatagcgaaaggtgcaagaagggaaacattatcattagatgagaggttttcctttccttcttatccaggtatacttgtagccttccattggaaaatcatggaggttattgtcagagatggcttcacaaaagcctcagataagccaagtgggatgatcatgaattcccactttttcatcgatggaaatgaggtcactgaagtcatcaaagacacaccaagggagaggggaaagttgagataa

SEQ ID NO: 59156 - DNA, 768 bp, Glycine max
  Peptide Sequence Number=SeqID_175934
atgacaccaaaacaattatctccgaatgcagtagccaataaccacattaagcattcggatgctaagaaagaaatcacaaaattacgaaatcaaaatgcgtcgtccaatctcactggagacaaaggcatcaatagtcgcgtactgaacctgttcatgagtgaggaagcgattgtcccagaggctcgtggtgatgtggtggggcttgttaatgtcgacgcccaggaagaagcggcccaatgcggcgagcccggccgagcccagccaaaacaccttgagcttctgctcggcgagggagcgaaggtcgacggcattggccacgtggagattgtagtctctcagaagcttctgggcgtcgtctcggacgccgaccccaacgaatttgacgtggcggttggcgaggaaggaggtgagggcgcgtgggacaagggtcgcgtggaggatctgaaagatgaggcagttgtggtcgatgcagagctggagggtggcgacggggttgggctgctgactgttggactgggtgttgggccgccactcaacgtccaggcccacgatcttgaggttgtcgtgggtgttgcgggtgttggtggagagccagataccgacttggcagggagaagtggttacgagggtttggatggtgtgggtgcccattttcacttcgtagcttttgtagttgttgttgccgatgccgttttctcttatcagtcatggagaaaccgtatttctactgagcctgtggaatttgggattttgatcgagtgtgggtga

SEQ ID NO: 59157 - DNA, 204 bp, Glycine max
  Peptide Sequence Number=SeqID_175935
atggaggatttggaagacgaggcaatgatggtccacgcagagttggagggtgacgaggaggttgctccatatccaagcctaggcggtgagtctatagtggtaggtgtcgtggaaggggttgcttcgcgcgctaattggcatgccgttttcttctatgggcgttgtcatcgttgtggattggagacgatactaagaaagaaataa

SEQ ID NO: 59158 - DNA, 831 bp, Glycine max
  Peptide Sequence Number=SeqID_175936
atggaacgtattcctgacaagatcaagaccattgatggattaaaagaaactcttaaacttgctatcaggattaaggaagggcaggcacttgataagttgctgggttatttccttgcacttaaagtcaaggttcaaccaaatttcaagaatgttgttgttcttagatgctcaaatgacttacatttgatcagtgttgtgatggacatgttgcctgatgctgaggattatatactaatatcagccttctaccatgaacagtgggcaccagactacccggactttgccttctttagctatgacggagcgatgtacaaaatacaaattagacaacaccaagggaaattcttctttgttgatggcttgaaaaccttcagaaaagacttagggatctacaagtccaccaccatcaatttttgggcttgtgaacaaaaatggatattcaacctccacttcactcctacactggaccagcaatcatgcggcagacccctactaacatccagaatgcatgtctggattgttgaactcacccaaggcctgcttggtgcccctgatcccctgagacttccacctattgcaacaatacatcttccttcctacggtctccatatgatgattttaaggaggttcgaccctccattgcaatggactgtcgtcacgcttgatgttggcattggtgacaagtacgtcgtccaaccatggtaccaatttctcgcagaagttgattttagtcatgaaaacgaactctcattctaccacagtcctcatgacaaaatttgggaaattgttattagaagacaaaaaaattggggcgacaacgatagtgactga

SEQ ID NO: 59159 - DNA, 1548 bp, Glycine max
  Peptide Sequence Number=SeqID_175937
atggttgcaaattcaactccattaggcaaacaagaatacacaattcccctggaggttttggtcgacaaagagaaaaataatgttgtgtttgctgtagcagggaaggattttgtggatgttctattgagtttcttaactttgcctttggggactattgctaaaacagtggctaaggagtccaatgtacaaccagtgaaagttggtagcctgagttcaatgtatgaaagtatgtcacattttgaagaaaaacatttatggacaaagacatgcaaagaaatgctactgcagccaaggaactccatggaagattattgtcaacaactgaagctgaatatcgatgatactgagcccaagaggtactacttttgtgagaactggtccgaatgtattataaagccgccccttgtgactacttttaggaatcaaagatgtcgttgtggaaaactaatgaatagggtgctgggatcctcagatgaactgaatttagaaaatggctttgtaaaggagattgcttcttttatagtttctgatgatctttacataacgcctaatgtttttggagaaagtgtaaacctgtttcagaagcttggaatcgaagacatggaagcggttgaggaacgaattgttgatatcagcaagaaggaggtagtggacttgctcaagttttcattgatctcaaggacccctttgacagacttattcttaagaaaggaacaatatgttgataattttaacccaataaaccaaaaccagtttgagattggaaaaacaccatgtgataagggtaggcaaatggttctgaaaatacaaataagaaaatctaatgggaagattctgtttgctgaagcagaggaagagtttgtagactttctttttagttttctcacttttcccttgggaggagtgcttcatatgcttgaaggattttcttctgtaagctgcatagataaattatataggagcatgaatgagttgagttcagacagatatttaacctcacaaggaatcaaagagaaactagccaatcctccatgtgctccacaatttaatctcaacaaccagatattaccaattggagcagaaagctttccttttacttactcattttatggtagatcatttaatattgttgatcctaagtcctctgctggagaatcatcaagtcttctaggatttgtgaaaggaccagcaatgtacatggtgacagatgacttggttgtgactccaatgtcatccatttctgctgtttcatatctaaaaagacttccggtaccactctctgacatggaggaaagggtcataacaattggtgtgaaggagggtcttggaatattgaaagcttcattgacctcaacatttgctttgacaaacggcctgaaacacttcataaaaaccactgaggagaatggaccaatcacttccgcacggtctaaatttataaataaggcatgtctcagtaacaatggaggcattttcccgctaagtggtgactattttggtcattccataatctgtccagcatttgtattcatcccttccgtcatttag

SEQ ID NO: 59160 - DNA, 1455 bp, Glycine max
  Peptide Sequence Number=SeqID_175938
atggtgaaggggttgcacgggcagaacctccctgccgacgtggcgcaggtggttgatcagctggagcgccactgcttcgctcccgatggatctctcatctccaggcctctcttcaacgatctccagcttgccagagaggaaatgtgcagggaaagactgcgttacctggaagccatggctatatattctgaggctattgcaatggtggaagagtatcagcaagccatttctgtgtccaacctcggtggaatcagagatactggcaatctttatccacagcttgggttgaggacctctcctcaggtttatcagactttagagcatcaaatggttgttgctgaagcagctcaacgattgaggctacctcttatctccaaagacggggaagttcatgatgaagacattgaaaagctaagtgtagtgtctcgaagctcccttgacagtactgttagtggggctaattcttctaactataacactccgaacagctctgttagtggggctaattctgctcttgctgcttcagatccagtggaactcggagttggtggtgttcccaatcgttttttgggaattactccttcttatttgtggcaaactcagcatcaaaaagcaccattatccgtggtagaggctcgcttgaaaatgaaatgtgaaaaattatcagaagcctttgtattggatgacaatgattcttcatcatctggaagtcatagttcaagttctcggtttccagaaagtatgcaacctagacttctacatgagagggtgaaattgctgattgaggagattgaaagggaagaaacagcactgcgggatgacctttattctgcagatagaaagtttgctgaatattacaatgtcttggagcagatacttgcagtgcttattaaacttgtcaaagatttgaagttggagcatcaacataaatatgatgagacgcagaagacttggctctgtaaaaggtgtgagaccatgagtgcgaaattgaggcagccactgttagttagccttgtcagcggaggggagagaccagtttctagaatccctgagagagtgagagacagtctacattctacaatagaatcattgatccaaatggaccttcgttatattttattgaggacaaagggggaagtgccaaaagaattgggtggtgttgagcctaaacagaggggtgttctagaacacgttctcttgctagaaacttacactaaggactctatacctgcccttcataagataaggaaatatcttgttgaggcaacagaagaagcttctattgcatataacaaagcggttacccgcttgcgtgagtaccagggtgttgatcctcactttgacaacattgcaaggcagtaccatgacattgtgcagaaattggagaacatgcagtggacaatccaccaagttgaaatggatttgaaacgtttgccagataaacccaacacatag

SEQ ID NO: 59161 - DNA, 633 bp, Glycine max
  Peptide Sequence Number=SeqID_175939
atgaaactacacctgccaataaagggaattattggggaaaatacaaaaagattaagggtggatgaattggataaggcaattgctatagcatctagagatccttcttggtatgggatagatgaagctgaggtcgaaagccgaaggagatggacaagtaacactcgttctcaggttggcacaatgaagaaagcagtggaatctggcaagggctcaagtaccacaagccatgctagtgttaatgggatgcgccgagaactaatgaggctaccaaattctcatcaaactgatagctctaaccagtatgctgcccgagataatgatgatttcatactatcagaatcagatagacaaacacttcttataaagagacaggatgaggaattggatgagcttagtgaaagtgtacgaagaatcggaggtgttggacttacaatacatgatgaactcactgcacaggaaaagattctagatgaacttggttccgagatggacagtacaacaaatcgtcttgattttgtccaaaaaaaagtggcgatggttatgaaaaaggctagtgcaaagggtcagatcatgatgatattgggtttgttggccctgttcatcttcctctttatcttagtattcttcacctag

SEQ ID NO: 59162 - DNA, 705 bp, Glycine max
  Peptide Sequence Number=SeqID_175940
atggtgtgggttgcggtagttgaagctggtatgacagccatggaaggcaaccatggactctcaacgagagcaccaaatgttagaggtgttgcgtgccaaggatatctagttttcgaggaaccagtgcctccagaggaatgttccctcaacagcaaacaagcgctatccagcatatcccctctgccagctcagcatcttcaacctcaaacaggaactctagatacatttatagaggaaagagaaatcataagagagacagaaccatactttggtggcagtattgacggaaaggataatggacctgaagttgggaaagattccttgtgtgacttatggatctcgtggacaattaagtgggcaacatgtaatgggagtggttctcttctagcacgcaatcttgccattattagatggaagacactttcaactcggaaagtaaatgcaactagtggagcagcatcagtaccagatgaggtttcccatagatccaaaggggttcaattgtgcaacactaaggcataccaatgcactccaaccttctttgcagattcttattttctcaacaaattctcttctgaagtcattgcagaaagggctcaagtacttgccactgcaacagtcatatgtgaaaagcacacaatctcagtattgccagtaactcgtgttaccatgtctcaatgttatgtcctagtattcgagaactag

SEQ ID NO: 59163 - DNA, 324 bp, Glycine max
  Peptide Sequence Number=SeqID_175941
atgcaaccattcactgcacccttgccgactccacgtcccatgcctgttgcctacctccctgatctctgccacacttgtgtcactgtttcatacaacaaactcttcggtacttttgctccgtatagccgtgcaacaactcctaatgtcaaagctctggaaggaagaaacatgacgttgtttaagataggaactgaataccatgagccgtggaatgatagagagatagaggtgcaaggagatgatagcataacagcagtaacgagggttcagatattggtgcagatagcagagaaaggaaccacaacagcagaaatgggggtgtag

SEQ ID NO: 59164 - DNA, 459 bp, Glycine max
  Peptide Sequence Number=SeqID_175942
atgtcatacaaccatgcaccattcaccgcacccttgtcgactccacgtcccatgcctgttgcctaccttcccgatctctgccacactcgtgccactgtttcatgcaacaagctcgtcggtactgttgctctgtatgaccatgtaacaactcctaatggcaaagctctcgaagggagaaacatgacgttgtttaagataggaactaaataccatggacctaccatggttgcatgcaagcaccaactagttgttgacccagaggagtttagaagccattggaatgatacaactgcaccaccaggggggtctgcaagaagcaagggctacaaggcccaaaagggagactgcaccaccagcctacttgaaggattaactgtagcatggcttccacttgatgaatcctccatgtttgagcaggatggaaaccccaacaacaacgatgaccaacatgatcaatga

SEQ ID NO: 59165 - DNA, 100 bp, Glycine max
  Peptide Sequence Number=SeqID_175943
atgggaaagcaagtccggtgctgcggaacaaggacatcttacaaaggaaggttcttgctgggatgcgaaagcataagtggcagtagatctattgctgcat

SEQ ID NO: 59166 - DNA, 310 bp, Glycine max
  Peptide Sequence Number=SeqID_175944
atgagtcaatcagacatccaagtaaaaagttattgtcgtttgaatttgtttggagattccattttcagtttcgagcatctcgatatattaagggactcaatcggacatccgagtaaaaagttattgccatttgaatgtggaagcaatgccttccatggttattttgatgatgccaaagaatcaagagttaagcaaattccaaagattcaagaatctagattcaagattcaagaatcaagtttcaagaatcaagattcaagaataatcaagatcaagattcaagaatcaagagaagactcaatcaagataa

SEQ ID NO: 59167 - DNA, 858 bp, Glycine max
  Peptide Sequence Number=SeqID_175945
gtggtcgcgcgggccgatgccggacagcatcagcagcttcggcgaaccgaccgcgccggcgctgacgatcacctctttggtggcgcgcgcggtcacttccgcgccgccgttctggctgtagaccacgccggtggcgacgttgccctcgaaggtcagccggtgcgccagggcgttcagtttcaccaccagccgccgttcgtcgcgcaccgccttcaggtaggtgcgggcggtgctggcgcgttcgccgttgtgggtggtggtttggtagaaaccgacgccgtgctggctgtcgccgttgaagtcgttgcggtagggcaggttcagctcctggccggcgcggataaacgccatgctgagcgggtggcggtagcggttttcgctgaccggcagcagcccgtcggcgccgtggtagtcgtccgacaggctttcgttggcctctgcgcgtttgaaatagggcagcacctcccggtagctccatccggtgcagccatagcgctcggcccagtcgtcgtagtcctgcggctgaccgcgcaggtagatcatgccgttgaccgaactgctgccgcccagcaccttgccctgcgcgatctgcatgcggcggttgttggcgtgcggttccggctccgtttcgtagggccagctctttttggcgatgatcttggccacgccggccggcatcttgatgaacaggttattgtcgtcgccgccggcttccagcagcagcacccgcgcctgggtgcggcggatcagctgcgccgccagcacgcagccggcggaaccggcgccgacgatgatgtaatcaaaggtattttccgacatgacagctctccgtgcgcgattgggatactggcagagtaa

SEQ ID NO: 59168 - DNA, 172 bp, Glycine max
  Peptide Sequence Number=SeqID_175946
atgacctgtttcaattgtagacaaaaggggcatattcagagagattgttcatatcccaagaaggggcagagtggtggcggcctgaatgaccaaactagacatccgaagaccatggaaagattctttacccttaatggtgtcaaggctttgaaatccaaagatttaatccaag

SEQ ID NO: 59169 - DNA, 204 bp, Glycine max
  Peptide Sequence Number=SeqID_175947
atgttgagagaaaaggatgagaagtttgcaaatcaaaatacaccagaaacaaattatcaaggccttggttacaattggtatggcagattggaacgagaaacagatcccattcaccagaggttgcaccctcatcaagttaccaaaattaggaaagaacctggtcatctggtacgtagcaaaacgattaaattcccaacagtctga

SEQ ID NO: 59170 - DNA, 596 bp, Glycine max
  Peptide Sequence Number=SeqID_175948
atggattgggaccagctcttggccgggataggaagtagaacaatcaaatgggttcccccgatggaaggaaggaaaggagggagtccttttctcatgtggaggatacccaaacattccgctgattggctcgccaagttaaaagtcgtcagcgaagagagttttgaagcaccggaagaggacgaagaagtccaagctctcaaaagcgagttaggaaaggcgaaacttgccaaggagaagttcaagttggccgctacacacatccggaaggagtgtgccggattacgggaagagaatgcaactaccgcacgagcccttgaacaagagaccaagagggctcgcaaggaagagtatggccggaacaaatttcacggagctctgtggggtagcatcaatgaactcaagctgcgaagggaagagaggaaccagtcgcgagcacgtagcatggttttgaaagaggagttagttgcttgttcaaggtccaaaagaagcttgtctcaacgtttatgcgagacggagaccaacatgctagctatcatcgccaagtaccaagaagagttaggtctagccacgacccatgagcataggatcacggacga

SEQ ID NO: 59171 - DNA, 195 bp, Glycine max
  Peptide Sequence Number=SeqID_175949
atggatgtcttgtgtcttgttggaacaagtgtgaaaccaaccaaacacagagggcgggcccgatatgccgttccgagtctgttttatgcggtccaaacctcttgcagaatccttgaccacagttgcaattctgctcaaggaggggagacatccggaggaaagatatggttttcttcccccgagaggacatcctag

SEQ ID NO: 59172 - DNA, 171 bp, Glycine max
  Peptide Sequence Number=SeqID_175950
atggcttgcttggaccagcaacattctgaaaaggagggacaaactattgttgttgtttttgttgtggaggacttgtccatctcagatttggatgattcctccaacctggattgtatctattgcttgaaaggtcataattattctactgttgttggttttgctgctgaggag

SEQ ID NO: 59173 - DNA, 442 bp, Glycine max
  Peptide Sequence Number=SeqID_175951
agggctacacgccctcgccatcagaggactacacgtcctcgcctttagagggttgcacgccctcgccttcagaggactacacgtcctcgtctttagaggactacacatcctcgccgtcagaggactacatgaccacacccttagagaactacacgtccccgccgtcaaatggctgcacgcccttgccttcaaagggctacacgccctcaccttcagaggactacatgtccttgccatcagaggactacacgtcctcgccttcagaggattgcacatccttgcctttagagggatgcacgccctcgccttcagagggttgcacgccctagccttcagaggactgcacatcctcgccttcagagggctgcacgtcctctccttcagagggttgtgctgtgtgaagatctacagagaccagagcttgaagcggaagtcgttctga

SEQ ID NO: 59174 - DNA, 225 bp, Glycine max
  Peptide Sequence Number=SeqID_175952
atgacaatcagaggaggagatgggggaaccgcttcaagctcagccgaagaaggtggattcaccactggagattgtgggtcagctggctttgaattgacctgcacaggaactaaggttggtgagctttggacgtcctgtcctctagttattgacggaggagctggagtggatgacgaagggatgtcctctgttctatctctttttcttggttccatcttaaactaa

SEQ ID NO: 59175 - DNA, 168 bp, Glycine max
  Peptide Sequence Number=SeqID_175953
atgcagacttggaaggagattttgataccaagagaagcactacatgctacattttactttgggaggtactgctatcttaggatcaagaatccagcagatatgttgactaaagctgttataactgacaagctaaggctttgcattgcctcagttggccttcaaggataa

SEQ ID NO: 59176 - DNA, 486 bp, Glycine max
  Peptide Sequence Number=SeqID_175954
atgtctatttcaccgagtctctctccgagacagtgcccagatcgttacgcctttcgtgcgggtcggaacttacccgacaaggaatttcgctaccttaggaccgttatagttacggccgccgttcaccggggcttcggtcgtcggctcccctgtcatcagtcgcccgggcctggtcactgcgaccccctttgtgaggaggcaccccttctcccgaagttacggggctattttgccgagttccttagagagagttgtctcgcgcctctaggtattctctacctacccacctgtgtcggtttcgggtacaggtacccatttgttgaaggtcgttcgagcttttcctgggagtatggcatggattacttcagcgctgtagcgcctggtactcgaactttggctcgaggcattttctctaccccttattaccctgaaaaagcaggggcaccttgcgtccttgaaccgataaccatctttcggctaacctag

SEQ ID NO: 59177 - DNA, 668 bp, Glycine max
  Peptide Sequence Number=SeqID_175955
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcg

SEQ ID NO: 59178 - DNA, 618 bp, Glycine max
  Peptide Sequence Number=SeqID_175956
atgtttaagagggagcatgaatctttcaaagaatacgcccaaaggtggagggatctggtagctcaagtagcgcccccaatgatggagagggagatgataacaatgatagtagacacgttaccaatgttctactatgagaagatggtgggttacatgccttcaagctttgccgatttaatgttagctggcaaaaggatcgaagtgggtcttagaagaaggaaattggattatcctgctttgatgaatagaaagcctgaggcaaatggagagaataagaaggagggaggaacccatgttgtgactgtcattcctacatggccaaatttcccaccagctcaacaatatcaatactcagccaatattagcctttctcattacccaccaccctatcagccaagaacacataatcatccacaaaggccacccctaaatcaaccacaaaacccgtttgctgcttatccgataccaaacaccacccttaacacgaaccaaaacaccaaccagggaaggaattttccagaaaagaagcatgtagaattctccccaattctggtgtcgtatgctaacttacttccatatctacttaacaatggaatggtagccataatcccagcaaag

SEQ ID NO: 59179 - DNA, 414 bp, Glycine max
  Peptide Sequence Number=SeqID_175957
gaatcgcacccacaaagacacccagtgaacccggagaagtccaacagggccctagggtttccagctctggttacgggcctctgtagtccaacagggtgcccgttccccccggcaaggtcacgtcatcatgacatagggatcgcgcccacaagacacccagtggacccgaagaagtccaacagggccctggggtttccagctctggttacgggcctctgtcagttctacggagtgcctgtcgcccctagcaaggtcatcaggccccctactaatcgagctttcatcaagaagtactacgcccccaggcaggcgcagggcgaaacaccacagcgacctggggatggccggcaacgggcaacagacgcaccgccatcacctctagagttcacctcagctcatccacaaaaaggttag

SEQ ID NO: 59180 - DNA, 408 bp, Glycine max
  Peptide Sequence Number=SeqID_175958
atggagacttgcctaagcaatcactacgcatgggtccaaactcgaaggtggaggacacatgaacgaaaacacaattcatggggctccgaaaaaggggttgagaatggagaattgcacaaagcaatcactatgcatggctccaaactcgaaaatggaggacacatgaacgaaaacgcaattcttggggctccgaaaaatgggttgagaatggagaattgcactaagcaatcactgcgcatggctccaaactcgaagaatggagaattgcacaaagcaatcactacgcatggctcgaaactcgaagatggaggacacatgaacgaaaacgcaattcatggggctccgaaaaatgggttgagaatggagaattgcactaagcaatcactgcgcatggctccaaactcgaag

SEQ ID NO: 59181 - DNA, 603 bp, Glycine max
  misc_feature (586)..(586): n is a, c, g, or t
  Peptide Sequence Number=SeqID_175959
atggcttcttggaaaagaaaggcaccttctacgccctctcaaatgagctggatagaagacactggaggaaggagttgactgactttctggatggcaacattgatgttgccattgtaaaagaattctatgcaaacctctatgaccccgaggacaaatcacctaagcaagtaagggtgagaggtcatctgattaagtttgatgaggatactcttaacacatttttgaagacctcgggggttgtggaagagggggaaacactttgtgcttactctagatttgcactccttgggccttatcctcaggagttagctgctaagctctgtatcccagggaggggattcgagcttaatgctgatggttatccggtgaagattctgaggaagaacatgacccctcttgctcagacttggagcgttctttctttttcaaaccttttccctacttcccacacttctgatgtcactcttgacagagccaaattgatttatgggattatcatgaacgtggacatgaacgtggggtacctcatctcccaccagatctccctcatagcacaacatgacacatccagactaggattccctgncttgatcacaactttat

SEQ ID NO: 59182 - DNA, 585 bp, Glycine max
  Peptide Sequence Number=SeqID_175960
atgaaccggaagctgggttacggtgcccaactgcgcgctaacctagaccccacaaagggtgttggtcgattaagacagcaggacggtggtcatggaagtcgaaatccgctaaggaggagtccggagacgtcggcgggggccccggaaagagtatcttttctgtttaacagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 59183 - DNA, 405 bp, Glycine max
  Peptide Sequence Number=SeqID_175961
atggctccgaaaaagctttccgcgaagagatctaggagggacactgcggctgaagggaccaatgccgccctcgagtttgatagccaccatttcaggagtgccgagcaccagcaccgcttcgaggccatcaaaggatggtcgttccacagagagagacgcgtccagctcagggacgatgagtacacatattttcaggaggagatagctcgccaacattggacgttgctggtaactcccatggccaagtttgaccctgatatagtcctagagtttcatgctaatgcttggcccacagaagggggagtgcgagacatgcggtcatgggtgaggggtcagtggattccctttgacgctgatgccctcagccagttcctgggtgacccgctagtgttggaggaaggctag

SEQ ID NO: 59184 - DNA, 282 bp, Glycine max
  Peptide Sequence Number=SeqID_175962
atggccatgttatcagtccatggcaaacccatttttggcaagagacactggaaaaatacaaagagtgcatctaatgcttctcatagacatcaaggtttgggggaacccggtaaaggtcaggaccatgatgtaggaggtcctgggccaactatctttaagaaagattcttggtggcttgataatggttccacaacccatattgttgtgtcttttcaagggttcaaaattttaagggattacagtcttaagggaaagcaggttaagggtaggaaacaatcttga

SEQ ID NO: 59185 - DNA, 189 bp, Glycine max
  Peptide Sequence Number=SeqID_175963
atgtttagagatggtcctcctgatagcaatcaaactcaacctattagacctcttcccttagccaaaaaggcttaccctcacgtaaagctagatcaaaatcaaaaattcccaaagagaatttcagatcttgcttctaattacgataatttgatccatccaagaactcaatggaagcaaaacaattgttag

SEQ ID NO: 59186 - DNA, 144 bp, Glycine max
  Peptide Sequence Number=SeqID_175964
atgagatgtatgttggggcaacatgacgagtccgggaagagggagcgcgctgtctactacttgagaattaatgaagcattgggcttgaatctagcattgggcttgaatctagaattgggcttggacttgaagagggcagactaa

SEQ ID NO: 59187 - DNA, 624 bp, Glycine max
  Peptide Sequence Number=SeqID_175965
atgggaaagttggatcatctagaggaaaggctcagggccattgaaggaggtgaagattatgactttgctaaactagaagagttgttcctagtacccaatatcatcacccctcccaagttcaaggtgctggactttgacaagtacaaggggactacttgccccaagaaccatctaaagatgtattgtcagaagatgggggcatatgcaaaagatgaggaattgctgatacattccttccaagaaagtcttactggggtagctgttacctggtacactaacttggaaccttcccgagtccattctcgaaaggacctaatggttgccttcgttaggcaatgtctgaacaattctgatatggctctggatcggatacaactacagaacatgtgcaaaaaggggcatgaatctttcaaagaatatgcccaaaggtggagggatctggcagcccaagtggtacccccaatgatggaaagggagacgataatcgtgatgatagacactgatgcaatcctccctaggaaaggaccagttaccagagccatgagcaagaggctccaagaggattgggctagagctgataaagaaggccttagggttctaatgaaccttagggtagatttttga

SEQ ID NO: 59188 - DNA, 138 bp, Glycine max
  Peptide Sequence Number=SeqID_175966
atgtatcgtgggccccgtggttcgttcggtgtagaaggtcgatcgaaagtcggcccgtccgggcaggcagaaggaatatacactaatgcatcggatcccatcagaactccgcagttaagcgtgcttgggcgagagtag

SEQ ID NO: 59189 - DNA, 136 bp, Glycine max
  Peptide Sequence Number=SeqID_175967
atgggattgagccagacgccttcgcttaaaaagtggttctatcaagtcaaggtcaagagcctaggagtcgccagtctgaaagagttaggacagttgatgggtcagctccagcgacaagccttttgcaaagcttatg

SEQ ID NO: 59190 - DNA, 129 bp, Glycine max
  Peptide Sequence Number=SeqID_175968
atggccaccccaatgagcactgcttactacttggataaagatgaagccgatcaatcagtagatatcaagaaatatagagatatcaagccaataccaaagaatctcaccttagtgccgtcaaaagaataa

SEQ ID NO: 59191 - DNA, 222 bp, Glycine max
  Peptide Sequence Number=SeqID_175969
atgattgacctgatcttagccctgaagatcgagatatgtggattgaagatctggtgggagggaaaacttcaatatggcagacagatgaacttaggcgttcaaaacccactccagttgatgaagctagggcggttgttcctaagaatggtctatggccattttgaccaagtgttcaagagttttgtccttgttatccccaaaggcacctacatgaacacataa

SEQ ID NO: 59192 - DNA, 168 bp, Glycine max
  Peptide Sequence Number=SeqID_175970
gcaatctgggttgatgacccttctaaattggttttctgggtagatgacccagcctgggttggtgacccagaagaggttgatgatttcttaatggttggctctggaagagccagtctggctcctttgcctgtacttcttcctccctttagggagattcccgatgcctaa

SEQ ID NO: 59193 - DNA, 249 bp, Glycine max
  Peptide Sequence Number=SeqID_175971
atgtgtctatcggggaaggagaaggaagtaccgggttcaacaaaaaataggagaaaatcactcaaagtgtatcaatctcacacagggcaaggattgacattcccaccctgggtcaaggtttatggtaagttgggattttggctcaaggcttgtagaacggctggtcatgatatatgtaagggtttggccagggggtcggggataaaggggatgtcctacattatttccatgatacacatgcaaaaatga

SEQ ID NO: 59194 - DNA, 315 bp, Glycine max
  Peptide Sequence Number=SeqID_175972
atggctgagaagacaaagaaaagactggaagaagttgcccagtctagaagcactgagggcatcattgaccctccatctcccatcagacgccacgtgaaatggaagatggctcgcacgaagaaaactggacagatgacgtctgaggcagcaaaggaaatagctgacaggattgaaaagcaccctggccatgttcgtgttgttggagccggtgtcaccataaagcaatactttggatcggcttcacgaacgtctcgcagttcttcctccatgcctcctgaagacctagaacaactgacccaatcacagaaaaagtga

SEQ ID NO: 59195 - DNA, 264 bp, Glycine max
  Peptide Sequence Number=SeqID_175973
atgaggagagcacaagcacataaggagaagatgagcttagcactaccacggaggagaagacaacatgaagatgacgatggagagaatgaccctctatttgcattaaggatgagacgacataaaggagaacaccccatgaagaagacaatggggcgaacaatgtttgtgcggaggagaagacggtggtgcgaaggagaagacaacgcagtggagaacataatggcacgaaggagaagatggcactttttgtgtgtgcgtgtctag

SEQ ID NO: 59196 - DNA, 726 bp, Glycine max
  Peptide Sequence Number=SeqID_175974
catatgcgtgccattgcagaactgtttactttacaatactcaaggttggatggtccacaggatcagttattagatataccggatgatatggaaccagaactggccatgatactttacatttatagaacagtctttgatgtgccatcagttgacatgctcaaggaagggattattgcccctagcagaagccctttttcacctccaatcattcttgtcaagaagaaggatggcacttggagattttgcacagattacagggccttgaatgccatcacaatcaaagatagctttcgtattcccactgttgatgaactaattgatgaactacatggggcagtatatttctcaaagcttgatttgagatctgctttcaggacacatcaagggcattatgaatggcttgtcatgccatttgggctcactaatgcccctgctacatttcagtctctcatgaatgagatcaattacttgggccacacagtatcaggcaagggagtaacaatggatcaagaaaaggttcaagcagtcctgaattggccatatcctataaatctgaagcaattgagaggcttcctccgtctgactggatactacaacaaacttatcaaaggttatgcgtcaatcgcaactcctttatccaattcgttgaagaaggaaaacgttcattggaatgaccacgcttccaaggcttttgacaatttgaaagccgcaattaccaaggcacca

SEQ ID NO: 59197 - DNA, 255 bp, Glycine max
  Peptide Sequence Number=SeqID_175975
atgggggatgcaaatagcaattttgaaaatttgaaattgggtcttccaaagtattttcgaagctggattgcttctggaggaagtaacccagctcgcttgggcgagctgggcggcaacctcctccccttttttcctataaataggctgaagggggctgttctaagggtcccagatcccccgggtgatgtatttcagctgttttgggtgaaaaaaattgtttccgtgaagaaaatccaagccgaggcgcttccgtaa

SEQ ID NO: 59198 - DNA, 477 bp, Glycine max
  Peptide Sequence Number=SeqID_175976
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataagtaaaataacgttaaaagtagtgagtcaagctcaacagggtcttctttccccgctgattccccccagcccgttcccttggctgtggtttggtggatag

SEQ ID NO: 59199 - DNA, 414 bp, Glycine max
  Peptide Sequence Number=SeqID_175977
atgaaaaatgaaaagattaacaccaaaaagaagaaggtgttggagacaccgatattaatagttgcaaagaacggtgtgacagaaatggtagagaaaatcattgactcgtttctagtagctgttcatgatatggatgccaagaaaaaaaatatagtgctattgacagtagagaacagacaaacttacttatataacttcttgctcaacaagaaaaatctaaagaaaagtaatatattcggaaaagtggataacaagggaaacagtgcattgcacttggcagccaaacttggagactataaaccttggctaattcctggcgaagctcttcaaatgcattgggaaatcaagtggtacctggggatacacactcgcgtgatatcagaaatggaagcaatgcagctaatggtgaaataa

SEQ ID NO: 59200 - DNA, 129 bp, Glycine max
  Peptide Sequence Number=SeqID_175978
atggaatactacgttcttctggagcagggctacgaatataaagaaagctcggggatcttatttttcggaggagtattggaagctaatggtccgaaaaatccaaggaatttgtttcaggaatatgagtga

SEQ ID NO: 59201 - DNA, 2011 bp, Glycine max
  Peptide Sequence Number=SeqID_175979
aggactatacatcgtcgccatcagagggctacacatcctcgcctttagagggctacacgtcctccccttcagaggacaacatgacctcccctttagaggaatgcaagccctcgccttaacaggactgcatgttctcatatttagaggactacacaacctcgccttccgagggctagacgccctcgccttcagaggagtacacatcctccccctgagagggctacacgccctcgccttcgtagggttagacacccttaccttcaaaggagtacacgtactcaacatcagaggactatacatcgtcgccatcagagggctacacgtcctcgccttcagagggcttcactccctcaccttcagaggactacacatgctcgcctatagaggactacacgcctttgccttcgtagggctacacgccctcaccttcagaggactacacatcctcgaggctgcacgtccttgccttcagtgggctacacgtccttgccttcagaggactacacgtccaatccttcagaggactacacgtcattgccttaagaggactacatgtcctccacttcagaggactacatgtcctccacatcagaggactacacgactacacgccctcaccatcagaggattacacgtcctcggcttcagaggactacacgtcctcaccttcagaggactgcacgttctcacctttaatcggctacatgccttcgccttcataggactacacgtcctcaccttcaaagggctacacgtcctcgccttcagggggctacaagctctcgccttcgtagggctacacgcccccaccttaaaaggactactcatcctcaccttcagaggactacacgtcctcaccttcagtggactgcacgccttcgccttaacaggactgcatgttctcacctacagaggactacacaacctcgccttccgagggctaggcgccctcgccttcaaaggagtacacatcctccccttgagagggctacacgccctcgccttcgtagggttacacacccttaccttcaaaggagtacacatactcaacttcagaggactatacatcgtcgccatcagagggctacacgtcctcgcctttagagggctacacgtcctccccttcagaggacaacatgacctcccctttagaggactgcacgccctcgccttaacaggactgcatgttctcacatttagaggactacacaacctcgccttccgagggctagacgccctcgccttcagaggagtacacatcctccccttgagagggctacacgccctcgccttcgtagggttacacacccttaccttcaaaggagtacacgtactcaacatcagaggactatacatcgtcgccatcagagggctacacgtcctcgccttcagagggttacacgtcctccacttcagaggactacatgcccataccttcaaaggataccttcataggactacacgcccttggcttcgtaaggcttcacgccctcaccttcagaggactacacatgctcgcctacagaggactacacgcctttgccttcgtagggctacacgccctcaccttcagaggactacacatcctcgttttctgagcgatacatgccctcgccttcagaggactacacgcctaacctttcaggggtctacacgtccttgccttcagtgggctacacaggactacatgtcctccacatcagaggactacacgttctcccctttggaggactacatgtccttgccttacgagggctacacggcttcaccttttgaggactacacgccctcaccttcagaggattacacaggattacacaacctcgccttccgagggctagacgccctcgccttcagaggagtacacatcctccccttgagagggctacacgccctcgccttcgtagggttacacacccttaccttcaaaggagtacacgtactcaacatcagaggactatacatcgtcgccatcagagggctacacgtcctcgccttcagagggatacac

SEQ ID NO: 59202 - DNA, 231 bp, Glycine max
  Peptide Sequence Number=SeqID_175980
atggcggcaggattatcactacggactgacatgtcagacacacacaagcacacacctcgtaccgtgtacaagggggacaagactaaagccgcacagcggcgtggagaaaaggaactaataagactacaacacgtggatgatgttgtcagaggacaccagttagggaaagacgttgatattgaatttgagctagagttcaccatcctctctccctggtgttcattgacgtga

SEQ ID NO: 59203 - DNA, 126 bp, Glycine max
  Peptide Sequence Number=SeqID_175981
atggatcacaaagaaattgggagctttaaaggacaaaacttggaggaaagggagttgcgtagaaatgtctggaagaaaaggttggcattaggtcttcttggtgtattggctgggttaggagcttaa

SEQ ID NO: 59204 - DNA, 277 bp, Glycine max
  Peptide Sequence Number=SeqID_175982
gaagaactattggaatcctgatgatctgacagttgctatacgaggggctaggagggcgagggcgaggccagctgatcttccttccacatctgtagctcctactccagcatccacttcagcatctccttcagtcccagctcagatggattctcagcgctttgaagccatgcttcagagcattcatcagggacaaatcattttacttcagagtttacaggtggtggcgcctccaagatccattccttcaattgagcagtttctggagagggtagcctag

SEQ ID NO: 59205 - DNA, 408 bp, Glycine max
  Peptide Sequence Number=SeqID_175983
atgaagctaaaccaattaagaatccttcaaactcttccagtgtctggggccaaaacaggtcagggctcgagccactctagacattccaccagctatttcaccagcggtccctcctccagacgtctctcctccacttaccgaccatacttgtcttctctgttggagcagcttctccctatgttgtatagcctccaccatggccagtacctactgatgcagaggcttcaccatctctccatccagcaagcggtcatgacacttgaggcattcctagcccagataattgtgaaagttctgattcttgtgagcagacgttattgtgaagtgatgaagtatgaatcgaaaaacaagagtgaagaggttagcaagtctgaacggaaatcatggtatggtaagccaaacacttaa

SEQ ID NO: 59206 - DNA, 546 bp, Glycine max
  Peptide Sequence Number=SeqID_175984
atgacgtcccctccccctctacccatggtccaactctcccacgcgctgctgcgcggctcctttggctcttgctctgtcggagcttttgttggagagaagaatcacggccccaccaacgcggaaaaggcaattgggtatgagcatggccttgttgttcccgaagtaccaattctgggttatgttcttggtactgacgatgacggcgtaggtgttggggtgaacctaaagcatgtcttttgcgagctcaacggcgatgatgtcggcgctgcagcccatgccgccaaggttgaagcttttgacattaccgcagagcttgtacttgttgacgatcatggaggagagggaaggggtgcggttgaagaggctgcagttgacgacaaggatgccgatgtctttggggttgacaagggggaagctcggaggagagagagagaggtggtcggacaccaaaggcagctcgaagaagctcgaaggagagagagaaaagaagaaaaaatctcatatttttttattttatctggtgtaaacgattctattgtagtttaa

SEQ ID NO: 59207 - DNA, 173 bp, Glycine max
  Peptide Sequence Number=SeqID_175985
gacatcgtatccgacatcgtggatcctgcacaatctgttaaagatataacagatttatgtgtccagtattttcgggcaggatgtcctggacattgtatccgacatcgggcaggatcatctcgagctaccttctggggtagagacaaagttaaagcggcagaaaaccaatcaag

SEQ ID NO: 59208 - DNA, 444 bp, Glycine max
  Peptide Sequence Number=SeqID_175986
atggggacctcgtccttccacctgcctatcaaaaagatgaccattactttgaatgatgtgtcgtatctcctgcacctgcctatgataggcaggcctattgatcatgtctcctccaccttcactaaaaaggccataaaggttctgctcatgactcgtcttggcatttcgacagaggaaaaggctatagcggtgaccactgtaggtgccaagtcttgggtgtttgtgcatctgcccattgttggctattttaagcctaggactagtgctctggataacccggtagccagtagatggaagccaacacgaggcatcgggcaaactcatttgatcaaggagaagttgaataacctccaggtggatgttgccgcctggtgtccttatgagcgccacagggggtgtttgccctttcccttaataaacctttttctcaacaggcccttatga

SEQ ID NO: 59209 - DNA, 231 bp, Glycine max
  Peptide Sequence Number=SeqID_175987
atgtggctcttttttaggtctatgagcaaaacctccattgttgcgaacgattggactaaacaaatgattctaactaacctgaacagtcaaacctcgcccacaattgggcgctcggtcttcttcttctcctttgtcaacgcattgttgttggcgacagtcacgagatggaagtgggagcaggacaacgatctttttgggtcagcgacagaagaagaaggggcccttatttag

SEQ ID NO: 59210 - DNA, 319 bp, Glycine max
  Peptide Sequence Number=SeqID_175988
ctcatcaagtcgggcctttccacctccctctgttggctcaaccctgacactgtgcaccactgcctcttcctccgatggatgcctctacatcgacaaccagatctgtgagagtgtagggtggaggctttgcgggggtggacttgcaatttgtgagcctgaagtttgtccctattggaagcttcttgatgatgcgttgggtgactatgatggtgttgtcagtgattacattgaactttgccagcaacaccgttgttctagccaccaattgggccctcaatctgaatctcttgccttggacatgttcaagcttaaattttga

SEQ ID NO: 59211 - DNA, 328 bp, Glycine max
  Peptide Sequence Number=SeqID_175989
atgttggaaagttttaaacaacaagaacaaatgtcagttcttgaattgtacatagaaaaggatgtggctggtggttcaatgtttcattctgcaaattcgcttacatcatgtggaaattatttatctaatgatgagacacaaccgacaacaaatatgagcaatttacatattgacgaagacgatgatgacgacgatgatgattatcttgtgtctaactcatacgttgaagaatctttagacgaagatgacagtgttgacggtgtatccgataccgacgatgaagtcaccaacattcctcaaccagtaaggattgttcacccagcagaag

SEQ ID NO: 59212 - DNA, 219 bp, Glycine max
  Peptide Sequence Number=SeqID_175990
atgcagaccacgtacaaaacagcaccatggcggaaattctttcaaaacggccccatttggggaataagtttgcaaaaggagaccaaatggggaaatttgccaaatccggatgcaaggcttcagattctagtccatcgtgaccctgacttcgtacttactgcttgtggtggtttgaacattgatggcagcatggaatctaagatacatgatcaggaataa

SEQ ID NO: 59213 - DNA, 546 bp, Glycine max
  Peptide Sequence Number=SeqID_175991
atggcattagtagctcattttgaccttgagttacaacaaatggatgtgaaaacaatattcctcaatggtgatctagatgaagaggtttgcaccagtcctgacattgcatttgttgttggaattttggaaagatatcagaataatccaagtattgaccactggaaagctgcaaagaagataatgagatatcttgaaggaacaaaagactacatgctcatgtatagacaaactaatgatttggaggtgattggctattttgattcaaacttttttggctacagtgatatcaggagatctacttttggttatgtttttatactagctggtggagttgtatcttggagaagtgcaaagcagtccttgaatgctacttccactatggagactgagtttgtttcttgttttaaggctacctcgcatgatgtatggtcgaagagttttgtatttgggcttagagttgtagactctatttctaggttgttgaagttgtactgtgacaatgctactatggtgtttatggctaagaacaacaagaatggaagttga

SEQ ID NO: 59214 - DNA, 645 bp, Glycine max
  Peptide Sequence Number=SeqID_175992
atggacggcacgccacggaacggcccgcccctgccctgtactcccctgacgtccccgcaggcgcgcttgatcgccgaagcgttccgcccggcgcaggcctggggcagccggcgcgactactactacacccgtagcagctcggcagcgatccgctgtacgacggcgtgctgcagcatctgcctgaggacgggcagccggtgctggacctcggctgcgggttgggcctgttcgcccatgtactgcgccagcgcggcggcacccaacgctacctgggcgtggatgtggatgcgggcaagatcgcccgcgcgcaacgtgctgccgtcgaactgcatgacgtgcgcttcgactgcgtggatgtgcaggcgccgctaccggcgcaggccgggcacgtcctgctgctggacgtgctgcagtacctggacgcgggcccgcagcaggcactgctgcgcgcggccagtgcgcgggtggctcccggtggctgcctgctgctgcgcacgccgctggccaccggcgatggccgcgaccgcaccacgcgggtggcggaccggctggcctggctggtcggctggatgggcacgcggccgcgccactaccccgatccagaggtgctgcagacgacgcttgccgaagcgggattgcaggtga

SEQ ID NO: 59215 - DNA, 338 bp, Glycine max
  Peptide Sequence Number=SeqID_175993
aggtatcatccccttcgaaaaaacatattgtggcagtagggactaccagcaacaacacactatcaaagagaaaaactctagatgagggttcactattatcaagcaagtcggagacccagcatgaccacaaactcacctccactccttatgttcccatggacccggaagccctaagccctaactctctaaaaacagtccccagtggattcgccaactgtcgcaaccttcccttcggcgggagggtgacggggggctcatgggtgcgtcttccaagggaggaaaatgcacagagtcgctaccaacgtttatttgaggaaaacgttggaaaaactgaaaag

SEQ ID NO: 59216 - DNA, 618 bp, Glycine max
  Peptide Sequence Number=SeqID_175994
atggaaggaaggaaaaaaatgggttcttcttcttctttcacttctgagctctttgggtctaaccagttccagaaatcttctgcttctgggatttttgaatctatgtttcctccaccgcctaaggtgttagggagaggttctctgtgctccgaagtgagtggaaaaagttccagtgaggggtggaactacaaatttggcagtgagaatattctgttgccttgtccttttactgagctgggactaaacgtagtcaatgaggtgtatggacctcttgagggtcctctcgattacatcagcatgggaaatcatggtgaaactcagaacacagcacaaaaggatatgagttctatatatcaggaacaaagacttcaaccatgtcaacttagctcatcaatccattatggtggccaggacatatattcttgtcctaagagtacacaagattcaggatacaactctttgctgtacaagaaagatggggttgaagatgatttaggaagtaacctgtggcaagtcttctgtcacaagtttctcattcactttctgtcttgtgcaactgtctatccacagggggtccctattattaagatcacacttgccaaaggatatgctccttaa

SEQ ID NO: 59217 - DNA, 1896 bp, Glycine max
  Peptide Sequence Number=SeqID_175995
atggagggtttgagtttggctgagaatagtactgaggctgttgaagagagtaataaaggaagtgaaaatggtgccaagagagaaacttttgctgatttgattgaagaaaagggtcgtgagagcagtttcagctctgagtttttgtcatctgagaccactcatgaggagcatagtaggagtagcaccgaggactcttcttcatctccttctgtggggtggccggttcaggaaattgctgcatctgattgtgctagtcctcatggaagtgaagatggtgagaagaagcacttggtgttggagaataaggagtttgagaaacgagtttcagcctcaccagagattgagatgatgaaggagaggtttgcaaaattgttacttggagaagatatgtcaggttgtggaaatggggtcgctacagccttggctatctcaaatgccataaccaatctatgtgctaccctctttggccaactttggagattagagcccctgcgttcagagaagaaagcaatgtggcgacgagagatagagtggtttctttctgttagtgatcatatagttgaattgacacctaattggcagacctttccagatggaagcaagcttgaggtcatgacttgccgtccacgttcagatctttatgtcaatcttccagctctgcgaaaattagataacatgcttcttgaaattctagatagttttgttgacacagagttctggtatatagaccaaggggttctagctccagatgctgatggtccatcctcttttcgacaagcacttcagagacaagaggagaaatggtggcttcctgtaccacgagtgcctccatgtggcctcaacgaaaactcaaggaagcagttgcaacacaagtgcgattgcacaaaccaaatattaaaagcagcaatggccattaatagcattactttagaggaaatggacattcctgagtcctatttggaatctcttccaaagcctgaagagagcaaatggcgtaatggtctaattcctaatccaactttcttgcagaatgctagagtaagcttgggggatgttatttatcgttacatcacatcagatcatttttctcccgagtgcttgctagcttgccttgatttatcttctgagcatcaagctatagagattgcgaaccgagccgaggcttccatgtatatttggcgcaaaaggaccaactccaagcctgctagtatcagtgccaggtctagttcaagaacatcatgggaaatggtcaaggatctgatggttgatgcagacaaaagggatttgtttgctgagagagcagaaagccttttgctttccttaaagcagcgttttcctggtctccctcaaacagccttggatatgagcaaaatccaatacaacaaggatgttggcaaagccatcctggagagctactctcgagttctagagagtttggcatttaacctggtagcgcgaattgatgatgtgctctatgtagacgacttgaccaaaaattcagataaaatctcatctctctcaaaagttggtgttgttactcacaagagtatatcagttccacactcagtgcctgtcccaggcactccatacaaatcggctttcggcacgccaaccctttctccagcacatgggattagtagtcctgccaagggtgggaagtccccgctcatcaattacagcaaccttccccaaagagggtcaggggtcaagaagtctttgactgattttcttagcattgatccaaaagggaaggacagtgacacttcaattgagaaacaagattcagaatcaaatgtacttgatgaagtgacaacatgtgaaacagatgtcgagtccagtgcctgcacagaaggtgctgccagtccaagtatcttggactggaaatggcatgtgtga

SEQ ID NO: 59218 - DNA, 420 bp, Glycine max
  Peptide Sequence Number=SeqID_175996
atggagggttgtacttattgtgtgaagttgctatgccttgttgggtttgtggtgcttgtgagtactattgcaggggtggagagtgctggtgaatgtgggaaatctaccaccccagataatgaggcttataagcttgcaccatgtgcctcagcagcacaagatgagaatgctagtgtttctcagagttgctgtgctcaggtgaagaaaattgggcagaacccaagctgcctctgtgcagttctgctctccaacacagccaaaatggctggtgtcaaccctcaagttgctgtcaccatccccaagcgttgcaacctggctaatcgccctgttggttacaagtgtggacaatcttctaaacgaccagagacagtgaccgctagaggtcatgttccaacatcgatggataaggatggacgatga

SEQ ID NO: 59219 - DNA, 360 bp, Glycine max
  Peptide Sequence Number=SeqID_175997
atggttcaagatttgattaaaaatgatgctaaactagagtttgaagatttgtcacttcttattgttgaagattcaatggataaggaagagaaaggtgaccacattcaagacaacttattctctcatgaattcaaagttatttctgcccacaaagaggaggtcacaacaacagaaactgagttatcaattggggtcgggattggaggtgaagcatctgtcaatgagaccgaaaatcattttgacctcaacaaagtgcatgttgatggtgttgaagaatgtgtattagttttgaataaattgctagcagaaggaatggacttaggatttgagagtgaagaattgaataaagaaaggatttaa

SEQ ID NO: 59220 - DNA, 2070 bp, Glycine max
  Peptide Sequence Number=SeqID_175998
atggatctttatgcattaccactgtgtggtgccgacatcgtcctcggagttcagtggcttaaatcattgggtctggtcctgacttattacaatgaccttacaatgaagttcatcactaatgggcacattgtcgaattaaaaggagatacaaattgtgaccttcattcaatgacacccactcagctacgccgcatggtccgaactgacagtgctagcgcctgtttccacattcgccttataccacctgagcttccttcgaccaaaacactttaccctgaaattgacaccctgctctgcaccttctcccctctttttcagaccccaaccaccttacctccctcacggaccaccaatctatccattcatttgctttgtcattctgagtcggtgaatgtaagaccctaccattacccttattttcagaaacacgaaattgaagcacaagtcgaaacaatgctacaacaggactacagggctctgaatgccattaccgtcaaggatcggtttccgattccgactataaatgagttgttggacgaattgggtggtgcctgttggaattggacttgttacaggggaccttccaagatcaccagttctttctcaaactatccaaatgcaccttcgcgcagaagcaggttgagtaccttgggcatttggtttctcaaaccagttcctaccaaggttgaagctattcaacaatggccaataccttcctctaccagagctttaagaggctttctcggcttgtcaggcttctatcggaggtttattaagggatacgtttccatagtggcacctttgactcaactcttggccaaagacaaatttcgttggtcgccggaggctcaggaggctttcaacaagctgaaggaagttatctttcatgcgctggttctcgggttgctggatttttcccttccatttgtaatcgagattgatgcctcaagggtgggcatgggtgccattctttctcaacagaatcaccttattgccttcttcaataaagctttctgtcccaaactccttcatgcctctacctatgttcgggaacttgccaccatcacttcggcagtgaagaagtggcgccacacttttgcttcattgagactcttcttcatgaattccattcaaccccaactggaggtcacatgggcattaccaagaccttggcacgactacgtgacaatttcacttggtcgggaattaaggacgatgttcacaactttgttcttgcttgtgttgattgtcaataaaccaagaatgatcaccacaaacaatctgggttactatgtcctcttccgatgccggcgcggaatccatttgggttcattgccatctcatcatatggctttcaatgttgttcacctcttcatggaaatcgtgggcaagctccatgggatgccctgtagtttggtctccgatcgtgactccctattcataagtcgtttttggcaggagctattcagattgagtgacacgaagcttcgcatgaactcggcctataatccccagtcagtcggacaaactgaagtcataaacagagtggtagagcagtatctccgagccttcgtgcactcccgactgacgacttgggggaggtacttcatgtgggccgaatggtcctataagacatccattcactctgaaacccaaatgacaccatatgagattacttttgggaaacaacccccgaccattcctcagtatatcgtgagaacctccaatgttgatgttgtggatgaatttctgatcaatcgcgatgagatgtttgctatcattctcaacaccaaatgggacacagtggatcatacttctaagttgcgggtcttggttcagtggaagggcttagccccagatgatgctacctgggaatcctgggatgaactcaaagcagagtatcaccttgaggacaaggtgtttttcgaaacgcatgggaatgttatgaaagggaaagaagctacacaattgccaccaacagaaacacaaacaaagcagataccaacaaaaaggaatcaaaggcaaaagagaatggtgaccaaacctcaatacctgagagattttgtctaa

SEQ ID NO: 59221 - DNA, 678 bp, Glycine max
  Peptide Sequence Number=SeqID_175999
atggcagctggtcaggaagatgtgaagcttttgggagttgtgggaagcccatttgtgtgtagggtccagattgccctcaagttgaagggaattgaatacaaatttgtggaagaaaatttggccaacaagagtgatttgcttcttaaatccaacccagttcacaagaaagttccagtttttattcacaatgagaagcccatagcagagtctcttgtgattgttgagtacattgatgagacatggaagaacaaccccatcttgccttctgatccttaccatagagccttggctcgtttctggtccaaattcattgatgacaaggtttttggtgctgcatggaaatctgttttcactcttgatgagaaagagcgtgagaagaatgttgaagaatcattggaggctcttcagtttcttgagaatgagttgaaggacaataagttttttggaggagaggaatttgggttggtagatattgcagctattttcatagcattttggattccaatttttcaggaaatagcagggttgcagatattcacaagtgagaaattccctaagctctacaaatggagccaagagttcatgagccaccctgttgtgaaagaagtccttcctcctagagacccactttttgccttcttcaaggcccgctatgaaagtctttctgcttcaaaatag

SEQ ID NO: 59222 - DNA, 525 bp, Glycine max
  Peptide Sequence Number=SeqID_176000
atggtggaagaagatgaagctgctgaacaaggtagcctcaatagccctcaagcatcaaaaatgaaagatgtgaatgttttacatgtttctcaagaggaatctggttaccctatgatggaagaatatgaagcagcaaaacaaggtgaccacagtagccctcaaggatcaaacatgaaagatatgaatgttttacatgtttctcatgaggaatctgtttaccctatggtggaagatgatgaagctgtggaacaaggcaaccagaatagccctcaagcatcaaacatgaaagatctgaatgttttactggtttctcaagaggaatctggttactctgtggtggaagaaaatgaagctgcagaacaaggcgaccaaaatagccctcaaggatcaaacatgaaagatatgaatgttttacgtgctactcatgaggaatttgattaccctatgaggaatctgattgccatacggtggaagaagaagctgttggacagggcgaccacagtagccctcaagcatcaaacatga

SEQ ID NO: 59223 - DNA, 468 bp, Glycine max
  Peptide Sequence Number=SeqID_176001
atggaagaagttattcctgtaagatttaataacacaaagcctgatacaaaaatgtcagagcttgatgaatcttttgcaaatttaagactgaatgaagacattggaccattggtagaacaatctacaggaacgaatgtgtctgatcaagtaaaaggacaacctcaagaagaaagagaaccaactggacaaattctaagcaagaaccatctagagagtcaaatcattggagacccctcaaccaaagtccaaacaagaggatctcttagacaacaaggtttcataactctcattttagaagtggaaaccaagcatattaatgatgctatggaagataagaattgggtaaaagccatgcaagaagaactagaaaaattcaagaaaaatgatatttggaagcttgtagaactaccacaagaaaataaagtagtgagagctaaatgggtgtttagaaacaagttgggcgagtga

SEQ ID NO: 59224 - DNA, 648 bp, Glycine max
  Peptide Sequence Number=SeqID_176002
atggctacacgccatcgccttcagaggacaacacgtcctcaccttcagacttctacatgtcctcgccttcagaggactatataccctcctctttatagggctacatgccatcccacttcaaagggctacacgtcctcgccttcagaggactacacatcctcctcttcagaggactacacgccctcaccttcagaggcctacacgccctcgccttcagaggactacacatcctcgtctttagagggctgcactccatcaccttcagaggactacatgtcgtcgccttcagagggctgcacgccctctcctttagaggcctacacgccctttccttccgaggactacacgtcctcgcctttagaggactacataggactacacgttctcgccatcagaggactacacgtgctcaccatcagaggactacacgtccaagcctttcgagggctacaccccctcgccttcaaagggctacaggtcctcaccttcagagggctgcacaccctcacctttaaaggactacatgtcctcgccttcagagggctacacgtccccacctttagaggactacacgtcctcccctttagagggctatacgctctcgccttcgtagggctacacgtcctcaccttcagaggactactgtga

SEQ ID NO: 59225 - DNA, 846 bp, Glycine max
  Peptide Sequence Number=SeqID_176003
atgggagtgcaccccaaaaccgatccgctgacctatcagtacgcggaggcgttcaccgctgacgccaggggaacgctgggagctcagaccgaagccggctatcagaactgggcggggacctcggcgccggcgacgtatgcgtggacgccggactgggccgtcggcacgacgaccgggctcggccaggccggcctgtcgatcacgggcgcgggcgacatgatctccgtcgggggcgagttccggtcggtcaacaacaagcagttcgaggggctcgtccgcttctcgacgacgcctccagggggtccgaaggacggccctcgactgtcgggcaccacgtggacgccgaaggccacctcgaccgcaccaggacaggtcgaggtgtcgatccgtcagaactgggatcgcgacgacctcgacctgacctatgaactgcgacgaaacggagcagcggagccggtcgcgtccgtcacggtcgacagcacctggtgggggaagacccccgtcacgctgagggacgactccgcccccggcgggcaggtcggctataccgtcgtcgccaaggacggcgacgggaacaccgtcaccagcggcgagacgaccgtcagcgtcgtcgcggcgggcggtaccgggggagatgccgccggaggggacgccgccggaggggacgccgccggaggggacgccgccggaggggatgccgccggggacgtgggcaccaccgactacagggcggtcgtgctggccgacaggccccagctgtactacccgctggggtcggcatcgcgagacctcgccgggttcaacccgccggtgatcggacgcggtgtcgcggtcgcagacgccggg

SEQ ID NO: 59226 - DNA, 870 bp, Glycine max
  Peptide Sequence Number=SeqID_176004
atgtctgatggtgaaaagcaaagcaaaaatgtggtgtctcaggaaaatgttgcagacggggagaggtttgacagttgcatccaccccactgccgttgttcatcccaatgccgtcattggccagggtgtttcgattggtcctttttgttctgttagctcctctgcaaagctggggaatggttgtcaactacatcctggaagccatgtttttggaagtacagagttaggggacaattgcatgttgatgactggtgctgttgttggtgatgattatcctggatgtactgtcattggaagcaataacacgataggatatcatgctgtgattggtgtcaaatgtcaagacatgaaatacaagccagaggatgaatgttacctggaagttggacacaataatgatattagggaacatacttcaatccaccgatcttcaaaatcaaccgataggacggttattggtaatgccaattttataatgggatcttgtcatattgcccatgattgcaagattggtaacaacaatatttttgcgaacaatactctcctagctgggcatgtcgaagtggaagactacgttcacactgcaggtgcgactgttgttcatcaattctgtcatcttggctctttctcttttcttggtggtggttctgtgggaaatgattgttatgcaattgtggaaacatgcaactgtcaaaatcataggcagtcagcactcagcagaagttttctagtaggtcgtactaaacttataatggatgtgaatggtgaggagtatgtgaagaatatgcaacctaaaaatctgtccaacacaattaagatcacttcatatcctttagatttgggcaaatttgatagggacttaaatttctga

SEQ ID NO: 59227 - DNA, 336 bp, Glycine max
  Peptide Sequence Number=SeqID_176005
atggctgttaggcgtgttgctggaacaaatattaacagagaaagggcgtttttcacttgttcaattaataaggatgaagttggatattgtgggtactttatttgggttgatcaattgattgaagcacttggagttgatgattcacttgggacattttccatggaacaaagaagacaatttggaagagaggaagataagacaatgtggaaggctcaagttaactcaaagcttgattgtatggggattgaaatgaagatgtttagaacaattgtctatggaatattcttaatccaattgttgtcaatggtggtgtttgtatgtattcacaagtactag

SEQ ID NO: 59228 - DNA, 210 bp, Glycine max
  Peptide Sequence Number=SeqID_176006
atgattggcctcaccaagccaacccctggtaccgcatttgttcaaggtcttgacataagaactcatatggatgtaatatatactagcatgggtgtatgcccacaacatgacttgttgtgggaatccctaccaggaagagagcacctattcttttacgacagacttaaaaatcttaaaggttcagccttaacacaactaaccctcagttga

SEQ ID NO: 59229 - DNA, 969 bp, Glycine max
  Peptide Sequence Number=SeqID_176007
atgaagggggtgttgtgggttgtagttgtatcaatggtggttgcagcatggatgcccttctcacactgttcaaagaaaccagtgggggtggctagaaaggaggacattcaatacatcaagtgtcaagtgtgtgagaaacttgctaaagaattgtatcagcaggttcaaaacaagcaagctgagatcgctcccaaaaagatctcggagtaccaaatcattgagatagcggagaatgtttgtaatctaaaaaaggctgaagcggattggatattgcgcatagatattgtggagaaagaagataggttagagctggtggaacaagactctgaaggacaatgcaattctgaatgcaagacaattgaacgagcctgtcaggaggtcataggatattctgataccgatgttgctgaatatttatatagttccaagcctgatattgattcattgcgcaattatctctgcaaagaccttactaatgcatgcagtaccaagccacctcctgtccctaagcatcaacaagtgttagtgttgattcctgagccagtgcttgttaccaattacctattttcagtacaggacagggctcctggtgaaccattcgttgcaaagtcttccaaggaggctgaaatggaaaagctacttaaatctatggagggcatgccaggagcacccggcatgaaaatgtactcaagggatgatttaatgaacatgaagaattttggtgatgaagatggcgatgatgaagatgaggatgacaatgaggaggcgagcttcccatccaaattgggaaaagttttgagagcgaaagaaagtgaaaaaagagattggaaacaagtgataaaaaagggaattgaggacacaagcatgacactgaagaaacatgcaaacaaagtttctaatcatatacgccagtggtggaggggaaagaagataaccaattcaaaaaaaggagggaagacagaactttag

SEQ ID NO: 59230 - DNA, 258 bp, Glycine max
  Peptide Sequence Number=SeqID_176008
atggagtttgttgaaagggttaaagaatcggcgaagggtttggttgtcatgattgggtgcctcagccactgcgggtggaactcgatgttggaatcgctaaatcagggggtgtcgattctgggctggccaatggcggcggagcagttttataactgcaagttgttggaggaagaggttggggtttgtgtcgaggttgtaagagggaagatctttgagacaaaatgtgaagacattgtggttttggggattagagggtga

SEQ ID NO: 59231 - DNA, 273 bp, Glycine max
  Peptide Sequence Number=SeqID_176009
atgacaacgattttatataaggttgagaacataggcgaaggaacatatggtgttgtttacaagggtcgtgactgcgtctccaacgagaccatcgcgttgaagaagattcgcaggggttgttatcctaatgcaaatgtttcagattttgagggtattcgtattttggcatggggagaagtggtttcatcattgtcagaaaatccagcagcggtggaggcgaaggccgtgttcgagaaattcaaccgcaaattcgaggaagcgtgtcggaaatag

SEQ ID NO: 59232 - DNA, 267 bp, Glycine max
  Peptide Sequence Number=SeqID_176010
atgaagcacaagaaccaattagttaatatcagttggcacgacgaaggatttgatcggagcttgagtggtcgcaccaacgaggccgacatcgacggtggaaaggtcagagtcagtggaagtgaagtttgggaggccgatgatttgttcgaggaagtcatcggcgggagcgttggaagggttattcaccatgagtgtgggtttgagtgtggactcgagcgagttagggttgagtcgggagaacgagttgggaacgcagaaactacatga

SEQ ID NO: 59233 - DNA, 408 bp, Glycine max
  Peptide Sequence Number=SeqID_176011
atggagaattgcactaagcaatcactacgcatggctccaaaaaagtggggaggatgcatgaacaaaaacgtaattcatggggctccaaaaaagggtagagaatggagaattgcactaagcaatcactacgcatggctccaactcgtgggtggaggacgcatgaacgaaaatgcaattcatggggctccgaaaaagggtagagaatggagaattgcactaagcaatcactacgcatggctccaaactcgtgggtggaggatgcatgaacgaaaacgcaattcatggggctccgaaaaaaggggtagagaatggagaattgcaataagcaatcactgcgcatggctccaaactcgtgggtggaggatgcatgaacgaaaacgcaattcatggggctccgaaaaaaagtag

SEQ ID NO: 59234 - DNA, 3201 bp, Glycine max
  Peptide Sequence Number=SeqID_176012
atgagaaatttcaagtccactactacttccgtgcgccttcccataggaaattattccttcgatggcgtagaagctggagaaagcaaaacggcattgaagctcgccgtttcacgcataaagcttttgaagaacaagagagaagcccaaataaagcaactcaagagagagttggcacaattgcttgagtctggtcaggaccgaactgctagaatccgggttgaacatgttgtcagggaagagaagacgatggcagcttatgatcttgttgagatatactgtgaacttatcgccgcacgcttgcccatgatcgaatcacaaaaaaactgccccattgacttgaaggaagcagtttcaagtgtaatatttgcatctccaagatgttcagacataccagagctcgtggatgtgaagaagcaaatcacatctaagtatggaaaagaatttgtctcagcagctattgaattacgccctgactgcggtttggttgagaaattgtctgccaaagcacctgatggtccaaccaagataaaaatactggctgcaattgccgaggagcataatatcaaatgggaacccaagtcatttggagaaaatgatgtaaagtcttctcaagactttttggttgggccaagtacttctgagaaggctgcttatgctgaaccttctcaaattcatgttccacctgctcatgatgaaaagggtccttccaatttacatgcttcctcgcaagttaaaccagtgcatcatgcatctacaaattcatatgagcagtctgcaagtggtgctgctagaaaggatcaatcaacaacatcaggcgtgtccaatttagaagtcagatcttcaggaactggaagtcaagaaacaaaatttcaagattcatactctggaaacaatagttcttttcctatgaataggcagaattggaacatgggattcaaggatgctgcctctgctgcgcaggcagctgcagaatctgcagaacgtgctagcatggctgcaagggcagctgcagaactttcaaaccgtgaaaacatgacaaggcagtattccagcggatcacatagttcttctggaagcaggttgagagatgaaagaccccaagaatacacttttcatgatgacaaaaatgtttctacaagtcctgttgatactagcttccatagaagcagttctgggatgcacaatgaacaaattactgctgcagaacaagataatctggtaggaccgccctatgaatattacaggaatagtcatgagaatgtggtgagacatgcccagtcagcttcattgatgtctgatagtgcttttcgtgatgataaaccatttatcgatggtaatcaaatggctgatatatatcagcataataactcatttgggcaaaagagtagtgacttacatgaaatgggtataaaaacgcaagcaggcagaagtgaagaagattttgtgactgacctatatgatgacagtgatttgaatgctgaaaacagttatcactttggagatgcaaggacaaatagacaatctagtaaagtttcctcttctcatttcattactccaactgatgatcacaatgataatttggacttggatgactggaatacgaggaacaaagctgtgggagacccttttgttactgatgaagtaaacactcagagaaacattatggaaacaaattcttataatgatactactgttgtatttgatgattctgaatcagaggatgatgatcataaatttggcgttgataaaaagtacaacggtgagggatctagtttgttcgtctcatccccttctaacaaatcacaagttgatccatttgaaaatacaaaatcttgcagcgatggacaaaacattgatgagaaagtgacaagttctagtacaccgtcacatttttctgtgatttctgaaagattgacgtctgcagtttcttctgaaaaagaagacttgccacctgtcacttttgatgattcagatgacccaggttcagatagtgacatgagttttgtcaacaagtctaaggtttctgggctctcgggttatggggcttcagggtcctcatcaagaaatgataaaaatgtgggctctgacagaaagtcttggttgtcacctttgtcagttgattcagatactgtggaagagcattttgagagaagggtagacaccactactgtgtcagaaaagaatttgggttatgatgacttgccagccagtcagtcacctacaaaggaaagaagctctatattgggtttggatatcgaggcaaacaatgatattgaaactctgaaggaatatcgtatagagtgtggcaaggaattaagctatggtaccttgaagggtggttttcgcaataaaggcttcaagcgaccaccttatattaataataccttggatgattcatcatcttcattgggggatgcttctgtccagaatgaaagatctttgcctatagtgaggacttcaattggttctgatgctcctgttcaggacaagtacacgagggaagtgagcagaggaaacaggactatgggcctgggagcgcacaacataccttctgattctgatagttatcgtgtggttgcaaattcacaagagactcttgctagaactaatgaacctcacattcagaaagagcaaagtgaagtaaaaaagaaatcaagctcaagggcctcttttacttactttaattctgataatagtgattctgaagaagaacttactaaacaaaattcacctagtcttgcccgtcctgttagtggaatatctcgaaggacatcagcttcttctaaagctgctacaggtttaagctcaagagatgctcctttatccaaggcttctgtgactcctgctacaacactcggatggaaatcttcaaggacttcttatgagagtaataatcaaaatgcttcaaccataatgaagagctctgaaaataggacaggacctaagtctggatcagccaaaaacaaagcatcagagccaatttcagaacctaatagatccttggatggggaaatttcgaaatcatctgcaagggtgcaaccttccagttctcttaaaacagtgatacaagataatgaagagggccaagaggatgatgcagatacttcctctaagcagaaggttgggcacgttcatccaaagttacccgactatgattcttttgctgcccacttcctgtctcttaagaagggtcgtcaataa

SEQ ID NO: 59235 - DNA, 573 bp, Glycine max
  Peptide Sequence Number=SeqID_176013
atggataatgaagagggagtgcaagaacagatgaaggtcgacctatcggccttaaaagatcaaatggcttctatcacggaggccatgctaaagcttcagaaaactatagaagataatgccacgacagccgcctccaatacagctagggaagcggaaccgatgctacagcccgcaataaacttgggccgagacagaaacacgacggtgttcggtcggaggtatagtcctcaagcctacccttatggtttgcctccggacttcactccccgtaccgctctagacgatctgagccaagcccctaccttcgaggggcaactccctccttatgccgactatcctctgcaagaagatgatgaaggagaggcctatctaggccctctacttcccctcaaggatccggccccccatgaattgtcccaaccaaacatagttcgccatgtcccgtctccacccgcacccgttaaagaatccgttccctttgcaaaagataagggaaagaggcaaaaacaccaaaaggggcgccccccagacaggcgcctccactgtgcacgtgacacgtggcacagcaggtag

SEQ ID NO: 59236 - DNA, 330 bp, Glycine max
  Peptide Sequence Number=SeqID_176014
atgcactctatcagcttcttgctctgccagtatctcctggctaaggtgtgcgatatatatccatgcattggatatgctaacggccaaaccaaatacgccaaatacagtgattcaaaaagcattcaaatgcctaagctgcgccgcatttcacgaatgacgagagtgatgagcaaaatgacggcaacagcgacgaagtctatttcgttgaagcctttgggaagagatggcaccgtgaggcgccatttggtggaggagattccgattgtggtgcctaggtacgtcgtcaagcctctggtgacggtgtcattggaaagcacggaccaaaggtga

SEQ ID NO: 59237 - DNA, 303 bp, Glycine max
  Peptide Sequence Number=SeqID_176015
atgatctctgcatcaaaccctaatcctaaaaatgtgtacctcatcagaggtcttgatttccaccttaatctagctcagaaagaaggccattgtcgcacgttgcttgagtctccaaccggtactgccaagtccctttcacttctatgttcctctctcgcttggcagcaccattataaatctcaacaacaccatctcaagcccgtgtcggaggcaaccactgatcctctggctcatggtggcagatttgttcccgacaattgtcctgcttttagtttcagaaattcccgaccatacgcaaactga

SEQ ID NO: 59238 - DNA, 1020 bp, Glycine max
  Peptide Sequence Number=SeqID_176016
atgtcaaggaaacactcatggaacagcccgaaaaggactgggctttgtgaacctcagtctggagagcctgaccttgcaaattgtgtgtttgaatacacaccggaggcttcagcagaaaacctagcaaattacaaatccaaaaatcaaattgtggcatggcaacttaagggagataaacatttgacttttaagaagaaattattggagaactttgcttatatggtgtacttggagcactgtctgcttccaagagaagcttataggattgtcaatggtcttctgaaaactgctttgggaccacccacagggtcaaccactgctttgtctccagcacaggatattactttccgacatgaatctgtgaaatgcttggtcagcattattaagtcaatgggagcatggatggaccagcagataaggataggagatttagatctagcgaagagccctgaaagcagtagtgcagcagagaatcatctaatactaaatgtagaagaaggaaatgcttctgatcacgagctacattctgatgtaaattctgaattttcagaagctgccacattagagcaacgtcgggcatataaaatcgaacttcagaaaggcatatcactttttaatcgaaaacctccaaagggtattgaatttttgaaaagcaacaaaaaaattggtagttctccagaacaagtggcactgttcctgaagaacactgctggccttgatgaaaccaagattggtgactatttgggagaaagggaggagttttctctaaaagttatgcatgcttatgtagattcctttaacttcaaagggatggattttggtgaagctattcgattttttcttcagggcttcaggttgcctggtgaggcacaaaaaattgatcgcatcatggagaagtttgctgagcgctattgtaaatgcaaccctagttcttttagcagtgcagatactgcctacgttctagcttactctgtgataatgcttaatacggatgctcataataacatggtgaaagataag

SEQ ID NO: 59239 - DNA, 462 bp, Glycine max
  Peptide Sequence Number=SeqID_176017
atggcactagtatccgcacaagctctacttgcactgctttgctcagagaacttgagcacaacagttgaggatgaacaggacttgtcacttaggagacttaatgaatataaaaaagaaaagaccgtgggtgatgttcaccgaagtttgcatgggactcaggtggaacagtcgactaatattagcaatagcacattggaaggtctagagcaggccattctcaagttaaaaatagaaaggaaaactataatttcagaagcagaagtggacaggcttgccaaactaaaagcaagcagaatgaaagaacttgtttttaagaagaggtcagagttagaggaaatatgtagattgattcatattgaaccagatccaagtactgtggccgagaaagctagtgcattaatagattctggactggtggatccttctgagctatttagccaaaatagaagaacagataattaa

SEQ ID NO: 59240 - DNA, 1941 bp, Glycine max
  Peptide Sequence Number=SeqID_176018
atgtcaattgcaaatctcataacagtagatctggttcaagtaaaaggtggcaagaatgatccagatacagggactttgattgggattttgcaaaccgcacgacctcctcccaagtcccaaccctccctctccctcacgccttgctctctcagccaccgggaggtcagccgtcaaggaagaaagccatcgcgagcacatccagcagacgaccacgaagccactgcagtcagtcacttggtcgggacgctaccgcttgtcacccatttacgagctcacaccgtcgcgattccaccgccgacagccactgtgacccgcccccttggtggtgggggtcatcatgtattggactacttgaagcgcatgcaggcagagaatcctgctttcttctatgcagtccaggatgacaataatctcgcgtgtgggaatatagtttgggctgatgcaacatctagaacaaactactcttattttggagatgctgttatattggacacaacctacaagactaaccgataccgggtgccatttacctctttcactgggttgaatcatcatgggcaacctgtgttatttggttgcgcattgattttcaatgaatctgagtcgtcatttatatggctattcaggacttggcttcatgccatgtctggccgccaccctgtctctattacaacagatttggaccctttcatacaagttactgttgcccaagttctcccttcaactcgccatcggttttgtaaatggagcatatttagagaaacccgaagcaaactggctcatttatgtcagtcacatcctgattttgaaactgaattcaagaaatgcgttcatgagagtgagactattgatgagtttgagtcttattggcacccactcttggaaagattctacgtcatggacaatgaatggcttcagtcaatgtacaatgcacgacaacattgggttcctgtgtacttgcgggacactttctttggagagatatctatgaatgagggaaatgaatgtttgaattctttctttgatggatatgtgaattcatccaccactctacaggtattggttagacaatacgagaaagctgtgtcaagttggcatgaaagagaattaaaagcagattatgacactactaatagtagtccagttttaaaaacaccatctcctatggaaaaacaagctgcgagtctttacacgagaaagatattcatgaaattccaagaggagttagtagagactcttgcaaatcctgctacaaaaattgacgattcaggaacaatcactacatatcgagttgccaaatttggggaaaaccaaaaatctcatgttgtgacttttaattcttttgagatgaaagctagttgcagctgtcagatgtttgaatattcaggaattatttgtaggcatatattgacagtcttcagagctaaaaatgttctcactcttccatctcattatgtgttgacacgctggacaaggaatgctaaaaccagtacattgttagatgaacatgcatctgaattgccaagtacttcttgtgagtctgtaatagttcgttacaacaatttacgccaagaagcaatcaaatatgttgaagaaggtgcaaaatcaatccaagtctatcatgttgccatgagagctctgcaagaagctgctaagaaggtttgcgccattaaaaatcatagttctggaacagcagagggagctacagtaaccaatggaagcaggggtgaattgcttgtagcagatgaagatgctccaagcaatcaatctgtggcggagaaggaaaagaaaatccgagagttgactgctgagttagaggtcacaaatcaacgatgtgaagtttatagagcaaacttgctgactgtgctaaaggatatggaagaacagaagttaaagctatcagtaaaggttcaaaatgcaagatttagtttgaaagagtga

SEQ ID NO: 59241 - DNA, 714 bp, Glycine max
  Peptide Sequence Number=SeqID_176019
atgaagagggagtctgattgtggcgaagcgggttcttcttcttggtgtgtgggaaagaagcagaagcagaagcggttaatggaggatgcaggagggtggaaggggaagatatcatcatcatcgtcatcgtcggagccacgtccctgtaccgagtgcggcaagaagttctggtcgtggaaggcactcttcggccacatgagatgccacccggagcgtcactggagagggatcaatcctccgccaaatgtgatcaggagacaacaacaaatgacccaggaagaccacgaggtcgctgcctgtttgctcctgcttgccaacgccaaagacaaagacaaagacaaagaggaagatgttcatttcgagtgctccagttgcaacaaggtgtttgggtcccaccaggctcttggaggacaccgtgccagtcacaagaacgtaaagggctgttttgccaataatgctgccataggaacgtcgtctagtactagtgatcaggagaacatgatgattcttcatggtcacaagtgcagcatttgcctcagggttttctctactggtcaggcacttggtggccacaagaggtgtcactgggacaaaggggacaacctcggtctccttgcagactcgtcatccaagtctctctctctcgtcgacttgaatttccctcccccttccttctcctcccccctcgctctcgatttgaggttgggactctag

SEQ ID NO: 59242 - DNA, 498 bp, Glycine max
  Peptide Sequence Number=SeqID_176020
atggctttccagatgacaaaggctgattttgttcgaaacaaccgaggaatagatgatgggaaggatttaccagaggaatatcttggggcaatttatgaccaaattgttaaaaatgaaattaaaatgaatgctgattcttctgcacctcaaaataaacaagcaaatagcttcaatagattgctgggattagaaggtatactcaatcttgtgaactggaagcagagtgaggaaaaagcagtgggtgcaaatgggcttctcattcggcacattcaggagcaatttaaatctaattcgcgaaaatcagacccacttttggtcttgtcagaacatgggttatatgagcttaactcaatcctacaaaaccggcttgacttcaacatggccccttttgcccacagctacccaccatgtgggactttcaacacacaccctctatcaagggctgaccacaatttaggtggcttttccaactggtccttatcaaggggactaaaatga

SEQ ID NO: 59243 - DNA, 537 bp, Glycine max
  Peptide Sequence Number=SeqID_176021
atgttgtttgccttcatggggtgctggtcgtcgttcctggtccgtgctcgtgtcgccgttcgtgccgacgttgactgcgttctacgtgcagactgtagagggtgtcacggctgggtgtggctgggtgcagctgggtgcgggtgggtcacggtatggacgctgggtgctggggagggtgcggctggtgcgtgggagaggagggctaagcttttgaatgaattatcgggtagggttgggtcgggtcagcccaactcctaccgtagacaaaaaacaaaaaaaatccgtcattttccgcctcgccgccatgaccgccatctgcaactcgccacgccaccgctattcggtggcgttttttctaaaaaccactacgcaattctgccatggcgccgccatttaacaacactggccacaagggccatgacatgctaccctattctacctccacttggttttcttcttcaagaatttggattttcctcaattcctcctgatcttcttcattctcggtcaaatctcaattcctcttcatggaagtga

SEQ ID NO: 59244 - DNA, 1632 bp, Glycine max
  Peptide Sequence Number=SeqID_176022
atggccgaaaactccacttgcacttgcttcgttctcaaaacagaagtcaacgaggctcgtcgcgtgttccaaattgacgatgagaaacccccagaagaacctgtgtgggtagctatggctattgggtattcgagaaacgggttctcccatgaagctttgcttctttaccgtgacatgttatcatgctgtgtgaagcctgggaatttcgcgttttccatggccctcaaggcgtgttctgatttggataatgcgctggttggcagagcaatccatgcccaaattgtgaagcatgatgttggagaagctgatcaagtggtgaacaacgcgcttttggggttgtatgtggaaattgggtgcttcgatgaggtcttaaaggtgttcgaggaaatgcctcaacgaaatgttgtgtcttggaacactttaattgctggttttgctggtcaaggtagagtatttgagacactttctgctttcagagttatgcagagagaaggaatggggttcagttggattactcttacaaccatgttgccggtgtgtgctcaagttactgcacttcatagtggcaaggagatacatgggcagattctaaagtctaggaagaatgctgatgtgcctttgctaaactcattgatggacatgtatgccaaatgtggagaaattggttattgtgaaaaagtgtttgacagaatgcacagcaaggatttgacctcatggaatacaatgctagctggattttcaatcaatggtcaaatacatgaagctttgtgtttgtttgatgaaatgataaggtatggcattgaaccaaatgggattacctttgttgccttgctgtccggttgtagccattcaggactcaccagtgaggggaaaaggttgtttagtaatgtgatgcaggattttggggtgcaaccatctttagagcattatgcctgtttggtggacatattaggcaggtcagggaaatttgatgaggcattaagcgtggcagagaacattccaatgagaccaagtggcagcatttgggggtcattgcttaactcgtgccggctatatggaaatgttgctctagctgaagtagttgcagagcgattgtttgagattgaacctaacaatccgggaaattatgtgatgctttcaaacatatatgcaaatgcagggatgtgggaagatgtgaagagggttagagaaatgatggccttgacaggaatgaagaaagatgccggatgtagttggatacaaataaagcataagattcatacatttgttgccggagggagctctgattttcgttgttctgctgagtataagaaaatttggaacgagttgtcaaatgccgttaagaatttgggatatgtccctaacacgggtgttgttctccacgatataaatgaagagatgaaagcagtatgggtttgtgagcacagtgaacggcttgctgctgtctttgcactaatcaacactggtgctggaatgccaattagaatcaccaagaatcttcgggtttgtgttgactgtcattcctggatgaaggctgtttcaaaggttacaaggagactaattgtattaagagacacaaacaggttccatcattttgaaaatggctcttgttcttgtaaggattattggtga

SEQ ID NO: 59245 - DNA, 1095 bp, Glycine max
  Peptide Sequence Number=SeqID_176023
atggctcaaacgttaaaacttaaaacacgtctgtctctgttttgtggtgagaagaagagagagacagacagaacaatgggggaagcaaagggaaaggaagaagaagtgttagcatcagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatgctagactggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgagaacaacattccagttttctgtccgggcttaactgatggctcattgggggacatgctgtacttccattccttccgcaatcctggtctgattgtggacatagtgcaagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaaggtacactgtgatgcaacaatagcatttcctctgctggttgctgaaacgtttgcttcaagagtgaaacctcaccattga

SEQ ID NO: 59246 - DNA, 345 bp, Glycine max
  Peptide Sequence Number=SeqID_176024
atgtaccctctatttataccacaaaggatataccctccaatgtgttgggtgcagcctgcaaatgaaggatcttatgactttgccttcattgatgctgacaaggagaactatgtgaactaccatgagaagcttataaaactggtcaagattggggggctacttgtatatgacaacacactgtggggtggacgcgttagctggcctgaagacaaagttccaccacacttcagaccagggagggacgcagcaattgaatttaacaaaacaatcacaaacgattctcgtgttgaatttgctcttacttccgtaggggatggtctcaatatttgtaggcgcattgcttga

SEQ ID NO: 59247 - DNA, 867 bp, Glycine max
  Peptide Sequence Number=SeqID_176025
atgtttagccggatgttcggtaaacctaaacaggaaaccaatgctgttgccactttggacaagctaaacgagttatacttttatatttccctcttagttgctatcagacttgtcaccaatcgccatgacagctgcaaggtctcggattcgagccttgtggatggaaaaaaacatggttgggaggggagacctactaaatgttgccagtctggttttccgtatctccagaattatcacactagttggcagaatattattgcaattcttctgagtcatggctcgacacttgaaatgctggagaaaaaggagaaagtgctccttaaaaaggtggcagcggaagttgaaaaggccaaagaattcacaagggggaagaacaaaagggcggcaatacaatgtctgaagaggaagaggttatatgaacagcaaatagagcagcttggaaatttccagttgcgtattcatgaccagatgatattgttggaaggtgctaaagctaccacagaaacggtggatgcattaagaactggagcagctgctatgaaggctatgcaaaaagcaacgaatattgatgatgttgacaagaccatggatgagatcaatgaacagaccgagaacatgaaacagattcaggatgcattgtcagctccaattggtgcagctgctgattttgacgaggacgaattggaagcagaacttgaagaattggagggtgctgagttggaagaacagcttcttcagccagcaactacagctcctgcagccccagtgcaggtcccagctgggcgccaacctactcgcccagttcctgcaaagcgaactcctgaagaagatgaattggcagctttgcaggctgagatggcactttga

SEQ ID NO: 59248 - DNA, 519 bp, Glycine max
  Peptide Sequence Number=SeqID_176026
atgtatataaatctcccaatttatggttctttttggcaaaaaggagctattttgaagaagtttcaaaggagtcatcacgctaaaggcctgaagagtgtgaatttcaaagagtgtgaagcagagcaaggggccaagttttcatcttttagggagattagtgagtttttgagtgattgtgagattcctagaggtggaggagacatccccactcctttgttgttttatgtgttcactgcttctatctatgcttattgtatgcatgcttgtcgcttgatcacccatttgtgtgtgctgttagggactttagcattgggaaatcatcgccaggaccctaacccttatcagttgcctactcccaagaagttcatagccattgtcgcatggcccgaggataggcctaattttcaagatgaggcacatcctacaggggctcaaggagctacccaaggggatgaaggcggagctgaggaggatggagacatggaagatttgcttgatttcttcattggaggagactga

SEQ ID NO: 59249 - DNA, 468 bp, Glycine max
  Peptide Sequence Number=SeqID_176027
atggagtgctctccccgtcggaaagcgagagtatttccggcatgggtctgttttacacgtaaaacgcatgcatgcacaaagcaaaccgccagtggaactagcgagtttgttgtccgtgatggactcgccatccccaatggcgatatcaccatgcatggagaaccgccagtcaaattggcgagttccagcataagaggcacaggaggcgtaggctcaggcttttcaattggcaggcgctttggcaggctaaagggaagtcgccactgccattggcgagttagcctaaactggagttgccattggcagtggcgagttaggcaaataaattggagttgccattggtattggcaagttaggcacatgggagttgccaatggcattgacgatttagagtctttatgtacgtccctcatcttcaaacttgcttcagtgtgtgttgaaaattttcagtattttcaaaacttctga

SEQ ID NO: 59250 - DNA, 239 bp, Glycine max
  Peptide Sequence Number=SeqID_176028
atggaggagtttgatgctcaggtggcctggccaggagaccaactctcttcttctggagggggtggagcctctgcagcccaggagcctgatattgaggagccaccagcaccagcaccagcagaggaggagactactcctgaggagacccagccatctacaccagttgtggagccagagagagcatcatccacagaagatggttcaaggcaaatttgtcccaaatttggaggaggcactgg

SEQ ID NO: 59251 - DNA, 237 bp, Glycine max
  Peptide Sequence Number=SeqID_176029
atgaagaacgcgttcgacaagaaggtgcgctcgcgcaagttccatgagggggaccttgtgctgaaaaaggtgtcccacgccgttaaagataatcgagggaagtgggccccgaactatgaagggcctttcgttgtaaaaagggttttttctgaaggggctctggtgctcaccaacatggatggcgaggagctaccttcacctataaactccgatgttgtcaagagatactacgcttag

SEQ ID NO: 59252 - DNA, 276 bp, Glycine max
  Peptide Sequence Number=SeqID_176030
atgaaggtgaaaaagaggctaagttttgaattgcaaaaagtagaagttgggctaagctcagtggtgccttcagccaggctatgctcgagactggcgctaagcccaatttcatttactcgcgctaagcgcgagggtggcactaagtgcaacaccgtgatttcaaagcctattttgtgcagaattagggtacacaatacccagggcatagattctacatcagccatagtgcctatcagccacagggcaaagaggagcagcttgtgcattgaagcctag

SEQ ID NO: 59253 - DNA, 177 bp, Glycine max
  Peptide Sequence Number=SeqID_176031
atgaagacagtacaagtggaggcttcaatccctgctccgtctctcttacgtttgagaactctatcggagcagtcggaggaaaaactggaggaatctcaggaaaccgctagaaatgccgctgtcactgtcgaaagacatgtgagtctgcttagaggggttttagtccccaagttgtga

SEQ ID NO: 59254 - DNA, 2643 bp, Glycine max
  Peptide Sequence Number=SeqID_176032
atggcaagttcaatcgggtgcatactgttgttgacactttgtgttgtcctcgtagctttagttcatgcacagcaacaaataggcttcataagcattgattgcgggagtagtccaccaaataatgagtacacagatgacataactaaaataaggtacaccactgatggagcctatatacaaactggggttaataagaatatctcctctgagtatgcatacccaaagaatccgaatctgccactaccactctcagatctcagaagctttcctcagggagaaaggaactgctataggttagtagccggaagaagaggcagtttacatttgataagggcttccttcttgtatggaaactatgatggagtaaacaagccaccagagtttgatctctatgttgatgtcaagttttggtcaacagtcaaatttagaaatgcctcagaagaagttactatggaaataataagtgtggcagaatcaggtgtcacacatgtttgccttgtgaataagggagcaggaactccttttatctcaggattggaacttagaccacttaatagttctatttatagcactgagtttggggaatctgcttcactgtcacttttcaaacgatgggacattgggtcactcaatggaagtggtagatatgaagatgatatttatgatagaatatggtcccccttcaattcctcatcctgggaatctgtcagcacttccacaccaataaatgtcaatgatgatggatttagaccaccatttgaagtcattagaactgctgctagaccaaggaatggcagtgatactttggaattttcttggaccccagatgatccgagttggaaattttatgtctacttgtactttgctgaagtggaacagctggagaaaacccaactgaggaaattcaatatatcttggaatggatctccattgtttgatgattctctagtaccgcgccacttgtttgcaaccactctttccaattcaaaatccttggtagcaaatgaacataggatttctatccacaaaacaaaagattcaacgcttccacccattcttaatgcagttgagattttcgtagcaagacagctagatgcccttgcaacatttgaacaagatgttgatgctattctgtccataaaggaaagctatagaattcaaagaaattgggtgggtgatccatgtgagccaaagaactattcttgggaaggcttaaaatgcaactatagcacctcacttcctccccgaattatatctctgaatatgagctctagcagtttgagtggaataataacttctgccatttccaatctctcctcgttggaatctttggacttacataacaatagcttaactggaacaatgcctcagtttttggaagaattgaaatcccttaaatatttggatttaaaggacaatcaattttcaggttctgttcctaccattcttgtagaaagatcaagggatggattactcacgttgagagtggatgatcaaaatctcggtgactcaggagggaacaataaaaccaaggaaattgtcattcccatagtggtatcagtatcagttttagttatagtggttgctttcattctcttttggaaacttagaagaaatgaacgatcagacgaggagattagtacgctcagcaaaggaggaacaactgtaacaacgaagaactggcaatactcgtattcggaggtcttggacatcaccaacaactttgaaatggcaattggtaagggaggatttggaactgtgtactgtgggaagatgaaagatggcaaacaagttgcagtcaagatgctttctccatcatcatctcaagggccaaaggaatttcagactgaggctgagcttttgatgacagttcatcacaaaaatttggtatccttcgttggttactgtgataatgataacaagatggcactcatatacgagtacatggccaatggcagcgtgaaagattttatcttgctctcagggttggattatctacaccatggatgcaagccacctattatacacagggatgtaaagtcagccaacattcttttaagtgaagacttagaagccaagatagcagattttggcctctccagggagtttaggacagataaccaagatcaacaatctcaagtgattcacagtgatgctacaaatgaaaaatctgcagtaatgggcacaacagggtaccttgacccagagtactacaagttagggacactgaatgagaaaagtgacatctacagttttggaattgttctactggaattactcacaggtcgccctgcaatattaaaaggcaacggaataatgcacatacttgagtggataagacctgagcttgaaagacaagatttgagtaaaattatagatccaaggctacaaggaaaatttgatgctagttctggctggaaagctttaggaatagcaatggcatgctctacatcaacctccactcagagacctacaatgagtgttgtgatagctgagctgaaacagtgcctgaaattggaatcccctagtgatacttctgaaaaatttgtggcccctccaaaacaagtctacggcgaattttatagttcatctgaagcattttcctatgatagtcaatctatcacctatcctttcccaagatag

SEQ ID NO: 59255 - DNA, 531 bp, Glycine max
  Peptide Sequence Number=SeqID_176033
atgactcaagtagggtggtcccttatagcagctcaactgccagggagaacagacaatgatgtgaaaaatcactggaacaccaagctaaagaaaaagttcttggcaggaaacactagtagtagtattgccaccacaagcaacaatattgtcactttcagcaatactagttattctcatcaagttgagggccttgtcttggatcaaaaactgaacccagctaattggtttgactcctacgatgttaatttcgaattggaacaaacaccaattccagttccttttccaatgcctcaggaattagaagcttttaattatactgggagcataagttgtagtactgcaccaccaccctataaggaagtttcattaatgctttccaatgcagacaaacatacactatggtttggttatgaccaagcaagtgaagatgatccaaatttgcttgagtttgtgcttgatgatctgcatcagatgaatcaaggatttgtttttcaagacaaaagcagccaagttggtccaccatctggctaa

SEQ ID NO: 59256 - DNA, 423 bp, Glycine max
  Peptide Sequence Number=SeqID_176034
atgaccgaacgtagctcagatgccactgttgctgcgatacaatgtctgatgagggaaaagttatatgaaaaccatatagagcagcttagaaatttccagatgcgtattcatgaccagatgataatgttggaaggtgctaaagccaccacaaaaatgatagatgcattgagaactggagcaactgctatgaaggctatgcaaaaagcaatgaaatttgatgttgttgacaagatcatggatgagatcaatgaacaaactcagaacaagagaatgattcaggaaacattgtcagctccaactggttcaactgcttattttgataatgtctcagtcgggcgacaacctactcgcgttgttcctgtaaaggccactgttcttgaggaagatgaattggcagctttgcaagctgagttggcactttga

SEQ ID NO: 59257 - DNA, 297 bp, Glycine max
  Peptide Sequence Number=SeqID_176035
atggaggccataaaagagcaaatggccacaatgatgaagaccatgatgagcatgaagaagataatggaagccaatgcggttatagttgccactattagcgctgtcgctaaagtgaacccgatgctcccatctggcctcaagcaaatgaatcatccaacctcaaatatggtaggcaaagatttgggaaatacggataaccccatgatgtgcaaaatcaaaacgagcacgccttcccatcatatggcttgcctcccaaactatacaccacccaatgtggtgtacattcccaatgaggac

SEQ ID NO: 59258 - DNA, 357 bp, Glycine max
  Peptide Sequence Number=SeqID_176036
atggcagaagaggccattcttccaatggttacgcttgaggatcatgccacatacactggacccttgcacttcaagacaattgcaaggccagatttcaccaatatggtccaaagattaacaagggaaaggttgttatatccatcttccaaaaaacttatgatgaaaagtcttggagaagattggcaaagatttagatatttgttgaggcaaacccccacccgtggttttgatgaagcactccaaatcaacatgctcctaggtggattaagagttcaaagcaagcttatgcttgatgcttcagttggtgggaaaatctctctcaagactccaagagaggctatagagatagatcattga

SEQ ID NO: 59259 - DNA, 1227 bp, Glycine max
  Peptide Sequence Number=SeqID_176037
atggctgttgtgagcccaaatttattgacaaattcaaatatcttgaagttgaagcccgcttgctattactttcttcctctaattatgcttttaatttgcattcttgaaagggactttatgtggaataacataagtgggagtataccaaaggagattggcaatatcaaaactttgagactcttactcctgaatggaaataaactaacaggtgatctgccagaagagcttggccaactttcagtcctgaacagaatacaaattgatgagaacaatattacaggatccatacctttatcatttgcaaacctgaacagaacagaacacattcacatgaacaacaattcacttagtgggcaaatcctacctgagctttttcaactaggaagccttgttcatcttcttcttgacaacaataactttacaggatatctcccccctgagttctctgagatgccaagcttaaggatacttttgtgcatagatcaccttgcatcactttggcttgctctccccctaaagcctccccgcaacagtcaacttgataacaatgactttggtggaaatagcattccagaatcttatggcaacatctcaaaattgtcaaaattgagccttaggaactgcaacttgcaaggaccaattcctgatttcagcaggataccacaccttgcttatcttgacctcagtttcaatcagttgaatgaatcaattcctactaataagctttccgacaatatcacaaccattgacttatcaaacaacaagcttactggaacaattccatccagcttttctggtcttccacgtcttcagaaattgtcatttgcaaacaattcattgagtggatacgttccttctaccatctggcaggacaggagcttaaatggaactgaacgacttatcttggacatgcaaaataatcagctaacaatcatatcaggcactacaaatcttcctccaaacgtcacactcttgcttgagggaaatcctgtatgcacaaataataacaccttagttcagttctgtggaccagaaattgacaatggcttgaatggaaactacagtgttaactgtcccagtcaagaatgcccctctccttatgaatacactgtagagtgtttctgtgttgctccattggttgttcattatcggttgaaaagtcccggattttcagatttccgtacatacgagagaacatttgagagcttcttgacagatggtcttaat

SEQ ID NO: 59260 - DNA, 618 bp, Glycine max
  Peptide Sequence Number=SeqID_176038
atggcagaggtctccattgaggccattgcctccctcacccaatattatgaccagcctttgaggtgcttcacctttggggacttccagttaacacccacagtggaagagtttgaagagatcctggaatgccctctgggaggaaggaaaccataccccttctcgggattctatccctccttatctagaatttctaagatagtcaaaatctcgacacaggaattagaccgcggaaagcaagtcgaaaatggggtggttagggtaccaaggaaatgtttggaagcaaaggcaagagtcttggcaagtcaaggcgaatgcgcccttttcatggacatcctggcacttttgatcttcggagtggtcctctttccaaatgtggatgggttggtggaccgggcggtgattgatgcttttctcgccttttacgaccgcaaagaaagcccaattgtcgctatcttagccgatctatacgacacattccatcgaagatgtgagaagaacaatcaaacaaagaagaagcgtctgtcaattggttccccctacacacaagatctggattggctcccgagtttgaggaccactaagggggtggaggttgaagctccggaagaagacgaagag

SEQ ID NO: 59261 - DNA, 397 bp, Glycine max
  Peptide Sequence Number=SeqID_176039
gcaatcaattcgcggggttccagactcgatggtggaggacgcatgaacaacgctaggcaatcaattcataggtctccgaataagattgagaatggagaattggcgaacagcgctaggcaatcaattcgcggggctccagactcgatggcaatcaattcgcggggctctagactcgatggtggaggacgcatgaacaacactaggcaatcaattcatgggtctccgaataagattgttggcaggaccgaacagtccaccgaggaagctgagtgttttggtcttttccttttatgtggggcgggatatcgccagtcgagaaaggcaattcgaaaggaagagacaccgaaaaatggtcttcctttgccggcagtcacttatctcgccgacaattcatctg

SEQ ID NO: 59262 - DNA, 618 bp, Glycine max
  Peptide Sequence Number=SeqID_176040
cgccgtcaggccgtcgagcggacgctgctccagacagcccatattgagctcgcgcaggcgggcatcgagcgtcaccgtacaaccgcaggcatcagcgataatctccgcggtgcgccggccaccatcaatccggcaaaaatccgcgcaattgctcaggcgttcaacgacgttttcggcgaaggatcctgccatattgaaggggtcgaggtcgagagcggcgtcgccgcgcagcccttaagcgatgccgaaacgcgaactggcgcacgccagcgtgtggcgaacgcgcgtcatgtgcggccacaggcggattactgggtggcgattgaagcgggcatcgagggcgactgcgcctttgcctggatggtggtggagaatgcgcagcaacgcggtgaatcccgctctgccagctttacgctgccgccggtggtgatggccggtctggctgccgggcatgagctcggtgacgaaatggcgcgcttaaccggcgtggagaatatcaaacacaagggcggtgcgattggcgccttcagccacggcctgctgagccgctccagcgtctatcatcaggccctgattctggcgctctgtccgttcacccacccgctgtatcagcagtaa

SEQ ID NO: 59263 - DNA, 390 bp, Glycine max
  Peptide Sequence Number=SeqID_176041
atggacgcatctctggtcaattctccaaaggctcgtcaaacccaaggtccgcccttggtgagtttcataggttcacaaaacccaaggtccatccttggtaagcctcgatgcagctctacatgcttgtcaaaacccaaggcaaacacaaccctagtccaaagctcgttaaacgaaagtaatacaagaatatcaaaaacccaaggtccacccttggtaagcactcgtacaaaacccaaggcacccaattggtcagctcactccttaagaaccacaatgaccacaatcaaaggtccaggttccacaagacgaactataaccacaatggtcagcaagaccttcaatcaggtgaaagtcatacttactccttacaacaggggaaaagctcaatag

SEQ ID NO: 59264 - DNA, 594 bp, Glycine max
  Peptide Sequence Number=SeqID_176042
atggtggcgtgttcttgcatacgtgacaatcatggaatgacacgtactagagacatggtggtgtgctcttgcataagtgtcacttgtggaatggcacgtactagagatgtggtgtcgtactctttcatacatgtcactcgtggagtggcacgtactagagacgtgttgggaccaagctttcctgcccagggatcttttctggcttcgcctcggactcgccacacgaggttgctgggtcgaaagggccccaaggatgactttgttggctgcctctgcctaaccgttggtctgaggatgctcgatagagggcctttggcagtgtggccccaatatgtccactccttacatggcaaagggccaatgggagctcagactgtggagattgttaggagaggtgcatggaatgtctgcaaactcttggcatcgcctgcatctctttgtgaagtcaagggtgtctacactgagtgttggccaatagtagccaacatgcaccacctttattgcaagggatcgtccaactgtatggagactgcaaattccttcgtggagttctttcatgacataatctgcctattggctctccaggcactttaa

SEQ ID NO: 59265 - DNA, 216 bp, Glycine max
  Peptide Sequence Number=SeqID_176043
atgtccaaacggtgctatgatagataccttccctcatgggttcataatattgcaagggagcattttctagatgtttttcgtaacctcttgtatctttcaaaccatttttgcaacctacccgtcgatgggagggtgaggcgaaaggtaaaagtgtgtcttctcatgaagaaaaatgcgtgggagttgctaccaacgtttattcgagggaaaatttaa

SEQ ID NO: 59266 - DNA, 615 bp, Glycine max
  Peptide Sequence Number=SeqID_176044
atggtcttacaaggccaatgggttcacttaatattcccagtggtgtttaggttgactacaaccttggatgaagttatagtgtatcctattccagcagcactttaccttgtcaaaaatttgcttcagtattacatctttgcatatgtagatgctccaggctatcaaatattgaagaactttaatatcatcagtacaggtgtcctatacagaattatacttaagaaaaattctgatcgtgttcttcaaactccctttcaaggttgggtgatggcaattgtcatggctctcttgagtggttttgcaggagtatatactgaggctattattaaaaaacgtccttcacggaacataaatgttcagaacttctggttgtatgtctttggcatgtgtttcaatgctgttgcaatattggttcaagattttgatgcggtgatgaacaaaaaaacttgtgttagtttaggaggggctctgtcaaggacaagtctgcttcttgctttcactataggtcgaaagaagtcttccgtgtctaggccggcgactcgatcctatgctaaggggattcttccatggatattcattcattacagttctgatgattttcaaccatgcactcag

SEQ ID NO: 59267 - DNA, 354 bp, Glycine max
  Peptide Sequence Number=SeqID_176045
atgtcgatatatcacgagactcaatccgacatccgagttaaaagttattgtcataggaatttgctcagagcttcagttcagaatttcgagtgtctcgatatactacgggactcaatcggacatccgagtaaaaaagcttctgtgttcaattacgagtgtctcgagatattacgggattcattcggacattcgagtaaaagagcttccgttttcaattacgagtgtctcgatatactacgggattcatttggacatccgtgtaaaaagatattgtcgttttattttggtcagagcttctgttctgaatttcgagcgtctcaatatactacgggtcacaatgggaaatctgaataa

SEQ ID NO: 59268 - DNA, 705 bp, Glycine max
  Peptide Sequence Number=SeqID_176046
atgaaatctcataaatcaacattgatggaaatgaatgtcatgaatgtgaagattgtgcaaaagaacccttcaaatgaacacgtaggagaagagcagacaattacattgacaaccaatcaagcatgtagtctctctggatctactattgaatttgactcgcatttgcacaaaaacacctcaccaaggcgtcattggattcaattcaatgagagcagacaagtccaaagtccaagcataacaaaaaaaagagagaaagaaataatgagctccatgggtgagagccagcagcggagcttgtttgggagtaccaaggcatcgtctctgccagtgtcaacgtcgcgttcagactctgaaggaggccttcgcagacgtctttcttctctgtctctgaagatccaattagagagcccgaattcctcctcatggtcatttcccagatccaagtccctctcatccatgggtgactatgcaaggacatggtgggactggagctgggcctggatcctctccaggaagctcatcttcgctacagatctcgaaatgaacgaccaggaaaccaagctccttgcttctcataacaggggcacttggagacatgttttctataagctgcgctctgagatcagaaggttcatcaatacttctgatcacaccactcttcccaaaacctaccaccacaagtccactcctcaagtcttctcataa

SEQ ID NO: 59269 - DNA, 420 bp, Glycine max
  Peptide Sequence Number=SeqID_176047
atgggattacggttttgggggataaacttgctcagagaagctgcaagttgtctttcaaagcaccattgcctcttgatacaaccgccactccaacccatgttactaaatggtaccgtttcattctccaataatacatatttaagtggtacgaagaaggaaactctggatttcggtgctttgagcgtttttgatggagggaagcagttacttgataacatattgagcattgatatgagtggattgactggacctattcaatttggttcagatagatctcctctaaatccatcatgtgtcatccttaatgtaattgctacaggttataggggtatcggctactggtctaattactctggcctctctgtaataacccctgaaaaacttcacccaaagcctgccaatcattcaatttcaagctag

SEQ ID NO: 59270 - DNA, 2613 bp, Glycine max
  Peptide Sequence Number=SeqID_176048
atggccaactccaccccgcctgaacctcccctgaaacttgaagaaatcctcacccgcctctccatccaacagctttccttgggcgagaaacttgatgccctcctcactcacattaacccacaccacaatcctgtctcccctgttccttctcccaatcccattatccctcagccgcaaccttcttcacctgcacacagccacaaattcaagttagacgttcccctatttgatggtacaaaccccaatggttggatcttcaagatcaaccaattcttcgactatcaccagactcctccccaggaacgcttgaccatcgcctccttctacatggaaggtagagctctggcctggttccagtggatgcagagcaacggtcaactgacatcgtggccagtgttcttacaagctttgcagctccgttttgcccaatccccttacgatgaccccacgggtgctttattcaaactcacacagcaaggttcagtgagcacgtaccttttcgaattcgaggagctcgcaaatcgcgtggtaggccttccccaagccttcctgctcacgtgctttgtcgcgggcttgtcaccggaaattcgccgcgaggtgcagatcctgcaacccctgactctagctcaagccgccggtctcgcccgtattcaagaggagaagttcctcgagcagcatcacgcgtctcgcccccgtccttcccccgtcaccacaaccccgacattaccctcgtcctcttccttccctcgcacccacacggccgcaccacaacccttgaccccaaattcgaacaccctgtctccaccctttcctcctccgttacatcctccgccaccaacaaccaagcgcctctcaccggaggagattacctcccgccgtgagaagggcctctgcttcacctgcgatgagaaataccacagagacactacattccaggtggagtacctcggtcatatcgtctcccataagggagtggaaccagtcgccgccaaggttgccgccattcagcaatggcttgtgcccaagtctaccaaagctttacgaagcttcttggggctagctggtttctaccgcagtgcctttgacaacctcaagctttccttatccacaacacctgtgttaacacttcccaacttcgatattccgttcaccttggaatctgatgcctcaggggccggtatgggcgccgtcttgactcagaacggtcatcctatcgcatttttcagcaagccctttagccccaagcttctccggtcctccacgtacgtgcgggaactatgtgccattacaacagtaattcaaacccctgaacagcatatgtacctggcgcgtctcatggggtacgattacgatatccaataccggtccggttcgagcaatcaagttgcagatgctttatcaaggctaccagaacctccggcgaccttacatatgattctatctgtgcctagtttgaccttcctcgaagaattacgtcaccaattggacactaatgatgattattgccgcaaacaacttgccaatactcacaagcttactcaccgaatatcatgcaactcctactgggggccaccaagaccttggctcgcttatcggagaatttccactgacctggacctctcgcttgacttcattgtcggccttctggcatatcagggtaacacagtgatcctcgtggtcgtagatagattttccaaagggatacaccttggtatgttacccacatcttacacggctcacatggtggcgtcactattcatcaacatcgtggtcaagttgcatggtcttcctcggagtttggtctccgaccgagatccactttttatcagccgcttttggcaagagctttttcgcctgagtggcactctgttgaggatgagttcggcctatcatccacagagtgacggccagacagagatgttaaatcgggtgattgaacaatatttacgcgccttcgttcaccgtcgcccgggactgtggggcaaattgttaccttgggtcgagtggtcgcacaattcttcttggagtgtgagtactggttctacaccttacgaaatcacttatggccggaaacctttttcattcccagagtgcattgtcagttcttctaatatcgcagcggtagatgatatgcttgctgagagggacaccactttccaagcaattcgtcggaagcttattaaggcgcaagagaacatgaagaaatacgctgatacgaagaggagagacattactcatcagatactagaacgtatcggcgacgtggcatatcgtttagagctccctgaaggtgttcggatacacccagtgctccattgctctgtcctcaaagctttccaaggctctcctgattcagtcccgcaagttcaattacctccagaggcaatcaatggtcaacctttagtagttcccttggctattttggaccatcatcgcagttctaccgatgttgacgctccatgggagggctgggggagtgttagcatatcagaggcaacaagcaggacaccaggaaacagagacacgaagcagaagaaagtacaagaggtgcagatagcaaagaagcccaaaaggaaggttacgaggccagcttacttgaaggactatgcgtaa

SEQ ID NO: 59271 - DNA, 771 bp, Glycine max
  Peptide Sequence Number=SeqID_176049
atgagtttgggggtcgccgagggaacatatagttacagttctttgaaacagataagcttctttattattgtttcaggagaaaacacagttagttcacttggtcgagttgagttgataatctggctttttgtggttctgataatcaattcaagctacactgcaagcttgacatctattctcactgtgcaacaactgtgctcacctataacaagaattgatagcttgatattcagcagtgaacgtatagggttccaagtaggctcatttgctgcaaactatctgactgagcaactcaacatccccaaacataggcttatccctcttggctcatcagaagaatatgctgttgcctttcaaagccgaactcttgcaactgtggtggatgaacgaccctatgcgttcccgagagactctcctcttgcaattgatatgacaaccgcgattctaaccctatctgagaatgctgaacttcagagaatccaagaaaagtggctttcagaaaaggcttgtggttttcacagtactgaggaagaacagcttcaattaaatagcttccggggcctgtttctaatctgtgaaataacatgtttcttggcgcttcttacctacttttttttatcaatggtacggcaattcagtaagaaatcccctcaaaaagttggtccttctaatcgttgcagctcacgttctgcacacatccagacatttctacattttgttgacgaaaaagaagacgtatcacccaagaagttaaaacgaaaactcgtttga

SEQ ID NO: 59272 - DNA, 2136 bp, Glycine max
  Peptide Sequence Number=SeqID_176050
atgagcggagctggagctgttcttgttgctgtggctgctgctatcggcaacttgctgcaaggatgggataatgccaccattgcaggatctattttgtacataaagagggagtttaatcttcaaagtgaacccacaatagaaggtctaattgtggccatgtcacttattggagccactgtcgttaccacatgctctggacccttatcagactttctaggccgacgtcctatgttgatcatttcctctgtcctttattttgctagttctctggtcatgctatggtctccaaatgtttatattctcctctttgcaaggcttttagatggattaggcattggtttggcagtcaccttggtacctctttacatatcagagacagctccacccgagatcaggggattactaaatactcttccgcagttcactggttctgctggaatgttcttttcctactgtatggtctttgctatgtcactcaccaaggccccaaattggagactcatgttgggtgttctttcaattccctctctcatttattttgcactcacgctattcttcttgcctgaatctccaagatggcttgtcagcaaaggccggatgctagaggccaagaaggttttgcaacgacttcgcggcagacaagatgtcgctggtgagatggctttactagttgagggtcttggagttgggcgtgataccgctatagaagagtacataattggtccagcggtcaatgaattcagtgaggcagagcagatcaaattgtatgggacagcagaaggtgtatcctggattgctaaaccagtcactggacaaagttccattggtcttgtatctcggaagggaagcatggcaaatcaaagtggtctagtggaccctctagtgaaactctttggtagtgtccatgagaagctcccagaaacaggaagcatgcgaagcgcactttttccacattttggaagcatgtttagtgttgggggaaatcaacctaggaatgaagattgggatgaagaaagcatagccagagatggagagggagatgattatgtatctgatgccaacgaggattccgatgacaatttgcagagtccattaatctcacgtcaagcaacaagtgtggatagggacatgcctgctcctggccagggaagcagcatgattggtggtggatggcagctagcatggaaatggtctgaaacagaaggtgttttcaagagaatatatttacaccaagaaggtggtccaactggatctagtagacgtgggtctctcatttcacttccaggtggtgatggtgatggtgagattgtccaggttgccgctctagtgagtcagtcagccctttacaacaaggagcttatgcatcagcagccagttggaccagccatgattcatccatcccaaacatctgcaaaagggccaagttggagtgacctttttgagcctggagtgaagcatgcactgattgtgggggtggggattcaaattcttcaacagttctctggtataaatggggtgctctactatacacctcaaattcttgagcaggcaggtgttgggtatcttctttcaaacctgggcctcggttctacttctgcatcttttcttattagcagtgtgacaaccttgttgatgttaccctgtatagctgtggccatgagactcatggatatatctggcagaagaaccttgctgctgactacaatccccgtcttgatagtatcacttctcatattagtaatagggagtcttgtggaattggacagtactataaatgcttttatctcaacttcgagtgttattgtctacttctgttgtttcgtcatgggctttgggccaattcctaatatcctttgttcagagatcttccctactcgagttcgtggtctatgcatagctatatgtgctcttacattttggatatgtgacatcatagtcacctacacgctcccagttatgcttaattctgtgggccttggtggtgtctttggtatgtatgcggttgtgtgcatcatagcttgggtgtttgtcttcttaaaagttccagaaaccaagggcatgccactggaagttatcattgagttcttctctgtcggggcaaagcaagctcaagttgccaacaatattaatacctga

SEQ ID NO: 59273 - DNA, 5211 bp, Glycine max
  Peptide Sequence Number=SeqID_176051
atggatgctagagtcgcatcgttagaagaagaaatcgcgggagtcaaaaccacgctgtcatccatggaaagaaaccaagctcttctcatctcgatgatggagaagagccttgggaaatccatactcacggaggaagagggcgaagatggggacggaggtctggcggagtcaggcggagacgggtcggggaagaagacggcgagttctgcttcgcgaaagatgccgagcgacgtgatttctgagtttcgacaatcggcgaagagggtggagctacctatgtttgatggagaggatccggttggatggatctctcgagcagaagtgtactttcgggtgcaggacactactccggccgtgaaggtagatctgacccagttgtgtatggaggggccaactatacatttcttcaattccttactcaatgaggaagaagaactgacctgggagcgattgaagggagcgttggtggagagatatggaggccatggtgaaggagatgtgtatgaacagctgacagccctccggcaagtggggacggtggatgagtatatcaccgagtttgagtatctcacagctcaaattcctccattaccggacaaacaattttccggttactttttacacgggttgaaggcggatattaaagggaaagtgaggagtttattggcggtgggaaatttgagtcgagggaaattgctacaggtgacaagggtggtggaacgagaggttaggggtgatgctggaacgggtattagtaaacaccccaaatcgggtcatgggtcatccaaacctgggtttggtgggtccagtaagggaggtggagctgactgggtgatggtcaaagggaaggagaatgggcctagtggaggtagtaagggaggtggttttgggtccagaagtgaaaaaggaagaaacggcccacgtgatagaggtttctctcatttatcttacaatgagttgcttgagaggaaacaaaaggggctgtgtttcaaatgtgggggtccttttcacccaaaacatcaatgccctgataaacacttgagggttttgataactgaggaggaggaaacggaggaaggaggaggaaaactattggcagtagaagtggaagatgaagaaggggggtctgaaggagagatgagcatattgagcttactccagttgggccagttgggcactgataagcctcagtctatccagttgaaaggtgcagtgaatggggtgccagtagtaattttggtggacagtggggctacccacaactttattgataaaagattggtgcaaaaaatgagctgggctgtggacaattcaacttctatgtgtatcaagttgggagatgggactaaggcccaatccataggggtctgtccagacttgggcgttgaggtaggagaggtgcagttagcaatacgagcccatttgtttgatttgggtggtgtagatattgttttgggggtggattggttgagaaccttgggagatattattatgaattggaacaagcacaccatgagtttttggcataacaaaaaatgggtgactcttcaagggttgaatgataacatggaaaccttgaatagtattgtgggaggcaccaacagaggaggaaaagggtggatgtggagtatagagaagaagaggggtgatgagaatgatctcaatattgggcaacaaaaggagttggaggggttgttgtctaaatatgaggacattttcaaagagcctagggggttaccaccaaggagaaagaaagagcacgctatcaatttgaaaggagggctggaggctgtcaacgtgaggccttatagatatcctcatcatcacaaaaacgagatagagaagcaagtcaaagagttgttggcagcaggggtgataaggcctagcacgagctctttctctagtccggtgattcttgttaagaagaaggatggttcatggagaatgtgcattgattatagagcacttaacaaggccacaattccggacaaattcccaattccggtgatagaggagctgcttgatgaacttcacggagcaacaattttctccaaattggatctcaaatccgggtaccatcaagtcagggtccatgaagaagatatccataagacggcgtttcgcacccatgaaggacattacgaattcctagtgatgccttttggattaatgaacgctccctccacattccaaagtttgatgaatgaggtatttcgagtacacttaaggaagtttgtgttagtgttctttgatgatattcttgtttatagtagagattggactacacacttatgtcatttagaagaagtgttgagagtcttgaaattacatggtctggtagctaataagaaaaagtgtcattttgcacaaaaatctgtggactatttggggcatgtgatatctggaaaaggtgtagctgtggatcctaataaagtagaaagtgtggtgaagtggccaactcccaagaatgttaaaggggtgaggggattcttgggcctgacgggctactatagaaaattcataagaaactatgggaaggtagctagacccttgactgcattgacaaagaaagatgcttttacatggaatgaagagactcacaaggcttttgaggctttgaaagagagtcttacaactgctcctgttcttgctttaccagatttcactaaagaattcatcattgaatgtgatgcttcaggtgtggggattggagctatattgatacaagaaaaacgacctattgcttactttagtaaggcattaggggtgagaaatgtggccaaatcagcctatgagaaggagttgatggctgtagggttggctatacaacattggaggccttatttgttagggaggcgttttacagtgtccacagatcagaagagtctcaaacaactgttgcagcagaaaattgtaacagtagagcagcaaaattgggctgcaaagttgttggggtttgatttcaatattgtttacaaaccaggaaaattgaacggaggtgcagatgcactatctagagttcatgaaggaggtgaagtatgtgtgatgacttctagtctgcaatggaaggatgcagacattttgagagaagaatttgcccaagacccacatttacaaaagatagtaaatgatttacaacagaataaggactctaggccaggctttgaattcaagcaaggagtgttattgtatgacggacgactggtgatttcaagtaagtcagtgttgattcccactttgttgaaggaattccatgaaacttcacaaggtggacattctggtttctacagaacatacaggcggttggctgttaatgtgtactgggtaggcatgaaaaatgttgttcaggagtttgtgagaagttgtgatgtttgccaacgccaaaaatatttggctagttcacctggaggactgctacaacctcttcctataccagacagaatttgggaagacatttctatggattttataactggactacccaaatctaaggggtttgaggctattttggtagtggtagatcgtttatcaaaatattgccatttcattgctttgaagcatccctatacagccagaacaatagcagaggtgtttgtgaaagaaattgttaggctccatggtgtacctttatcaattgtaagtgatagagatcccatatttatgagcaacttttggagggagatgttcaaactacaggggactaagctgaagatgagtagtgcttaccacccagaatcagatggccaaacagaagtggttaatagatgtttggaaacttatctaagatgcttcatagctgaccaaccgaaaacatgggtgcattgggttccatgggcagaatattggtttaacaccacttatcatgcttcaacaggcaagactccctttgaggtggtttatggaaggactcccccaactattatacgatggatccaaggagaagttagagtggaggcagtacaaaaggagcttttagacagagatgaagctatcaaacaattaaaagttcacttgttgagagcccaagatagaatgaaacagtttgctgataagaagagatgtgacaggagcttttccataggagaatgggtgtttgttaagctaagggcccatagacaaaagtcagtagtctcacgtatttgtcctaaactagcagcaaaatactttggtccttatccagtggtctcacgcataggggcagttgcttaccaattaaagctgcctgaagactcccgcgtgcatcctgtatttcacgtgtccttgttaaagaaagctgtggggtcctacaatggagaggagactttaccagatgacttagatggagagaaggacaatacttttgaaccggacacagtcttggcacagaggactgtacaagtacagggtgaagaggtaaggcaggtcctagtgcaatggaaaggacgaaatatagaagaggctacatgggaagaggcagtgatgatgacaagtcagtttccaaactttagccttgaggacaaggcagtaatttcagatggaggtgttgttaggaatgaagggaataatggtggacctagtggaacgatggaaccaaatgaatccttactcaatcatgaggtgggccctagagaatggaaggtatattctagaagggagaaaagagtcacaaagggtgatcatggtggtgtccagtctgtgttttctggggacaaaaattttgatgaaccaaattggggaaccttcgacacaaatgatgatattgattcagtttggggattcaatgctagtagcttcactaaggaggagagagaacttgatagagctgggaacaactatttctttgattctggggaactgggcttaaaccccatcaaaacaggttcgccacaggctggtgatcccttccagaggagcagtggattcagttttgacgattctgttccaagcacgccacttttcagttcaagtagctctccgcaaaggccaaaagagtggttggaaactgcttttgacttctcaagatttgattccttcagaacacatgatagtgtacctttgcctgctcgggagacgacagaacaatttgattcagtgcgcaacagtgcggattttgaccatgctcatgggtttccagcttttgatgactcggatcccttcggctctggcccgtttaggacttcatcagataatcaaactccaagacgaggatctgataattggagtgctttttag

SEQ ID NO: 59274 - DNA, 654 bp, Glycine max
  Peptide Sequence Number=SeqID_176052
atggggatattttccttggaggttatagttgtcccccagccatttatccttccagaaactgatgttggacccccttcccaccctccatttaaggttatcaataaagcagttgttgtgctgctgctgaaagatgatcttcagatcctgccaccgttgagaagctggcaacctggtatccaagaaggagctgctgactgggatgaagattgggataagcttgaagataaagaactcactcttgacgtgcaaaacattatagcgcctccaaagcaaaagttgctgtcagctgtgaacacgaaagctttgaacacagaagctttgaacacggaagctgtgaacactgacagtcctacatttgctgcttctcccaagagtgatgataagtcaaaaaagccccagactaccaatgaacagggagttggtaatggatctgtttataataaaagtgaagatgggtctgtaaaaagtgctcccaatagtccatttgctagcagtgctattggaagcccgcatggggattttgattctaacataagaaagacagctggtgaagatagctcaccccgtgatcaagataccatacaagaaacccaaaggtatggttttttagatttgttcaccagtttcccaaatgctggccaagtgcttatatga

SEQ ID NO: 59275 - DNA, 438 bp, Glycine max
  Peptide Sequence Number=SeqID_176053
atggaaccttgcccattcttaaggctaaccatcgaccaaccttgcactcaaaattcccgtgggttccaaaatgcacactgttgttcgtcattcttcttctccatgcttatgcaaactcaagctcaagaactctatttgaatgtaaaagtcgaacccaatttggatttccaagagtataaccgtttttgctattttggaagagagacacccacccacccgcaagagttgagatggcgacgtcgacgtaagcatggaggctgtcaagagggctgccattcaggctggtggttttggttggtcgctgtcattgataatgagcaaactggacacctcattgcccaacatatgattcactcttttctcaaggatggctatttgaaggcttctgctaatcttaagcagcttgatcgccttggttctagacgcattctcaattga

SEQ ID NO: 59276 - DNA, 324 bp, Glycine max
  Peptide Sequence Number=SeqID_176054
atggttgtattgacaggtgataagggaggagaatcgttacctggaaaggacaatgatgacaagggttccacaagcatgattgtcgaagatggggaccactgtggagatggcatggtgggaggtattgggttagctatggaaagtataagggttataatgatgggaaacatagacatccgaaggattatggaggcctcaagatgtgatgccatggtttgtgagatgatgaaatcgagatatattttgttggtgatttgggtggatgaggcatgtggtagaggcctccctatgcggtcctctgagtattggaacccttgtctttag

SEQ ID NO: 59277 - DNA, 1017 bp, Glycine max
  Peptide Sequence Number=SeqID_176055
atggctttggcttcaaataattttagcgagtctgctcaaattggagaagggggctatgggaaggtttataaaggtcatcttcctgatggcactgttgttgccataaaacgtgcacaggagggttcactgcaaggtgagagggagttccttacagaaatagaattgctatcaaggctacatcatcgcaaccttctgtctctgattggatactgtgatcaagggggtgaacagatgttggtttatgaatatatgccaaatggagcgctaaggaatcacctttctgctaattcaaaagaacctcttagtttctccatgaggttgaagattgctctaggatcagccaaaggtcttttatatctacacacagaagctaatcctccaatattccaccgagatgtgaaggccagcaatatattattggactctaggtacacagcaaaagttgctgatttcggactttcacgacttgccccagttccagatattgaaggaaatgtacctggtcatgtatcaacagtggtaaaggggaccccgggttatcttgatccagagtacttcttaacctacaaattgactgacaagagtgatgtttatagtcttggtgttgtatttctggaacttgtgactgggaggcctccaatctttcatggagaaaatattattagacacgtttatgtggcataccaatctggtggaatatctttggttgttgataaacgtatcgagtcttatccttctgaatatgcggagaaatttttgactttagccttaaagtgttgcaaagatgaaccagatgaacggcctaaaatgtcagaagtagctagagagcttgaatacatctgttctatgttacctgagtacgataccaagggagctgaatatgatacaagtaattattctggaacagtatgcagttcacaaccttcatcatctactataaagactccttttatttcagaagatgtgtcaggtagtgacttggttagtggaggtatgccaaccataaggccaagatag

SEQ ID NO: 59278 - DNA, 252 bp, Glycine max
  Peptide Sequence Number=SeqID_176056
atggatcagctccaaggtcaagccttccgcaaggcctatgtgaagatttgggatctggctatgatagaagtctttgtcgaagccattgcatccctcactcagtattatgatcagctgctaagagttgtcctctttccaaatatggatggactgctggacttagcggcgatcgatgccttccttgcttatcaccatagcaaggagagtatggtcgttgctattttggccaatgcctatgacactttcgactga

SEQ ID NO: 59279 - DNA, 165 bp, Glycine max
  Peptide Sequence Number=SeqID_176057
atgatagatggaggtgttgacgccaaaagggtggtgggtgcagaggaggtggagacggcggtgtcgcggcttcgaagaaagggtttggactttggatattacttacacagagagaaggagagtggtgcagcatctcaactgcttcacatgttcttaagcgcatag

SEQ ID NO: 59280 - DNA, 201 bp, Glycine max
  Peptide Sequence Number=SeqID_176058
atggaagggctttccttggcaaatgatgaagatgggttgactttcgacattgaaggagaacaaggaaatcttgaagatgtcaaactgtgtatggtgggacgtttggttatagataaatcaattctagcccacaatatgaaggagagattggcaaccttgtcgtgccttgtcatgggggtttcaatcatagaggtagcctaa

SEQ ID NO: 59281 - DNA, 1179 bp, Glycine max
  Peptide Sequence Number=SeqID_176059
atggatgagaattggggttcaagggcactactggggaaccagaaccatgatgggaactcttttaactctgataaggtccgttctggcctccactctgagtctccctttcagtttgaccatcaagtctcctctaccagccacttaattaagtcaaggtctctctctgatttctctcttgaaagagagaaagaatattatgaaagacagtttgctactctgaaatcatttgaagaagttgactccatagcaacatcggactgcgccgacgtagaagacattggaaaacaagctgaacatgaactggcaatgaagatttctaattatgcaaatgcagcattattggcattgaagatttatgtgactataaggagtggatcaatagctgttgcagcatcaacgttggattctctgcttgactttatggctggtggcatactttggtttacccaccttgcaatgaaggaaataaatatgtacaaatacccaattggaaagttgagggtgcagccagtgggcataattatctttgcagctgtcatggcgacacttggctttcaagtattggtcacggctgtgcaacaactaatagaaaacaatcctcctgagaagatgtctgttgatcagctagtatggttgtactccattatgatatttgcaacggtggtgaagcttgcactctggctttattgtagaagctcaggaaacaaaattgtccgtgcctatgcagatgatcaccactttgatgttgtaacaaatgtgattggattagttgcagctgttcttggtgataaattttactggtggattgacccagttggttctattttactttcaatttacactattacaaattggtctggcactgtgatggaaaatgcagtttcacttgtgggacaatgtgcacctcctgaagttctgcagaagctgacatatcttgtccgcgcctacacatttggcgttctatattttgtgaaggttgacattgaactaccagaggatttacccttaaaagaagcacatgccattggagagagccttcagataaagctagagaaacttccagaagttgcgagggcatttgttcatctagacttcgaatgtgatcacaaaccagagcactcagttcttaccaaactgccagatcacaaatcagatcacaaaccagagcaattattatag

SEQ ID NO: 59282 - DNA, 1506 bp, Glycine max
  Peptide Sequence Number=SeqID_176060
atggccgtggtgagtgcgaaaagcaattttcgagatgtcaccgaaatacatatgaatctagtgatagccctggagcaaatccaacttcgagaagcaacgagctccccccaattcatccagaagctcatcaacaatgggaattggaaatctgtccttaacggcccttttgcaacattgtttcaacttggttttcaatctcttgtttctggtagtgggggtaacagtaagggcgtacatttaccggcatggcctggggaaggaggtgaattcgatggtctatgtctcgtaatgggggtagagtttgtgggggctcagaaagcacttgcacatggaggtacaggctttcaggttggtggcgatagagactatggaattgcgaagaagagagtgaattcaaggacggggccaagagatttcaaccattggacccctaaaatgacatttgcgccggcgatggtcagagacgagttgcaattggatgaagttgtgggtactcccaccatccaccaagaggaccacggggtggtcatcgatgaggcccatgaagcagagagtttccagcgccacgtgaccagccagggagtgaaaactgatttgggccgagtatgggtcattcggcaagggttcgtcctcctctgcaacgaggagaaataccctagaggcgcaacgatgccctctgtggtatttctcatcgcagggggtggtaacagtggtgggttgggaacagaacaaagaggggtgggtgaggtggtgaccgcgggtggtgggggctgggagggttacggccgtcaaggagcttctcctcctggagccgggcaaggcctgccgcttggacgagcgttaagggctggccgattgtgcaatttgcaaggtcctcaaagtcagagaggtattgcaccaccatacctcgctgaggagcaaagcgggtctgcaacacttgaaggaacgccgactatgaattgcatgatattcaaaaaattgggtgatcttaaagatccaacccaagggatcagtcccatcaaaacgagggacatcgagtttgattttgtgtgtaattacaggtgcagcggaggtggagctggggaaggagatggtgaattagttagggatagcatcctcaagggaggtagggactttggatggattagttatggcaacgagagcaccaaaatgatagggatactcagagaagtctggttttcgaggaaccaggggcctccagagacaaagagaaggaagggaaactttctgatttttattgatgatgctcaaccgatacgcagcatcatccctcaggattgtagaatcttccagaatcattcttcagacgtaatctctcagggtgacatcaccgtgctcagcatcgatgatgatgtcgccgcgaagcatctaggccaagcccactttgacggagaaaaggggctttttggtctagtgagaagagaagatactagaaggaaggcattgttgttgtgtggtgaggatgagcagtgcccgtggcaatga

SEQ ID NO: 59283 - DNA, 2166 bp, Glycine max
  Peptide Sequence Number=SeqID_176061
atgccgtttggtttgtgcaatgctacatcttccttccaggctactatgaatgcattattccggccttacctccgacgctttgtcattatcttcttcaatgacatcttggtctacaacgggtccctggcggagcacctcacttacttggaagttgcgtttcaggtggaataccttggccacgtcgtctcgcatgaaggggtaaaaccagttgcttccaagggctgttcgcagcttcttaggacttgtcggcttctatcggcgtttcatcagagactttgccaccattgctgcacccctggtccaccttactacacaggaacgttctgttcaccgtctgcgccagtgttagctctcccggactttgaccttctgttcaccgtggagacagacgccttcgacttgtttgcaataaccacggccttcaagaagtggcgccaatatttgcttggccaccacttcatcatcatcactaaccatcggagcctcaaagagttgcttactcaggtaattcagacgccggagcaacacactaatttgacgagagcacgccccttcttctctaatgaccctgtaccatgtctcactttcatggaggaacttcgccgtcaactagaagcttgcgccgcttatgtgatgcaccaccgtgacatttcacaatcaccggaggcacaccctgaattcacaattgccaacaaccttattctacaccagaagcgtatttggcttccacgggatttccaaatgattcccaccccgctcactgaattccactcttctccaacagggggacacatgggcgtagccaagacctttgcccgcatttcagacaattttagttggcccggtctctggaatgatgtgaccaaattcattgcccaatgtgtagattgtcagcttaccaagtacgaaacgaagaagagtgttgggctgttgtgtccattactggtgcctcagaggccatgggaggacctttctctggatttcatcatgggcctacccctttatcatggcaactccgtcattcttgtggttgtggatcagttttcgaaaggcatacatctagggatgttaccagcagctcatacagctcacacagtagcctccatgttcatggaaattgtcgggaaaatccatggattgccccgaagcttgcatccccaaagcgatggtcaaacggaagtgatgaatagaatcattgagcagtatctcagagcttttgtgcaccgtcgtccgaaaacatggggcaagcttcttttatgggtggaatggtcccataacacctcctggaacgtagcaacagggaccactccatatgaaattactttcggtcacaaaccttttaatttcccaaactatatcacggggtcatccaagttagatgcagtggaggatatgctcaaggacagggatgacactttccaggtaattcggaagaagctcctcaaagctcaggccacaatgaagcgttttgctgataccaagagaagagaggtgatgtacgagcctggagattgggttttgctcaaactccgtccatgctggcaaacttccgccaaaggtgtttcagaggtgcagggtaaattgtccaaaaggttctatggccccttcaaggtgattgaacgcattggacccgttgcttatcgcttacaattgccagagggagctcgcatacaccctgttttccattgctcagtgttaaagccatttcagggaacacccgagcttgaggttgcggcccaattgcctgatcattttctccaagatcagcctattatttctccgctagctatcttggattaccgcagatcaacatcaacagacccatggcaagttttggtgcagtggaacgggttactccctaatgatacgtcatgggaggatgggaaaaattacaggaggattatcaccttgaggacaagaatgattctggaagattctacaatcctgagggatgatgctgcgtatcggttgccggaaaatctcacaacacatgtccgaaggaaaaccagcgatgctcgtgaaatgcaaactttttatgggcagtactatgaaaagtatattcaagcgttagataaggctgctgataagggattgaaggaagttaatcgaacagaatatattccagtatctgatgagattatggaagctcatataaaggttgattga

SEQ ID NO: 59284 - DNA, 471 bp, Glycine max
  Peptide Sequence Number=SeqID_176062
atggattttctagaggctaaggaaaaaggtaatcaagcctcctaccctatgcaagaccctcttcgaagtagtgagcacttaactgtccatgacattttggtgcaaagggagaagtgggatgaaaatgttgatgttattgctactcgtatgaggttggaagacaagggtgtggactgcccttctctttgttccatttgtagggctagaatagagaatcctttccaccttttcttttgttgtcaggagatgcttgggaaccccctccctatggtttcacaaaatgcaattctaatgcaacctttcatgaagccttgggccaaactagttggggtatatgttgtcgagataagtaagggggcacttagaggtgttaaaattgaatggcagcaagtgatgctaccagttgatgtgggagaagctctaagtttgttaaaagctctgcattggatagtagataaaggatgctcttag

SEQ ID NO: 59285 - DNA, 687 bp, Glycine max
  Peptide Sequence Number=SeqID_176063
atggtggaggaagtttttctgaatagctgggattcaaattctaatgccaatattgtcaggaaactagagttctatgttgttgatttagataaatgggggaaaaaacttaaatctaagttcagatctaatattgaaagttgtaagaggaaccttgaggaattgagagagaagagggatcctgattttgtagctacttttaacaagttaaaggatgaactaacaaatctgctggttcaggaagaagggttttggaagaaaagatcgaaaatattctggctatatgaggggtaccagaatacaaaattcttccacacttcagcgtcttcaacaaaaaggcaaaataaattgtgcccacttactaacgaggatgggaccatagttactgcgcaaagggagcttacaaatctagcaaatgagtattttggcaatctattcacccatcaagattgtgagttgggtaatgtcatttttgtaattcctaattttatcactgatgaggataatggttaccttatagctcattttatagtggcaaagttcaaggaggctcttatggaaatggatcccaagaaatccctaggacccgacaatttaaattcggtgtttcatcgtagattttgggatatctatggtcaagaagtagtggacgcttgcactagctggttggagagtggaaacatgccttag

SEQ ID NO: 59286 - DNA, 453 bp, Glycine max
  Peptide Sequence Number=SeqID_176064
atggtggaggagaggaagataagaaataatatgaaagaggagctacaagtagcaatgacaggagctccagaaataggaagcaaaatgccagaaaataatagcacaaatgaagaggatcgagccaaccaacttttaggcacaatcaatcattatcaattggttgggcaaccacacctagatgatactgaagcaaagctgggagatagaaaaagaagaaggattgaagctgatcaaaacaaatggcatggagaaagtataggtcaaattacagatcaagagatggtcggagcttcaattgtaggaggcctcgataacctccaagcaattccagtcttaaaggacctgttaagggctcatagacctgagggcttttgggaggttatggccttaggtacatcaacctctaaggttatcccttcactagggccaaaagtagggattctgaaacaatag

SEQ ID NO: 59287 - DNA, 204 bp, Glycine max
  Peptide Sequence Number=SeqID_176065
atgcagagaagaaggtggaaacaagatttgggagtgaaagaagagaataaaaagggagaagatgagagcttagatggtgtttccatcggtgttgaagattcttgtgccaagaaacttgaagagggtgtcaatttgtgtttgatagtgaatggagaaaacaaagataaagaagggagggttgatgtatggaaaggaaaggggtga

SEQ ID NO: 59288 - DNA, 306 bp, Glycine max
  Peptide Sequence Number=SeqID_176066
atgactaccatcttttcttcagagcttcgatctaggaagttggatagagttggcagagaaattcttctgaagtcagtggctgatgcactccctaattattgcatgagtatatacctttttcttgaatccatgacagatgaattgcagtggatgatgaattcctattggtggggagcgcaaaggaatgacactaaaggtatacactggctctcttgggagaaattagttatggctaaggaggtaggaggcatgggattaagacctacctatgggtgtaaccttgtattgctggggaaacaaggctag

SEQ ID NO: 59289 - DNA, 876 bp, Glycine max
  Peptide Sequence Number=SeqID_176067
atgtctggtttgtacaatcagatctcctcaccttcaacagcaagggccaattcaccaaacataaacatgagaagcaattttgaggttgaaaggatttcaattaacttctgggtggatgttcttattcacgtttttatatacccttcctgttcatatttcacagtttgcagcaggaaggtctcattctttatagttgttctcatattcagtgtaactttattatcagagattttaagggtttctggaaagaatggattgatgcagaaccaagggcttagtgactatgacagagtgcagtttggaagccccaaacccaatcttatgccttctttagacatacaacctaattttacaggctggaacagcttgtcacatgaagggttagcaggagtacaaggactaaacgttgattggcaaacatcaccaggtgtcccaagctctcacattgtgaagaggacattgcgcttggatattgctaatgatagctatccaaatttcaatttagttggacggcttcttggccctaggggcaattcactgaagcgagtggaggctaccacaggttgccgtgtatttatcagagggaaaggttcaataaaagaactagataaggaagagttgttaaggggaaggccaggctatgagcacttgaatgaaccactgcacgttttgattgaggccgaattacctgtcaatgttgttgatataaggctgaggcaagcacaagagatcatagaagagctactcaaacccatggatgagtcacaggatctccacaaaaggcaacaactaagagaacttgctatgctgaattccaattttagagaagatagccctcaactcagtggtagtccctctacattcaactccaattaa

SEQ ID NO: 59290 - DNA, 177 bp, Glycine max
  Peptide Sequence Number=SeqID_176068
atgagtaaaataggggctgtaattgaattgaaattagctgcagtaattctctggagatgtggagttgaagcggtatgttcaaaactacctggaaaaggagaagctggctcacagtgggcctacttgaggtcttgtactggttcaactaataagtgcccaatctatcttagtgggtaa

SEQ ID NO: 59291 - DNA, 114 bp, Glycine max
  Peptide Sequence Number=SeqID_176069
atgttcatggacgagattgttgatgactcctgttgctgcaatggacgtgtgcaggctttccaagacaagaccagggctcaaccaaaggctgtgaaatacccagttgaatgttaa

SEQ ID NO: 59292 - DNA, 207 bp, Glycine max
  Peptide Sequence Number=SeqID_176070
atgtcgcgggggtcaggagaccttggggacgtcaggcgagctcctggcagtcaaccaataaaagaacaaagtccacaaagaaaggaggcttgtgtggcggctggccaactatgtatcttgggtggtatctggaaattagcctctggtaatcgattaccattcgtgggtaatcgattacagggcttaaaaatggagataggaagttaa

SEQ ID NO: 59293 - DNA, 345 bp, Glycine max
  Peptide Sequence Number=SeqID_176071
atggtcattgcacttgatggtgcccatgttcgatacgttggatgttgtgtatgttcgtggggggcgaagtgcattgaccttgtcggatggcccattcatgggggacaagcatggttaaagaatctaagcatttctgaggggatgcttaggcactttaattggtccatgtgtatgttcatgggggggaagtgcattgaccttgtcgaatggctcattcgtgggggacaagcgtggttaaagaatctaagcatttttgagaggatgcttaggcgctttaattggtccatggggggaagtgcattgaccttgtcgaatgacccattcgtgggggacaagcgtggttaa

SEQ ID NO: 59294 - DNA, 213 bp, Glycine max
  Peptide Sequence Number=SeqID_176072
atggcagtttccaaactcagaaatgatgcaaagagaacaatggcagtttatggtggctactggtggccgtgggtgatggagaagaatcttgacacattggaaatggctcaaaacgcaaaagtgactaatgctcttggaaacggaaactttgcggacactccagacgtcttcttaaaaatcccaacggtcaaatcgtggacaagtgttctgtga

SEQ ID NO: 59295 - DNA, 402 bp, Glycine max
  Peptide Sequence Number=SeqID_176073
aacatcattgaggttccactgtcttaccatagacagtggaggccacattatccaacgcttcacagatatggtagccgatactttttttctgatggcctaaaagagtttagaagaactcatagaattgacgacagtgttatcctgcagttttttggtggtaacaaaaataccaccttcgaggtggatgtcattggacctatctttgggcagcgccgtccaaggtcagttcagacaaccaggagacacatctttacagccgatgtcactgaacacatgatgcaacagagtcttcctttggtccttccaccagcagctttcacttttttgtttggatcacaaaaaatattcctgttcagagaggctatggcaaacgtcaacaatggaaaatcaccatgcacgatg

SEQ ID NO: 59296 - DNA, 1180 bp, Glycine max
  Peptide Sequence Number=SeqID_176074
atggggcatgattgccccatcctggtcgttcaggaagcgccagcccaggggcgtggcccgcagccgggtgggatcggcgtccagcaggcccttggcggacgctgcctccaattggtgcgcaatggcggccagcgacaggccggtgcgctcgttgaacagggtggcggccaccccgtccttgagccgcaaggcattgagcatgaactcgaacggcagttcgtccgggccgacctggcggctctcggccaggtggctgccgtcgcgcgcggcggcggcccgcaaccaggactccgggctgcgcaggcgcgcctcgcgcacgatgcggtcgtggaacgacaacttgccgtgcgcgcccggccccaggccgaggtagtcgccgaattcccagtaattcaggttgtggcggcagcgcgcgccgggccgcgcgtacgccgagacctcgtagcgcgccaggccggccgcggcaagttcggcctcgaccgcgtcctgcatcgcggcgctggtgtcgtcgtccggcaggtcttcggggggaaacttggcgaataccgtgttcggctccatcgtcaggtgatagagcgacaggtgctcggtgccgaagccgatggcctggcgcagatcgtccacgcaggccgccagggtctgcccgggcagcgcgaacatcatgtccagattgacgcgcggcgcggcgcgctgggccatctcgatggcggcgcgggcctgggccgaatcgtggatgcggcccagcttcttcaattgggcgtcgtcgaagctctggatgcccagcgaaaagcgcgtcacgccgctggcggcgtagtcgcggaaccggccggcctcggcggtgccgggattggcctccatggtgatttcggcgtcgggccatacgttcagacaggcgcgcagcatcgccagcagctcgtccaggccggcggccgagagcaggctgggcgtgccgccgccgatgaataccgaaaccacctggcggccccagatcgacggcagcgcctgctccaggtcgctgcgcaatgcgtccaggtaggcgcgttcgggaatctcgccgccgggcgccgcatgcgagttgaaatcacagtacggacacttgcgcacgcaccatggcacgtgcacatagaccgacagcggcggcaggctggtcagcgtggcgccggccggggtgaccaggcgc

SEQ ID NO: 59297 - DNA, 306 bp, Glycine max
  Peptide Sequence Number=SeqID_176075
atgacaataaacagcatcagaggcctacaacatcaagcttcaatcccatatccattttactccaatatctacacgcccattctcgatatggcccaaaacccaaccaaatatggctttgcacaaactcttcaaggatgctgtgggacagggctattggagatgggtcctgtgtgcaatgcacatgacctaacttgccccgattcgtctaagtacctgttctgtgatgctgtgcaccttactgaagcagggaactacgttcttgccgagagtggtcgacaaaatgtgcttcgataccttggtagttag

SEQ ID NO: 59298 - DNA, 585 bp, Glycine max
  Peptide Sequence Number=SeqID_176076
atggccccctatttgtcattcgttatcatggagtttgatgttcgcttttctgtcccttttgggttttacaatacagcactaaaccttgggatatctgctggtgctgtttttccatgggggaatggattcaaaaccaagccatctccccttccagaaaggttttatttgggtggtgatttttctccagtttgcaccctaggaggaccaacaaccttatggggatttaaaactagaggattaggtcctactgaacctcggaggcaaaatagagatgggtctaatgatgacaatgttgattcctctggatgggacttcattggtggtgattttgctgttactgcttttgcagatctctcttttgatcttccaattatgtggttgagagaacatggaatccacggacatgtttttgctggttctgggaatgctgctaaattaactcagaatgaatatacgcacttctctcctcggaagttcttagaatcctttcgaatgtcagtaggatgtggagtagttattcctactagactcttccgcttagagaagctcagactaaccaaaagttgggagattgagtggagttag

SEQ ID NO: 59299 - DNA, 807 bp, Glycine max
  Peptide Sequence Number=SeqID_176077
atggctcatggctaccggggtgctgctgggcacggtggtgctgctggtgtggtggcagcggcagcgcgcacccaccgcgccgcctgcggtcgcgtttccggcaccggcgtccgatgccagccagcgtatcgaacagcgtctggcaacattgcgcgaccgctgccagccggcgcaggcggggctgctggcgcgcatggccaatcgtgcatcgctgccggtgctggcggcagtcagcgcggtgacccagcaggacccatcgctggaccggccgatctaccagtacatccagcaccgcgccgatgcgacgccgtgcgggcagccgctgcagatgccgttggccggtgggcgcagcatggccgtggacatcgaacagtatgcgcgcacgtttccggacagctacttcgacccgcaacgcagcagcgaaccgcgggattttggtggactgtcgctgcagcagcgtgccggcaacgcctgcaacagcgtggtgtattcggtgctgccgctgggtggcgccgactggcggtgcagcagcctgcgcgcgaatgcccgtgcgcgggtgcgcggcctgtgcgaggacgagctgcggcgccagcatgggggaactggcggggaactggacatggccgtggggaagggcatgcaggcggcggtggtatcggcgattgccgcactgccggaagattgccggtgatgatccctgacaccgggcacgacccggcacgaggggcacgacaacatgaacattgcccgggccccaatctgaattggtggcgctgttttcataactatacaggacatcctgtatag

SEQ ID NO: 59300 - DNA, 255 bp, Glycine max
  Peptide Sequence Number=SeqID_176078
atggcatcagaagtgatccgatgtgaatcttataatgaaaagtgtgatgtatacagttttggggttatattgaacgagcttttaactggaaattacccatacgttgagatgaaatatggtcccaccaagattgtcatggaagttgtggagggtaagttgcgacctaagcttccgtgtgatgatgttggccaatttggaaccagagagattgaaggcgctttgtatccagtgggcaaaatactatttgaaagttaa

SEQ ID NO: 59301 - DNA, 375 bp, Glycine max
  misc_feature (14)..(14): n is a, c, g, or t
  Peptide Sequence Number=SeqID_176079
atgcagagttcacnacgcgatgtctatcttggagcctacctaaatgggttccactacagcggacactggcagatggtggtcatcctacccaaggaacacctaagttgtctgtgcgttaaaaggttcttgatgaatgctccacagcctaaatcaaaggcttctgctaggtggattgtcgtcaagtgtaatagacaaaaaggaagtacagagtgcggctactatgtgatgcactggatgtccaccatcattttaggaacttttaggaataattgggaagcgtattttaacgatcctagaccattggagccagagagattaaaggcattgcggatccagtgggcacagttttatctccgagttagagatcaggcctag

SEQ ID NO: 59302 - DNA, 390 bp, Glycine max
  Peptide Sequence Number=SeqID_176080
atggcgggtcacagcagctacacttctgggagatgccacacaggtcacaggcacgggctctcacacgtactcacagcacgagctccactgcacacaatgggcgttgccgagagagcgaggtttcgacaaactttcaggggtttgaggtgggtttcaagagagcgagagagagcgaagggcacatcagagagagtggttagagttagggcacagcagagagaggggagagagcaaggttcagcagagagaggggagagagcgaagggcacaacattgtggaaagagagagtgaggttcagcagagagaggggtcagtgtatgggccacgcaggaacaaagacgggctacttcaaaggaccgttgttgtcttgcattaagataacattctaa

SEQ ID NO: 59303 - DNA, 288 bp, Glycine max
  Peptide Sequence Number=SeqID_176081
atggattttgtttctagaatgttaaaagtgtatcaacaattagttgaaaagacaaaatcaactcctggagctctggttgagaacaacaagttctgtctttcagtccattttcgttgcgttgatgaaaagaaatggagtgaactagcacgccaagtgaaatcagttttaaaggagtacccgaagcttcgacttacccaaggaagaaaggtgctagagattcgtcccactattaaatgggacaaagggaaagccttggaatttttattagagtcactaggtgagttttag

SEQ ID NO: 59304 - DNA, 510 bp, Glycine max
  Peptide Sequence Number=SeqID_176082
atggagagaatgaggaagaggcagcccatgaaggagccaatggcgaagcccaccatgtcgagccttagggccctgagtgtcgcaggaggagtgattctcgaggctgccttaggccggggtggtgagggagaggcccacgaagacgaagatcgtgaagagggagttcacgcttaccaggccgcaacggcgcaacgaaccctaaagggggcggggggagtcaaagagagagaagcacaagagacggtgggggaggttgagccagaaggaatagtagcaggcgaggccatagctactgaagacgatgtggaagatgccgagttccttggcaatagtggcagtccagccgaagaagatgtcaaagatgataagaagtttatgtttatggttttggatgaggatgctggtgctggcttcgatgaggcaaatgatgaagaggtaagggatggcattggtgttctttgtgttgggagggaggccgtggtcagaggagtaggatttggaagaggatga

SEQ ID NO: 59305 - DNA, 457 bp, Glycine max
  Peptide Sequence Number=SeqID_176083
gccctgccccaccccctgggaaaacgggcttcaaggcgcgggaggggtaagggttcccagcgggctgggaaggagcaccccgcaccgttcgcggtgggtgttccggtggcgcccccccggcggccccttgaaaaatccggaggacccgagtgcctcccaccgccccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 59306 - DNA, 706 bp, Glycine max
  Peptide Sequence Number=SeqID_176084
atgacgatcactctggatgacgtggcgtcactcctacaccttcctatcactagcgcactacatacctttgagccgctggttacttccgatatggtcatgctgttaacggagctgcttgagagcaggtgtcgggccagacgttgggttgtagcagcccacgcgtatctcctccacttggtcggttgcactcttttcgctaacaagagtgcaacacatgttcatgtcatgcacctggaggctttcagggacctggcacaggcagggggattctcttggggagcgacaacattggtgcacttgtacgaccatctgaatgaagcgtcgcagacccctacacgacagatggccggttacatgacattatttcagatatgcgagtactttccgatggtgcatcagtgcgtcgttgatgatgcttatgttgaggctagcccacgtgcctccaggtggcttacaagtaaggctcatatgacagggatcaagggagccccataccgggtacgtatagaagccctgactgtcacggacgcctattggatgccctatgcagagcaccggggagttaagggcttcgacctgatctcattctacacgggccaactcatatggggtcagatagttgtctatgttcgaccagagtgggtgcttcgacagttcgggtacattcagaccgtccctctaccgcctgttcgtgattcgttgacgg

SEQ ID NO: 59307 - DNA, 967 bp, Glycine max
  Peptide Sequence Number=SeqID_176085
atggaaaacatgcagagcttctggcaattgggtgatgaactccgtgggcactcaaaagcatcggaggatcacaagtggttaatggttgcctcgaaactggccgaacagacaagattgaagggggagcgtgtgaacaaccttgatctttcaaagggacccattgaaacaaggtcaagggataaatttgggttccaggaagagaacaaatttgattctcttaacttgagcatgttgaacctggactctaaatttactgagaatgtgagcaaaagctcacttcgaaatggtgtttatggtatgaatgcagtgtatcagaaaaacaatgcaaacttggtgagtaatgtgatcagtaacaagtacaatggcagtattcagcataacaaagagatcaacaacaacactggcaacaacatcaacaccaatgaaagcaacaacacaaatgcaactgacaaaaggtttaagaccttgcctgctgcggagacactcccccgcaatgaggtgcttggaggatacatctttgtctgtaacaatgacacaatgcaggaagacttgaaacgtcagctatttggtttgcctccaaggtatcgagattctgttagggcaataacaccagggctacctttatttctttataactatactactcatcagctgcatggtatttttgaggcagcaagttttggtggctctaacatagatccaactgcctgggaggataaaaaatgcaaaggggaatcaaggtttccagctcaggtaagaatccgtgtcaggaagctctgcaaggcattggaagaagattctttcaggccagtattgcatcattatgacgggccaaagtttcgtcttgaactgtcagttccagagactctggatctgttggacctatgtgaacaagctggcgcgaccactagtggtggcctgccaggcgctatcagtagtggtggggccccagacgcgaccactagtg

SEQ ID NO: 59308 - DNA, 498 bp, Glycine max
  Peptide Sequence Number=SeqID_176086
atggcagggaacttgaaattcacaatggaccagaaagatattgttagattcttgactacaactattgatagtttcattcaagatcggttattcaacaaagaacaaagaacccaacacaaggagcagtgtgcagagaggttagcaattgaagatggaagttatgacaaggacactgaggtggaatactctaatcaagcaatattagcatatcttgattggggtattgaagcccttgaagaagctatcaatacctataacatggaaactaagcttgcaagactagattatgccaaaaaaatgttgcaattatggaagttgaggaacaacgttcaaaattgtgtttttcatgctcttgagatgttcattgttgatcctttttttttcttgcggattgactttgctcctaaactctggaaaaacttgtttcttccacacatgagctcaattatggggtcgtattcagaggagaggcatgagttgctttggcctggaagttag

SEQ ID NO: 59309 - DNA, 288 bp, Glycine max
  Peptide Sequence Number=SeqID_176087
atggatgagcgattgacgcttactagaagatctaagaaggagaaatctagctcaagtcccaccacaggaggcaaaagtgggcagacaagtcatacaagaaatcccatcttggaaatgattggaagaatccttttgttggttcatcccatgccaagggaattgttcttgaaaagatttgaggtattaaggctaagtagtccaactctaccattcgtaagtgtgccagggttcaacttatcaagaattggaagaagattgccgcttttgtccctaatgatggttgcttga

SEQ ID NO: 59310 - DNA, 402 bp, Glycine max
  Peptide Sequence Number=SeqID_176088
atgatggataatgatgcactatgccaacaccaaacccgcatagtagagatagaaagacaccatgaggaaaaattcaaaaaactaaaagccgaccacaacaaattggaggctcgcattagaagcccccaaggagacaagtactccgctcacacgattaacgaacaaacccagggtgagtcacacccccgtcaaaccaacaatactgtggatgacaacaacaacttgcatgcacaccgacatgaagagcagatgactcgaaagacatactttcatcgatccaatcatggaggtcgacctacctctaggttggaacccactcaacctgagcgttatgatgggaccaccgacccaaatgagcatatggatgtcttcctcacacagaccaacctttacactaattga

SEQ ID NO: 59311 - DNA, 687 bp, Glycine max
  Peptide Sequence Number=SeqID_176089
atgcaaacggtttgcgtttgtggagataagttatggcgttacgacgccgtttcattcttcggctctcacgtgtcgtttacgagtacccgtgtgtcgttttgcccaccccgaagaagaagcggattagtgtccatggttgctaagcgcagccccaagcgtctcaagtacacctccgcttctcgcttcaccaaggaggatggtttggtgtacattgaagcagacccatctgcctctgattcttggaaattggaaccaattgcgaatcttttgaaacaaggtgctgttggagtcattcctactgatactatgtatgcaatagtatgtgaccttagaagccagtcagccattgaacgtcttcgtagaatcaagaatatagaagcttcaaagcctcttagcatcttgtgccactcatttcgggacatagacaagtacacagctggatttccacgtggtgatggtcaaggccatgcaaatttattcaaagctgttaagcattacttacctggtccttacacattcatcctaattgcaagcaaagaattacctaagcaatgcataaggtttggaacttcatctgccaagtatgcgtcaagaaaaaacgtgggtgtccgtatgcctgatgatgccatttgtcaagcaatactaaaggagatggatgcaccgttaatatgtacaaggtttgtttaa

SEQ ID NO: 59312 - DNA, 1374 bp, Glycine max
  Peptide Sequence Number=SeqID_176090
atggacaagttatgggagcgagccaagggctacattcagatgaaagaaatgtcaagattccaaaacaaagacaagatcgaggaacttatacaagcaggttacctagctcagttcatgaaaaaactcgataataaccagactggaggacgacccaaagggcacaataaggaacatcacaggagaagggataatggacaagatagaaggggagacaaaataaaggatagaaggagattgaggcatcaccaacaaagacatgagcaccaaccccaacaagagcaagaagatgaacctgttcaacaacgaggtgtcatcaacactattgcaggcggattttcccatagaggactatctaaccagtcccgaaagtgtcatctccatgccatcaaagatcttgatgtcaattgtgtcgatgtcaagccactaagaagtcttcctcctataaccttcaccaacaaagatttcaaagccatcaatcccatcaaccaagacgaccttatggttgtctctatcgttattgccaacttcatggtggccaaggtccttattgaccaaggaaatagtggaaaccagaggttatgtggacctgatgaccacctttggttagggaaagctctcaaggaccatagtataaacactacacctgaaaatgaagttccctaccttgacgggagaaatcttcactatcaaggcagaccaaaagcaagcctgacaatgctatgcgaaaagcctgaagatgaccccttatccttctgtcagagagtcgagcaagccctattccccttctggaccctaaccatctacaagacaaccgagggaaatcccggtgatacattcgacgtggacccttgggatgacaccatggataaaggcccaaaaccaatagaagaacttgtcaagctacagcttgggcctaagcctaggcagtgcactcaacttcgcaaagacctcactagccatgaacatagacatatagttgaagcattcatcccagcatcatatgccataaattggccatctgcccttaggccaaaccagtctcacagaagaaaaggaagatgggagaagaactacgccaacaagaaatggcacatgtgcacaaactatgccaacctcaacaaagcctgttccaaagattcgtatcccctgcctggcatcgacaagctggtggacagtgtgtccgacttccaattgttaaactttctagactcttattcagggtacaaccaaatcaggatgcatcccctagatgaggaaaaaattgtcttcatcactgaagacgccaatttctgttatagggtcatgccttttggactcaaaatgctagagctacaaaccagatgctcatggaccgggtcttcaaacattagatag

SEQ ID NO: 59313 - DNA, 276 bp, Glycine max
  Peptide Sequence Number=SeqID_176091
atgaagtttcagccttctacattcattaagttccagaaggaagatgaatggatgattgatccagttatgatagctgatacatatggaccagagggtcttgattttgttgttgatggtggtgtaagagtggccgatccatccacggtggttgacatgacaaaattgcctcccaaagtactacggcaaggaaaggttggtcctattttacattggatggaattggaagatgatcagaaaactgatgttgataaggatctcatccctgctggcatttga

SEQ ID NO: 59314 - DNA, 1297 bp, Glycine max
  Peptide Sequence Number=SeqID_176092
atggctacactacttaagtttcttcagctgtattgtgcttattgtgttggattgatggtggtgggtgtgctgtttgtctcagctgaatcaacacttttggtttatttcaagcgtgctccttcaccaaggtctaggtcttctaatgctgttttccagtacctagttgagaggttggatggttccaatgcatgtaagagaaacacttgttcgttttcatgtgagcttgatggcaaagtttacccttgccagtctaatggcattgtgttaacgaacttaacactaaatcatgagcatagatttcttctcaatgtcagtacaatcacaggagaaagaaattcatcagtttactcatggttcatcgatacaattcccccaactgcagccattagtagtgaacagacccatacaaatgagcaaaagatagcaattgatgtcacattcagtgaaccgtgcactggactaggcggatttcattgcctaaactcatcaaactgtgatattatggtagctggtcctgcacaagtggatgcatcttctttacaaattattagaccaggtgccaaatacagccttgaagtgattatctcctcagaagttacttacgggcgcgttgtaatcacaatggcagagaatacttgcactgaccaggcaggaaaccagttcagaagaaccaatggttctactttgattactcattttggtgaggttctggttgccaaaccggtgatggtggacttttggacgtctgttccttcttatgagttgaaaattaatggcatcccaagaacagtagttgcaacaagcaaaccagaggacctgataattttcttggacttcagcattcctataacaaactcaactgagcaagttctaaatgcactacatgttaactctggcgtcttaattcctctccatggcagaagcaatggaacccgcggatttagttttaaactcaagaacatatcaggaactgagattatcacaattgaattacaagctgcatccatacttggaaagacaggcactcctgtctctcctgttgctccgatcacattcctttatgatcctatgaaacccaatgtggtactaaggaccagctccctcactgaaacaagggatttcaacatcaacataatggctgagttcacaaagccagtatttggctttgggacatctatagtagaagtctcgggaggaagactgataaggcagggtaaaggaactatcaagagctttatactcgttgactgtccaagcagtgacaaaggaggtgtcagttaccattcctgcagggaag

SEQ ID NO: 59315 - DNA, 2154 bp, Glycine max
  Peptide Sequence Number=SeqID_176093
atgaatgatacctgcatggacttaagaattttctctatgtttgactcaaactctaatatggtatgttcagactccaccccagcaatatccattgcactagactcatttatcagtgccggaacaatagcaacatcactagtagctgctatggtttcactttcctcagcaaatttagaagcattaagcatacttgctttgggaggtgcaagtagtcctgcttccaatccatcaattaatctacatggaatgattggacacctacaagtctttgccctcacaagttggttttcaactaatcaatttatcaaatactctgagacaacaagaggtcttaggtggctcatacctcatcacaagcttccctggaaaaaaattgatacttggaagaaacttggatggagaagtaacggccaatctgcaggagagagagatcaacaacaaactgatttaatgagcttgtcttatattgatcccaaactatcatttcaaactgaaaataccaccaattttggtcggtttcacaatcagcatgatttaagtaagacaagtacattatatggtctacctctcaattccatcgaatatttcacttatttcttgagaggagaaccattgtctgctagcaatgtcatcaaaggaatggagagttacaaagggtggcaggacatggagatgaacttattctggcttggtgtgggaggaggctgtttacttttattccatgttttcatgatattcttcctaagacacaggactgggagatcacctcaaggcagtttatcagttcctaggtttgagctctttcttctgatcctcatgctaccttgtctttctcagtcatcaacatttgtaataaaaggtcgtacaactgggggaattattactggggtgttgctactagcaatccctgtggcattcatcttatcagcattgctatttcttattattgcaatctacgcgggaagctttgcccaatacaaacaattcaaaaaaataaccaatgaagaaaaatggtacaccaagttattgttctgttttatcgggaggtctacaactgggaagtggtttaacagggaagggctaccttcctctttcctctcgcgctttggaattctctttgatgattggaagggtcctccagtgctcattttaggtgatcaaaatgaacagaataataccataaccaagtggagcgaaagtggcaaaagtgggaacggaagaacgaaaacagtgtgttcagaggacagtaatgaggaaatcaaaatctccacattcaagaaggtattgggctgcatgagagcatcctatatcatccttgacttactaagaagagttggtttgggaataatatctgtagcttacccatcagaaagctcaaacaaaagcctttttgcattgataatcacatcaatgcagttcatttatctattcactaccaaaccatacatcaatagaggcgtccatgttgtggaaagtgtttctctcttgtgtgagacaggtgtgtttagtatcttagtcctccacaatggttcacactcagttgaatccaaaacttgggaattggttatgctgtttcttctgatgtttaccttcattgctcagcttaccaatcaatggtatgctatggtaaattccctatggaaactctcacaaactcagaataactctttaagggatggagtaaagttagctgccaagggcctcatcctgcctttccttccaagcaagcattggtcgagcgtgatatcgacattctcccagccggagacgaaccagctttcagtcaatcctacatgctcaggaatagattttgaaagaagaaatagaaatggatatatggatccaattagcaccatgacggctacggtagtccccgtgcaaagtccaagcacacccaaccacaatgttgttgaaagaagagatcctacaacctgggagacaggtgcaagttcacatattgaagtggaaggtaaatggctaaaggggcacaaggctgggcttaagaaagagctaaggatgttgagggagcttgcaaaagctagcttctctggggataccaggtttgatgaagccagtactagctacactttaggggaacaacagcattcatctggtgaaatctatttgggtaatccaaagcgaagatattgctga

SEQ ID NO: 59316 - DNA, 750 bp, Glycine max
  Peptide Sequence Number=SeqID_176094
gctgatgaaggtaaagctgagaagaaggtggaggaacataaacaacagctggcagctgagccggcactagaaccagtttctgattttgttgaacttgaggaagttgtggaagatgaagatgaccaacaggagagagagacaccaataaaagatagtcaagaaggaataaagatgaaggaagagcaaggaaaagaaaaagaaaaaagagagattacttcagctgaaggcaaggaagtaccatatccattggtaccttccaagaaggataaagagcgaaacttagccagatttcttgacgtcttcaagaaactggatgagcacgaagtctgccataaagaatttggaagtccaagtgggacaactggcaaaagagctgatgaaggtaaagctgagaagaaggtggaggaacataaacaacagctggcagctgagctggcactagaaccagtttctgattttgttgaacttgaggaagttgtggaagatgaagatgaccaacaggagagagagacaccaataaaagatagtcaagaaggaataaagatgaaggaagaacaagaaaaagaaaaagaaaaagtagaaaaagaaaaaaaatcaaaaaatgcaaaagaaaaagagaaggttgatgatgagaaaaagaagagcaagagtgaggtttcaagagagaaaagagagagattacttcagctgaaggcaaagaagtaccatatccgttggtaccttccaagaagtataaagagcgacacttag

SEQ ID NO: 59317 - DNA, 240 bp, Glycine max
  Peptide Sequence Number=SeqID_176095
atgccttttagagacttgaaaagtgcaagaaaacgaactgcgttttctggaaaacgcgatgaactcgctaagcgagcatgttgcgctaagcgagttcatcaatactcattttgtataaaggtattctcggaagaactcgctaagcgaacccaccgcgctaagcgagtttgtcctgtgaggatgacactcatcctcttgctggactacctgtggctaagcgatgctgagtcgctaacctag

SEQ ID NO: 59318 - DNA, 492 bp, Glycine max
  Peptide Sequence Number=SeqID_176096
atggccattaaccaaacacattgtccgaggtccctgcgtgtactcactggtcgaatgggattacacgttttcttggcaaaaatctcttcatcatccccacatatccctccacccacttcgatctccgacaacgtcgaagctgtgttgggagaagccaggggcagggcacttgttggaggtagaggagtggttctcgacgatagaattctgcttcctgagaatgggatacaagttagagcaagtgaacttggtggcgcaactcgggtggagttgtattctcgagttgcaaaggtgggaggaaggaggcaacagtgcaatgatggtgaaccagatctaaagaaggatggagatggtggttgcaagttgcaacaccgtgttcgcgcatgtgaacaagggcacgacgacaatgtttgtgtatcgtgtttgcgccgtggtggttgttcgttggtttcagaaagtgtaccagatcgcacaagtagtataaaacggtaa

SEQ ID NO: 59319 - DNA, 222 bp, Glycine max
  Peptide Sequence Number=SeqID_176097
atggaggatgagtcatctgaggccaccatcccagagccatttgatataggagaagaggcagaggagacacagccttctgcaccaatggtaaacctaccctcgcctcagcctgcagcagaccccttcactcctcttctacagatgccagaggacccgactacaccagtcctagctgtggacacttctcctccaactactccagtgcttcagttgacagattag

SEQ ID NO: 59320 - DNA, 262 bp, Glycine max
  Peptide Sequence Number=SeqID_176098
tgctaaagttgatgtctcgctaagcaagctcaatgcgcttagcgagtgtcatccgataagcaaggtatcaacgcgcttaacggataggagaaatctagaaggaaatcgatcacgtaggcacgcgctcaatgcatcatcagctcgcttagcgagtcgtttgtcaccttccaggcttagcgcgagtttggcattgagtggaaattcacttactcgtgctaaccacgacgtcgaggtcaatgagccctttttaagcctggaatag

SEQ ID NO: 59321 - DNA, 819 bp, Glycine max
  Peptide Sequence Number=SeqID_176099
atgactatcccgggatcgccccgccctcacgccaccgactcagcgggcgccgtagcccccgcctcccggcgtctccaccacgaacacgtcgcccggatgcagttgggcgctatcctgcggaccgagttcctcgaccgtgccgtccagcctttcgacatagttgcggcccatcgcgcccggctcgccaccggccaggccgaacggcgcataacggcggttgttggacaggatcgcggcggtcatgtcttccaggaagcggatgcggcgcacgccgccgttgccgcccggatagcgccccgccccgcccgaaccgtggcggatctcgtacgactccagccgcaccgggaagcggaactccagcacttcggggtcgccttcgtcgtggggaccggcggcatcgatgcgcacgggaccggcgccggtgccgcccgaaatggtctcgtagtactggtgacgcgcgttgccgaaggtgaagttgttcatggtgccctggctggcggccagcacgccgagcgcgccgtacagcgcgttgactatgcacatggacgtttcgacgttgcccgccaccaccgaggccggcgggttcgggcgcaccatctagccttctggcaggatgatcgacagcggcatcaggcagccgtcgttcagcgggatgtcgtcgttgaccatggtgcggaacacgtacagcatcgcgaccacggcgatggcgcccggggcgttgaagttgttgtccagttggtccgaggtgccggtgaagtcgaccactgcgctgcgcgcctggttgtccaccctcaccgcgacacggatgactgcgccgtt

SEQ ID NO: 59322 - DNA, 726 bp, Glycine max
  Peptide Sequence Number=SeqID_176100
atgattaaagcgaaaggttttgaacctgttttaggaaaacatttgtataccagattttctaacggatataactatgccgggacagaaaaggaaagattgaaagatataaactgggccttcaatgactccgaaatttctgcgatctgggcctccaggggcggatacgggtgtcagcatcttatccagcacataaaacttacacagtttttaaaagatccaaaatggtatatcggatattcagacaatacagtaatccaaagttatttactgaaaaaaggatttgtatctattcatggccagacaattaaaacttccagtttcggagttacagaagaaagctatgatttagtttttgatattctgaaaggaaaagctccaaaatatggtttacagaccaatcaattgaatagagaaggcaatattgaaggcgaattgattgggggaaatttagctctgatctatgcacttttaggaactccctactcttttgattttaaaggacttattgttggtggaatgaccaatatgggtgatgaaaaagagaataaaaattatgaggaaagtttcgatgaatttgcctataaactaatctcagaaagaatttcaaaatataaatttcctgttatttttggttttccaaacggacatatcaaagacaacagaccattgattatcggtggaaatgtgaaaatgaaagttggaagtaaagttaagatagaattttaa

SEQ ID NO: 59323 - DNA, 192 bp, Glycine max
  Peptide Sequence Number=SeqID_176101
atggggctaagtcatgaagtgctaaaagtgacagttgagcttaactcatcacgcaacagttgtcttcaaccaggctcagtgcacgactggcacgaagctcaaatcctcttactagcactaagcgcgagggcagcactaagcacaacgtcgcaaattcagagcctatttaaagcctgtcttgtgcagaattag

SEQ ID NO: 59324 - DNA, 852 bp, Glycine max
  Peptide Sequence Number=SeqID_176102
atgagcaatatcactagcattaacaacgggtggaataacaaagtgccaaagtttcctaatccccccaaccctatatttcatgcacaagaactccttggcatactgcttctcaacctccctatccacgtcatgaagaaacacgtgcgtcacacccgatctctttctcccacgcgccatcatcgcggtggagtatatgaccgccattctaccgggcgcggccgcaaaataccctcgcggcccatcgatcatgatcacatcccaatcacgatcgtacacctcattaggcaaattgtgcagtgccagcttacacaagcggttacccttgagtgggatggggaagcgctggagggcagagagggtccacttgggatcctcctcgagaaacagcgtggtgccacgtggattgaacgagtcccacataagcgagtcgtggccgagtccgaacacaaggaagttgcatggcgcgagggactgaagcacgtcgaaggatctccggatctcgcccttggtctgctgagggagcacacgcgccgtggcgtagtggaggatggtgacgagggtgagcggggaggtgtcgaactcggcggcgatggcggcctcggagggcgtgaggggaacgacggaggaggaggagacgcagaggtcggcagaggtggtggggtcgaggagggtctggcggaagaggaagaggaggaagatggtggcggcgagggtggcagcgaggagggggaggagacgcgggttggaggtgggagggtgtttcttcctttgggaggagggctggaaggacttgaaaacccacggttgcatggtggtgaatgtgtgttggttgatgtgaaggatgctacttaa

SEQ ID NO: 59325 - DNA, 252 bp, Glycine max
  Peptide Sequence Number=SeqID_176103
atggcgatggaagtggagcagaatcagaatcatcaattagggtttcccttctggaaaccgctccgtcacaggttcgggcccgaatctcctttcttcgctcccggcaacctcgaacgggaacttcttgccaaacagaagaaaagcaacagcttgagaaatggatgcaagaggaagaaggaaggtactgatccttatattgttggtttcatattgtttacaatacgtgagattcaaatcaatgctggtacatga

SEQ ID NO: 59326 - DNA, 402 bp, Glycine max
  Peptide Sequence Number=SeqID_176104
atgacttttggcagagaagaggtggcctgtgatgaggcagagcttggagaagaagaatttacagaaaaaatgctcaatcaacaaaagttacaggaacagcaactagagatgctgaagtacatgcgcaagtttcacttggatgatcaatctgcgatccttgagaagttacaccagcagatggaaaacggaaattatgaaagtgagacatccattttgtcagctgagcagatcgatgagattgtcccaagaaaggtgtcccctttgtatacaccaagctgctgtaaggctaacatttttacgcaatggttggcacttgctgctttttcccggctaggttttcctacttcagtagtcagcacagaacgaccgataagaaaaattacatattacatggtccactaa

SEQ ID NO: 59327 - DNA, 564 bp, Glycine max
  Peptide Sequence Number=SeqID_176105
atgggtcgttctctttgggctccacaagtgtttaactgtggtgcacttgacacaggtaatatggaggtattactacgctatggaaacatagagcaactacaagaatggctaattcctttgcttgaggggacaattaggtttggatttgcaatgacagaaccacatgttgcatcttccgatacaaccaatattgagtgttctatcaaaaggcaaggagattcatatattatcaatgggacaaaatggtggacaggcagtgctatggatccaagatgtagaattcttatagtcatggggaaaactgacttcaacgctgtgaagcataaacaacaatctatgatcttagtggatgtcaagactcctgtcatccacataaagagaccattgatagtgtttggttttgatgatactccgcatgggcatgcagaaagcttcaactttcatgtgttattgcctcctatggcaggaagatctgtgtatggctattgcattagcaggcttatggtccctatttcttgctcttggttattcagcgtgtgtttggcccatatattacactgttag

SEQ ID NO: 59328 - DNA, 255 bp, Glycine max
  Peptide Sequence Number=SeqID_176106
atgagggtttgggagttgtttatgcacggggaaggtggccttgttggtgcttgtgcgcttagcacgaatttggaccgcttagcgtgcatcagtgaatttcggcttagcgtgcgtcttcttgctcagcgggtggactcaagcggtgcgcttagcaggataacagcttgctcagaaaacatgcacagctcatccttcttgcaaattcttccttgcgctcagccaaaggagtgttgcactcagcggatggctcgctga

SEQ ID NO: 59329 - DNA, 522 bp, Glycine max
  Peptide Sequence Number=SeqID_176107
atggtaaagaagttccatgggaagtggaggttgtgcactgactacatagacctaaataaagcttgccctaaggactcgtacccacttacgagtatagatcgcttagtcgatagagcatcaagattccttattctcatctttctagacacgtattctggatacaaccagatctcgatgttcaagcaagatgaggagaaaactgtgttcatgaccaatatggtgaactactactactcagttatgtcattcatccttaagaatgctagagccacttatcagagattgatggaaaaaatattcactaatcaactcaaaaggaacctagaagtctatgttgatgatgtggtgaagtacaacattaggctaaacccaaaaaaatgcatattcagggtacaaggaaggaagttccttggcttcatgcttactcatagaggaattgaggccaacccgaacaagtgcaaaaccattattgcaatgagaagtcctaacactctaaaaagagtgcagagactcattggttga
